United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 4

SEQ ID NO: 12505 - DNA, 375 bp, Glycine max
  Peptide Sequence Number=SeqID_129283
gggacgggtggaaatacccaagtggttatccgtataaacattcttttgctatctggttaccttatggatacccacgcctttcatcaaccaggggcaaacgagctcgttgatgcacagagactaacatcgtctcctgcaccttttgtcgtcctgacctgtgaaggttaccttatagttacccgcgtctttcgtcaaccaggggcaaacgagcccattgacgcaccgagtctaacattgtctcctgcaccttttgtcgtcctgacccgtgaaaccgacgtcgtcttctgcaccttttgtcatccagggacagcgagtaaggtggtaggcggagatgccttatggtcatccgcacctttcgtcaaccgaggggaatga

SEQ ID NO: 12506 - DNA, 705 bp, Glycine max
  Peptide Sequence Number=SeqID_129284
atgatcctgccgcaggcgattatgcatctgctggaaccgctggtctccgcctccgattcgctgccggcgattctgctgtcggtgctgatgtgccagattttctggttcgccggtattcacggctcgcttatcgttaccggcattatgaacccgttctggatggccaacctgtcggcaaaccaggcggcactggcggccggcgcggcgctgccgcacgtttacctgcagggcttctgggatcactatttgctgattggcggcgtcggctcgaccctgccgctggccttcctgctgctgcgtagccgggtcacgcatctgcggactatcggcaaaatgggcatcgtgccaagcttcttcaacatcaacgaaccgattctgttcggcgcgccgatcatcatgaacccaatgatgtttattcccttcgtctgcgtgccgatggtcaacgcggtgctggcttacggcgcaacccgccttggctggttgagccaggtggtgtcgctgacgccgtggacgacgcccgcgccgattggcgcctcgtgggcggctaactggaccttaagcccggtggtgatgtgcgttatctgcatggtgatgtcggcagtgatttatctgccattcctgcgcgcctatgagcgttcattaataaaaaatgaagtcgaaaaggcgaaaagcgttgcatcggtcgccggggccgttagccagtaa

SEQ ID NO: 12507 - DNA, 479 bp, Glycine max
  Peptide Sequence Number=SeqID_129285
ttgtcttcagctaggcacagtgcacgactggcactaagctcaaatccacttacttgcgctaagcgtcagggtggcgctaagcgcaacatcgattccagagcacaccacaatgcttatttcgggaaaagagctctggaggcagcaaaaggagcagcttttgcagagataactaggtgtcgcaacgtgcccttcgcgggcgagcgagggcgaggctcacgggtgcgctttccaaaggaggaaagatgcgcagagtcgccaccaacgtttatttgtggaaaacgtcgggaaaaccgaacgaaaccggtcaaaatgaaaattctaagttcgggagttgtatttacgcttgaggaaggtattagcacctctcacgtcgacaaaagcggggctcttgctcctacgtaccctccatcaaagaggaaatcagacctacgtagttcttctttatgcgtgaatcaagtgattgattttttacttgaggg

SEQ ID NO: 12508 - DNA, 306 bp, Glycine max
  Peptide Sequence Number=SeqID_129286
atgggggtctttccttcagtaacgggagaaatcccttattctaagaaatctcagatttcccatcaaggttcagctgaattcgcaaagaggttcaggctacagtaccctatgaagagattttccactttttgtagagtagggttaccgcgctctctatctagaatcggccatgttagaagtcttaaggaggtggacgcaggattggcttcggtctgtccacaggtactggagtacagcaatggatccctgggtaaccatccaccaactattggatgcccccgtggtgatccgagactaccagattaa

SEQ ID NO: 12509 - DNA, 405 bp, Glycine max
  Peptide Sequence Number=SeqID_129287
atgttgaagaacagtcgagaatcttcgcgtaattactcactgaaacgttacggaagcgcctcggcttggattttcttcacagaaataattttcctcggcaatttcgagagagggagaagtgccaagaaggggaggagcttgccacccagctcgctcaggcgagcaaggttgcttcctccagaaggctggaaggatctggaaggcccaactttcgaaggagttacggaaactcacggattgcgcaaaaacacatcttttcgatttccgccacaccacggaatttcacggattgcgcaagcctgcttccttttgatttctgacacgtctcgggacttcatttattgtgcaacaaaggacgccaagtatctcaaagcggctaaccaaaggttgcacgtcatcaagtaa

SEQ ID NO: 12510 - DNA, 132 bp, Glycine max
  Peptide Sequence Number=SeqID_129288
atgttcaaccctcctgaaaatccaagccgaggcacttccgtaacgtttccatgggtgatttcgcaaagattttcaaccgttcttcgacgttcttcgttcgttcttcgtcgttcttcggtcttcaaccggtaa

SEQ ID NO: 12511 - DNA, 348 bp, Glycine max
  Peptide Sequence Number=SeqID_129289
atggttatgggggatttcatcagcagactctccttccccgcatgtttgcattttagcgaagaaaacaccgagactttttcaagtctcacaagttatccagaactacgtaggtctgagttcctcattggaggatacgtaggagcaagagcctcgcttttgtcgaccataccgccttttgttgccatgactcaagagctggtagtacgcggagataccttacggttattcgcacccttttgtcatccagaggcggcgggcccgatgacaagcagagaccaagtttggtcattctgcacccttgtatcatccagaggcggcgggcccgatgatacgcggagataccttacg

SEQ ID NO: 12512 - DNA, 798 bp, Glycine max
  Peptide Sequence Number=SeqID_129290
atggcgaaatcccagtcaggcagggtgccggaggtgcgcaacaccagccactccagcgcatctgcttgtggtaaggcgcgggaacgcgggccagcattttcgttaccgcaaaatcgccaagcgattccgcaatgctgccggcatcggaaaggcgctgtgggcgcagcaccagacgcgatgtctcgatcacggggcaggggcctggcggcgctatcgcaggggccgcccggcggcggctcagttcgagcgtgctcatcccatgtccccccagctcttcagcgaaacccaggtcttgcggtccagcctgtaccattcgaccggcaccatgccaccgagcgccagcgaaccgaccatgccggagccctggaactggaaaccgcacttctggatgacacggcgcgacgggatgttggtgacccggcaacgggcatcgatctggtcgatctcacgcgtacgaaaggccatgtcgatcagcgcatgcgccgcttcggtcatgtatccccggttccagtagggttcccccagccagtaaccgatctccagcgtcttttcgtcttcctggggttcgagcgcgcagcagcccagaaactcgccattgtccatgcgggtaatcgcatagacgcacttgccaatctcgccagctttggagcgtcgcacaaaatccgcggcgtctttggccgtgtaggggtgcggcatacgcgataccatggtcgcgatattggcattgttggcaagatgggcaagggcgtcgatgtcttcttcgtgaggcttgcgcaaaaccagcctctgcgacagtaa

SEQ ID NO: 12513 - DNA, 996 bp, Glycine max
  Peptide Sequence Number=SeqID_129291
aggagaagaaagcaaaagcgattcccgtagtagcggcgagcgaaatgggagcagcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggggtgaaatgccactcgaacccagagctagctggttctccccgaaatgcgttgaggcgcagcagttgactagacatctaggggtaaagcactgtttcggtgcgggccgcgagagcgacgatggggataagcttcatcgtcgagagggaaacagccggatcacagctaaggccctaaatgaccgctcagtgataaggagcgctcttgcgccgaagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgtaagaccat

SEQ ID NO: 12514 - DNA, 203 bp, Glycine max
  Peptide Sequence Number=SeqID_129292
gttacgaggaaattatcatgaatccaattatttctgctgcttctgttattgctgctgggttggccgtagggcttgcttctattggacctggggttggtcaaggcactgctgcagggcaagctgtagaagggattgcacgacaaccggaggcagagggaaaaatacgagcattagcacttttatttgctaatccttttgtttaa

SEQ ID NO: 12515 - DNA, 153 bp, Glycine max
  Peptide Sequence Number=SeqID_129293
atggctcgtgatcgccattggtggtcgtgggtggtggagaagaaggagatctcgcttagcaagctagtctcgctaagcagaaatccgcttttggcactgagcacggcctctcgcactgagcgaattacttcctcaagtttgaattgcacttag

SEQ ID NO: 12516 - DNA, 180 bp, Glycine max
  Peptide Sequence Number=SeqID_129294
atgaaagatgatgagaagagaaaagtgcaagatgataaaaaagctaaaaacattttaacttctagtttatcttctgatgaattttttagtactgcaaggtgcaaaagtgcaatggaaatatggaaaatgctgatcatgttgcagtcattgtttggaattgaaaggaacatcctgaattaa

SEQ ID NO: 12517 - DNA, 635 bp, Glycine max
  Peptide Sequence Number=SeqID_129295
ttgctttaagtggaattgcttcattactcttgcctggtggtcggaccacacattccaaatttgctataccagtccctgcaacacaaaattcaacatgcaatattcatcaagacagtgagttagctgaattattaaaggttacaaaactaatagtctgggttgaagctccaatgtgtcacaaatttgcatttgaggcactagataaaagccttaaagacatcatgcaaaacaatctgccttttggagggaaaattatcgtttttggtggagatttccgacagatcttgccaattgttccaaaaggagatggaaaaattggacaacataatgacggatttttagaaatcactattccagatgagtttcgtataaaaaattatgatgatcctatccatgctattgttgaagccacctatcccagcttgatagataactatagtgacacaaattacttgcaaaaaagagctgttcttgcctctaaaaaagaaattgttgacaaaataaatgattatgtcctatcacttgtacccaataacgaaaaggagtattgcagcgcagatagtattgataaatcagatgaattgctcaatcctgctttcgcattattgccacctgaatttctgtattcattgtaa

SEQ ID NO: 12518 - DNA, 849 bp, Glycine max
  Peptide Sequence Number=SeqID_129296
agtagcaaaagtggtcaagatctcggcataagtgctagaccgagcgaaacaaaacagaaatggggtgaactattggtgtttgggatcgtcctctttccaaatgtagacgggctagtggatcttgcagcgatcaatacttttcttgcttatcaccacaacaaggaaagcccggtcgttgttgttttggccgatgcctatgacaaatttgactggagatgtaagaagagcaacacgagaattatctgttgcacacccgctctttatgtatggatggtctcccacatttttcatcatgaaagtagactcgtctgtcccttacaaggtcgtcacatgtgtgctgagaaagggaaaacaaattgggaagaactcttggaagggttcccaaatgtccccttgatgggaacaaggggttgcatcaattataatcctatgctggccataagacaactaggctaccctgtgagaagggcgccatcagaagagattatcgtgcttctcatcgcacgggataaggagcttagaggaagcaacaacggtgttatcagggactaccatacatggttgaaggctcggacggaagaagctgaagtccctgaagagagcgaagaagtgcaatccttgaaagcaaaacttgaaagagcgagaggggtcaaggaaaagttcaagatgacagccaccagggtcaggaaagagtgtgacgagttgagggatgtcaacatggccatggccgaagggactcaagctttgaagggccgaaagggacgagtcaaggatggaaagtatgatattagaggacaagttgaaggcttgtcaaaggtcgaagaggagtttaaccgaacaactgagtag

SEQ ID NO: 12519 - DNA, 585 bp, Glycine max
  Peptide Sequence Number=SeqID_129297
atgtggattgtcaaggtgttgtatgatggtgttgttgaaatcctaattcacccattattttcttctcccacctcctcctccttcctcgtttcactttccccgccaccaccacaaagccttcgcgtttggtccctccgacatttcgtttcggaagtcactttcattaacggccccagcctgaccggtctggctctcgtcgactacaatgttcccaaaatggatttttggtttcagtttatgaacacggttagggttagggagaggtcgttgaacttgacctacgtgcatagcaggggcgactataggatcatcatggacggaaccttcgtgtacgattccgcaaacaaggtttctaccaattacacactcaattcagggaattacaagctcaagtacacttatgtccacaagggcttgaccacgttcgcctatgacatggccaagaacatgtgggactttttcatcttgtggaaggtctacagcggcaatgacacattgagggcctcctaccagacatacaacagggttttgggagttgagtggttgaggaatcccaaacataccgctggcttcaaggtggaatga

SEQ ID NO: 12520 - DNA, 1119 bp, Glycine max
  Peptide Sequence Number=SeqID_129298
atggagttgagctttgtagaggacgatggttgggttctctttgagggggatggcggcgagtttggcaatgtcgttgacaagtatgaggttggagtcggggttagtgaggtagttgtgagcgtagttgagaaggaaatcgagggcaaagtggatggaggtggagatgaagccaaagacggcaacatcttcaaaggagtagcggaaggaggtgtagaagatgcgattgagaagggtaaaggaggcttgggaggcaacaatgacgaagtggaagatgacattttcggggcaggaggagtgttgaaggacgaagaggatgacgaccatgaaggaggcttgttgaggaaagattcctggaatatgcttagaaatctatcttctttatctacattgccttggtgtgttattggtaatttgaacaatatccttcctggtactcttattgttgtggaagagtggttagactatgccttgaccactaaggattggctagacttgcatcccgacgtggagctaaagaatactctagcttccatgtcagatcatagtcccatcatcttatacgttgatgctcaaaggcatgatgtgaaggagacagcgcaaggtagttgggatgattcttgtgatgtggagtttactagcaagattaaagaggaggaagtaatggaatacaacaaggagaaggaggttcttactaacaaagcattggctaaaggatggagatatgaacaccaaatttttcactcatctgcttcaagaaattatggagtggtccctaacaaagtgaataccaaaaattcagatgaagacaatctcatattgatgagaccgttttccatagaggagttcaaggaggggcgtgttgtatgtaacaccctatgcaaattacaccagattgagagagatccagaggatgtacatgtatgggattgcacagttgaggatgacttaaaggaattaattggcactacctataccaacaagatgcatatactttttggtagcacatcacttaaaaactccatagttaagcgttcattgatcctgaaagcagtcaaagttgattgtggagttctcagaaaggtctacctacggaaagttctaactggtgaagggttctga

SEQ ID NO: 12521 - DNA, 615 bp, Glycine max
  Peptide Sequence Number=SeqID_129299
atggccaagaaacaaaaccaaccacaagctgctcaagctgcacctgacttaaaaaataaccctccatctacttcatctgagaatagttcccccatatggattaccagacctgcaccaatgactatcttggttgcggaagtcataatgaaagacaaggaacccagagttcatgtcgaacacttcttcgacattgaatctttggagaatgctggtgtcatcaaatcccacctcatgttgtgtggcatccaccactttttcgaggaccccaaggcgaatgtgcctgaactcatccatgagttttggaggatttccaaggtatacatgaacaaaattattggaagatacttcactagaaaggttcttggcataatagtgaagctgattgctgagacgattgctcaagccattggttgctcaaaggatttcttatccaatgcccacaagttcatactataccatctcatcaagggtacttcttttgacttgcctcagattctctttaattgctttgcaactaaagtgataaaggacaagagcattgggaaggacatctaccacaacattgtcctaacaaaggtatttgaggtccatggagtcataaagaagttcttgtag

SEQ ID NO: 12522 - DNA, 1113 bp, Glycine max
  Peptide Sequence Number=SeqID_129300
atggcggaatgtgtggcttctgcattctgtgttaagctgaatgcgcagagaaggcctgttagagagaggggcttctcgggccagattacaagtctcaagtctgttcaaagaaagtattccagaaatggatgtaaatttgttcacttttctatgtggaagacatttgagctgagtgtatttggggccacacacttgaaattcactcctcatcttcaggaatttccattaaagtgcattggtttaggggctttggttgactttaatggtgcaacagcctctgatttggttccagttgttgaccagatgcttttgttgggcagtatatttctcacttatatggctggagtaattcctgttgagaaatcttatgctagttatcaaaagactaattctgataaaaatgtatttcctgaaagctcagacatttctggtagttctgcgaagaaaaattctggttttgagtcaaagtatgtattgaatgtggtgagagaaaaacttttaaattctctaaatgctttagagaacaaggattattctggagacatcatagttcaatctgcaaagagacctttgagtttaagtgctgttgccaggggtccaaagttaaggttgctttgggctgtttttcagcaagttgaggaagaggcaggaattctcttcattttcttcaatattagacccttgagtttaagtgctgttgccagaagtccaaagttaaggctgctttgggttgcttttcagcatgttgaggaagaggcaggaattatctttattttcttcaatactgtcatatgcataatttatgttaatagtttctcttgcatttccagagctgttggtatggatgatctatttggaatgttttctgacattattcagagatcttgtcactctacctgtactgcgtggctggaaaaagaatttttccttcttaagggcaatgccgacaaggaacttgcttctatgatacttgtaaaagtgaaaggagatatcactattgtacagagcattacaaggtctggcaagaaagatttgtatgcagaattactttggtatcttacttttggttctctcagtttatgcaatgaagcagggatgctccaaatcatttga

SEQ ID NO: 12523 - DNA, 801 bp, Glycine max
  Peptide Sequence Number=SeqID_129301
atggctagtgggctcattgagcatgtgccatgtagtcgtagatgcctggctaagactgaagatgtcaaagatccaatggttgtagtggctgatcatttgggttttgaagagaattgcaagagagtggcggaccaggatctcgaactcaagtatatccatttgtttcaaggtgttccaaaacaagatgtcggtcgagcttccttgatctgcaagggtcatcttgatgatacagttggctatatcaacactactcagcattgggtcgtcctgtaccaggtcaattgccttgatgtcgccagggtgtcaaatgagtccatggagttggggagcctcacttgggtaatgtacacatccaggcactcgtttgggtctgtggtaccatcgtacttcttagtagtcaagttgttcgagttggaaggaatagttgcctccataatgctaaggacaaaatggttcttgaactgcgataactacttgcccaaagtgttgaaggacaagggaatagcgtccgagcgtacacttagatttgtggctcggggtaagtcgattgtggttgatttagcctctcctccttcttgtgggatagcatcagtcgattgctccattggtgttgtgtttgtactagttcttgttattttcatgagctcatgggctccatgggagcttgtaggcctaggatcttcttcatcaatggatttctttgcttcttggaagatgaatgatagtggaatggagaaggaagagagagaggagacgccacttcaaggagaagatgagtctagaagaagctcaccatcatag

SEQ ID NO: 12524 - DNA, 606 bp, Glycine max
  Peptide Sequence Number=SeqID_129302
gtcgcagaagacgacgttagtctctgcgtgctatcaggcttttcgtcttacagaatgcaaaaagtttatacggataaccactcgggtatttccggccgtcagcgtgactcaaaagtcagtatgacagatcttgtgagcacggaagataacctaaatctccacgtgtcaacgggcttgtcggccgcgattgctaagggcgcagaagacgacgttagtctctgcgtgctatatggcttttcgtcttacagaaaacaaaaagtttatacggattaccactcgggtatttgcgcccgtcagcgtgactcaaaagtcagtatgacagatcatgtgagcgcggaagataacgtaaatctccacgtacaacaaaaagtttatacgaataaccactcgggtatttccgcccgtcagcgtgactcaaaagtcagtatgacagatcttgtgagcgcggaagataacggcgcagaagacgacgttagtctctgcgtgctatcaggcttttcgtcttacagaatgcaaaaagtttatacggataaccactcgggtatttccgcccgtcagcgtgactcaaaagtcagtatgacaaatcttgtgagcgcgaaagaaaac

SEQ ID NO: 12525 - DNA, 601 bp, Glycine max
  Peptide Sequence Number=SeqID_129303
atgtttttcctatacgaatttggaggcataggaaaaacattcatatggagaacattagcaagttcattgagagcagagaatcaaattgtgattattgttgcttctagcggaataacctctctattagtaccaggaggcagaactgcacattctagatttaaaattcctataccaatttttgaagactcaacatgtaatatccatcaaggcaccgaattagcagaattactgaaccagacaagtctaataatttgggatgaagtagcaatggcccacaaattttgttttgaagcgcttgatcaaagtttaagagatattatcacaaataaatcaaactcaaatcaaatatttggaggcaaagttatagtatttggtggagatttttgtcaaatactaccagtcatcccaagaggaacccgctcagacattgtaaatgcagcaatcaattcatcctatctatgggattcatatgaaatattgaccttgacaaaaaacatgcggttacacagcaatctagaatcagttgatgaacaagaaactgccacatttgctaaatggattctagacattggagatggaattatagatgatgaacatgatg

SEQ ID NO: 12526 - DNA, 258 bp, Glycine max
  Peptide Sequence Number=SeqID_129304
atgggtgccaagtacctcgaagtggtcaaacgagggtcgcatcccaacaacggatggtccccggacgaaattaggcccgcatccaccgctaagcgtagcttcagcgcgctttgcgtgacaagggaatcaggaagagcacaagaattaaggtcgtgcgctaagcgcaagatcagcttactaagcgagacatttgtctcttgccaggctcagtgcacgactggcgctaagcgcgacatcgcgatttcagagcctatctaa

SEQ ID NO: 12527 - DNA, 222 bp, Glycine max
  Peptide Sequence Number=SeqID_129305
atgggaccaatcacgagtagacagtttgatcttgaaggattagttgaaggtttgcctaaggtccaaaagaagcctatctcagcttttatgcgagacgaagaccaacatgttagccatcatcagcaagctagaggaagggtgatcgactcgttacatcaagaggcaacaatgtggatggaccgatttgctcttactttgaacgggagtcaagaacttccctga

SEQ ID NO: 12528 - DNA, 120 bp, Glycine max
  Peptide Sequence Number=SeqID_129306
atggctcaggttgaagcaatcaacacaagaaggaatgaagtagacaaaaaggttttgctggggagatggagctgcttctatatgattggagtattgcttatgctagataaggcaatctga

SEQ ID NO: 12529 - DNA, 1382 bp, Glycine max
  Peptide Sequence Number=SeqID_129307
ccttcagaggactacacatcctacctttcagaggactacacgtcctccccttcagtgggctacacgtcctcattctcagaggactacacgccctcgccttcagagaactacacgtcctccccttcggagagctacacgccatcgccttcaaaggactacacgtcatctccttcattggactacacgtcctccccttcaaagagctacacgtcctcgccttcagaggactactcgtcctcaccttcagaggctacacgtcctccacttcagagacctacacgcccttgccttcaaaggactgcacttcctcccctttagaggattacaagtgctcaccatcaaatggctgcacgcactcgcctttagaggactacacgtcctccccttcagagagctacacggcctcgcattcagaggaatacacatcctcactttcagaggactacacaggactaaacgtcctcgccttcagagcactacacctcctccccttcagagagctacaggctgtcgccttcagaggactgcacgtctttgcctttagaggactacacgtcctcaccttcagaggactacacgtcctccccttcagaggactacacgccctcccctttagaggactacacgtgctcatcttcagagggttggacgccctcgccttcagaggactacacgacctccccttcagaggactacacgtcctcaccttcagaggactacacgtcctcccctttggaggaatacacgtgctcaccttcagagggttggacgccctcgccttcagaggactacacgacctcccctttagaggactacacgtgctcaccttcagagggctacacatccttgccttcagaggactacatgtcctccaattaaaaggactacaggtcgtcgccttcagaggactgcacgtcctcacctttagagggctacacgtcctggccctcagaggacaacacatcctacccttcagaggactacacgtgctcaccatccgagggctacactccctcgccttcagacgactacatgccctccaattaaaaggattacaggtcgtcgctttcagaagactacacgtcctccccttcagagggctacacgtccccgccctcagaggactacacatcctacccttcagaggactagatgtgctcaccatcagagggatacactccctcgctttcagacaacttcatgccctccccttcagccgacaacacgtcctccccttaagagagctattagccctcgccatcaatggactacacgtccttgccttcattggactacacgtcctctcgttcagagagctacatgccctctccttcagaggatactcgtcctcaccatcagaggacaacacgtcctcgccataa

SEQ ID NO: 12530 - DNA, 453 bp, Glycine max
  Peptide Sequence Number=SeqID_129308
atgatttctttatcacaggggagagctatgcagatagggaatcctcttgtcgaattcaacacggatttcaactccagagctgagtttttctggtcccatggactaatatcagattcaacttacgaaatcttcaccaaagtatgcaactattcccaaattaggagacaacatcagggtgggacgcttacccccatttgttccggagtaaataggctagtgtcaacggaagttagtaggtatattgatacatatgatgttacacttgatgtgtgtctttcatcagcagatcaacaggcttatgtgctgaatcaactgactcaactgcaagagggtgccaagatagatgtttgtgtggaagatgaaactatcgcatatttgaataggaaagatgtgcaggaagctctccatgctaagctcgtagggatcacgtcatggtcaacttgcagcgagtaa

SEQ ID NO: 12531 - DNA, 189 bp, Glycine max
  Peptide Sequence Number=SeqID_129309
atgaagagctgcatgatgcgatcaaggaacaagctagagatccaaaagtccacttctagtaacaactcccaagtgtggtttcatgcaacttcattggcttctagagatatcatcctcttaggtaacaacattgtggcagtaggaactaccaacgacaatgcctcaccaaacgaggaaaactctaggtga

SEQ ID NO: 12532 - DNA, 132 bp, Glycine max
  Peptide Sequence Number=SeqID_129310
cgagacggatttggggatgagttcaagtcgggtattaatcatcccatttccaatcccgaacgtctggacgggtctggaacaggcccgcaggtacatcgaaacaagatgtatatttatgcattgacagcttaa

SEQ ID NO: 12533 - DNA, 240 bp, Glycine max
  Peptide Sequence Number=SeqID_129311
atggctccgcctctccctaaaggaacatttttcaatgttggtagcgcacgcgggatcaactactttcgccttgaagagttggatatgagatgtgttacggatatcaacccgggcggcacctgctacggtacctatgcatctagtccaattgctagattggatgctgctcgaaaagccctttttgatttgagagtacttttctcgcctttgagttggcttcacccggccgatagaaagtga

SEQ ID NO: 12534 - DNA, 337 bp, Glycine max
  Peptide Sequence Number=SeqID_129312
tcccagagcctatgagtgccatgcaaacagcactgattcaccagaaagaccgtgacggttatcaacaagacaagacctatcacgtggctacgagctctttccttactcagacagaccccaagcgggcacgattggcgaagcataaggagttgggcgagatgcaagactttttcctcaaggagttagagcagaagttgtttactcacgctcagctcaagccaacttctatcagttcaggcggaaggtcagggggagtggtacaattaggccttcccttcggtaatccgggccctccccctgtctacagctatgctatctctatcactgctaaggtcag

SEQ ID NO: 12535 - DNA, 150 bp, Glycine max
  Peptide Sequence Number=SeqID_129313
atggctcgcgtgaggggaccaaagcttttgatgctccgccagccactccgtaaggtactgatcgaaactccccaggatagattaggaatcgaacaaagcagcgctttccgcttgtcccgggctaggttaaggacgacgacctattggtag

SEQ ID NO: 12536 - DNA, 342 bp, Glycine max
  Peptide Sequence Number=SeqID_129314
atgcgtagatcttctgtaggtgaattggttccattggatttagaaattgaagccacctttagaagaaacaacgcagaaaggaaaagaaagcttttgcacaacataacagtagcatcaatccttgaagaggctcacttttatgagtcatcatcttctaattcacctacatccaaggaatctcaaacaacagaatttgaagccgaagtcatggctgaagagcaacctcgacgagtgaccttggaagattactcaagtacttcagtgccacaatatttctcaagtgctacatggccaaaggttcaggaacaaaacttaacttacccaccttcattgatcagctaa

SEQ ID NO: 12537 - DNA, 132 bp, Glycine max
  Peptide Sequence Number=SeqID_129315
atggttcctggggcttccctggcttctgtaaaatttctgaaaaccttgggaggaagcaactgtgcggtaagctcctccacgtttttgaaaatggtttccggggcttccgttgcttccgtaatgcttccgtaa

SEQ ID NO: 12538 - DNA, 102 bp, Glycine max
  Peptide Sequence Number=SeqID_129316
atggttcgtgcactcacgaatggagaaaggggtggcctctgcgatctggtggattcgctcaactatgctgcaagtgtggctacacttcccactgtgtcttag

SEQ ID NO: 12539 - DNA, 675 bp, Glycine max
  Peptide Sequence Number=SeqID_129317
atggaggaaattaaacagcattccagaatgttcattggcacttgcaaaaggctgaaaattatgaagggttctgatcccattggtttagaaaactgctttgtacccgccggtttccaagttcgtaacgtcttccctgccatcaaggaggcgttgacagtaaatgggatcgaaggtgataacatctacgcgttcgatcatagtacttctttctcaaaacgaaactttaaggaacttcttcgtctcacaagcatccgttacaccaaaactaaagtggctactcaaaagcatgcttctgaggccttccacaaagttgcaagcataacatggaggtggggttggttgaaaggagaagatctctccttaatacatgttaatcatttcgctcctgctcatttccagaaaaagataacattagtcttaaatatagtatttgttagtataattaatagttttttaaaagataaaaaaaaaacttcgtaccccattgcccagaggctcttcgctatgcgaaggtatgggggagggatgttgtacgcagccttacccttgcatatgcaaagaggccgtttccagattcgaacccatgaccaacaagtcaccaaggcacaactttaccgctgcaccagggctcgccctcccgggtctattgcttggaaggcaattatcctaacctag

SEQ ID NO: 12540 - DNA, 291 bp, Glycine max
  Peptide Sequence Number=SeqID_129318
atgtctgacgaagtcaacaacgttttcaagaaatatctcaaccaacttcagcttcatcctctcagaaccaagttttggctggttttagtgatgcagtggcacagaagttatctgggccaagaaacttcagttagaagggtacttcttttcatgctctatggttttgcctactctgggccctttggacattttctccacaaattgatggataaaatatttaagggggagaaaggtaatgacactgttgctaagaaggtgctctcaaccatgggtattttagggatcatttga

SEQ ID NO: 12541 - DNA, 972 bp, Glycine max
  Peptide Sequence Number=SeqID_129319
atggcttcgaagaagctttccacgaagaggtccagaaaggatgccattggagaaagctccagtgctgcctcgggttttgaccggcatcgatttcggagtgccaagcatcagcaatgcttcgaggtcatcaagggatggtcatttcacagagagaggcaggtccagcatagggaggacgagtaccctaatttccaggaagaagtaactcgcaggcgcttggcaccacttgtcacccccatggctaaattcgactcggagatagtcattgaattctatgccaacgcctggcccatcgaggagggggttcaggatatgagctcatgggtgaggggtcagtggatccccttcgatgcaaatgccctcaaccaattcttggaccacccgttgatcttggaggaaggccaacagtgtgaatacggtcagaggaggaaccaggcttccagctttgatgaggaggctattgctcagctattgtgtataccgggcaacatcctgcccagcgaccacaactctgacctccccctgccgaagtgtcagctggtgtatgccatcctgacacggatgagcattcacgtggctcagttgattgctaacgccatctatctgtttgcaggaacaacacctgcgaggcaccctttggacccgaagaagtccaatagggccctggggttcccagctctgatcacgaacctctgctacaaggtcatccaactacctatcaccagagccctcatcgagaagtactgtacccctaggcaggcaggttggagcactatatatgacatgtggccagccagcaggcggccaaccaccggggactggtgcggttgcatgagtattttcacagatacaccctcagccagcaaggccaaggtaggacctgcaaggacccctgaagatgcggatggagcccaggaagatgaggatatggcttacttgctcgacttcctgggcgggagcggagccacatga

SEQ ID NO: 12542 - DNA, 1776 bp, Glycine max
  Peptide Sequence Number=SeqID_129320
atgtcgggcaataaacatgtccctttcccctataagaacagcaatgcggtcccgtggaggtatgcccctccaaagccaagcaaaaggaaggaagagaccaccgacattgactcactgtcagcaaaagtgaccaatatcacctgcctaagcggcgtgacccacagcggtcacattttcgcaccacctgacctaccggcacggcccgtgaatgctaaagggaaagcgaaggtgatcaaagaacaaaccaacaaagcaagccccgtgtcggacgaggatgtttcgatagggaggttcaccaagagaaaggagggtttcagtggaagggaggtatcattggaggagtccaacgagttcctccgcattatccaacagagcgagttcaagattatcgaacaactcaacaagaccccggctagggttttgaacaaggcccatgtggcccaagacatctctgtagaaggctttgaggggattgtcaacaacatcacagccaacaactacctcaccttcgccaaggaggagattcctgccgaaggacgagggcataatagagctctgcatgtatcggtcaaatgcatggaacacatcatggccaaggtgcacatcgacaatggcttgagtctaaacgtaatgcccaaaagcacattggaaaaactgtcattcgatgcctctcacctgaggccaagctctatggtggtctgggcttttgatggcggtcgctgggaaatagggccccacacctaccaggttacctttcaagtgacggatattaacccagcctatagttgcttgttgggccgaccatggattcactcggtgggagttgtcccctcaatattccaccaaaaactgaaattcgtggtggaagggcatttgatcattgtttcgggggaagaagatgttctggtgagctgcccctcctctatgccatatgtggaagccacggaagagtcattggaaacgattttccagtcctttgaggtggtaagcaatgcttccataaaatccctcccaatgcagctccgcatgtttggcacgacaatgatggtggtctgggtaatgttagtgcatgactatgagcccggaatgggtttgggcaagaataatgatggcatggccggcgtagtagacatcaagggaaaccacgagagattcaggttaggctataaacccacacaggctgatgtgaggaaaaacatcttggaaaggaggaacaagggtcagggctcgcagccaagaccacaagcaagagaggtcccaccttgccacatcagtagaagcttcgtgagcatgggcttaagacacgaagagcaagtcaccgcgatattcgacgaagcccctcaaaggcggttgggcttggtgcaaccatgccttcccgatttccagctagggaactggcaagtggtggaacgacttgaagtttacatgacgaatataatatccgacaacgagtcctgtgaaggtactaatactgaggacccagccatcaattttgagcgagaagcaagtcgagcagaggatgaggaagaagaagatatagggtttttctcaaagctagaaaggataatcgctcaggaagaccaagagatgaagtcacaccaagaagaaacagagatcttaaacctaggtgttggcgatggaaagaaagaaataaaggtgggtacgggtatgaccacacctatctgtgaggaattagtggctctactatgggactaccaagacgtctttgcttggtcctacgaagatatgcctggtttgagccgcgacattgtgtaa

SEQ ID NO: 12543 - DNA, 426 bp, Glycine max
  Peptide Sequence Number=SeqID_129321
atgcggggttaccgtatggttaccagcacctttcgtcaaccaggggcaaacgagcccgttgacgtgcagagactagcatcttcttctgcaccttttgtcgtcctgacccgtaaagttttactctcgtcgttcggaaacattcaagcccggcgatgcgcgaggttcttctctgctgggcagggacgatcgagtgcaatggcgaagggaagtgtcgtagttgtccaactttgtcgctttcaagacactgaagggaagctgtcataccctaatttcgtccggggaccattgtttggtggcatgcaaccttcgcttgaccgctttgaggggtgtgcaaatagcaaccaagcccacttgggccttctagggggttccaacagaaggcggtgccttctggtggaagcaacccagctcgcctgggcgagctag

SEQ ID NO: 12544 - DNA, 132 bp, Glycine max
  Peptide Sequence Number=SeqID_129322
atgccgaggcgcttctgtaacgtttccataacgttttcgtgggtgatttcgtgtagattttcaaccgtttttcaacgttcttcgttcgttcttcatcgttcttcagtcttcaaccgatttctaaaggcctaa

SEQ ID NO: 12545 - DNA, 224 bp, Glycine max
  Peptide Sequence Number=SeqID_129323
atggacaatgggaaccttattgttagtgatgaagtaaatcatcaagtgaagattctgtggcagagttttgctaatcaaatagatacatttcttcccggcatgaaaatggatgacaatttagcactaacttcatggagaagttacgaagatcctgcaccggggaacttctcttttgagcatgatcaagaggagaacaagtatataatatggaagaggtccatcag

SEQ ID NO: 12546 - DNA, 1521 bp, Glycine max
  Peptide Sequence Number=SeqID_129324
atgccaaccatagaagacgagctagagcgaagatcattgctctacagcctcttgatgccagtgatggaccaattcgtaccaggtttagacaaaggcaaaggaatgtactttttgttcataaaatcagaatccaaaacccctggtggactcttagctcgtccagttttaacaagttactacaaaagctcacacttcaagaacaaaacacacggtttaaattttgacccttacacaaactacactagccccattgagaccattctctgtcaagactcttaccaaagcatgtactctcaaatgctttgtggactttctcaaaacgagcatgttctccgtgttggttctgtttttgcctcaggtttcatccgtgccctcaagttcttagaaaaacactgggaaagtttgtgtcatgacataagaaatggcaccattgaccatgaaatcactgattcaaccgtgagagaggccatcatgaaaatactcaaaccaaacccaaaacttgcggattttatagagggtgagtgcaagaagggtttgtggaaagggatcattactaggttgtggcctaataccaagtatgttgatgttattgtgactggaaccatggctcagtatattcctatgttggattactatagcaatggtcttcctctcgtttgcaccatgtatgcttcttctgagtgttattttggactcaacttgaaccctttgtgtgatcctagtgaggtgtcttacacccttgttcccaccatggcttactttgagttcttgccacttaataagatgaagggacatgccaattcaatttctcacaccgagcaggaacttttggttgatcttgtggatgtggagctggatcaagaatatgagcttgtggtcaccacttatgcagcttctaacaattatgtcatcatgcacaatccacacacaggactctacaggtaccgggttggcgacatcctccgtgtggcaggattcaagaacaacgctcctcaattcaacttcgtgtgccgaaagaacgttgttctgagcattgattccgacaagaccgacgaggttgagctacaaaacgcagtgaagaatggagccaagcaccttgcaacattgggtgcatcactcacagaatacacaagctgcgctgacacgtccactataccaggccactacgtactatactgggaaattaacatgaacaataatgatcaaaccccaattccaagttctgtttttgaggagtgttgctttgcagttgaagggtctctcaacagcgtgtatagacaaggaagagtttccgagtccattgggccattggaaatcaagattgtggagaacggaacttttgataagcttatggactttgcccttagccagggtgcgtctataaatcagtataagacacctcgttgtgtgaagtatgctcccattgttgagcttcttgactccaagactgtttccaattacttcagtccaaaatgtccacagtgggttcctggtcacaagaagtggtgcatgtacccttga

SEQ ID NO: 12547 - DNA, 591 bp, Glycine max
  Peptide Sequence Number=SeqID_129325
atggatttcataacccaagttctctctattcgtgataagtattcagatattagggttctttgttttcgggcacgtttgagtttttcgcggttgaatagtttgatccgtagggctattaggcacaacgttagggaacttgatatagaagcttccacagtttgtacagatgattacttcaactttcctagatgtgttatttggagtgaaactcttagggttttgaagctaaaatcagggtttcgtttgcctccttcatcgattctatcaaataatcacctccttattcagccattttataatcttaaacatttagagctgcatactggtttcaacagaagtaatgtgcctggattgatactcttattcaagagctctcgcactctcaacactctgattctcaagatcattcacgaatacaggattgaaagaaaagaatggaatagagacttatggggcatgactatcactgagggagagaagtctgaaagagtcttttctacaacacttggaagtgctgcaaaattcatggttttcttggttatgagaatgttgcacttgcaaagtttctcccaaagcatgggaaggccttag

SEQ ID NO: 12548 - DNA, 327 bp, Glycine max
  Peptide Sequence Number=SeqID_129326
atgaagctttacgagtttgtaatcatatttggatgcttcatgctgattttggctcaaatcccatctttccactcattgaggcacattaatctagtttccttggttctctgcttagcctatagtgccggtgctactattggttccatatacattggtaaattaaattctcaatctccttttcaattcttttggagagtcatcaaaaggaccagaaaaggatattctttgaaaggtgattcaatgaatcgcttatttggaatcttcaatgtaatagctatcattgccacaacttatggaaatggaatcattccagcaattcaggtctga

SEQ ID NO: 12549 - DNA, 394 bp, Glycine max
  Peptide Sequence Number=SeqID_129327
ttctatccgaggacccgctgtggcatttaatgtatttgactggaaaggggagaaatgtgatcctgcacttgtgcagaagcttgctgataggaacaacatctctttagggagctcatatttgagaaatataaggttctctgacaagaatgaagaggagagacattgggcctcagaaacaacaagaggttgttctgaggttgaaggattgggcctgtccaagaaaaagacacgtagccatgagcctgggatttttgttgtcactgctgcactgggcctcttgacaaacttcgaagatatctacagattatgggcttttctttctaggttcctggatgctgactttgtggagaaagagaggtggagatacatggctcttaaccaaaagactattgaa

SEQ ID NO: 12550 - DNA, 380 bp, Glycine max
  Peptide Sequence Number=SeqID_129328
tgacaactctgaacattgagttagagcaactcattgtcaaaacttcctttctccatggaagactggaagaagacattttggtgaaacaacctaaaggtgttgaggtggaaggaaaggaaaattatgtttgtagatggaagtggtatctttataggctgaaacaatcaccaagtctttatgacttatgtgtttatcataacaaggtggaggatgactcccacatctatctattgctctatgtagaccatgtgctcatagcatctcaaattttgttggcaattcagaagctgaagtcactactcagtagtgaatttgagatgaaggacataggagtcgctgaaaagattttaggcatggagatcaagagtgatcgagtctag

SEQ ID NO: 12551 - DNA, 606 bp, Glycine max
  Peptide Sequence Number=SeqID_129329
gacagagagcttaggggaagcagtaatgggatcatcggcggctatcataagtggctgagagtccgaacacaaggattggattggctcccaaatctaaagactgtgagagacgatgaggttaaagcttcggaagaaagtgatgaggtacaagccctaaaggcagagcttgaaagagcccgggtagtcgaagagaagttcaaggcagcaatagtgagctcaagctccgaagaggtgaaaggaatcatcatgggtcaaaggcatgatcttgaaggacgagctaaagggaatatgtgggccatcatcgataagtgcaaagagaagctaaatctagcggcgactcacgagcaaaggctaaaggatgagtacgccaagatatcagcagaaagggaggcaagggaaagggtaattgattcattgcaccaagaggcaacaatgtggacgaaccgatttgctcttactttgaacaggagtcaagaacttcccccattgctagccaaggccaaagcagtggcggacacctactccgcccccgaggagatccacggacttctcagctattttcagcatatgatagacttaatggaccatatgattagaaaccgctag

SEQ ID NO: 12552 - DNA, 1161 bp, Glycine max
  Peptide Sequence Number=SeqID_129330
atgcccgatcaggagacaagacgcatcgcacatatcgatatggatgcttttttcgcatcctgtgagttgtctcgctacccggagttgaaaggcttgcccatggtagtggcgggtcgggcctcgcatgcccccaggctcaaggaagatggtacacgtgagttttcacgcttgcgggactatgctggccgtggcgtattgactactgccacctatgaagcacgagcgctcggcctgaattcggccatgcccaccatgcacgctgctaggctcgctcccgatgcaatcttgctaccggtgaactttgaactgtatcgccattactcacgcttgttcaaagaggccatacgcagcatcagcccgctggtggaaaatatcggtatcgatgaagtatacgctgatgtctctgccctgacaggcgatgccaccgagatcgcacaacggttgaaatctgccgtctttgaggccaccagcctgacctgttcagtcggcatcgcgccgaacaagctattggcaaagctttgctccgagatgcaaaaaccagatggcatcacagtgatcaccatggcagacctagccaaacgcatctggccgatgcctgctaacaagataaatggcataggccccaaagccagcgccaaacttgagtcactcaacatacacaccataggtgaaatcgccgccatgaacgaagcctggctggtgcagcattttggcaacagttatggccgatggttatatcgcgtttcccacgggcaggacgagaggccggtaatcacggaaagtgccccagtctctatgagcagggagaccacttttgaacgcaacctgcatccactacgtgacaaaccggagttaagccaggcgtttacccagctctgtgagcgcgtcgccagcgatttgcagcacaaaggctacatttgccgcaagatcggtattaaattgcgcttcgacgattttaaaaccgtcacgcgtgacctgaccctgcctgcaccaatcagcgatgcaaaatcgttgcggcaagccgctggcaaatgcctgaaaaggatagacttgagcaaacatatacgattgctcggtgttaaagctagcggcctgacgcgtgctgatagtccagccaatactggcaccggacagtttgaactggatttcaactttgattaa

SEQ ID NO: 12553 - DNA, 603 bp, Glycine max
  Peptide Sequence Number=SeqID_129331
gtcgactctagaggatcccacaatacgtcattatggggaagtgccaatgaagaagatgtgcaaagcgcgatcgatttagactatccagcaggcgtggtcctgccatccaaagtctatgatgatgaagcggatactgaattgaggattgcgtttgactttgatggcgtgattgcggacgatgaggcagaagctgtattcaaaatgaataatgatctgggcgagtttgaagctcatgaggtcgaaaagcaatctatcccgcatcaagccgggcctttggctgacctgtttaagaagctatcttttatgcagcagctggaagaaaaactgctcaaagaaaatcccagttataaaaaaatactcagaattgccattattactgccagaaatgcgccctcacatgaaagagtcgtcacgaccctaaaagagtggggcgtttctgcagatgagtcattttttctgggcgggatggaaaaggccagaattttggcggtattaaaaccacatatgttctttgatgatcaaagaagccatttgcagtcttctgcgggcgatatcccgatggtgcatattccattcgggatcgcgaacaaaaagattaagtaa

SEQ ID NO: 12554 - DNA, 589 bp, Glycine max
  Peptide Sequence Number=SeqID_129332
atgttggagattggattgacttttggtcgtcctcttgttctaggtatactagaagttgtatccaatccttggaggtttatactagtaaactggttctatgatgcagatctagttaatcctactaggattgatcgggttcttactaacaaagaccttcttgccgattcgtatccagatcttgaggcttttaatctagatgaaaaagaatttctcctattgaaggttatttctaccttaccggagttatcttgcttaatttgttctatggttggagcgggtctagggactgacaatgtggccttgtccatgacccatttcccgaaaagagttgcctcatcccattttatggttcttgggagagaaacattggcctttgtcatatcagtgataaacaaagttgtctctcctctttgtgaccatgtgtcataccctaatttcgtctggggatcattgtttgtcagcatgcaaccttcatttgaccacctcaaaatgtttaaccaccatcgttgtggaatccataaagttccaagatgtttcgggaagaaaccggtcaaaaacacgaaaatggaagtgtatttagcaaagtggg

SEQ ID NO: 12555 - DNA, 546 bp, Glycine max
  misc_feature (79)..(79): n is a, c, g, or t
  Peptide Sequence Number=SeqID_129333
atgctcagggctttggctagtagtggaatcgtcttagcttcttttagtcatgatttaagcaaattaaacgacatgttgnccgtaagaacagatcgtttaaaaaaacttcttgtaagtaaaattcaggaagatgattataatgacatagaagatagaaacaacccctttaaactgattgaacgtataaaaattcaagatgtgaaaatacagaattggttgaatttttctcttgatataactgagcctgaaaaagtctttgagccattatttacaacaagaagaaatcagtacacaggtgaagaagaaggaacgggattaggaatgtggttaataaaatcaatagttaatgagaatgatgggacattggggtataatgttccttataatggtgttgagttagttgaagaatttttgacaataagatataaattccctagctttgttttaactgcgaaggaccaagatgctgttagtgatagtgaggatgtaaatttggtttacacaaaaagtttaatgactacagagattgctgatacaaaagccaaa

SEQ ID NO: 12556 - DNA, 174 bp, Glycine max
  Peptide Sequence Number=SeqID_129334
atggctggaaaagctgagatcaatgaactagttcacagttgcagagatgcacatggcagggttgttgtcggcttgagaatggataaaagcatatctgacaaggattcgggagctcttgaagaaggttttgatttttgcttgcctgaggttttgattcatgggaggttcttctga

SEQ ID NO: 12557 - DNA, 277 bp, Glycine max
  Peptide Sequence Number=SeqID_129335
atgacccgtggcttggaggcaatagaggtcaattggttttccattggagaacaaaggtttaacactaattcgacttacggtgttggacgccggttacagtgcaaagcaaggaaccattcggctagcctctggcttgcttgggcccccaaattacttcagggtgaaggaaccagctcgctttggcgagctctagctcgcccgggtgagctgccattgcccccaagtgcccattttcctataaataggggtgttagggaggctaaggagaggttccaag

SEQ ID NO: 12558 - DNA, 252 bp, Glycine max
  Peptide Sequence Number=SeqID_129336
atggagttgtttcagactaactacgggatttctttgaatgatagtaatggcaatagtaacaaacaagcttgtgatattagtaacaacaataatgatatggtaataataataatgaagattatttttgttctcactaatgaaaatttcatatccatcgttggtggtggtagacctaatggtgatattagtaatgatgatggtatcaatggctataatgttgttcatggtatcaatgatatgaagttgatatga

SEQ ID NO: 12559 - DNA, 2160 bp, Glycine max
  Peptide Sequence Number=SeqID_129337
atgtattatttaagattgaccttgcttttggggcctccaagatcaggaaaaactacactgctgcaagcacttgcggggaaactggatagggatttaagggtatccggaagagtcacttactgtggtcatgaattatcagaatttgttcctcaaagaacatgtgcttatattagtcagcataatcttcatcatggagagatgacagtccgagagacgttggacttttctggacgctgcttgggagttggaacaaggcatgaactactactagaactgataaagagagaaaagcaatcaggactcaaaccagatccagagatagatgctttcatgaaagccacagcagtggaaggtcaagaaacaagtctcattacagattatgttctcaaggttcttggattggaaatatgtgctgatactttggtaggagatgagatgaggagaggaatatctggtggagaaaaaaagaggttaactactggtgagatgttggtaggacctgcaaaagttttcttaatggatgagatttcaactggtttggatagttccacaaccttccaaattgtcaagttcttgaggcagctagtgcatgtcatggatgttacaatgataatctctcttttacagcctgcaccagaaacatatgacctttttgatgacatcatcttgctttcagaaggccacattatctaccaaggtccacgtgagaatgttctcaatttttttgagagtgtaggcttcaaatgccccgaaaggaaaggagttgcagacttcttacaggaggttacttccagaaaggagcaagagcagtactggttcgcaagggacaaaccataccgttatgtcagcgtgcccgagtttgtagctcacttcaacaattttggcattggccaacaactttcccaagatcttcaggttccttatgaccgtgccgaaactcatcctgctgcattggttaaagataaatatgggatctcaaaactagaactctttaaggcatgctttgcaagagagtggctactgatgaagcgcagtgctttcgtatacatatttaagactactcagattatgataatgtctttgattaccatgacagtgttttttaggacagaaatgagaagtggtcaccttgaagatgggagaaaatattatggtgcactgttctttagcctcactaatataatgttcaatggaatggctgagctttcattgactatttttagacttcccgttttcttcaagcagagagattcattattttttccagcatgggcttttgcaattcccatatggatctttcgaattcctctctcttttgtggagtcaggattatgggttgtccttacttattacacagtagggtatgctccagctccaagtagattttttcgtcagttattagcattcttctgctctcatcaaatgggtatgtctctgttccgattcattgctgctcttggaagaacactagttgtggcaaacacatttggtttctttgtactgctacttgtttatgtgcttggtgggttcattattgccaaagataaccttgagccttggatgaaatggggctattatatttctcctatgatgtacggtcagaacgccattgccatcaatgaatttctcgacgagagatggagcgctcccaacacggaccatagaattcctgagcccacagttgggaaggctcttctcaggattagaagcatgtttactgaagactattggtactggatttctattggtgctctactaggcttttctctgcttttcaacatttgctttataattgctcttacatttctgaatccatatggagattctaaatctattattctggaggaggagaatgagaaaaagggaactacagaagacagttctgcttcaactgataaatcatttgaaaacattgatatggcagaaaaaaacacccgagagagttcaattcccaaagcaggcactgcaacaaccaagaggggaatggtgttacccttcaagcctctatcacttgcttttgatcacgtgaattactacgtcaatatgccaactgtaaattctacacactctagtcctaatttaaccaccttcaaatgttacttcagcattgtttttcgctgctttcttttcttacctgtgataagtatctctgttgattaa

SEQ ID NO: 12560 - DNA, 594 bp, Glycine max
  Peptide Sequence Number=SeqID_129338
atggaggaaggggtggatgcagatgaagtggtgaggtcagtgagcagcttgaggatgagcatagggtctatgagcaggaggagttgggtttcagcaagtgtttctgagatgtggggtgctggacatggtggagatgtttttgaaagaagcactagagtggatgatggtgataatgatgaagaggagctcatgtgggctgccatagagaggcttccaacatttgagaggcttaggaaaagcatagtcaaaagggctttggaagagagtggaaggttcaattatgaagaggttgatatatccaatcttggttttcaggacaagaagaaactccttcatgccattctaaggaaggttgaagttgacaatgaaacatttctccgtaggataagggagaggattgatagagtcgctatagagattccaaaagttgaagtccgatttgagcatttgtttgtggaaggagatgcatttaatggaaccagagcactgccaaccttagtgaactccaccatgaatgcgatagaggtcctccagtgggacccactgcaacccaacaactgtgttgttgtagcagctgcctacaatgacacttaa

SEQ ID NO: 12561 - DNA, 771 bp, Glycine max
  Peptide Sequence Number=SeqID_129339
atgcctcctcatctgaaaccaaaattgtaccctgatttcatggggaaagagcggcaccagtcttacaggtcgaagaaaatcctgggtagactttaccggcgtatcaaagatgcttatgatgaagatattgatgctccctatttgaactttgtgactggcgatataccgtatgataaagatcttgaagttccaggatctgctgattttattgctgatgcgtgggagcaaaaatgctcatatgatggccaattgagtgggctacttggacaatacaaagtgaaaagagaagaggaagttgttactggacagatttggtctatgccaaaatacaacagtaggaagcaaggggagcttaaagagaggctgaagcactcttacagtgccctgaaaaaagaatttaggcacacttttgagaaattgaattcagatgttggagaattaagcgaggaagaaaaaaatttgttctatgagcagaaagcttcggcctggtatcaggtgacatatcatcctgagtgggtgaaaaaatcccttgatctgcaagataaatcctcagagaaccaagaggctgatagtttgggaagtacggtgatgttgagttttccttggattgcagttgattacctagctcgcacaaagataaggcaacgacatcagagatgtggaaattttgactcaactaagccagttgattctctggcaaagtatctatctgaaaggtttgttcccaagccaggaaatgcctctggttttgaggcttacgactgtatctag

SEQ ID NO: 12562 - DNA, 1344 bp, Glycine max
  Peptide Sequence Number=SeqID_129340
atgtttgtcgaggaagttatgaaccttgttgagctacatccagtgagagattttcaagtaggccttcctggaatagatggtttatcaactgaacaaagaaagagactcaccattgcagtagaattggttgccaatccttctatcatctttatggatgagccaacctccggccttgacgctagagctgcagcaattgttatgcgtgctgttagaaatacagcggatacagggagaactattgtctgcacaattcatcaaccaagcattgacatatttgaatcttttgatgaggctttcccggaagttcctagaatcaaagatggttataatcctgccacatgggttttggagatcagtactccagcagttgagagtcagcttagagtagactttgcagaattctacacaaaatcagaattgaggaatcaagaacttattaaagagctaagcacacctttagagggaacaaaggaccttgatttccctactaaatactccctttcctttatcactcaatgtatagcttgcttctggaaacagcacttgtcctactggaggaatccacagtataatggcatccggttattcatggcaatatctataggtgttatttttggactcattttctggaaaaaaggaaaccaaacagatacggagcaagatcttatgaatttaatgggagctatttttgctgctgttttctttcttggaggctccaacacttccactgttcaacccatagttgcaattgaaagaacagtcttctaccgtgaaagagcagctggaatgtactcagctctaccttatgcaattgctcaggtggcaatagaatgtatttatgttgcaatccagacatttaccttcagtcttatccttttctcaatgatggggttcctttggcgagttgacaagttcttgtggttctacttcttcatgttcatttcatttgtctacttcacactttatggcatgatgactgcggctctgacaccaaatcctcaaattgctgcaattgttatggccttctttctagtgttttggaacgtattctcaggtttcattatcccaaaatcgcaaattccaatatggtggaggtggttttactgggtgtgtccaactgcctggagtgtatatggcctagtgacatcccaggtgggtgacaaagatactcctattctggtacctggatcagaaccaatgacagtgaaagcattccttgaggaagagttcggctatgaatatggcttcctcggagttgttgctgtggctcatattgcatttgttgcattgtttctttttgtttttgcatatggtatcaaagtctttaatttccagaagagataa

SEQ ID NO: 12563 - DNA, 3039 bp, Glycine max
  Peptide Sequence Number=SeqID_129341
atgcaatataataggcggcgcgaggaagagcacggtgtaccgcaccgattcgaatcggaacccgacccatttcggagaaaccgacgagatgggtcggattcggcacggcagaggaaggtgagccctctgaaggtggatggggtgagaagggttggtggtggtgggaacaaagggggttctgatgggtttgaagggagggactatgattggcagcatgtgggtggtggtagaaggagtgctagggttcggtcaaggtcacctcctgctgaaccagtgaggaaaaggtcacattttgatgatggggttggccataatagaagttgctcaccaccacaaccaccaccaccaggcttgagagcaagatatgagttgtcaaaaaccacggattactctgttgatgatggaaacttggatggaaagcgtgtataccttgatagagagcaggacttggttgagggcaggttgggtggtatggtggatcagaagtttgtggtacgtgaaaatgaacttggaggatcgtatggatataggtctattccaccggatatggatgtaagtgtgacaacacggtacaaagaagctggtgagcacttgcctctactgccaaggggtgtgccggcgggtagatttgagcatgggcgactacatcacagagatggtccacctatggacaagatgcccatcacagaatcacacagtagggcggaaaaaactatagttcatgctagggatgtttcgtattctgctgtatctccctcttacgcaaaagattttgcaggcccttctcacatgagggattatggagactcctccatagaaatgtcaaggggtgattttctatgttcacatggtgatggcatctgtttacctgcatcttatgatctatcaaggaacagcaggaaacttgcagaacctgtagggtttagtgggcatgggcaaagggcaattatagacactgctagaggtcctgaaattgggctaaggaatatggcatgtcaccaacgatgtgagtttagtcctaccaggactgagcatgaggattatcttaatcacaaattacaggtaagagcagcacaggatgagttattatatcagtatgatgatttacctagaaggatagctcctcatggccgattggactatgagcaatctgtaacagaatatgataatagggaattttccagaccttgtattccacatccagatttagatagaactggtaagagtgaagattcttatggcaatcaaagaagggttattgtacatgatcaccctgcattgcagaagccaaagtattttgactatcatgatgtgagaagaacatcaattgcatcgatgcaaggtgaggcttatttgcgatctggatataagcatcttgaaaatgggaagagtattccacaagactatgaagtttcacatatgggtgcacctgaggctgatcgattaccaattttaagaacagaatatgaatctcgaagagatagaggtcctgggctccagcaagaaagatttcaaagtccacctttgtctaaacataattcagaaacctacagacaaggtgtcaaggtgcaggaaatgagacaggatcttggtattcatgatcattcagatagacttatgaaaagaaaatacaatccaaatgatgaaatagatgttcatgatttgagaacaataaaatcaagtaaatggggtgcaactgaagaatttcaagatgcatatgaatgtgaagagtgggtagatgaccgagatatggatatgttgtattcatctggtaatgttgaatttaaccctaagatatacaggaagtataagaaagaatatgacgagttggagaatgaagaagattttccatctgatgagtgggttatacctcaaggttctatgggacatgtacaaaggcattcatttcaatttcggaagtattccaatcaaaatataaagcatcactcaaagtctagttcttcaaactggtataaatcccagcatttttctaagagaaatgcaattcaaaagcagcctaaagtttggaaaaagtatcatggatatgatgagaataagcatgcagctaatgatgaatcatctgaagattggataagtgctgcagaatctgagccaactgagggctctgaggaatttaatcaaatggtacatgaaaatttcttaatgtactccaagaagttgaatctgaacttatatgtgcaaagaaggtacgaggaccagggaaaagcgggtagtttgtactgcatcgtatgtggcagaagattcccgagaaattgcagattagttatgcttaggaagaaagggaagacagctatgatacctgagacaggaaaatttatgtggcttctgatcttcaaaggctcgtcgaaagaattcatggacactcaacgcctagtaactcatgcttttatgtcccataaggccgggttgagagcaaagcacttgggtcttcacaaagcagtttgtgttctgatgggatgggatactgttgttcctcaagatacagtaacttgggttccccaggtcttgcctcaggcagaggctttggctcaaaaggaggatttgattctttggcctcctattgttatcatccataacatatcgatgtctgatgacaatccacaaaactggaaggttgtaagcatggaaacaattgagggatttctaagaggcaaaggttttgtgagaggaagaatcaaattatgcttagggaagcctgcagatcaaagtgttgtattggtgaaattccttggcacgtttggtgggctgggagatgcagagaggcttcataaatatctttctgataataatcacggtagagctgaatatgagagagtaaagtctgaaggtattaaaagctgtaacattagcgagacagatgagggagacaaagtggagaatattctttatggctatgtgggaattgcggaggacttggacaaactagatttcaatagtaagaaatggagtatggtaaagagtaggaaggagattgatgacctggataaagctcctgttaaaaccgatgagaagcgatag

SEQ ID NO: 12564 - DNA, 1111 bp, Glycine max
  Peptide Sequence Number=SeqID_129342
tggtcattccgctgttaacatcgggaaatccgaaggttgtcgtgttcggaggactcgtggataaaaagtttctcagcgatatggctgtctatgatattgaggccaaacaatggtttcagcctgagtgcactggaagtggttcagatgggcatgtgggtcctagctctcgggctttccatgttgccgttgccattgattgtcatatgttcatttttggtggtcgccttgggagtcaaaggttgggggacttttgggttttggatactgatatatggcaatggtctgaactaactggcttcggtgacttgccttcaccacgagattttgctgcagcttcagcagttggaaaccgtaaaattgttatgtatggtggatgggatggaaaaaagtggttatctgatgtttatgtcttggatacaatatccctcgagtggatggagctctcagtttctggaacattgccgcaccctagatgtgggcatactgccacaatggtcgaaaaacggttacttgtttatggtggaagaggaggaggtggaccaattatgggcgatttatgggcgttgaagggcctcattgaagaagcacagtggaagcggctctccataggcaatgaaccccctcctgctagagcataccactctatgtcaattattggttcacggtatctgctaattggtggttttgatgggaaatcaacttatggtgatccctggtggttagtccctcaagaggacccaattgcaagtagattaactgcatctccacccagaaatattcctgaaagtaaggatgttacctcacttaatgatgattttcaacctcagttcaaggaaagccaaacagagaaatttcctttctctgaattgcaaagacgattgcaaatatcagtttcggaatccaattctaggcttcatattgtaaatgagttggaagataaagagcttcttgagttagcatcaagattagcaggtgaaaatgtttctacaaattcactggcaattgaagcacttcgtgaacactggagaaagtctgaatcgaatatggttaaactcaaagagcttggaccgttgcttcgggattaccaacgtctaatatacaggcaatatct

SEQ ID NO: 12565 - DNA, 267 bp, Glycine max
  Peptide Sequence Number=SeqID_129343
atggttttaaattgcggttgtggtcgcggttgtggtgtaacaaaccaggaaaagaaagttattagtaattatggatttatgattctggaaaaaggtcggccatacaactgtggaggttttgcttttataccagaaactaagccctttaaggttacatgctttcctgcctacatctcttatgaattccccattgcaatcattaaactacaacttcctaaacacaacgtactatcaagcaagttacaagaacataactaccaaatgtaa

SEQ ID NO: 12566 - DNA, 594 bp, Glycine max
  Peptide Sequence Number=SeqID_129344
atgacgaaagacaacgattggtacctcaaagccttacactggggcaatgagggggcaccgtgcatgagcctcaatacccttaccttcagaggactatacgtcctcacctttagaggactacatgtccttcccttcggagggctacacgctctcgtctttagaggactacacgtcctcaccatcagagggctgcacgccctcaccttcagaggactacacgtcctcgccatcagagggatgcacatcctcatctttagaggaccaaacatcctcatcttcagaggactacacgtcctcaccttcatagggctacacgccctcaccttcatagggctacacgtcctcaccttcatagggctacacgccctcaccttcatagggctgcatgtcctcaccttcatagggctacacgccctcaccttcagagggctgcacgtcctctccttcagaggactacacgtcctccacttcagaggactacacatcctccatttcagaggactacacgtcctcgcctttagagggctacacgctctcgccttcagtgggctccacatccgcaccttaagtgaatttaaggtcctcttcccttaa

SEQ ID NO: 12567 - DNA, 459 bp, Glycine max
  Peptide Sequence Number=SeqID_129345
atgatgggaagaaagaggacaccctcgcttttggttgaaactctacgtgccaggcttacccaaatgcccctactctctcttcatggaactgcatgcaatgcttgtaggcagattatgccttctgtgccaatagtgaatcaatttcttccaagagcatgcttggctatagaaaagagtgtaaggggtgtgtgcaatgcagcatatgctcctggaatgggaacagtgccttgggttctaaactcagagatatacctattgagatacagaggtcttggtggaggtatagttgcagtttccaactggtgtgctaatctcataatgagtgagtctttcttaagcatgacggagtctttaggcatagctaacatatttctcctcgttgttggcttctccttggttgtaacacagcagacacatttctcgttgttgttggcttctcgttggttgcaacgcagctga

SEQ ID NO: 12568 - DNA, 240 bp, Glycine max
  Peptide Sequence Number=SeqID_129346
atgaaaatgctacaatgcgaagggttttcctctaagatgagatattattttgaaattcccaacggtgaaaatgttcgaaattgggttgcgaacgtgctactcaaatttcacgacgatccaacggttaacaagtccgagatcgtcatttttctgagacaggtttggtgggctgcgggaaaaagaaagggttttgagaggagaaggggaaaaacgaaaatgaggccaaaaagaggcacctga

SEQ ID NO: 12569 - DNA, 195 bp, Glycine max
  Peptide Sequence Number=SeqID_129347
atggagccaaatatccctgaggtcctagtggcaccagaagcaggaccttcacatgcaccttctgatgtggagcatgtgaatattgtttcaacaaacaaagccttgattcaagatttcttcaagatcaagccttgcctcacaatgaaaggtttcaagtcattcaaggtgcatgtaattgattaccaatacatgtaa

SEQ ID NO: 12570 - DNA, 633 bp, Glycine max
  Peptide Sequence Number=SeqID_129348
atggataaccattcatggtgttatccagcctgtgctcaatgtcataggaaaactgatatcccaataggaccattcacatgtggatgtggcaaggataatgatcagcctgttctaaggtatagagttgaagtcatggttacacaaaacaataagagtggcaaatttttgctctgggaccgtgaatatgctgaattgattggccaaacggctgatgatgtgaatagggtcaagattgaagatggtgatcttgatttgaatgcttcccctcaagcacttgacaaattgttggttcatgtgcttgcttttaaggtcaggattcaatcaagattaaaaaatgcagttgtacttaaatactcaaaagacctggatttgatcaatgctgttctggagatgctggctgatagtgaggcatgttccaaaatagatccttccaatgttgattgcaatgatgctacgcatgctgaatgtcaatttgtgtctgtcacagctgaccatgatccagttgcggggttacctttaacacccagaaagcggatgtcatctaatgaagccgatgatgggttagggagctctcaaatttcgccagcccaactatcgtctaacaaattaacaagacattctcataggagctga

SEQ ID NO: 12571 - DNA, 249 bp, Glycine max
  Peptide Sequence Number=SeqID_129349
atgacaccgccaacaacaccctcagtgggtttcagaggagaatctgaagtgggtttgaggcagtggcaccaaagatgcatgcttttcttggtgggtatgagggtggagggtgaatcagagaatggtggtgtgaaaggtgacacagagaatggaaaccctagaaggcatggtgggtggataggtgggagtgacagtgaccaaaatggtgaaagatctaaaggtaatgatggtgatgagcaagatttttga

SEQ ID NO: 12572 - DNA, 1767 bp, Glycine max
  Peptide Sequence Number=SeqID_129350
atggatttggaggaacaacttaagacggtgattcttcagaggaagatggcagagaaggccactgctgatgttcttgccattttggagagtgaagggataagtgatgtatctgaagaatttgattcaggctcagaccttgaaaatccttgtgattctagcgtgagtaatgagtgtgcaaaagaaggtgaggagcctatgagctcaaaaggaagacaacatgggtcagataaaatgcctggttccaatgtagattcttcaccagtatccagtaagagtttgtcttggaaaggacgccatgattcttcccattctcttgaaaagtacaagacttctaatttgaggaggcaaagcagtttttcatctatcagttcttctccaaagcatcgccaaggaaagtcatgtcgcaagataagacatcgacaaatcaggttggtagtggaggagtccagaaataagtttgctaaccacgaaaaagaacttgcatccttgtctaaaggatttccaaatttctcaggtggtgggtctaacatcccgaaaatagaatccgaaattcaagaagagggtggatcaggggcaaacccacttaacaaaaatcatcatgtagatggatatggaagagagaaggacatggaaaaggcacttgaacaccaagcccaacttattgaccaatatgaagcaatggagaaggttcaaagagaatgggaggagaaatttagagagaataacagcacaacaccagattcatgtgatccggggaattactcagatatgactgaggataaagatgaaagcaaggttcacattccatttgctgctaaggtggtcacctcagatgctcaagagagtaaaggagaaccaagaggtgtttgcttatctgaagaaaaattcaaagctgaggccagagatattatgccaaaaactcatgatgatacagggggttatagtgaccagaagaatacaacttttagcacttctgatctgcttggtcaacaaaattcatgtcccccactgaagggaaaccaaaatgagagctcagtaaacggtcactttcagccttctgttatgaaccatcaagatccaggtaggcatggttaccatgattccaaacctacttattcctttccaactgatatccatggtgttcagcaccaaaatgatgcttcaagaaacaaaactgacctctttgcattagttactcatgaacaacctcacaagttcaatggtgtacttgaatcacttaaacaagctaggatatccctacaacaggaactcaagagattgccactagtagagagtgggtacactgctaaaccctctgcttcttttagtaaaagtgaggatagatttgaagttcctgttggatgttctggtctcttcagaatacctacagatttttctgatggagcaactgctagattcaatgttaaagatcctactgctggatttggttcaaactttcatcttaatagagccatgtctagaacttctgatggtcagttttttcccagtcttccttaccctgacacacagttgagcttgcctgctaatgatcaatctcttgctatccgatatgtggaaaacgggccaaatggaggttcactctcttccagtaaatacacgtatcccacatttcccatcaatccatcctatcaaaatgcaacaccacagatgccatttggtaatgaagtttcaagaccgtattcaagtagcacagttggggttcctcttgcaaatcgtttctcgtttaatagcgatcatttaagatga

SEQ ID NO: 12573 - DNA, 501 bp, Glycine max
  Peptide Sequence Number=SeqID_129351
atgaattccctgtttcaaccgtaccttcgtcgtttcgtcatcatcttcttcgacgatatactcatctacagtgcttcaattgaagaacatctcaccgacctcgaggttgcatttcagctattgcttaatcatcaattcgtgcttaaactttctaagtgcttctttgcgcagtcccaggttgaatatctcggccacttagtttcacacgcgggagttcaaccagttgcttccaacattgatgctatccgacaatggccagtgcctcagacaatcagagctgttcgcagcttcttgggccttccggggttctacagaaggttcatcaaggggtacgcttctatcgcagcgccattggtgcagttgaccactatgcccaaattccaatggaccgtgacggcacagatagcttttgaccacctgaagcaggcattatcagaggcatcggtagtggccgtgccggattttactttaccattcacacacgaaacagacggatcgggg

SEQ ID NO: 12574 - DNA, 852 bp, Glycine max
  Peptide Sequence Number=SeqID_129352
atgggaaaaacagcagaagtgcctctcaatactaaacatgttatagagaaaacgagactgaagaatagcattgagaaagtaataaaaaagcctctcaatagtaaacttgctatagagaaaacagaacggaaaaatatcatcgagaaagcaataaaaattcccctcaatactaaacttgctatgcattcacctggcaatggagaatcacttggaacttgtcttctcctacatttttcccctggagcttatttaccatcgaaagaagatttactgacaacattttaccggtttggtcccttgaaggtgtgtgaaactcaattgttaaaagatacttgtagtgctcaagttgtttttgtcaaaagtgcagatgctgaaactgcatttcatagtttagagtataacaatttcccctttggttctacgcttgttgattacaagctctatcatctttctgcaacatgtccacttgtggagcaatgtgttacccatgcccaaccaactggatctattgcaatgcctggtgtgaccgaacctagtgggtctatgccaatgccaatgcctggtgtgatccctattcaaccaattgagtctataacaatgcctcgtgtgatccctacccttccaataaggtctattgcaacgcctgatgtgacccctacccaacaaacttggtctactgccatgccgcctagtgagacacctccttccgttgagttcatgaaacagaagttggagatgatggcatcaacaatggagagttcagggcatagactttccccccaaattagagccgaactagatgctggaattaaaaatcttctgaaaagggtgaattctaggcttaatgcctaa

SEQ ID NO: 12575 - DNA, 164 bp, Glycine max
  Peptide Sequence Number=SeqID_129353
gtgagtgcacaagagacttaagggacttcgaaagcttgtttggaagccaattacccaaagggccagtgccaccatctggaccctcttcatgtcacaacaagcttagcccttacaaatacagcaaagcttcattcccagatgattactataatttttgtccttag

SEQ ID NO: 12576 - DNA, 213 bp, Glycine max
  Peptide Sequence Number=SeqID_129354
atggcgaggcaagattcaagagtgcttcttccaaaaaggaaaatgcctggagtcgccaccaacgtttattcggggaaaacgttagaaaaaccaaaaggacgtattttcaggagaatgatagatcttatccagcgcaagttgttgcagcccagatacgtacactgctatataaacatgaaggctgcacgggttttctatcaagtcagagattga

SEQ ID NO: 12577 - DNA, 510 bp, Glycine max
  Peptide Sequence Number=SeqID_129355
atggctttgtcagggtacacgcatgacagtttacaagtgtcacactctagtgcacatggtgctgatagacaaactatatgtgtagcaccccgattgaatcacaccagaataagagggatccattggttgtgcagagctgattttcaaggttctagaaagggctatcgatggagggttatgaccaacgagaagttgagtgaaggcgaaccaggcggaagctggtgggcatgtaacaccctgatcaaatcacaccagaatgagagggatccattggctgtgcagccactgagaagtaaaaaatttgggatgctacaagatgtcacacccatcaccatggatcactctcggtactactacattcttggggatttacgtctcactgacaactggagtggtaatgtcctgagttggagatttgagttagtatgtcccgtgcaggtcattatggaccggggagatcacaccaatatgacgcccaaggaggaggaagagtatcatgagcttctatga

SEQ ID NO: 12578 - DNA, 168 bp, Glycine max
  Peptide Sequence Number=SeqID_129356
atgtatctatgttctatgctgtcgtttctgcatggctctcaatggaattcagatgtgagaatggtaatgaatgtaagggtggcagcttggaagcatatgcacacaacaagggtggcatggtacatttctagtagtataggatttggcatagctgagcatgctatgtag

SEQ ID NO: 12579 - DNA, 417 bp, Glycine max
  Peptide Sequence Number=SeqID_129357
atggcccaaagtctaactcttcaacatagatcaattggtaacatacttcaaaaacaaaaaagagttagaaccatgagtagcagaaatgaaagctatccaaaacttggcttggatttgaacctacccccaccaacgattgttaaccatagacttgagtccccggctcgatcaacaacggtcttaccaacatcaccatcaaactcatgtgtgtccactgaactcaaccaagatgacaacaacaacaataatagcaacaacaatcttgaatactccaacaactctgaagccatttttgtggtgctagtagggtgctcttattgccttatgtatctgatggtcaatgaaggtgacctcaagtgccccaaatgcaaaagcaccaatttgattcattttcttaatttcaacaacatcccataa

SEQ ID NO: 12580 - DNA, 2289 bp, Glycine max
  Peptide Sequence Number=SeqID_129358
atggggcaccgaaaggtttgttttggtagtagcatcaatattgacacgcttgaagcagcaaatgcgtgcgtgccacttgatcaaatgcaatgctattccactccaccctctacacacggctcaaaacacaaccctgttactgatgccatagttccttcgcacttttcagattctcacgattcaaaatcaccactcgctacgcaccgtttcgatcccgtggactcttcttcgggagcttcagagaggaacggagcagagttcgaaatgtcactttatattggtaatctgtcagaacattctcgaagagatgatctcgagcgtgttttccgtcgatttggacattgtaatgttcagctgaaaagaaatggctatggctttgtagtatttgatttccctctcgatgctgaaaaggctctgagagcactgaaaggtagaaatatatgtggtgaatcgctgacactaacgtggtccagtaaacagcctagttcgcatttttctagaattcctagtggtgtcagaagaaatgcatatgagttgggacatgcgaggaatgctgaaagagttgggtatgcgagaaggagaatgggcaccaacgggaggtcaaatcagaagatgggaaggggaaaatccgtggaaatggccggtgaggagaggggatattgtcgtgatgattttaaagattatgttggggaaaaaaagaattatgagggagactttcccaatgaaggcggtggagttgttcctaacaaggaggaaaatggtggatggggtgagccagttcatgacccattggttgacaatgggaatggaagtggtatagaatttgatcgttatgaaccttaccagtgccctgataggaagcatgacaatgaagattatcatgttggttactctggtggttctcctgcagcccattcccaagagaatgttagcagagcacttggcgaggatacctcaaattgttcaaatggctcaaaattccagcaaaattgttttagatgtggtgatcctggtcataaaatgcgaaattgtccaaaagaacatacttcacagaggaaatataacagcaaaattgttcagcagaataataaaatagacaagaagcataaaagtgaagatgagaataaatttgaatctgattccttggcaaggctgcagtcaagtgtggaggctttgtcaatgaggcaccagatagatgggaggaggttgtctggttcacgacatcaccatgcaccacggagaaacgaatcatcccctgtaacaagggaaactgataagcataataaaaaggaatacggaggaaagaagcgaagcagaaatgaaatagaattgcctaaacaatctaaggcaaagatatccaagcagtcagtctcatcctctttgctatctgattactctgcatctcgctttcattcaaattctcaatcttccaagtcattgcataggtctagttcccattctagatcaagatcagtgtcttctagatcatattcttcatcatcaaaatctcagtattgtaaaggtaaacgtttgaattctaggagattaagctcctctatgcctctgtgtgtatcactcaatcagactttatcatcatctccaaataaaatacagttgaattcaaaaggctcatccatcaatggtactgctcttgaatctgtggagcatttggtcgcacaggggcaacaaattggcagtaaaatggaattggagaatcttcaatccaaggatacagttattgctgtaaatggaaaagctgcagtgtataccacagtggtggatgatgtggaaaagggccaatttgtacaggaggacaatcatgaaaatcattttttcttaaaatcatctggcagagtaacagatttaaatgaaccacttgttgggaatttatctccaccagtagaaaaagagacaaagggtcttgagcattctggagcaatgatgttggataatatttcaacagaaattgagaagcctgcttctgaaactaatgttaatctccattctaacctttcaaccattgtatccacagaggagatccgcatggttcttaatacctatggcttggaacttccgaaagatgatgaaaacaatttaacaattgatgccgtatttggttgtgctcggttgtggccttggcatgttgtttattaccgtaggttgaagaaaggcccaatttcaactgagaactatgcccgacgggttgctcaaaatcaggaatttggcattgttgataagtatataagaagcagtagtgggtggggagagttcagtcttgagaatgcttaa

SEQ ID NO: 12581 - DNA, 322 bp, Glycine max
  Peptide Sequence Number=SeqID_129359
gattcctgaacacaagggaagggttgtccctgtgtggttcagactttgtaaaaagagttttacaaagagaatggaaaatctcaatcaatcaaatttcagccaacatcaattagaccttgcaccttacgcttcagagccctacaatgctcaatggaatgccccgaggcttctccgtgacaagcacacgttgcgttcgagtcgtattctcggagaaatggaggttgatgaacctttgttggggttatggctaccattgaattatcaaatagatatgggagcaaggatggcctttgtcgataactgggcggtgggtaaggagaag

SEQ ID NO: 12582 - DNA, 252 bp, Glycine max
  Peptide Sequence Number=SeqID_129360
atgaagtgtgttcttaagagtgtatttctaacatttctcattatagtaatattgttttattggacaaggggggcaccagtgctgtcgggcttggtgtttggttgcaccacttcgtcgaggctgcaaaacacttctccattgcggttgaaggatgagccatttgttgatagcatggacaaggacaatgttgaaggggagggagttggtggtgcaggggtatttgtgtccattcaagtcttttggggtgcatga

SEQ ID NO: 12583 - DNA, 771 bp, Glycine max
  Peptide Sequence Number=SeqID_129361
atgtatgtgcctacgtccacggctacactaggagaacttttttattacttacacataaaggcttacaagactaagcgatgtgggacaaaggaactaagaccacaaactctaacactgcaccacgcagcgcaaacccacgccgatcgtggtcgtgggggaggcgatggctctggtggtggaggtaacggcgacgaatacgatggtcgtgggagggaggcaagagatgatccagggggcacaagtggtgctacaagcttccgtgtagtgtctccactgctggtaagcgggactagcaagggtgcggtgtgttgttgcggcatgagcgcggggcatggcggcagagttggcatggtcgcgggtgcggtgagcttgggtgacggagtcggcttgagcggcagaggcagcggcagagtcagcggcgtggtcggtcactggagtagctcgtctaaggatgaggcatttgttgatagcatggacaaggacaatgttgaaggggagggagttggtggtgcagggtcatccccttggaaaaccgcacagctcaaccatatatgcatttacacgcttcaagtatcacaaacaacagaaaatgcacaacgaactcttccaagtggtcgcagccggaagtactttcggcaaatcgtatccgccgtgagacactatcactggcatgacatgtaccattgcgatttaaagctcgacaacattctcctcgacaaagacatgaacctcaaggtctccgactttggattaggcgcattgaggagctag

SEQ ID NO: 12584 - DNA, 1010 bp, Glycine max
  Peptide Sequence Number=SeqID_129362
atggcgctttctccggaaacgtttacaacccgaaaacgacgcccccgagggtcgtcgtttacgtccccgaaggtaaacgaccttaacgtgttgagctctttgcttcaactaacggatcagatatgttccctaaatctcacagccaccctcttaaaccgtgtttcctcttccaccatccgcaaaacgcagctcctcggcgtcgttttcgaggagctcttccgcgtttcgaatctgaactccgattccgttctgttcctctgcctcgaggaaatgtacatcgttctccacaagctcaaaaccctaatccaagatttctccaacggaagcaagttcaatttgctcatgcagatcgataccgtcgcggagagcttccacaggctcaccggagaactctccacgctcctcgacgtgttccctctccaagacctcgacctcaacgacgacgttagggaactcgttctcctcgtcagaaaacagtgctctgaagcgaaggcgttcatcggagccgaacatgtcagcctccgcaacgacgtcgttttggtcctcgaccggatcaagaacgagatcgtccccgaccaagcgcatctcgcttcaatcttcgagaaattggagattcgcgacgcgtcgagctgcagagcggagattgagagcctcgaggaagagattcacaaccgttgcgaagagcaaccgaaaacagatctcgtcgcgttaatcggcctcgtccgtttcgcgaagtgcgttctctacggcgcgtcaacgccgtcgcagaaaaccgtcactctgcggcggaaccagtcgtcggagctggcgattccggcggattaccggtgtccgataagcctagagctcatgcgcgatcccgtcgtggtggcaacaggacaaacatacgatcgtgtatcaatcaagctctggatggattctggacacaacacgtgtccaaaaacgggtcaaacgttatcacacagcgacctaatccccaatcgcgtcctgcggaacatgataacagcgtg

SEQ ID NO: 12585 - DNA, 429 bp, Glycine max
  Peptide Sequence Number=SeqID_129363
atggcggcgatcccggaggacggggtgacgattctggaggcagtggtgaagaggggtgggttggtggcggtggcggcggcgtacgccgggattaagaggctgggggctgtgctgagggaggggtcggagagggcgagggagagcgcggcggcgacgctggtgacaatgtgtcggaaaggggggtcggaggttgtggcggagatggcggcggtgcccggcgtggagaggatcatttgggagcttatggcggtgggaagtgtcagggggcggcggaaggcggcgacgctgttgaggattctgcggcggtgggcggcggggctcgacggtggcgaaaatgaagggttcccgacaactaccaccatggttgcttcctcaaccactactgtggttgttccaaccaccaccaccaccacttcgttagcacagtaa

SEQ ID NO: 12586 - DNA, 496 bp, Glycine max
  Peptide Sequence Number=SeqID_129364
gaaagatcacgctttacagctcccttaccgaacccgtgctagagctagagtaatgggtgaagtagaggaggtgcaagagcagatgaaggccgacacagaggccttgaaagagcaaatggccacaatgatggaggtcatgatgagcataaaggagataatggaggtcaatgcggctgtaatagccgttaccagcaccattactgagccctcatttagtgcaaaaaacaagcatgccttcccaccatatggcttgcctcccaactatacaccacccaatgtggcatacactcccagtaaggatgtcaataacttcgctcccatactcattgaaagccgacaacctcaaactgatcatgcacatgtctctcaaaccatgggggagagacatgaaattccctaccacaatctagccgacttcgagccttgccttggatatgccactgaagggcaagcagttggtggtatacccctgcaaaacactttggaggggccttaa

SEQ ID NO: 12587 - DNA, 477 bp, Glycine max
  Peptide Sequence Number=SeqID_129365
atggataacacatactggaggcttgatagtatgctcctgcatatatgtcacgcaccgtgggtgaaatatactggagtcatggcaggtgcttatgtgcacatgtcactcgccaagggtggcatgtactggagtcaccctggtgatacactcttacatgtatgccactcgctgtgggtacgaaggtctactgaagtagaacttcaggttggttgtgaccctgaagggaccttctcagttgaggccaagctttcccgctcggagatcttttctggcttcacctcgatctcgccatacgaggttccaccctcatattttcttcattttattgttgtcgtcagacctccttgtcaatggttccctaacttctatggggatcatggtgtctatgccatatgtgagtcgtcagtggataccctccaacaaatggtatcaggcatacttaacaaggcccaagtggagaaggatgaaggcccaaag

SEQ ID NO: 12588 - DNA, 612 bp, Glycine max
  Peptide Sequence Number=SeqID_129366
atgaccatcaaaatagatcccgaaaaggcctatgataggctaaagtgggatttcattgttgaaactctaactgacattggtttccccaacaacttcattgataagacaaccctgctcttctttgcggaggcttccatagatcaggaaaacattattaaaggtatcttgatgttatttgtgagagttttggttccagatagcattgctactcagttgggttaccaaagaactgttgatcttggcaattacttgggaattcctatgcatcttcaaagggtttcctccaagagcttcagctttatcacgaagaaggtggaccagcctctgggcaattggaaggctaagaacctctctcttgctgggagggtcaccctcacaaagtttgtgattcaagctttacctacttatgccatgcagtctaattatatctcagcttccgtttgtgacgaaattgataagagatgttgcatttttatttgggaagattcaaataacagtaggaaagttcactggatgagttggaaagccttatgctcccctaagaaaagtggtggtcttggtttgcgaatgttgagtcatatgaacaaatctctccttatgaagtctacctag

SEQ ID NO: 12589 - DNA, 987 bp, Glycine max
  Peptide Sequence Number=SeqID_129367
atggtgagctctgctagagtttgtaaaataagcgatgaagggtcaactattgaggaagacgatctcctccatagaagtaccacgaaaattagggaaggttctaagattgtggaagaggtgcctaaggagaaggagggggatgtgaatgaaacgaaagatggactaggagacgacagagggggtggcgggggaggtgtagggacgatggtggggctgttcgtgaagccgctgttcgaggcaatgggggagcagaacaaaggggtgcaggcgggggcggcggtgtgcatggccaagatggtggagtgtggcggtggcggcgaaggaggggaggtggtgccggtggcagcgtttcagaagctgtgtccgaggatctgcaagctgctcaacagtcccgtattcgagccgtattggagttgtattgaagccgtgtctagtcttaggaagccgtatctaagtcgtgtcccggaggagaaaagccatgaggtgagggctgacgtaagccctaaggagacaacaaatccatatattattaatgacaataatgacattaatgataaagataaccaatttggggcagtggactatgccaataagattcttgaatcggaggaggcattaaaagcttctttggacgtgatgaatttcccaactgatgatatgggcttgaaatacgaatcatcccgtatgttcttggttgaaacacatgcttctaatgcagttgctactcgtattattccaaaaacaagtttcaatgtaagttttgtcaaggagacccgtgttcagtcaaggggtatttggtgcctctggaaatctgagaattggaaagtggaaattcttcgtagtgatgatcaatatgcttggatggtgattggagattttaatactgtcctctatgctcatgacagaattggtggctctgaaaacccttgttggcgagggaccaacatttacatggatgagaggaaatttggttcagcgcctcgataa

SEQ ID NO: 12590 - DNA, 164 bp, Glycine max
  Peptide Sequence Number=SeqID_129368
atggaagaaagtaggaggttttctaccactccaaagcgaatcccaaacctttcgcactctatcacaatcgcgaaagcaacgagtgagagtttcaatcttcttcttacaaatagggcagagactttcctgagtcatatgacggtgatatcgaagagcattggtag

SEQ ID NO: 12591 - DNA, 375 bp, Glycine max
  Peptide Sequence Number=SeqID_129369
atgatgcatgatctaaggaggttgaatgaggaattggatgttctgcaatcttctatgatggtgaatgattcaactagcaaatcctattggtcgccgccatgtccaggggtcttcaaacaattgcaacgtgtatgtgggggaattatcagagacgaaaagactaattttattcaagcctactcgcgtcgtatggcttcttgctccatccttgaagcaaaactttggtcgatattttatggaatgagacttgctgaagattgtggggttcaacacattataatggagtcagattctgcggaagcagttaatcaccttatggagcactcatatgataaccacctgttgttccatctggtgcaagaaatcaagagatag

SEQ ID NO: 12592 - DNA, 213 bp, Glycine max
  Peptide Sequence Number=SeqID_129370
ctgctgcactcaaacatactgcgtggagaagactacttaggcgcatcattcctgtgagtctagttgtgttcttcgactgtcgacagcctgtgaaagccaatttgaggtttccgactcgtgttttctgctccatctcacctgcggccaaggatcttcttcgtaggatgctatgtaaagagctttctagaaagttctcggtagaacaagtcctaa

SEQ ID NO: 12593 - DNA, 540 bp, Glycine max
  Peptide Sequence Number=SeqID_129371
catgactcaaatgtcagtatgacagatcttgtgagcgcggaagatgacatagcaaaaaagaatgtttatacggataacaactcgggtaattccgcccgtcaacgtgactcaaatgtcagtatgacagatcttgtgagtgcagaagatgacgcaaatctccacgtgtcaacaggcttttcggccgcgattgacacagcaaagaagaatgtttatacggataaccactcggatatttccgcccgtcaacgtgactcaaatgtcagtatgacagatcttgtgagcgcggtagttgacacatcaaaaaagaatgtttatacggataacaactcgggtaattccacccgtcaacgtaactcaaatgtcagtatgacagatcttgtgagtgcagaagatgacgcaaatctccacgtgtcaacaggctattcggccgcgattgacacagcaaagaagaatgtttatacggataaccattcgggtatttccgcccgtcaacgtgactcaaatgtcagtatgacagatcttgtgagcgcggaagatgac

SEQ ID NO: 12594 - DNA, 2355 bp, Glycine max
  Peptide Sequence Number=SeqID_129372
atgaggagaggtgttatggagaacagtgatggaggggaggatatggttctggctaatttgattgcaaatggagatgatgttggtcctcttgtcaggcttgcctttgaaagggggaggcctgaggggctgcttcaccagctgatatatgttgttaagcaaaaggaagctgaaatcgaggagatgtgcaagacccactacgaggaattcatccttgcagttgacgagcttcgtggagtgttacttgatgctgaagagctaaagagtgaactccaaagtgacaattttaagttgcagcaggttggcagcgcccttcttgccaagcttgaagagcttcttgagtcttattctgttaggaagaatatgactgaagctatagaaatgtcaaagaactgtatacaggtgttggagctttgtgtcaagtgtaacagtcacatttctgaaggtcagttttattctgcattgaaaactttggatttagttgagaaaagttgcacgcagaatattcctgcaaaggctatcaaaatgctcatagagagtagaattcctgttataaaattgcacattgagaagaaagtatgcagtgaagttaatgaatggatggtcgagataaggagttctgctaaaaatattggggaaacagcaattggtcatgctgtgacagttcgtcaaagggacaaggaaatgctagaacagcagaggaaggctgaggagcaaagtatttcaggactaggggatctagcttatactttggaagctgaagaacttgaagaagattcagttttacagtttgatcttacaccactttatcgtgcttgtcatattcatgactgtctgggtatccaagagaagtttcgtgaatattactatactaataggttgttacaattgaattcagacctggaaataacttcagcacaaccttttgttgaatcataccagactttttttgctcaaattgctggattctttatagtggaggatagagtccttagaactacagggggcctcttggtagctgatcaggttgaaacaatgtgggagacagctgtagctaaaatgtcatcactgttggaggagcagttctcttgtatggaatctgcccctcatcttctcctggtgaaggattatgtcactctgtttggatctactcttagacaatatggacatgaaataggcacacttcttgatgttcttaatagcagctgtgacaaataccgcttgctttttttggaagaatgtcagcaacaaattcttgatgtctttggcaatgacccgtatgaccagatggagataaaaaagcaaagtgactatgagaatattgttctgtcatttaatcttcaaacatccgatattatgcccgcatttccatacactgccccattctcctccatggtacctaatgcttgtcgcattgtgagatcatttatcaaaggctctgttgattacttgtcttatggcatacatgtgaatttctttgatgttgtgagaaagtatttggacaagttcctgattgatgtactaaatgtaatgctgcttgagaaaatcaatagtggcaatgtcactgttcctcaactcatgcagattgctgcaaacatagctgttcttgaaagagcttgtgatttttaccttcgacatgctgcccaactatgtggcatcccagtccgatcagttggaaggcctctaggtactttaactgcaaaggtgatcttgaagacatccagggaagcagctttcattgctttacagagtctggtgaacacaaaaatagacgagtttatgactcttactgaaagcgttaattggactcctgaggagacaaatgagaatggaaatgactacatacacgaagtgatcatttaccttgattctatcttgtccccagcgcaacaaattttacccttggatgcagtgtacagagttgggagtggtgcttttgagcacatctcaaattccatagtggcagctttctctagtgataatgtcaaaaggtttaatgcaaatgcagttataaatgttgactatgatcttcagatcatagagaattttgcagaggaaaggttctattctgctggtttgggagaaatagacgatgaggttagttttaagatctgcttggtagaagcacggcagttagtcaatcttttgctaagtagtcaccctgagaacttcctgaatcctgatatatgggagaaaaattattatacacttgaaattaagaaggtggctgctatccttgataaattcaaggattctccagatgggatctttggaagcctagctaataaaaatgcaaagcaaagtgctagaaagaaatcaatggatgtactcaaaaagcgacttaaggatttcaattga

SEQ ID NO: 12595 - DNA, 249 bp, Glycine max
  Peptide Sequence Number=SeqID_129373
atggcattgtcgccttgtcaaaggcgaatgaaaaaagaagtttctgagcctaaatgccagtttgatgttgtgatccgtgtcagcgatgaggttgaagattgcaccgaggaactggaggaggacctccttggtggcttttggcggcgcggagagggaccaccgacgacaacaacggtatcatcagggaacatctttccaaccacaatggacgacaaggaggacacaacaatcaaaaacccgttcttgtga

SEQ ID NO: 12596 - DNA, 174 bp, Glycine max
  Peptide Sequence Number=SeqID_129374
atggcttcctatggtgaccttaagaagcaaaggaatccattgacgaagaagatccaaggcctacaagctccacatggagctacatcatttgactctctagagggctatacaactccaatttgggtgacaccaacgacatttgttagctaccagccagagctacaacattcatag

SEQ ID NO: 12597 - DNA, 525 bp, Glycine max
  Peptide Sequence Number=SeqID_129375
atgccacttagtgaaattagtcactttctcaaatccattggttttgaggggagcaaaaaaaattgtattgaggctggtacagcagaaagacaacttattgaccttgagaatgatgaggttgattctgacaatgaatataatccctcttttgtttgtgacaaggatatggccaccaacttagaactctatgaaacaccttgtttaaaggatgtcaaatggatcgacaagcaagtccatgggaaagctatgggaaaatcaatggagaagcctttctcaattgccgcctttcttgccactagtggtggtaacaataagaaaatgctttcgagaaacaagcctaaaccatcagacaaaggaagaagttctattgttgagactcattccaaatctactcatgacctccctctgcctcctttgaagagggagagggttgtcaatattgaagacggtgtagaaccagccagctgtagcttgattgttgttagcaagattggcggtcctcctatgtggatgtcttcaggctaa

SEQ ID NO: 12598 - DNA, 348 bp, Glycine max
  Peptide Sequence Number=SeqID_129376
atgataggaggtatgatgaatgtgttgagtggtgcaacactcttttgtaaaatcactcatgcacccaacatcttcatgatttgtgtacatagggactcattaggtaggaataatcaacatgaaaataaagaaaaagttatgttttattccattactttccttaactttttaaataatgatcaagggcttcctatggaccctaagagaataaaggtcattcctgagtggcctactccaccaagtgtagaggaaagaatccatgagtttcatgaacctctggatttgaggtcaaatccttttcaagtgagaggggatgatgcaatcctaccccccaagggcattggatag

SEQ ID NO: 12599 - DNA, 369 bp, Glycine max
  Peptide Sequence Number=SeqID_129377
atgaattgcgttttcgttcatgtgtcctccaccttcgagtttggagctatgcgtagtgattgcttagtacaattctccattgtcaacctttttcagagctccatgaattgcgttttcgttcacgtgtcctccaccttcgagtttggagctatgcgttgtgattgcttagtgcaattctccattctcaaccctttttcggagcccatgaattttgttttcgttcatgcgtcctccaccttcgagtttggagccatgcgtagtgattgtttagtgcaattctccattcttaacctttttcgtagccccatgaattgcgttttcgttcatgtgtcctccaccttcgagtttagagctatgcgtagtgattaa

SEQ ID NO: 12600 - DNA, 165 bp, Glycine max
  Peptide Sequence Number=SeqID_129378
atgaaggatgcgatccatgccaataggtgccagaccaactctcctaggcgagctgtactcgcccaggtgagttggttgcttaaggctgaagacactcactcgcccaggagagttgtttgcttaagtttgaagaaacttcacaagcccaggcaagttggttgctag

SEQ ID NO: 12601 - DNA, 354 bp, Glycine max
  Peptide Sequence Number=SeqID_129379
atggagcatcttttggttccacaatgggatgagtttgaggctacatcatctgttagtgaatcagagactagcctcttgaccctgctttggaggagagtattaggtctaggtgttgggccgaagctattggcagaaagaccaaggaacaactctacgggattagagaccttgcttgtgattatcaatgatgacatagtagcgtcacccgaaaaaggaaagcatcaacatattccttctccattccacttccattcatcttgcaagaagcaaaggaatccattgatgaagaagatcctaggcctacaagctccaatagagcttacatcatgtggtatcaagagcatcttcatctaa

SEQ ID NO: 12602 - DNA, 300 bp, Glycine max
  Peptide Sequence Number=SeqID_129380
atggtatatacacaaattgtgggtataccccacagacaagccactgtcccagatagcaaaaccaaatctcattcaaaaatctgtattgagccttacccttgcatatgcaaagaggctgtttccggattcgaacccatgaccaacaagtcaccaaggcacaactttaccgctgcaccaggactcgccctcttttcaaaatttcgtaccccattgcccagaggctcttcgctatgcgaaggtatgggagagggatgttgtacgcagccttacccttgcatatgcaaagaggctgtttcctga

SEQ ID NO: 12603 - DNA, 201 bp, Glycine max
  Peptide Sequence Number=SeqID_129381
atgaatatcaccgtgaaacatagagaacagaagaacttaatgcaagtttggattgctgttgtgaaaatccaaatctccgtttccaaaagcaagtccatcaatacttctgtgttggctgttgaagttgcttggaatttcgtgctgcagcaagatggccggataagcaaacacgcgcttaacaatatgtggttatcattttaa

SEQ ID NO: 12604 - DNA, 258 bp, Glycine max
  Peptide Sequence Number=SeqID_129382
atggtgggtggagtgggtttagagttggagggtcctagtaaagatgcatctatgtggtggagagatttaaagttgatttgtagaggaaacaaccaatccttgtggtttgactacatagtgaaatggaggatagatgatagagatggcttggaagtgtctagaacaagtgtggctgagtgctcatgcttgtgggtggaaaaaagactcgatgggagcaagcttgcctccttacacatcctaacgctaccctacatatga

SEQ ID NO: 12605 - DNA, 369 bp, Glycine max
  Peptide Sequence Number=SeqID_129383
atggagtgtaactcatctttctctaaatttgacagagagttgagtttgttggagaagcgtgaggtggtgaaggtcagaagcgatagaggtagaggcacagtagtagtgtatcataaggggaaaagtgggggcaaaaaggacgtatcatatcacatcggtagtaaaaagaagtctatggaagttttaaaaatggaaatgaaggtgggacccatgataatgggtgatggaggagtggaggggcacatgtatgtgaatggggagatattggcttacttgggccacaatgtgaagctcaaaagagcacaaataggggaaaggagtgtgcgacccaacttttgcactcacaaaataaagatgttggggcgatag

SEQ ID NO: 12606 - DNA, 537 bp, Glycine max
  Peptide Sequence Number=SeqID_129384
atgggtgggggaccctatgttttaaaagagaagtttaaagacaaattgaagatttggaacaaagagcactttggtgacttgcaaagaagacgaagaattatagagtatgagatgatcatccttgataaaaagggagagaaatggggtttacctttaaagaagtgtgttttgagggaaaaagaaaccttacaagaccaattgtggagtgttgctatgtctaatgaatccctcttaagacaaaaatcaagagatagatggattgtgaagggtgattgcaatactaaatacttttattcgatggtgaataagagaagaagaaaaagcttgactaggggtatctttattggtggagaatgggtggaggaaccaaatatggttaaggaggaggttaaacatttttctcaaaagagattccatcatcaacatggatgtaggcctttattagatggaatcatgtttgaggaggaggaagtgaaagaagcagtttggaagtgtaggaacaagaagagtatagggttggatgacttcaatttttaa

SEQ ID NO: 12607 - DNA, 192 bp, Glycine max
  Peptide Sequence Number=SeqID_129385
atggtgagtgatagtgaaggcaatgatagcgacaatgatggtggtggtgacggtgacatcaaccaaaataatggtggtggtgacaatggctatagtggttgcggcgaaagcgacaatagtaatgacagtgatgacaactacaatgatgaatcaatgataatagtgatggtggtggtcacaaagatagtgtag

SEQ ID NO: 12608 - DNA, 1833 bp, Glycine max
  Peptide Sequence Number=SeqID_129386
atgtacaaggggagatttggaggcaaggctgagcttggatatgttgaaactgacccttcaggtcgatatggacgtaatatggttattgagttggagggatatttcagggacattctaggcaaaggagcagtgaaggtagtgtatagggcatttgatgaggtgctaggaagagaagtggcttggaaccaagtcaagcttggtgatgtgtttcattcaccagatctacttccgaggctttattcagaggttcatctcctcaagaacttggaacatgactctatcatgaccttccatgattcttggattgatgtccattgtagaaccttcaacttcatcaccgaattgttcacctctggcaccctaagagagtatagaaagaagtaccagcgagtagatataagagcagtgaagaattgggcacgccagattctaagtggcttggagtatttgcacagccatgatcctcctgtcatacatagagacctcaagtgtgacaatatcttcatcaatggccatttggggcaggtcaaaattggtacaccagaatttatggcaccagagttgtatgaagaggaatacaatgagttggtagacatatactcctttgggatgtgcatgattgaaatttttacttctgagttcccatacagcgagtgctccaaccctgctcagatatacaagaaagttacttcggggaagctgccagaagcgtattacagaatccatgacttggaagcccaaaaatttgtgggaaaatgtttggcaaatgtctcagagaggttgtcagcaaaggagctcttgttggatccatttttagccacggaacaactagactctccacttcctagcccaacattacccaaaaaacaaacccccacactaaatttcactgcattactagccaaagagctacctccaccaaagagtaaccaaacaaaggacacacacatgacaatcactggatccatgaatgaagagaatgacacagttttccttaaagtacaaatttctaacaaaaatgggcaaaagagaaacatattctttccattcgataccataaacgacactgccattgatgtggcaatggagatggttaaagaactggagattagtgacttggaaccattggagattgctgaaatgattgaggaagagatatcagctttggtcccaacatggagggactggggcagtgctaagtatcaaaaacagcatagttttagctatgaagaagaatatgatatgagtaaccaccaccctttcttctcaccaacttctcgttcttcctctcatgcttcacttccagtttttggttcttcttcctacaagaatagttcccaccatcgtgagaatcattacccttttgctcaagattggcctcaaggtactcctcctctttcaactcgtaatacaaatgaactattcatgaatgatgatgcgagctcacaaagctcaatgaactccttcaagtgtttcaatctcaattgctgcgaccccggcaatgaagatgagcatgatccaactctagcactaggagcagaacaccttttctacacaccaaaaggcaatgaaaagtacacaagattttgtcctagagaagaagtgatggaatctgatttcaccaaacagttttgcaacatgagaatggattctcacaggtgtcatggaatgcacaggctaaccaggatccgttccttcgtcgatctgaggagacagcaacagcaacgatcactggtggaagagattcacaagaggaggatgttcaagacggttggtgccattgagaacattggatttcaggatccagaaggagatggatgtttttcttactga

SEQ ID NO: 12609 - DNA, 207 bp, Glycine max
  Peptide Sequence Number=SeqID_129387
atgaaaatggaactgcatcagttgataggagacctcttttggatcggacataaaatatacaatgttcaagctattatgctactttatgcagaggacattctaaatttcaacagcatcttagttcagtacttcagttctattattatcaatcttcatgttggattggatgggcacttgagcggatcaagattggagattcttggatga

SEQ ID NO: 12610 - DNA, 270 bp, Glycine max
  Peptide Sequence Number=SeqID_129388
atgagtatcaaaggtggtgccggtggagctggtggaggtggtagaatctcaaccttcggggaagctggtgggtctactactggtggttgcgactcaactggtacaataatcagctgcccccggaataggctctgcaacataggaactataggttgtgcttgtaggccatctggttccatggttgttgttggaggaggtgggttggatgatgaagggatgtcttcagctcttgctctctttcttgaggtcatctataagaaaagaatgtga

SEQ ID NO: 12611 - DNA, 453 bp, Glycine max
  Peptide Sequence Number=SeqID_129389
atggatgattttagtgaggatggggatcaaaagttctttgatcacatcaatgaggatagcgatgaccaaagcaataacgagggtgttggcagaccaacgacacctccatcacctccattgcagtatcaccaacctaggtgtccagtagacttaaactttgaccacctaccacactacattgatcgacaccattttgttcagcagcaacataatgtacaaccaccaatatgcactcaaggttgcatggccttcaatgaaaaagcacaatacagacacccctcaattataagtgcctacaacaacccaactaacttatgggttcaggatacatcccatttcttttgcctgcgccacattgcacaaaactttcttctcggtaactcaaacggaaaacatttaaggaaaccacttatgctggctggttacacatacactgagaagatgcacttgtga

SEQ ID NO: 12612 - DNA, 298 bp, Glycine max
  Peptide Sequence Number=SeqID_129390
atggaggggttcttctgtgagaagctcctaggaatagtggttttggaagtggaggaactcttttgggataagctcctgatcaagagaggggagtttgaagaagaagaagaagaagagcctcttgttgagcaactccttgagaacaatgatgacttgctggatgatgtgcttgaacctgcttccttctttgacaccttccacttttcatccatgaaaaacaaaggaactgtaatatctacaactagctatgggacagagtgtgtgtgtgagagagagagagagagtgagaatggaaaag

SEQ ID NO: 12613 - DNA, 1503 bp, Glycine max
  Peptide Sequence Number=SeqID_129391
atgacaacaaaaaacaggcatggagtgagacagcttcaaagtggatgggcagatggtccatcttacataactcaatgccccattcaaactggccagagttatgtgtacaacttcacaattgttggacaaagaggaaccctcttctggcatgctcacatttcatggttaagagccactctctatggacccctaatcctcctccctaggcgcaacgaatcttacccatttgagaaaccctacaaggaagttcccatcctctttggtgagtggtggaatgctgatccagaggctgttattgcacaagcccttcagacaggggctggcccaaatgtctctgatgcctacacttttaacggtcttcctggacccctctacaattgctccaacaacgagacagacacagaaacagacacgttcaggttaaaggtgaagccagggaagacatatcttcttcgtttgatcaatgctgcactcaatgatgaactctttttcagcattgcaaaccacaccttggtaactgttgaagctgatgctacttacgttaaacctttcgagtcagagatcatcgtaatagggccaggacaaacctcaaactttctgttaaagacaaaacctgagtacccaaatgtcaatttcttgatgctagcaagaccatatttcactggcatgggaactttcgacaattccacagttgctggcattcttgagtacaagaaaccgcttgttgctccaaaaaacactattcccactttgaaaccctctcttccagccatcaatgacacttccttcgttgccaacttcagtagtaaattcctcagtttgaacactgacaagtaccctgcaaaggtgcctcaaaccgttgacaagagcttcttcttcacaattggacttggaacaagtccttgccccaaaaaccaaacatgccaaggaccaaacaacagttcaaagtttgcagcctcaatgaacaatatatccttcactcttccttccatagcacttcttcagcaacatttcttcggccaagctaataatggcatttacaccactgatttccctgccatgccactcatgccattcaactacacggggaccccaccgaacaacacaagggtcagtaatggaacaaagactgtggtgataccctttaacacaagggtgcaagtggtgctccaagacactagcattttgggagctgagagccaccctttgcaccttcatggctttaacttctatgttgtgggtcaaggctttgggaactttaatcctaacactgaccctccaaaattcaaccttgttgaccccgttgaaaggaacactgttggtgtgccctctggtggttgggttgcaatcagattccttgctgacaacccaggtgtttggctaatgcattgccattttgatgtccaccttagttgggggttgaggatggcttggattgttgaggatgggaagctacctaatcagaagttgcctcctccaccagctgatctccctaagtgttga

SEQ ID NO: 12614 - DNA, 279 bp, Glycine max
  Peptide Sequence Number=SeqID_129392
atggagaatcttatcccacatggactaggttttcttaacatttcaaaccttatgtactatgtgatgcaatcctaccccacaagggcattggatagaagactccaagaagatcgggctagagatgcaagagaaagccccagggttctcatgaccttagtgatgcaatcctatcccccaaggacattggatagaagactccaagaagattgggccagagatgcaagagaaggctctagggtgctcatgagtctttgggtagattttgcgtccatgggctaa

SEQ ID NO: 12615 - DNA, 408 bp, Glycine max
  Peptide Sequence Number=SeqID_129393
atggcccctactattgatggaaaagcagtaactcttgttcggaaattaccagttgtagacccaacgcgtgtttttgtaggagatgttgtggttgtgaaggaccctgagaagccagataactacctactcagaagattaactgcagttgaaggctatgaaatggtttctactgatgaaaaggatgaagcctttgttctcgagaaggatcaatgctgggtagtggctgaaaatgaaaaattgaaagccaaggaagcgaaggatagccgaacatttggtccagttcagatgacagacattgtaggcagagtcatatattgcctgcgaagtgctgtagaccatggccgggatacaccagtgctggaagtggaacttgatgttgatgagatggcaaagagtcacaaagcctga

SEQ ID NO: 12616 - DNA, 3462 bp, Glycine max
  Peptide Sequence Number=SeqID_129394
atgttgtctgaattgggaagaagacctatgcttggaagtaacgagggttcttttggtgatgaattggagaaagagatagggatgttacttcgtgagcaacgcagacaagaggctgatgatcgtgagcgagagcttaatatttttaggagtggatcggcacctccaactgtggagggttctttgagtgccgttggagggttgtttgctgctggtggtggtggtggtcctgctactggtgctcctgctgcctttttggagtttcgaggagcgaaggatgtgaatgggattgcttctgaggaagagcttaggtctgatccagcgtatctttcatactactactccaatgtgaatttgaatcctaggctgccacctcctttgctgtcaaaggaggattggagatttcaacaaagacttaaaggtggagcttctgctctaggtggaattggagataggaggaaagtgaacaggactgatgataatgctggaagattgctttttgctaccccaccaggttttaacatgaggaaactagagagtgaggtggataatgaaaaaacaagaggttcggccgagtggggtggtgatggactgattggtttgcctggactagggctgagcaaacagaagagctttgcagaattttttcaggttcctttattttcgtatccttttctttctgcccatcatttacaaccagtaattgtgcaggatgatttggggcataatacctctatcacacgccttccttctcgcccagccagtcgtaatgcatttgatgaaaatgatatcattagttctgctgaaccagagttggctcatgtacgtcgtgagtccactcccactgatgcactaaggtcaggatcaaatgttcaaggatcatctgcagcccaaaatgttggcttaccagcttcatattcttatgctgctgcagtaggatcttccttgtcaagaagcactactcctgatccacaacttattgctagggctcccagtccctgcatcactcccattggtggcggcagagccattgcttctgacaagagagctattgccaatccagatgcatttaatggtgtttcatctggcatcaatgagtcagcagatcttgtggctgcattatcagtgatgaacttgtcagcagatgatgtgttagatggtgaaaaccatttcccatcacaagttgaatcagatgtagatagtcatcagagatatctttttggtaggcaaggtggtcaggatcatgggaagcaacaggcttatttaaagaaatctgaatcagcacacttgcaaaattcaagtaagagcagcaggagtggatcaggtctcaacaatccatccttggataggcaggttgagctacaaaagtctactgttccttccaataactcatacttcaaaggatcgcctacctcccattttagtggaggaggaagtatgccacctcagtaccagcctttagatggtacaaattcatcatttactaactatggtatgagtggctatgctggaaatccagcattggcatccttgatgactaaccaactaggcactggtaatctgccacccttgtttcaaaatgttgctgcggcatcagcaatggctgcccctggaatggactcgagaattcttggatgtggtttggcttctggaactgctgctccatctgatgtgcataatcttggtaggatgggaaatcaaattcaaggcagtgctcttcaggctccttttgtcgatcccatgtatcttcagtacctgaggacgtctgagtttgctgcagcacaacttgctgctctcaatgacccctctgtggacaggaactacttgggcaattcatacatgaatttgcttgagctccagaaagcttatcttgggtctgtcctctcacctcagaaatcccaatacaatgtaccgccgggtggtaaatcaggcagcttcactcctcatggttattatggaaatcctgcatatggtgctgggttgtcttacccaggaagtcctatggcaaactctgttgtgtccacttctccagttggatctggaagtcctgttaggcacaatgaactgaatatgcattttgcttctggaatgaggaatttagctggggtcatgggaccttggcatgtagataatgagaacattgatgaaagttttgcttcttctctgttggaagagtttaaaagcaataaaacgaagtgttttgagctgtctgaaattgctggtcatgttgttgaattcagtgcggatcaatacgggagtcgatttattcaacaaaagcttgaaacagctactacagaagaaaaaaacatggtttatcaggaaatcatgccacatgcccttgctttgatgactgatgtctttggtaattatgtggttcaaaagttttttgagcatggacttgcatcccagagaagagaattagccaacaaacttcttggccatgttctgacacttagccttcaaatgtatggttgccgtgtcatccagaaggccatcgaagttgttgatctggatcagaagatagagatggttcaagagcttgatggtaatgttatgcgctgtgtacgtgatcagaatggtaatcatgtcattcagaagtgtattgaatgtgtccctgaagatgcaatccactttattgtgtcaacattttttgatcaagttgtgacactctcaacccatccatatggttgccgggtgatacagcgagtgctggaacactgcaaagaccctacaacacaacagaaagttatggatgaaattttaggagcagttagcatgttagctcaggatcagtatggcaactacgttgttcagcatgtgctggaacatgggaagcctcatgagcgttcttctataataaaggaattagcagacaagatagtgcaaatgagtcaacagaagtttgcctccaatgttgtggagaaatgtttgacctttggaggtccttctgaacgccaattactagtgagtcagatgcttggcaccacagatgaaaacgaacctcttcaggcgatgatgaaagatcaatttgcaaattacgttgtacaaaaggtgctggaaacttgtgatgatcaacagcgcgagctgattctttcccgaattaaggttcatttgaatgcattgaaaaagtacacctatggaaagcacattgtctctcgtgtagaaaaacttgttgcagctggaggagcaatttcattgatagcatgctcctacatgataaatgcattacacgagatacatgcatggaaaccaagccattctgctgcttctaattgtgttatgatatgcacatttaatttcaagcttatgaaaggagaattgctgctcaggctcctcctcaacccgcttaggtgcttagaaaataatcttgtacagctaactgaggctagtgtgccgcttcttcttcctctttctctcccagatcaagaggttcctctttctctcccagatcaagaggttatgtag

SEQ ID NO: 12617 - DNA, 272 bp, Glycine max
  Peptide Sequence Number=SeqID_129395
ggtacatctacttgggtttgactgagaacaagagagggtacatctcttgtggatcggttctagtggagggtacatctactaggttcaaagagaacaagggagggtacatcccttgtggatctttgcttatcattccactagacagtgaagaagaagccaatctttgtctgatggttgatgcttccaccaataaagtagagccaacactggacacaagttcaaataatgaggactctcatcctaatgacactatcaactctgatggcgaagag

SEQ ID NO: 12618 - DNA, 142 bp, Glycine max
  Peptide Sequence Number=SeqID_129396
atgactcatcttgagatgcttaatattgttgaatttcctctgctgttatgtctgccaagtggcatgtatcacctcattgcccctgaagatttgagcatagatggttgtcctgaattgtgtagaaaatgtgagccacaatctg

SEQ ID NO: 12619 - DNA, 336 bp, Glycine max
  Peptide Sequence Number=SeqID_129397
atgttgttgggtgagatttcaaactcaaaggaacaagatttggctcataagaaagcttacagtaatgtccagaagctaaaggcgtttgatgtgagcaatgaaggatcagtactcaccagattgtggctcacattttctacacaattcaggacaaccatctatgctcaaatcttcaggggcaatgagcggctccaagaatccactgaggcaatgtctgttgccttggacaatgctcaagatgcaggactttcatcctcaatctttggattgcactttcacaattcaatggcagatttagcatcttgcagtgtcttccatacagaacctccagtttag

SEQ ID NO: 12620 - DNA, 267 bp, Glycine max
  Peptide Sequence Number=SeqID_129398
atggctcttgtggtaaagaaggatgtccagtacaagccgctgaagaccgctctccatcaccacattctcaaagagatgactcttcatctcttttgcacatcattcttgaaaggtttaatgaacttcaaacctatgttggtgagagaaggtagtaatcgattaccagaaggtagtaatcgattaccagtagccatcattgttttcaaaactgatttacaaagctgtaatcgattaccatgggcatgtaatcgattaccaatgttttaa

SEQ ID NO: 12621 - DNA, 578 bp, Glycine max
  Peptide Sequence Number=SeqID_129399
atgggggaagaggtgaagacgagcgagtacgacgaagagcgcgtgatggagtgggagatgggtctcccaaccgccaacgatctcacgcctctctcccagccgctgatcccgccggagctcgcttcggccttcagcatctcgccggagccccaccgcaccctcctcgaggtcaaccgcgcctcgcgcaacacgctctccacaatccgcggcggcggtagcgtgcaccaggccttctcatccaacaacaacaacaaccaccactacgacggcgacggagacggcggcgacgaggaggagtacgacgacgccgatcgcgatggctcggggtcggattcccggaagcagcggaagatcgactgcggcgtggcggaggaggcggactcggcggtgcggacagagacctcggcggagcgaacggcggtgaagcggccgcggctggtgtggaccccgcagcttcacaagaggttcgtggacgtggtggcgcacctcgggatcaagaacgcggtgccgaagacgattatgccattgatgaacgtggaagggttgacccgggagaatgtcgcgagccatctccagaa

SEQ ID NO: 12622 - DNA, 2616 bp, Glycine max
  Peptide Sequence Number=SeqID_129400
atggtttctccaagaaactcattccaggattcgggtcatgattctgcaccagctacattttctcagtcaattttaatcaagcttgaacaagttttgttattttcatatcctttttcttctgcccattatttacaaccagttattgtgcaggatgatttggggcataatacctctatcggatgccttccttcccgtccagccagtcgtaatacatttgatgacactgatatcattagttctgctgaagcagagttggctcatgttcaaggatcatctgcagcccaaaatgttggcttaccagcttcatattcttatgctgttgcagtaggatcttccttgtcaagaagcactactcctgatccacaacttgttgctagggctcccagtccctgcatcacgcctattggtggcggcagagccattgcttctgacaagagagctattgccaatccagatgcatttaatggtgtttcatctggcatcaatgagtcagcagatcttgtggctgcattgtcagtgatgaacttgtcagcagattatgtgttagatggtgcaaaccatttgccatcacaggttgaatcagatgtagatagtcataagagatatctttttggtaggctaggtggtcaagatcatgggaagcaacaggcttatttaaagaaatctgaatcagcacacttgcaaaattcaagtaagagcagcaggagtgggtcaggtctcaacaatccatccttggataggcaggttgagctacaaaagtctaccgttccttccaataactcatatttcaaaggatcgcctacctcccattttagtagaggaggaagtatgccacttcagtaccagcctttagatggtacaaattcatcatttactaactacggtatgagtggctatgctggaaatccagcactggcatccttgatgactaaccaacttggcactggtaatctgccacccttgtttgaaaatgttgctgcagcatcagcaatggcagcccctcgaatggactcgagaattcttggaggtggtttggcttctggagctgctgctccatctgatgtgcataatcttggtaggatgggaaatcaaattcaaggcagtgctcttcaggctccttttgttgatcccatgtatcttcagtacctgaggacacctgagtttgctgcagcacaacttgctgctctcaatgacccctctgtggacaggaactacttgggcaattcatacatgaatttgcttgagctccagaaagcttatcttgggtctgtcctctcacctcagaaatcccaatacaatgtaccgccgggtggtaaatcaggcagcttcactcctcatggttattatggaaatcctgcatatggtgctgggttgtcttacccaggaagtcctatggcaaactctgttgtgtccacttctccagttggatctggaagtcctgttaggcacaatgaactgaatatgcattttgcttctggaatgaggaatttagctggggtcatgggaccttggcatgtagataatgagaacattgatgaaagttttgcttcttctctgttggaagagtttaaaagcaataaaacgaagtgttttgagctgtctgaaattgctggtcatgttgttgaattcagtgcggatcaatatgggagtcgatttattcaacaaaagctagaaacagctactacagaagaaaaaaacatggtttatcaggaaatcatgccacatgcccttgctttgatgactgatgtctttggtaattatgtggttcaaaagttttttgagcatggacttgcatcccagaaaagagaattagccaacaaacttcttggccatgttctggcacttagccttcaaatgtatggttgccgtgtcatccagaaggccattgaagttgttgatctggatcagaagatagagatggttcaagagcttgatggtaatgttatgcgctgtgtacgtgatcagaatggtaatcatgtcattcagaagtgtattgaatgtgttcctgaagatgcaatccactttattgtgtcaacattttttgatcaagttgtgacactctcaacccatccatatggttgccgggtgatacagagagtgctggaacactgcaaagaccctacgacacaacagaaagttatggatgaaatattaggagcagttagcatgttagctcaggatcagtatggcaactacgttgttcagcatgtgctggaacatgggaagcctcatgaacgttcttctatcataaaggaattagcaggcaagatagttcaaatgagtcaacagaagtttgcctccaatgttgtggagaaatgtttgacctttggtggtccttctgagcgccaattactagtgtgtgagatgcttggcaccacagatgaaaatgagcctcttcaggcgatgatgaaagatcaatttgcaaattacgttgtacaaaaggtgctggaaacttgtgatgatcaacaacgcgagctgattctttaccgaattaaggttcatttgaatgcattgaaaaagtacacctatggaaagcacattgtcgcccgtgtggagaaacttgttgctgctggagaaaggagaattgctgctcaggctcctcctcaacctgcttag

SEQ ID NO: 12623 - DNA, 222 bp, Glycine max
  Peptide Sequence Number=SeqID_129401
atggaagaagatgaaggaaaatgtcttctccagcctctcaatcctatttctctttgttttacacatagtaaggcttggctagactctggttgtggtggtgcgagagtaagtgaaaatccgctaagcgagcttggacgcgctaagcgtgagaagagacaacgtcctcgctgggcgagcatgttgcgcgttgagcgcgcagatctctggcttatcctcttctag

SEQ ID NO: 12624 - DNA, 657 bp, Glycine max
  Peptide Sequence Number=SeqID_129402
atgggaatgagatttattatagatacctccatatgggatgggaaaaagattctggatacctccatctatgatgggcaagacagttgttattgtaacaaagggtattacacaaatgatatgagagcaaacctttctcccagtacggtgtggtttgaggacgaaccaggcaaaatctcatgggcctgtaacacccttagcgaatcacaccacaataagagggatctagaggttgtgcaagtttttaatggagtttctaaagaactgattgttgttgggttttggctcaaatttgagaaactcttcatgatgatatcaatctacaacaagttgcttctgaaaagacgatatttaggtctccgaatgaggaaaggtatgccactaaagaaacatattgatgagctaaactctattctaatggaactatgtgaaattgatgtcaagaaggaagataaagatctaacaatgattctattagcctttcttcctccttcctatgaaaattttgtgagttctcttagtctaagcaatgacttcattacccttaaagaagtcaaggctagtctctattctagagaacttctagtaaaggcatcaaggaataatgatgaagcctctacattcggattattggtggttgattctgctaaagggcagtag

SEQ ID NO: 12625 - DNA, 291 bp, Glycine max
  Peptide Sequence Number=SeqID_129403
atgactagaagcaagagaattcaagaggactctgaggagaagaaaaattctttcctaaaagctgcagatgacgtctttactgagaaggaccaagcacctaggaaagttgaggtttctactaatgggaatccagtggcaagcaaagagggtaagaaggaggtactgagacctcctcatgtaagtgttctctttcctcaaagattgaaagacaagagtgaagatgaacaatttgctagatttgttgagatgcttaaaaagaagtgcataatgatccccctagggataccaaag

SEQ ID NO: 12626 - DNA, 528 bp, Glycine max
  Peptide Sequence Number=SeqID_129404
atgatggatggcatatttttctttttgaaagagcaaaatagtttagagggacgccacaggacacttgccaccttgatgcgtgttatcattcaaaagaatttgaaaaactgggagaaatattgtttgccacatgttgagtttacttataataggtctattcattctactatttcttattctcctttcgaagttatgtatggctttaatcccttgactcctttggatatcctacctttgccttctaatgactatgttagctttgatggtaagaaaaaggcagattctatcaaggagttgcattcaaaagttcgagcgaccattgagaagaagaataaacaatatgcaaagcaagcaaataagggccacatcaaagttatttttgaactaggagattgggtctgggttcatgatgaaatcctacccccaagggcctcagatagaagactccaaaaagattgggccagagatgcaagagaaggccctagggttctcatgagccttagggtagattttgggcccgtggactaa

SEQ ID NO: 12627 - DNA, 503 bp, Glycine max
  Peptide Sequence Number=SeqID_129405
agggtgagaagatcaaagagaaagtaaagaaggtagatgagaatgaagttgttaggttgataaaagagcaggaggacaaaaatttggaaatttcagctttgaaggtagaactggaaacaactataagaacatatgaagtacaattctcacagatggaagaagaagctaatagttttaaagcagcattgacacggaaggctgaaaagatcaacgaggaagtaaaaacgacagatgaagaggaatctattaaattcatgaaagaacaggaggacaaaaaattgaaaatttcatcattaaagcaatgttcacagttggaagaagacgctaaagatgctaaagcagaattgacacacaaggcccaagaatatgagaatcaattggaagcattagggaataagtttgctgcacaaggtttagaggcaagtgtgaacctaaaagtcaagtttggaagatataagcattatcctgcctattgctcaaaagtcaagtttggtacggcataa

SEQ ID NO: 12628 - DNA, 375 bp, Glycine max
  Peptide Sequence Number=SeqID_129406
aaaaaactggaggaagttgttcaatctgaaagcactaaggccgtgattgatcctccttctcccattagacgacacgtgaagtggaagataatccgcaccaagaaaacgagccaaatgacatctgaggcagcaaaggaaattgctgagaagattgcgtcacagggttcctttgtcccccatagacgtcaggatgtcttgactgctgccattgggcgaccagaacaccctggtcgtgtgcatgctgctggagccggtggacttgcactgccttcggagcctgaggatggtcccttagctggtcgtgtcagcacaaaggggagttgtgttgatccctcagggaacgatccagacacgggtgactcagacaaatacggg

SEQ ID NO: 12629 - DNA, 414 bp, Glycine max
  Peptide Sequence Number=SeqID_129407
atggcttctatgatggatgccatgctggggatgaaacaactaatggagagtaacgtggccactgccgttgccattagctcgactgccgaggcagacccgactctctcgactgttgtgcaccatcccattccaaacatggtgggacgagagagaagcacaccggggcatattagcaaccccatccggggtacaactgaggtacttacccctacggtttaccacccaattacacatcaccagccatacatgaagacatgggtcacgttcctcccctcatcctcgaagggaagcctcctcggcatcctgacggggtccacgagaatcctcaagagcatgctcagggagacgtcgactcctactccccgtttcccgctgaggggccgacgcccaacaccaatgattatcctttcgtag

SEQ ID NO: 12630 - DNA, 366 bp, Glycine max
  Peptide Sequence Number=SeqID_129408
atggcccgcaccaagaaaactaagcaaatgacgtctgaggcaacaaaggaaattgctgacaagattgcctcacagggttcctttgtcgcccatagacataaggatgtattgactgttgccattgggcgaccaaaacaccttggtcatgtgtgtgctgctggagtcggtgtcatgatcaagcaatactttggaccggctccaaagggactcacaatgcctcctaagcctgaggtttgtccttcaactgctcgtgttagcacaaaggagagttgtgttgatccctcagggaacaatccagacacggtcaaggttggtgttaagaaagttacaaatgcatatgctcacattcctgtacccactgaagag

SEQ ID NO: 12631 - DNA, 186 bp, Glycine max
  Peptide Sequence Number=SeqID_129409
atgaaaggaagatgtgctctatgtgaccttcatgccaccttgaacgcatttggccatcaagctagtgacattaaagaagagcttattgggagtgtgcgctcagtgtgcaagtgcaagctcagcgtgaatgggcaactggctaagccagcatgtcccgctaagcccaaaaacgtctctgttttgtaa

SEQ ID NO: 12632 - DNA, 1224 bp, Glycine max
  Peptide Sequence Number=SeqID_129410
atggagcaaaaaggaggtgtgcttatgcaacgatatgaactggggagattattaggccaaggaacctttgcgaaagtctaccatgctaggaacatcataactggcatgagtgtggccattaagattactgacaaggacaagattctgaaagttgggatgagtgatgaggctaatcaggcatccacatgtggcggtgagctcttcaacaaggtatccaaaggaaagctcaagcaggatgatgctaggagatattttcagcaattgatcagcgctgttgactactgccatagcagaggtgtgtgccatcgcgatcttaaaccagaaaatcttctactggatgaaaatgggaatttgaaggtcacagatttcgggttaagcacccttgctgaaactaagcaccaagatggattactccacactacatgtggtacccctgcctatgttgctccggaagtgataaacagaaggggttatgatggagccaaagctgatatatggggagagttcaaatttcctaactggattgcaccagatctacgcagattgctgtcgaaaatcttggatccaaacccaaagacaaggatatcaatggccaaaatcatggaaagttcttggttcaaaagggggttagagaagcctaccattactcggaacgaagaccaagaactggctcctctggatgctgatggagtatttggagcttgtgagaatggagatcctattgaaccggcaaaagactcaaaacgttgtaataatttaaatgcttttgacatcatctcctattcctcgggttttgacttgtctggtttgttcgaggagaccaatcgaaagaaagaagcgcgtttcacatccgacaagccggcctcaatcatcatctctaagttggaagaaatttgcattcgtcttgggctgaaagtgaagaagaaagatgggggtttgttcaagttggaaggttccaaggaaggaagaaaagggtcattgggtattgatgctgagatttttgagatcaccccagtcttccatctggttgagttaaaaaagtccagtggagacacattggagtaccaaaagcttttgaaacaggaagttaggcctgcacttaaggacattgtttggaactggcaaggagaacaacctcagcaattgcaacatggagtggtgcagaaagaggaacaaccttcttatcctggcatatcagatgttgcaccgccacaaactgcgtaa

SEQ ID NO: 12633 - DNA, 662 bp, Glycine max
  Peptide Sequence Number=SeqID_129411
atggctgaccaagtcgctgtcgctatagaaccagtggatctacagaagcatccttcagggatcgtgcctacccttcaaaatattgtgtccacagtcaatttggactgtaagttggacctcaaaacaattgcacttcaagctcggaatgcagagtacaatcctaaggcaattgcctatcctgctttctggattgttttctgttcctttctggaccagagaagtgtgcgttttgctgctgtgattatgaggataagagatcccaaaacaactgctctaatttttgcttctggcaagatggtttgtactggagctaagagtgaacaacaatctaaattggcagcaaggaagtatgctcgtattatccaaaaacttggcttccctgccaaatttaaggatttcaaaattcagaacattgtcggctcttgtgatgtcaagttccccatacggctggagggtcttgcatattcccatggtgctttctcaagttatgaaccagagctgtttccaggactaatctaccgtatgaagcaaccaaaaatagtcttgcttatatttgtctctggaaaaattgttctaacaggagccaaggtgagagatgagacttacactgcctttgaaaacatatatcctgtgcttacggagttcaggaaaaaccaacaatg

SEQ ID NO: 12634 - DNA, 276 bp, Glycine max
  Peptide Sequence Number=SeqID_129412
atgaacagagcctattcgtcttggctcgccaaggttctcgcctttgcttccaaacatttccttggtactccaaccaccctattttcaacttgcttccccgggtccaattcctgtgccgagattttgattattttggaaatcctagccaaagaaggattgaaccctgagaaaagatacggtttccttcctcctagagggcatcccaagatctcttcaaactattctatcgtgggtgttaactggaagtccccaaaggtgaagcatctcaaaggctga

SEQ ID NO: 12635 - DNA, 180 bp, Glycine max
  Peptide Sequence Number=SeqID_129413
atgtatgaataccttgaagaggaaagagtcccttatcctgagagtattttggcagacttcatgacataccaagccatctctaaaggaaccagtcttctgcaggctatcactaggagtcatgctggcaaccagattataatgataaagcagaatgagttattaatctggatgacctgctaa

SEQ ID NO: 12636 - DNA, 159 bp, Glycine max
  Peptide Sequence Number=SeqID_129414
atggtggcgacgaggtctttgtgggggttcaggttaataaaggaggtagcgacgagggtttgggtctgtggtggtgacaacaaggttgtcatagggagtttagcaacgtggtggcggggtggggtcgtggtggcagtgatgtggttgctaatgttatga

SEQ ID NO: 12637 - DNA, 789 bp, Glycine max
  Peptide Sequence Number=SeqID_129415
atgtggagagagagagcgttattggtgatcctgctactgcttctagtccagcaaatttgtgctaccaagaagcaagatcatggttgccccctttcttcctgcggcaaaatcaccaacataacttacccatttcgattaaagggccaccctaaaagctgcggcgacaataggtatgagctagcttgtgaaaacaatgttactgtgttacatttgtactctggaaaatatcatgtgcaggcaatcaactacaataatttcactatccgagtggttgatccaggagtcgatcaacaaacaaattgctcctcccttcctcgctatttcttgtctcgctccaatttcactgatacttacaattatagatacaacatggatccataccaagctggtcgtagtaattgggacaggcttgctttccagcatatagtgtatatgaattgtagcaatccagtgactcagaatggtaagtatgtggatactgcttcatacgtcaactgggactccaaagataagtacatatacgctattgctggtgacttaaaagcagaggacttccaagttggttgtcacgtaaagctggttgctctgacatcttggtggggtttggatacaaacaattattcctacgctgccatgcacacggggctagtctatggatttgagatttcatggatgcgcctcatatgtgaccagcactgtccaagtaaacacggctgcgacgactgctttttcgactctgtcagccaggagcttaattattggaacgggaattcattatggagtgagtga

SEQ ID NO: 12638 - DNA, 357 bp, Glycine max
  Peptide Sequence Number=SeqID_129416
atgtttgacatcgttacaccagttttggcttacgggatgcagcgaaattcgttggatttgagatggttcgaagcaaattctagtaagtgcaaagcaaaaggaaagaaatgtaaatggaagaacaacaaaggttcgattcttttggggttcatagttattgccatttttaagatcatataccattttagacagaaagaagaggaccaagcaagggggaagaagttcttagaggaatacagggcagaaaagcctgcaagatttacttatgctgatgtgaaaagaatcacaggtggttttaaagacaagttaggggaaggagctcatggggttgtattaagaggaaaacttttcaattga

SEQ ID NO: 12639 - DNA, 471 bp, Glycine max
  Peptide Sequence Number=SeqID_129417
atgacgccatttcggatgcctctaagctccttgtctttcttcaacgaacttctccacgccttgtggactctttgtatcaccttgagactttgcgcgctggattcctcacaaggaaaggcgagagactttctttggtgtgaaatcaaccacaaacagagagcgggtaaacaacagacaatccgcgcactgtttttctcacacctccggtcaaaggtgtcaaacaaatctgccaagatagccactgttgcaacctacccttcggcgggagggcgacgcgagactcgcgggatgcgtgttccacgaaaggaatacgcgcggagtcgccaccaatgtttatttgaggaaaacgtcggaaaaaccgacaaagacgcgatctacgaacttttaaatgaaaaggttcgggagttgtatttacgcacggggaaggtattagcaccccacacgtccgtcccaagggacggcagcctttaa

SEQ ID NO: 12640 - DNA, 632 bp, Glycine max
  Peptide Sequence Number=SeqID_129418
ttattgccatttttaagatcatataccattttagacagaaagaagaggaccaagcaagggtgaagaagttcttagaggaatacaggacaaaaaagcctgcaagatttactaatgctgatgtgaaaagaatcacaggtggttttaaagagaagttaggggaaggagctcatgggagggaagaagggaaagagttcatcaatgaattggaaattatgggcaaaatccaccacatcaatgtggttcgtttgcttggctattgtgctaaaggaatccatcgtgctctggtctacaatttatttccaaatgattcgctacaaagcatcatatttccaccagatgataagcaggatttccttggctgggagaagctgcagaacattgctcttggtatagctaaagggattgagtatcttcaccaacagctagaggaaccttgggatacattgcacctgaagttttctctagaaactttgggaatgtcttataagtctaatatttatagttacagaatattgttagacatgtcttctccacaagatttccatgtgttgtatccagattggatgcatgacctagttcatcgagatgtgcatatccatgttgaggatgacggtgatgttaaaattgcatag

SEQ ID NO: 12641 - DNA, 207 bp, Glycine max
  Peptide Sequence Number=SeqID_129419
atgactttgtggcttccgttgcactcatcgcacactatgaatctgaagcctccgcaagaatcacaggtgttgttttggttggagcgcaagaggcgtttgatgagctggtggagctcgtcgcggaagtcggtgatgctcttgtgcggccgtgagcgggtggccaaggcaagagtcaaaggaagcgctagagagtggagggagaaatga

SEQ ID NO: 12642 - DNA, 1380 bp, Glycine max
  Peptide Sequence Number=SeqID_129420
atgattcaactcaaacgccctcagagacatgttgaaactccaacaactccccctaccatccaaaccatggaacaactcctccgagctgaagaatcctccaagtctaagcggtcaccaaccttctcctcctcctcctcctcctcctccaactctttttctccatcttcccctttcttccaaaggttgaggcaccatgactcagaagaagaccatggccagaatcagaagaaatcagttctcaccaaggtgaaggagaaggccaagaaacttcgacacagcctcagcaagaggagacacgaggacgggagccccactagtccctcatccggtgatggagtagaagaagatgctgaatacctcggagctcctatgtacaaatcggagaagtcacctcaaggatacgaagcaaatgcaaggcagcattcaagtccaagaggaaatccagtattcccagagaagcatgtgttatcaagcagtgacaaacacgtggtggaactagatcatcaagaaaagacactaagccgctccatatctaagaaaacagcaacacaacctgcaacaacaatctcttctccaaatgctaccactgccactacttttaatactcatacaaatactaatgctctttttggtccaaacaagacaatgactgaaaccgtagcaaagaaacccacaccagttcatgttcaaaaaccagatgcagctcatataacctccaaaattcaagaccgtactgtgtccaaacccacagagcatcatgatcacccttcaccattaacggttaagacagctcgcaacacttctttgtcctatgctgctccatgcactccccctgcaaagttaccctccgttgttgcttcaagcactctggaaactacaccggcttcagtgacaccagctccttcgtctgctccagcatttagtgggaagaacacaagtcccaccgcgaaaatatgggacaagggtgtgtcaatgaaagagtatttgctgaacaaattggagccaggggaagatgagaaggcgctgtctcaggtgatatctgaagcaatgagtcctaggagaactcccggtgatgcaggcgtgatggagaaagtgaaagaagttgtaacttctttgctccgaactgaggaaccaacaaaatatgcagacatgactactaccgctactgctaccagtactactactcctactcgcatatcgcgtcaaagcccggtatctaccaacgcttcccgcatttcatctcaaatgtcagcatctaccagtgcttctcgtccttcatctgaaatgccagcatctaccagcggttctcgttcttcatctcaaatcccagaatttttcaacgctcaacaaggtagcaatgtaccaataacagttcattaa

SEQ ID NO: 12643 - DNA, 2173 bp, Glycine max
  Peptide Sequence Number=SeqID_129421
atgacgaaggtgaatatggaagtgattaagccttggatcaccagaagggtgaccgagcttcttgggtttgaagatgaagtgcttattaacttcatacacagtcttctggatgcaaaggaagtgaatgggaaagaagttcaaatacaaattacaggatttatggaaaagaacactggaaagttcatgaaagagctttggatgctgcttctcagtgcgcagaaaaatgccagtggtgttcctcagcagttcttggatgccaaggaagaagaactcctgaagaagaaggctgaaagtgatctgattgcaagtgaaattcagaggaaaaaagataaggaaggtagagagatcatggaagagaggttgaagaaactggacggtggatttgattcgaaggataatgatactgcatcagatccaactttgaagcccagggattcagggtactacgagcgggatgggaaggaaactgataagaggaatggtgtaagagcaaggagcaggttttctaggtctccacattcacctgcagtttccacttcgcctcatcgaggctcaccttcaaggtcaatgagcaaatcattttcaaattctcgaagttattcaggacacaggtcaaggagtatatctaggtctccagaggctcgaggtcgctctcgttcttttgaaaggattcgtcattctccacgacgacggtctatttctcctcacaggcattcaccacgacgttctccttataggaggataccttattcaagaagatctagatctccttctcctgtacgacgtagaatgcattctccagttcatcgtagatcaccatcttttcgacgacgtagatcaccttctcttgtgcgacggcgtagaccaccttctccagtacgtcgacgtagatcaccttcccctgtgcgtcggcgtagatcaccttcccctgggcgccgacgtagatcaccttcccccgggcctcgacacagatcaccttctcccgggcctcgacacaaatcaccttctcctgggcgccatcatagatcaccatcacctcttggacgacgaaggtcactctcacctagacgacgaagatcagttgttactcggcataggtcaccttcactagtacgccgaataccaccaaccaatgtgcggagaagatcagactcccccatgcaatccccctcccccatacgacgaaggtatggtagtagaactcctccacactctccatctccattgcgacgtagatcacctattcctggtaagcaaagatctcctagtatctccccacagaggtctcctcgagatgaatggagttctcaatctccaatacggcgtgtatctccatctccaatcaggaaaaattctccaagacacaaaagaagtcccttgccgtcttctatggggagagtcagaacacaagaaagattgtcatctgagactcggcaaccctctagtcccctggggtctacacgaagagataaaagtggcaaagcttcacactataaatcacaagattcaatgtccacacaagagaagtctccaattcgatctgtatctccagaagagaggagtgagacaagcagtgaaggtcgaagtcctcatgagagccctatgaaacaaagaagagaaaagttgtccaatgaaagaagcatgagtcctctgaagaaacaaagaacccagaaacctagccgtgacagcccagatacaagagaagaagcagaagaaacatactattccagagaaagcagagatccaaaaatgaattcatcacaaaagatatcaaaacattcccccatcagtaagcgaaaaggttcacctgcaaaatttcgtcatgaggatttctctcctgaaagggtgtcaggtcatacagcttctgaacatcattatgataacgatgattggagtaagaaaggccgggagataaaacgtgataaatcttccagacaggacaatgaatttcctgctcaaaagtcatcaatcaacaaagaaactttttccagggagaagcctcaagaatcttatgctgtagatgttaaaaaatcagatgacaaggaccaatcccgttcaaactatgccaaaagtagtggtcgacaccacaaatccgaagccactcaagatttagttggaaaaggtgatcgtgtcaatcacagtgcttcatatgattctgtttctgaggatagtg

SEQ ID NO: 12644 - DNA, 174 bp, Glycine max
  Peptide Sequence Number=SeqID_129422
atggctgaccttggaggttcatttatcattaggagcaaggtggcggaggaattaggcatggggatgcccatgtggccatgggcatggggcatgccggacatcatgggaggggggtatggcatggacatcatgggagggggatatggcatggacatcatgggaacagggagatga

SEQ ID NO: 12645 - DNA, 717 bp, Glycine max
  Peptide Sequence Number=SeqID_129423
atgttcgccgctggatcgatctcattggctcctgcgctcgctgcggcttctacgatcacgctctcgccgtgttctctgagatgcaatccgttcaagggcttacgcccaactacttctttgattgttatgtactccaagtgtgagaaagttgaggatgcgcgcaaggtgtttgatgggatgactgtgaaagacactggtgctgcaaatgaggcactgggtttggtggaaactatgaagttgatgggtttgaagccaaatgtgaagggtgaccaaggaatggtgtttgagatttttaggttgatgattgcagatggagtggagcctgatgttaaatttcgtaataaggaagcatttgatacgtttaagcaaatgttgagtcatgggtgctgcccaacttcggctactataagcacccttttgcctgcttgtgctactgcagcaagagttaggcgaggaatttgtttagtaggatgccagagaagaacaccgtacgttacgtggaactctatcatttttggttttgtgaatcacgggtattgcgaggaagctattgaactcttcaatcagatggaaaaggaaagggcagccaagctggatcatttaactttcacagcagcactcactgcatgcagtcatgttggagatattgaacttgggcagaagctattcaagattatgcaagaaaaatacagtattgaaccaccgctagagcattag

SEQ ID NO: 12646 - DNA, 1320 bp, Glycine max
  Peptide Sequence Number=SeqID_129424
atggcatcaacttctctcttcaacttcagactccctctgttcaacttcaacccactgcaccatcgacggataaagaggccaaaatctctgctctcctctcctcgcaacagtccacgcctcgtttcttccattaacgaccatttggcgctcacacgtgtcacatatccgcttctccaatctcactctgctccgaagcgcagattccacgttggtgtacagaaagagtattctgatggggaaagctctgagtcgattgtttctgacgctacataccaagaggaattttcctggtcttctgtagttcttccgtttctattccccgcattgggtggcttgttatttggttatgatattggtgccacctctggcgctacaatctcactgcagtcacctgagcttagcggtatatcatggttcaatctttctgccattcagcttggactagtggttagtggttccctatacggggctcttcttggctcgcttgttgcatttgcgatagctgatttccttgggaggaagaaacaactcattactgcagcactgttgtatttgtttggtggtgtgattactgcctatgcaccagaacttggtgttctcttagcaggaaggctgatttatggacttggtataggtttgcttggttattttgtgggaagctttctgattgagacagttggaggatggcggttcatgtacggatttagtgctccagttgctgtattaatggggcttggaatgtggactctccccaattctccacggtggttgcttctcagagcagtgcaaggaaaaggttcttttcaagatttgaaggaacaggcaattgcttccctgagcaaattaaggggccgaccacctggtgacaaagaatctgagaagcaaatagaagagacccttgtctcattgaaatctgtctatgcagaccaggaatccgaggggaatttcttagaggtgtttcagggtcccaatctgaaagctttcataattggtggggggctagtcctatttcaacagagtgctggattttctgctgcatctgatgctacaaaagtttcagttgttattggcctattcaagttactaatgacttggattgctgtcctaaaagttgatgatttggggagaagacctctgctgattggaggtgtcagtggcattgtaggaattccatcacaatttaaactaacagattcttactatgctgcaacttgtcatatgcaaatggtaaatgtcttttggtcaggtttggtcattggccctgcttctttcattatcatattcaacccggggatggacttcttctacagtagtgtttaa

SEQ ID NO: 12647 - DNA, 495 bp, Glycine max
  Peptide Sequence Number=SeqID_129425
atggaatctgatcatcatcatgaagcagcatcagacaatcatccctctgatggagaggagcaaggtgcaagtcacgtgacatctaggtcctacgagtgcaacttctgccggaggggcttctctaatgcacaagcactagggggacacatgaacatccacagaaaagacaaagccaagctcaagcaacaacaatcttcaaaccaaattcaacaggatccggccaagtctggtggtgaagagagtaacaaaccaaactggaattggaatgtgtctccacaagaacatgtcattcacaagaggcatcagcttccactctttgccgaaacaccaactagcagtgaaacacaaaagccacaaggtcaaactcaaactactactgaacaaactttgttatctactcatcaagattcctcatcggagttagaccttgaactaagactaggacctgaaccacaggattcatcagcagaaacggatacaagaaattttttttga

SEQ ID NO: 12648 - DNA, 252 bp, Glycine max
  Peptide Sequence Number=SeqID_129426
atgactttcctcctcgatatttcgaagtctatagtctccaatatttttactaaatcaaatttaaaccggctttgtagagtaggggacgaatctcacctgatctggcctcacggtgtagggacgatgcagatagaagtaagatctgagtgcttccgaaacttatttgtgcaaactatagacttcgaaatattggggaggaaagccactctcgggaagatgttggagaaatgtaggggtgtgcaaaaattttga

SEQ ID NO: 12649 - DNA, 703 bp, Glycine max
  Peptide Sequence Number=SeqID_129427
ggagttggcacagcttggagtcactgtgcacacttgcgctcggaacgaagctgaactcaacgaatccttaaatgaatggaacacaaaaggatacagagtaactggttccgtctgtgacgtggcgtctcgtgcagaaagacaagacctcattgctagactctcctctgagtttaatggcaaactcaatatacttgtaaacaacgtgggaacaaacatatggaaagacctcttggaatacacagaggaagactttttatttctggtgaatacgaatttgcaatctgctttccacctatgccagcttgcacatcctctcctaaaagcctccgaagctgcaagcatcgttttcatatcctccattggaggtgtggtatcaataaatttaggatccgttgtatatagtgcaacaaaaggagcaatgaatcaaatgacaaaaaatttggcatgtgaatgggccaaagacaatataaggactaattgcgttgcaccaggaatgatcagaacccctgctgctgatgagtatttaaaagagggaaaaattgctaatgcatacattccacgaacccctcttggacggttcggagaaggagacgaggtgtcttcggttgtggcattcctctgcttacccgcagcctcttacgtaactggacagataatttgtgttgatggcggcttcactgtcaacggcctatacataagctag

SEQ ID NO: 12650 - DNA, 264 bp, Glycine max
  Peptide Sequence Number=SeqID_129428
atggggttgcagaaaggaaaaatcaacatctccttgaggattccactcctacaaagaatgacaaagaccctgaaccagcatcatcaccagttcaagaatcatgtctccgaggatggagataaccactcagtcaacaagaatcatgtcttcgaggatgcagaaactaaaagttatggtactgacgaggaggaaggcacgctgcctcatgcttggatgaaaaaggtggaattacccactttcgaggggatcgaaccattgagctag

SEQ ID NO: 12651 - DNA, 195 bp, Glycine max
  Peptide Sequence Number=SeqID_129429
atggccatgatagataaagtatgtaaggaggaagcaaattcatttatcctgtttgatcctgatgttgtaaagggtctttatagccggggattgatctattttgatgttcctgtatatcctgatgatcggtttaaagtcgctcatccggcgacctttctgtctaatgaccccatcacaggcatcgccgtccactga

SEQ ID NO: 12652 - DNA, 393 bp, Glycine max
  Peptide Sequence Number=SeqID_129430
atgccaccaaatagcaatggcgttgcgggtttcaaatggcggcaccatggtggctgccataggcttaacagtggtggcggaatggcgcacgcagcacgcgaactccagcgccagcacgagcagcacacaccagcgcgagcagcaggcagcaggcagcacgcaccagcgacgacagcaccatgcactagcgcgagttctctcacggtctcacccgaagttgacgacagcaccacgcaccacacacacgagcaacggacggcaacggcaacggctacagactgcgacggcaacaccctgccctcttctactaattacaatggcagcaaccatcatctaatgttgcaacctttactttgcactttgcattatgcttttatccttttgttattttga

SEQ ID NO: 12653 - DNA, 1167 bp, Glycine max
  Peptide Sequence Number=SeqID_129431
atggaacacgagaaagcccctatcttggttgaagaaaggacgatgcaggaaattgagattcccattgcctctgaaagacttgatgttcttcctatgaaggcagactcatcttgcagttctgtttgtcctttttccggacaagaaaacagtgttgtggcatcaaaggagtcttcaaagtcagcaaagaaactctctggactcattgttttctatgctattgttatggttgtggaacttattggtggaataaaagctcacagcctagcagtcattagtgatgcagcacacttgctttctgatattgctggattctctatctctctttttgcagtgtgggcttcaggttgggaggcaacaccgcaccaatcttttggatacaatcgtcttgaggttttgggggctcttgcgtctgtgcagttaatttggttgatatctggttttttgatatacgaagcaattggtagaattctcgtccgaaatgccagtgtgaaaggaaagctcatgcttgcaattgcagcacttgggtttgttcttaacttcatcatggttgcatggattggtcatgatcatagtcatcaccaccatcatcatcatcatggttgtgaaagctcgggtcatgatcataatcatcatcaatgccagacagatcatgatcatgggaaggaggaacaatctattataactgatgaggagaatgttaccctggtttcaagtattcagacaaacactaatgtcttgaacataaatctgcagggggcatatttgcatgtcatggctgatatgattcaatctgttggagtgatggttgctggagccataatatgggcaaaacctgagtggtttatggttgaccttgtgtgtactcttctattttctgttttgtctttaagtactactcttcccatgcttaggaatatttatggcattctgatggaaaggacaccaagtgagatcgatattagtaagctggaaaatggcctcctaaatatcaagggagtgcaggatgttcatgacttgcacgtttgggctataactgttggaaaatgtgtactgtcttgccacgtagtggctgagcctggcataagttccattgatttacttggcacgattaaacattactgtgaaaaaaagaatcaaatacaacatgtaaccatacaaattgagtag

SEQ ID NO: 12654 - DNA, 748 bp, Glycine max
  Peptide Sequence Number=SeqID_129432
atggctattaactcatcgataccttttcagcatcagttcctccatgacgaacggggcgaacatattcttccaccaataccaataccatcacgtgaccccaatcacaccaactgcaacaacaacaacaacaacattagcggacatgatttaaagccaccggagctgctcattcccgtcccaaatatgcctcacttcatgcctcaagacaacaccaaattcgattcctcaagcattggttctgaccatctggaatcgctatgggattcagttagttcgccccagtcaacgctctcgtcaactttgatctcaattcagggtagttctgaagattcttctcaggaaccatcgcctaatagctatgacttttgttggaacagcacctacgatgtggtggagatgttagagaagatgaagcttgacgaaagggacagttccaaatacaatcctggttatgggaatcacaggttggagatctcaaacgttggagcctgctctctccttcatgaacaaattcaagcaattcaattgtctcgggtcaggcaagagcagattctgtctgagaagcataaactaactgcatacagaggaaaaaatcatgggcagatatcacagcaatttcagaagaaagttaaagggattgatgatgggtgtgataaaggatggaggactcgtccaccgtggcacaatcgttcacaccagcaagctggttcaagaggcaagtcttgtggaactggtgttttcttgccat

SEQ ID NO: 12655 - DNA, 693 bp, Glycine max
  Peptide Sequence Number=SeqID_129433
atggcgcatcgagtagaccacgagtatgactatctgttcaagatcgttttgatcggagactcaggtgtaggcaaatccaacatcctctccaggttcactcgaaacgagttctgtttggagtccaaatccactatcggagttgagttcgccaccagaactcttcaggaatttgacgtcaataaacttgatgttgccatcaaaattgtggtagagggtaaaactgtgaaagcacagatctgggacacagcaggtcaagagcggtaccgtgccattaccagtgcttattacagaggagctgttggtgctctacttgtatatgacataaccaagaggcaaacctttgacaatgtccaaaggtggttgcgtgaactgagggaccatgcggattctaatatagttatcatgatggctggaaataaatctgatttgagccatcttagagcagtttcggaggatgatggtcaagcattggcagagagggaaggtctctcgtttcttgagacatctgcactggaagcaaccaacattgagaaggcattccaaaccattttgacagagatttatcatattgttagcaaaaaggcgctcgctgctcaggaagcagctgttggtaccatacttcctggtcaaggtaccaccatcaatgttggggatgcatctgggaatacaaagagaggctgctgctccgcttaa

SEQ ID NO: 12656 - DNA, 525 bp, Glycine max
  Peptide Sequence Number=SeqID_129434
atgaaggatggtaataagggattggttgcacctgatttgtgtacctacaacagtcgcatcaccgcactttgcagtatagtgtttaagggaggaaacgtagggtacataatggccttagagggcatcgtcaacgttaattcgctcttcaccttagccctcttcctcggcatcatcaccaccaccaacaccctcattcgcgacgataacgccgcatgcgccgccggagcctctatttccaaaggcttcatcgagctccacgtgtactccttcagctccttcctcttctcgagcctcatcgccttggctctcaaaaacatcatgaacttcagcaaggacgtcgacaacggtgagatcgttctggacaacaacaacaacaacaacaactgggttcatagtgttgcgaaaattaacactgtcgttttgaggttggggactcttgttttggcttttgggtcggttttcagatgcgggttcttggtgatagcgcttgtggatttggtgcagaatgtaggaagggcagaatga

SEQ ID NO: 12657 - DNA, 522 bp, Glycine max
  Peptide Sequence Number=SeqID_129435
atggccttagacggcatcgtcaacgttaattcactcttcaccttagccctattcctcggcatcaccaccaccagcaccaccaacaccctcatcggcgacgacaacgccgcatgcgccgccggagcctccatttcggaaggcctcatcgcgttccacgtgtactccttcagctcgtttctattctcgagcctcatcgctttggctctcaaaaacatcatcaacttcagcaaggacatcaaagacggtgacgtcgttctggacaacaacaacaacaactgggttcacagtgctgcgaaaattaacactgttgttttgaggttgggaactctcgtttcggcttttgggtcggttttcggatgtgggttcttggtgatggctcttgtggatttggtacagatcaagttgggaactttggcttgtggtagtcctcatacttttgctgccgtggctccattgcttgttcttgttcccactgcgctactgatctatgttgttctcgtcctctattcctttactcgttaa

SEQ ID NO: 12658 - DNA, 768 bp, Glycine max
  Peptide Sequence Number=SeqID_129436
atggcgagtcgttccttctttaaaaatttgaaaaaccgtgatttggcttcgttattactggtagaatttacgagaagtagcaaacccatcaaacacatttcttcaacttcatcaccctttgttgaatgcaattcgttcaaaacggcgtcgtgttttcggcaataccacgacggaaggcccagagggcccctttggaaaggaaaaaagctcattggcaaagaagcgctttttgtcatatcggggtttaagaggtttaacgatgacgaggataagcttcacaagttcatcaaaactcacgttctcagactcttgaagatggacatgatcgctgtcctcaccgaacttgagcgccaagaacaagtttctctcgctctcatgatgtttaaggtgatgcaaaagcaagattggtacaagccggatgcatacctctataaggacttgatcattgcattggcaagggctaagaaaatggatgaagtattgcaattgtgggaaagcatgagagaggaaaatctgttccccgattcccagacttatactgaagttataaggggcttcttgaactatggatctcccgcggatgccatgaacatatacgaggacatgaagaattctcctgatccgccagaggagttgccattcaggattttgttgaaaggacttctgccccatcctcttttgagaaacaaagtgaaacaggattttgaggagatttttcctgattcaagtatctatgatccaccacaagagatatttggcgcacgctga

SEQ ID NO: 12659 - DNA, 486 bp, Glycine max
  Peptide Sequence Number=SeqID_129437
atgagagcaaggagctcaaaatggaaacaacccactctctctcattttgagctccttgctctttctctctccacacattcaacctccgctccacccatgacctcgtcactccaaagatcgacccttccctcttcaaccagagcaccggctcctaccgccaaacctactcccacccccagcagtcctccaccactgaccgccgccgcctcgccaatcctacccaagaggaagcgtggcagaaagcccaaagtcaaactccacttggatcactgctaccacgaaatcgacataattgttaatccaaacggcgtcgttatggatctccaccaactcgccaactcccaagacccctttgctgaggaactcaagagacgcactgagggtttgcataacaaagaggagctgctagggtttctaagagacttgcctggacagtgggggagccgctggtatggagaaaggagtgagtacgttctgagaaattga

SEQ ID NO: 12660 - DNA, 336 bp, Glycine max
  Peptide Sequence Number=SeqID_129438
atgggtgcgaagtacctcgaagcggtcaagcaaaggttgcatgccatcaaacaatggtccccatacgaaattaggcaacattccgcccgacgaccacaaagccgatctccacctacggaagtatcagttggtctgtgccatcgtgacatagggatcgcgcccataagacacctagtggacccggaggagtccaatagggccctagggtttccagctttggttacgggcctctgtcagtcttacagggtgcccctcccccccagcaagggatcgtgcatgcaagacacccagtggactcggagaaatccaacagggtgctggggtttccagctctga

SEQ ID NO: 12661 - DNA, 561 bp, Glycine max
  Peptide Sequence Number=SeqID_129439
atgcaaattgcacctcttggttacttcaaacaggggtatgaattgttgcaccaaatggagccatatattaaccaggggtctagtagtcaacatcctggccagaggaatagctctgagcttgcttctggacttttaagtcgatggctgtcttttcatcatcatggtggagtacatgatgagaaatctattgctcatcacactgtgaacttgcttacatcaacaattaaagtagatactgaccaatcagatttgaggttttgcttccggttcatttcaccaacaaagaactatactttgcagttcaacatcacaggcttacaaccatttgtgaccctttttcattgggatcttccccaagctttgcaagatgaatacggtggcttcttaaatccacgcattataaatgattttcaagactacgcggaactttgttttaaggaatttggagataggttagtttacagcttcctgcgcaaggtcagatcttttcatgaatcttttctgcattctgcaggaatactagattatgtgaagttggggaccaaaccccataaattttga

SEQ ID NO: 12662 - DNA, 400 bp, Glycine max
  Peptide Sequence Number=SeqID_129440
agaaacaaaaagaagcattgctgagagaaggggtttcaattccaatgctgcaagaatcaacacagcactgtttcgcactgcaacttcaacaacaaacccttcaccttccctggccgctcgatcacctcgtctcaccatcccccctggcattagtccaaccgacttgcttgactctcccatcatgcttccaaattctcaggccatatctcccaccactggctctttcttcatgctgccacctctcagccatgaaggatcaatgctcacaactgaacaagggaatgtggatgtgtcaaccgcatctgatgtcgatgcctctttcaaattcaagcctcgtggacattttgatcctaatcatttgcctccttactctgcttctctaaatcagttgttgatttga

SEQ ID NO: 12663 - DNA, 486 bp, Glycine max
  Peptide Sequence Number=SeqID_129441
atggcatgtagagacaaattatggtcattctgtgcccttttgtcatccagaggcggcgagcccgatgacatgcggagacaaattatggtcattccgcacacctttttgccattcggagacaatcgtgtccgatggcacgcaaagataaattatggtcattctgcgcccttttgtcatccagaggcggcgagcccgatgacatgcggagacaaattatggtcattccagacaccttttgtcatccagatacgatcgtgtctgatggcacgcggagacaaattatggtcattccgcaccatttgccatccggagacaatcgtgtccgatggcacgcagatacaaattatggtcattctgcgcctttcgtcatccagaggcggcgagcccgatgacatgcggagataccattatggtcatccacgcctttcgtcaatcgagaggaacgaattcggcagtatcaggatgatgttggtcattcggtgctga

SEQ ID NO: 12664 - DNA, 1080 bp, Glycine max
  Peptide Sequence Number=SeqID_129442
gaaaggacaccaacaacttctgctgtgactgagctttcagatcctatatcaactaacaatgctaaatctctatgtatgcttgaatcggaggacactccagagctttcttctacacttgccagtcatgatggcgatgaagatggaaccgctcaagcacttgtctcagctgaagacgaagctgagaatgatgaattggattcaaaaagaaggaagaaagagagctacgcagttgaaccaaatttgccccctactagggctgttcgtgagccaagagtggttgtccaaattgagagtgatgtggacatacttgatgatggttaccgctggcgtaagtatggacaaaaggttgtcaaaggaaatccaaatcctaggagctactacaaatgcacaagtgcgggatgtatggtaaggaagcatgtggaaagggcttcacagaatctgaaatatgtcctaactacttatgagggaaagcataatcatgaagtgcccactgctagaacaaacaatcaggtaaactcaagtgatggtggtttacctcccaatggtgctaatggacaagttgctcttacattaccaaagcccgaaactcatcaaactctttttggacatcattttgatagaaaacctgaattcagcaacgagtttctcagggctagtttggtcggaagtttcagcaatgatatgaagtttggaccttctaccctttgccaaatgaagtatccttccttgaataataccatgccttatggctcctacggactgaaccatgaacattgcactgcccctcaagctggatccattgcctcaatgttccccgattttccaatgccactaccattgaatcttccctcatctggacttaattttaactgtgtcaagccaatgaatcgtgtccagtctttcctttctggccagcaggtgaaggacattgatgcagggttcctgaggcctaaacaggaacagaaggatgatactatgtacggctcgtgcatgccccccctagatcattcaaatgcttcactcacttcttcaccatcaccatccatttatcaacgtatgatgcagaatttcccttcataa

SEQ ID NO: 12665 - DNA, 1827 bp, Glycine max
  Peptide Sequence Number=SeqID_129443
gtcgactctagaggatcccacgaaatcaccgggcggcggaccaccggcattgttgaccaggatgtccacctgcgggcaggcggccagcgccgccgtgcggccggcctcggtggtgacgtcggcggcgacggcgcgcacctcaccggcaccgggcagtgcacgcagttcgtcggcggcgaccttcagtgcagcctcgccacgcgccacgatcaccacgttcacgccctcgcgtatgagcgcacgcgcgcagcccaggcccagccccttgcttgcgccgcagaccagtgcccagcggccgttgatacccagatccatgcgtcaatcctgcggaattcggagggggctcattgtccgccatcggccggtgacaggccggcaacgaagtgttgcagggcggcggccacttcgtcggcatggccgaggaagggcgcatgtccgccgtggccgatggtcagtgcctgcgcgcccggggccagtgccgcggcggcctgcatcgccgccggtgagaccagccggtcgcgctggccggcgatccacaggctgggtttgcccagcgtggccagtgcgccgcgcagatcggtgctttccagcaggcgcaggccttccagcagggcgcgttcggtgggcgcaccgcgctcgaccagccgctgccgcagcgtgcgcagctcctcgcgggcgtgcgccgagcccatcacgtccagcgcgaggaagcgttccagcgtgccgccgaagtcggtggccagctcacgcccgaactgctcgaacacggccggctccactgcgtgcggccaatcctcgccacgcacgaaacgcggcgtggcggcgatcatcgcgagaccgcggaccttcggcagcgtggccgccgcatgcagtgcgaacaggccacccagcgaccagccgcaccacaccgtcggcggtgtggccgcggcaatggcactgaccacgaacggcaggcgcagcggcgtggtgtcgtcgcggctgtggccatggccgggcaggtcgaccaggtgcagggtgaactggtctgccaggcgctgcaccagcggcgcgaatacaccgccctgcagggcccagccgtggatcagtaccaggtccggcccacggccggtgacgtcaatatgcatgggcaacgacacggaactcaggcaaaagcgggcagcggcggtggcgcggcttcacgcacggccagggtcacgcgatcgcgcgcgctggcgatggcctccaccaggccacgcacctgttccggcgtatgcggcgcggacagtgtcacgcgcaggcgtgccttgccttccggcaccgtcggcgggcggattgcaccgaccagccagccggcctgttccagcgccgtggacatcgccacggcggtgcggtcatcgccgcacagcagcggctggatcggtgtttccgaagccatcaggtccaggccatggcgacgcgcttcagtgcggaacagcgcgatcaggtcggtcagctttgtgcgacgccagtggtcgcggcgcgccaggcgcactgcttcaagcgcagcagcggccatcgccggtggcacggcggtggtgtagatgtacgggcgcgcggtttcggccagatgctcgatcaggtcgtcgcggcccagcaccagcgcaccggaaccgccccagtgccttgcccagtgtgaccagctgcagcggtacgtcgtccacgccccagcccggcggcggccacggcaccacggccatcaccgaccacgccgacaccggggcgcatcatccacatagaacagcgcctgctgtaggccgtgccacaagcgacaaatgcacgcagcggtgcgatgtcgccatcccatgctga

SEQ ID NO: 12666 - DNA, 360 bp, Glycine max
  Peptide Sequence Number=SeqID_129444
atggaaaggcttgtcattcttcctttctctgctggttgcatctctgaggccagtgttgctgttggtgttccatatccaagaagatcaaaaccagacaccaatgcaccacctcctacaataatggaaaaagatgagtttgaagaagtggaaatagacatggaaatagggtgcccaacagatgtgcagcatgtgacacacattggttgggatggcattgcaacttctgctgctgaccccatcatgaagggatgggatgctctcattcctcatgagctcctctctctatcttcctctcaatctttacagcaccaccaagaccttcctaatttggacgcaaaacatgatgattctcctaattaa

SEQ ID NO: 12667 - DNA, 810 bp, Glycine max
  Peptide Sequence Number=SeqID_129445
atggggtgctttaaagaatttcctcatgaacttgagttggcctgtgaagtgttgatgaatggaaagaagaagcatcaagtgggcctgcaagatgggcttacccagcccaaaggagcccatcatgaagacataaaaatatcaattttatatggaaaggccatcatcatggcagctgcttccccaatggcaagccaactcaagtccaccttcactaggactcttgtagctcccaagggcctctctgcctcttcaccacttcacctcgtgccttctagaaggcaatttagcttcactgttaaggccatccaatcagagaagccaacctatcaagtgattcagccaatcaacggtgacccattcattggaagcctggaaaccccagttacatccagccctttgatcgcatggtacttgtccaacctgcccgcatacagaaccgcagtgagcccactactaagagggatcgaggtgggcctggcccacggataccttctggtgggcccattcgtgaaggccgggcctcttaggaacaccgagatcgccgggcaagcgggctctctggccgccggtgggcttgtggtgatcctcagcctttgcctcacaatctatgggatttcatccttcaacgaaggagccccatccactgctccgtcgctgaccttgacgggccgcaagaaggagcccgatcagctccaaactgctgatgggtgggccaagttcaccggaggcttcttcttcggaggcatttcgggtgttatttgggcctacttcctcctctacgtcttggaccttccatactacatcaaatga

SEQ ID NO: 12668 - DNA, 834 bp, Glycine max
  Peptide Sequence Number=SeqID_129446
atgttgtctacaaattgtagacatgattttctcaacatctcctattttcatgtacaggttgctaaagatccttctggaaaggacatcaatgcacttgagcagcacattaagaatctcctatgtccatccacaccatttttcttcaacaccctttatgatccttacagagctggtgctgattttgtccgtggatacccttttagtcttcgtgaaggtgccccaactgctgtttctcatggcctgtggcttaacatacctgattatgatgctccaacacagcttgtcaaacccctcgagaggaacaccaggtatgttgatgctgttcttaccattcccaaaggaacattgttccccatgtgtggtatgaatctggcattcgatcgtcagctgattggacctgcaatgtattttggactcatgggtgatggtcaacctataggacgatacgatgatatgtgggctggatggtgtgttaaggttatctgtgaccatttgggcttgggagtgaagactggccttccatacatctggcacagcaaagcaagcaatccttttgtgaatctcaaaaaggagtacaagggcattttctggcaagaagagatcattccattcttccaaagtgccaccattccaaaagaatgcacttctgtccaaaaatgctacattgaactctccaagcaagtcaaagagaagcttggggctgttgatccctacttcaccaagcttgcagatgccatggtgacttggattgaagcttgggatgagcttaacagcaccacatccgaagaagcttcttccaagtcagccaatggtgctgctgctgctaccaagtga

SEQ ID NO: 12669 - DNA, 684 bp, Glycine max
  Peptide Sequence Number=SeqID_129447
atggtggaatgtgggactgagttctctgtggtcactttctccatagctcttattttgtcttcctctttatcactcgtggagcttgggaggcaacttcatgggatggtcttaaaatttggcttttgtagagatggttttataaggagttcacttgtagaaatgtactgtaagtgtggcagaatggataatgcatctattgttctcaaagatgttcctttagattttctgaaaaatgggaatgctggagttacttgcaaggaactgaaagcagggatagtttcatggggtttaatggtttctggttatgtttggaatgggaagtatgaagatggtttgaaaactttcaggttaatggttcgtgaactggttgtagtggatattcgaactgttacaaccattatttctgcttgtgctaatgctggaattttggaatttggaaggcatgtgcatgcttacaatcacaaaattgggcatagaatagatgcttatgttggctcttccttaattgatatgtattctaaatctggtagcttggatgatgcatggacgatattcagacaaaccaatgaaccaaacattgtcttttggacttcaatgatatcaggctgtgcgctacatggtccaagaaagcaagcaatttgtctttttgaagaaatgttgaatcaaggaattataaccaaatga

SEQ ID NO: 12670 - DNA, 3440 bp, Glycine max
  Peptide Sequence Number=SeqID_129448
gcaaatgtttcattgtttcaatgctcacctcgaggcaatccttgtacatctctccctcttctccttctccttctccttcttcttcattgttttttatcattctcctccaacttacatttctctatggccttgccttctctgcaaaccatgaagcctcaacactcttcacatggctccatagttcttctgcatcatcatcaccaccaccttctttctccaactggaacctccttgatcccaatccatgcaactggacatccataacatgctcctcactaggccttgtcacagaaatcaccatacaatccatcgctctagagcttcctataccctccaacctctcttcatttcactctctccaaaagcttgtcatttctgatgccaatctcactggaaccatcccttcagacattggtcactgctcttccctcactgtcattgacctcagctccaacaaccttgttggctccatccctccaagcattggcaagctccaaaaccttcagaacttgtccttgaactccaaccagctcactggaaaaatccctgtggagttaagcaactgcattggcctaaaaaatgtagtactttttgataaccagataagtgggactattccacccgagttgggaaagttgtcacaacttgagtctctaagagcaggagggaacaaagatattgtagggaagattcctcaagagattggagaatgcagcaatttgactgtgttggggttggcagataccagaatatcaggttctttgcctgcttctttggggagacttacaaggcttcagacactgtccatctatactactatgctgtcgggtgagattccacctgagttaggtaactgttctgaacttgttgacttgttcttatatgaaaatagcctatcggggtctattccatctgagcttggtaggctcaagaagctggaacagttgtttttgtggcagaatggtcttgttggggctattccagaagagattggtaactgtacaaccttgagaaaaattgatttctctttgaattctctatctgggactattcctgtgtctttggggggtctcttggagcttgaagagtttatgattagtgataacaatgtgtctggttcaatcccttctagtctttcaaatgctaaaaatcttcagcagttgcaagttgacacaaaccagctctcagggttgattccaccagagcttgggcagttgtcaagcctcatggtgttctttgcatggcagaaccagcttgagggaagcattccctcctctttgggaaactgtagtaacctccaagcgctagacttgtcgcgcaacgcgctcaccggtagtattccagttggcctattccagcttcaaaacctcacaaaactgcttctgattgccaatgacatatctggtttcataccaaatgaaataggcagttgcagctctctgatcaggttgaggcttggaaacaacaggattactggtagcattcccaagacaataagaagcctcaagagcttaaactttttagacctctctgggaaccgcctctctgggccagtgcctgatgagattggaagctgcactgaactgcaaatgatagacttcagcagcaacaacttagaaggtcctttgcctaattctttgtcttcactatcatctgttcaggtattggatgcatcttccaacaagttttcaggtcctctaccagcgagtttaggccgtcttgtttctctgagtaagctaatcctcagcaataacttgttttctggtcctattcctgcatcattgagcctatgttcaaatctccaactgcttgatcttagtagcaacaagctcagtggaagcataccagccgagctcggccgcattgagactcttgaaattgctcttaatcttagttgcaattcactcagtggaataatcccagctcagatgtttgctcttaacaagctttccatattggacatctcacacaatcagttggaaggagatttgcaacctcttgcagagttagacaaccttgtctccctcaatgtttcttacaacaaattttctggctgtcttccagataacaagcttttcaggcagttggcatcaaaagacttcactgaaaatcaagggctctcgtgctttatgaaggactctggcaagactggtgagacattgaatggaaatgatgtaaggaagtcacgaaggattaagctagccattggattgctgatagccttgacagtaataatgattgctatggggataactgctgtgatcaaagcaagaagaaccattagagatgatgattcagaattgggtgactcgtggccgtggcaattcataccattccagaagctaaacttttcagtggaacaagtactgagatgtttaactgaaagaaacataattgggaaggggtgttctggtgttgtttataaagctgaaatggataatggtgaagtcatcgctgtgaagaaattgtggccaacaacaattgatgaaggagaggcatttaaggaaggaaaaagtggaattcgtgactcgttttcgactgaggtcaagacccttggctcaatccgtcataagaacattgtcagattcttggggtgctattggaacaggaaaacaagactgcttattttcgattacatgccgaatggaagtttgagtagtctactacatgagaggactggaaactctctggaatgggaacttaggtacagaatcttgttaggtgctgctgaaggccttgcatatctacatcatgactgtgtccctcctatagttcacagagatattaaagccaataacatcctcattggccttgaatttgagccttacattgctgactttggcttggctaaacttgtcgatgatggtgatttcggtcgttcttcaaatacagttgctgggtcctatggatatattgctccagaatatggctatatgatgaagatcactgagaagagtgatgtttatagctatggcatagttctattagaagtcttgacaggtaagcaaccaattgatccaaccattccagatggtctacatgttgttgattgggtgagacagaaaaagggtcttgaagtgcttgatcctagcctactactctctagaccagaatcagaaatagaggaaatgatgcaggcattgggaatagccttattgtgtgtgaattcttcccctgatgaaagaccaacgatgagagatatcgctgcgatgctcaaggagataaagcatgaaagggaggactatgcaaaatttgatgtgcttttaaaagggtctccagcaaatggtgcatgtgggaataaaagcattggtggagttcttccaacatcttcttcatcagtgccagtcatgcaaactttgaaaacaaaaaacgataactcaagcttctctgtgtcttcactgcttcactcatcttcaagtgtcatgatgggttccaaatga

SEQ ID NO: 12671 - DNA, 147 bp, Glycine max
  Peptide Sequence Number=SeqID_129449
atggaatcaggaccttatcctgagcatccaggagaaccagattgttcatactacattaggactggcctttgtagatttggagcaacatgtcgatttaatcatcctcctaacaggaagctgaatatcccaaggcgatgcaatcaatag

SEQ ID NO: 12672 - DNA, 303 bp, Glycine max
  Peptide Sequence Number=SeqID_129450
atggttataagtcacatcggcacagctccaacaatgtctacaaagagtctattcttcccaataggttcttgcattggttccatcaagaagttcatggtagcatttgcattcggtgccttcaatctcaacgaccctgacattcctattagaagtgggttgatgaaacttgggaacagtgacaaggagaatcccgtgacgcatgttggttttgagttgttcgaggttaccgttgtcggggatcttaaacctcgtcaggaagttaccactctccacgctgacctggagcaccctctggtcttgtag

SEQ ID NO: 12673 - DNA, 945 bp, Glycine max
  Peptide Sequence Number=SeqID_129451
atgtattccatcgattcggtggcaagagaactacaactacccagcatagtcctcagaaccaccagtgctactaatttgctcacttatcatgcgtttgttcagcgacaaagcaaaggtttccttccctcgcaagattttatgtcgttggacttggtgccagaacttgaaccgctccgattcaaagacctaccaatgttcaattccggtgttatgcagcagcaaatagccaaaacaattgcagtaaaaccttctctgggtgttatctgcaacacagtggattgtcttgaagaggaatccttgcatcgtctacaccggatgtacgaagtgagtttcttccccataggccctctacgcgtgattgccgaagaatattcctcctatagttgctttttggatgaagattatagctgcatagagaaagagctaactgaagtggcttgtggcttagccaatagcaaacagaatttcctttgggttattagaactgggacaattaataatgatgtttcagaatggctaaaatcattgcctaaagatgttagagtggcaacagaagaaaggggttacattgtgaagtgggcaccccagggtgaggtgttggcacaccaagctgtgggagggttttggagccattgtggttggaattctacgttggagagtttgtgtgagggagtgccaattatgtgccaacctcattttggggatcagagggtgaatgctaggttgttgagccatgcttggaaggtgggtattgagtggtcctatgtcatggaaagggatgaaatagaagaggcagtgagaagactaatggtgaatcaagaagggatggagatgaggcagagagcattgaaattgaagaatgagattaggttagctgtgaaaggtgcttcttcctatgatgccttgaataggttggtaaagagcatcttatcagcgaatctctaa

SEQ ID NO: 12674 - DNA, 486 bp, Glycine max
  Peptide Sequence Number=SeqID_129452
atgggtgctcgttgctctaaattctctctctgctggtggccttcccacctcaaatcaaaccttcacaacttgtctgataatgatgatgatgggaaaaggaatgagaaggatccttgtggagggttcagtgagtacagtttggatcagttaagagttgcaacctcaggattttcaccagacaacattgtctcagagcatggagagaaggctccaaacgttgtctacagagggatgcttgaagatgataggttggttgctgtgaagcgcttcaacaagtctgcttggcctgattctcgacaattcctagatgaagcacgtgctgtggggcagctaaggagtgaaagattggctaacttggttgggtgttgctgtgagggagaagaaaggttgcttgtggcagagttcatgcccaatgaaactctctccaaacacctttttcattcaatcaacaggagagaagatctaattttgatgtcattttgttaa

SEQ ID NO: 12675 - DNA, 585 bp, Glycine max
  Peptide Sequence Number=SeqID_129453
atgattgatcttgcaagtaataagctgtctggagcaattccatctgaaatttccaagctatctgctttgcggtttttgaacttgtctagaaatcatctgtctggagggataccaaatgacatgggaaaaatgaaattgttagaatcccttgatctctcactaaacaacatttcaggtcaaatccctcaaagcttatctgatttgtccttcctcagtgtcctgaatctatcatacaacaacttatcaggcagaattcccacgagcacccaacttcagagctttgaagaacttagctacactggaaatcctgagctttgtggtcctcctgtaacaaaaaattgcacagacaaggaagagttgacagagagtgcttctgttggacacggtgatggtaatttctttggaacatcagagttttatatcggtatgggagttggatttgcagcaggattttggggtttttgcagtgttgttttctttaacagaacttggaggcgtgcttattttcattaccttgaccacttgagagatctgatttatgtgataatagttttgaaggtaagaaggttacttgggaaattgtga

SEQ ID NO: 12676 - DNA, 378 bp, Glycine max
  Peptide Sequence Number=SeqID_129454
atgggcgtcgtcaagtacatgaccatggatgaattaaagcgcctaggcatcccctcagaaatgcttaaattctttaaccattctagtttcccacacaagggacatccgacaagggtttttcaaaggaagcgtaaaaacatacaatggtggttccaaagtaagaaaagatgcaaagacaagttgaatctaacaaggaacaagcgtagaatcacggttacctcaaagaaaaccacgaaggtcagattgagcttcgttctctaccgaaaccgcgagacaagtttagaagattccgctccgattgaagggttcctctcggtgtgggttttcaatggagaactatggcggtttgtggtggctactggtggttgtgggtggtga

SEQ ID NO: 12677 - DNA, 2316 bp, Glycine max
  Peptide Sequence Number=SeqID_129455
atggtgctttcgatctatgctggggaagcgcaccgcctcgctgtagcgcagataggcacgagcggtcggcgagaaacgcaccgtcgccgagaacgtcggcaaccaggcgtgatcgcggtgccgttcgttgcgcccggccaccgactgcatcgccccgcccccgatcctgcagcggatgtcggtgccgaggaccatcggcagcagcccggggatggcggcgacctgaccgttgaggcagggattggtggcccggctgtagttgccgtttccatcgggcaaccagggaatgccgtgctggacctccctgggtgtctcgtacttgcgcagcaggtcggccagcgactgatcgacgatccagcccatgccgatgctgtcccagaattcccgctcgctctcgagtgcgtcgatctcgccctgcaggctgtccggccgcggcggcagttcattcacccggtactgtgcttcgcgcggcacgatcgaggtcgtctgcagttccgggtgggcctgcaggaagtcgtcgaacgcccagtaacggctgtaacgcacgccggcattgagggtcaggaagtcgaccggacgccattccagcgtgaggtagccctcgccctcctggcgacggccggcacgcgggtacatgcgccagccgtcggacgggccgaaatacgggtcacgcgaaccgagcttctcgtattgccagttgccgcccacggtcaggtccagggtcgaacgcagggcgaagcggttgctcagggtcaggccggtccggtcgttgctcgcatttgccagcgcggtgttgcgcagaatcgggctggcgccggcattccagtccggattgcccggggcgaagttcggaaagccgcctgcggtgtaggtatcgctgtccgtctctgtgcgccacaggttggcgtagatgtccagccagcggctgccggccggctggaagcggtactccagattccaagcatcggacgcaacccggctgagcggccactggatgcgcccatagtccggtgccgacaggatgcgcgacggcatgatctcgccgtagtgcgacagcgttcgccgccaggtcgccttcaactgctggtcatcgttgatctgccagctgcccttgaccagccaggactcctgttcgctggaagtattgggcacttcatcgcccggcttgaagtagcgcgccagcgtggtgatgtagtcgatgccctggtactcgaactgctcgcgccggtcctggtcgtagtaggcgctgccctgggtcccggagaagtagttgccgcgcttgcgccaggcgtaggcggccatcaggtcgacgttgtcgccacgcacgcccagcgccaggcgccaggcctggtcctcgccatcgaaggggttgttgccactgcgcgacttcaccggcaccaccagggtgcggtcgtcgtagggcgagttcggcgagccctgcggaaaccccggcacggtgcggtaatcctcgccggtgtgcagccgcggcaggcgtggcgccaccgcattgctgctgccttcgatcttcagctccccgccgaagcgctcacccgcttccacgatgtcatcgacgtcgatggtcttgatcaccagcgcgccaccgatcccgctgtgcacatcgcgcaccagccctggccccttgatgacctggatgccacccatcaggttgggatcgatgtaattgcggttgctgacgccgttgtagccgcgccagaccgtgagcgcctgttcgccaccgtcgatgctgaccggcacccgccccggcccctggatgccgcggatgttgatgtccagcgcgccgctgttgcgcgcatcgccactgaacacaccgaccagatcctttaccacgtcggccgggttggagccgcgatagcgctccacccggtcgcgccccgaatacgccgtggtcaggtccagcgcgaacacatcatcgtagccgcgccgatcacgcgcctcgcccccttccgactgcaggcggccggccacgtccagtgttttggtcacccgcaccccgtccccctcacccgcctccgctgcggcccgcaggctccaggtaccgtccatgccgcgctgtgcacgcacgccgctgccgcgcaacagctgctgcagtgcctgcatctggctgtactcaccactcactgcactggagcggcggccctccaccaggcacgcacggcgtcggccaggggctgttccggaatggtgtactggcgcaacggtgcgacgaccaccggttgcgcctgcacggccggcacccaggccagcggcagcaatgcggtggagatggcaagagccaggacggtggcgcgacgatga

SEQ ID NO: 12678 - DNA, 225 bp, Glycine max
  Peptide Sequence Number=SeqID_129456
atgggatggccgataacgggcaatagacacaccaccaccacctttagagttcacctcagctcatccacaaaaaggttagagcgttgcctacgacacatggccgaccagcaggctaccaagtccaaagccaaaggtaagcaaagtactaggacgcacctagttgctcatgatcctgggaatttaaataaaacaagcgcaagctcggaaggtagaaagataccttag

SEQ ID NO: 12679 - DNA, 195 bp, Glycine max
  Peptide Sequence Number=SeqID_129457
atgccaccaaaactttatatgatagataggaaggtgaacaaatttcaccgtgaaaatgccatagatcagctgatatcagaaaaagtaacagagcagttcgccaatactggaggtctgaccatgataacagatatccaagaaggtaacatgtcagtatatgctcagcagtgcatcgcaatcccaagacttagatga

SEQ ID NO: 12680 - DNA, 276 bp, Glycine max
  Peptide Sequence Number=SeqID_129458
atggatgctttgttatcaaaaggtgaagatcatatatcgatagtgaagattgaagacaagttatcaatggtagagatcaaagcccaaatgttacccaagtcctgtgtactacccgtggtagacttggtggatcttgtgtttgaggatgaagaaaaggatttggaggaggatacatctattaagaaggatccatctatggatgaggaggcccccatcacggagttgaagccgatggagaaggactcttcacaagattcttctgatgactcttactag

SEQ ID NO: 12681 - DNA, 501 bp, Glycine max
  Peptide Sequence Number=SeqID_129459
atggatctcattcaaaaggctatctctagtaggcgactaaaatttgaagataacttgatgaaggtttatactgaccccttcgttgttcaagctaattatgttgaccatgttcatatcctcatgtttgatgttgttccagagaatcatattcaacctgtattgattcttatggtggatgttgtgcctgagattgatgaacaaaagtcttttggttccaatgatagccttgataggttgttggaggaatttgaaaaggaaaacattgaagtttaccccaaggttagagatactttggcagagttcctgactggaaagaaaaatgctaaaaaagaagttatgttatgtccaaggtgtggtgctgtgtttgacaaagaagcaactaactctttgaatagatttgaatctatgagaagggcctatgaagatgttgctcaaagggaacttaataaatgcctccaaataggtggttcagccaaggcgcaggatgaggtggaaagaggg

SEQ ID NO: 12682 - DNA, 228 bp, Glycine max
  Peptide Sequence Number=SeqID_129460
atggataaagcaaatatccaagaaaagaaatttgaatctagccaaaaaagacacacaaatatgatgaactcagttaaggatgataggaaaggacaaaacacattaaatggtgatggggtatgtaccctaactagctcaaatcggttagaggtaggcttcctattgagagaggaaactaatggaaactgcttagacaaaaagaacaaaaaatggggagttcaacactag

SEQ ID NO: 12683 - DNA, 267 bp, Glycine max
  Peptide Sequence Number=SeqID_129461
atggtgcagaagacgatgttagtctccgtgcgtcaacgggctcgtttgcccctgattgacgaaaggtacgggtgtcgcaacctacccttcggcgggagggcgacgcgagactcgcgggatgcgtgttccacgaaaggaatacgcgcggagtcgccaccaacgtttattcgaggaaaacgtcggaaaaatcggaaagacgcgatctacgaacttttagtggaaggttcgggagttgtatttacgcacggggaaggcgttggaccttaa

SEQ ID NO: 12684 - DNA, 399 bp, Glycine max
  Peptide Sequence Number=SeqID_129462
gataaaataaacacatcttccttcccttacttcaattccagtcggggagggggagtggagagaaagagatcacattctatcctagggctagggagagagagattccagccttcttcccaactgaggcaacaaacaatcgagcagaagtgtctgtttacggcctcaggggaaggagaagcctcagcgtaccaaacagattcattaggttcaggggctgaaagggacggattccctattgggttcagggacgagtacggaaagtcagagtccaagtcccaaagaacgagttcagccacttccttcgctattgatgggacatctagatctaggtcagccgcatctgcagttgaagcagttgacggccgggccaaggccaacaagagccatgtttgcatttga

SEQ ID NO: 12685 - DNA, 495 bp, Glycine max
  Peptide Sequence Number=SeqID_129463
atggctgttgggataaagcagaaagaccttgtgaacaaaatggtcaaaaagtttctagtaagtaatttcgttgtaatgctcttccactacgatggcattgttgacgaatggaatgactttgaatggaataatcaggtcattcacgtggctgtagccaatcaaagtaaatggtggtttgccaagcgtttcttacaccctgacatagttgcagaatatggttatattttcctgtgggatgaggatcttggagttgaacactttcaccctgataggatttacaaaagtggtgttagtggaaaacgttgtgatggaagtagcactgctcctccttgcacagggtgggttgaaatgatggctcctgttttctcaagagctgcttggcgttgcatttggtatatgatccagggtgatcgaacaaaaaatgttggtgttgtggatgctgaatacatagtccactatggtcatcctactcttggtggcttagatgtgcatgag

SEQ ID NO: 12686 - DNA, 411 bp, Glycine max
  Peptide Sequence Number=SeqID_129464
atgaagcttgtgtggcgcaaacttgcaacgaaccctaactcctttggctgtgtcattggcatttcctgggcttttatatcaaacaggtggaacttggagatgccaagtatgttagagggatctatacagatcatgtcaaaggccgggaccgggactgccatgtttagtatgggtactttcatggcacttcaggagaaggtgattgcctgtggaccaagtatgactataatcggtttggttttaaagttcattgcgggcccagcggctacggcaattggtgccatcgttgtaggattgcgaggtgacgttttgcgagtcgtaatcattcaggctgctgtgccacagtccatcacatccttcattttcgccaaagaatatggattgcatccagaggtcctcagcactgcgtaa

SEQ ID NO: 12687 - DNA, 382 bp, Glycine max
  Peptide Sequence Number=SeqID_129465
atggaggagtccttacaatggaaacagtttttgagtaagaaccttaatgtttatagaattggaatcttggttggaactagtgatgagaatcctgaaattgaccaaatacaggctaaaggcccaagtggagaaggacaaagcccccgagtggagaaggatgaaggcccagaggcagagacattatcaagactattaactacttatcaaggtaatccttgtggcgtctatcctgacttatcttccttcaccggaagtggcgtctaccctgacttatcttgcttcaccgaaagtggcgtcatccaaatttctctagcctgtatcaaacgttccgctcccgtaaggttcacatcatctgctatcagagcttcagctcttgatacag

SEQ ID NO: 12688 - DNA, 885 bp, Glycine max
  Peptide Sequence Number=SeqID_129466
atgatgaaacaaggtgtgaagcgtctgcttgttccaaagagcgtagcatggaagggcatgagcaagcgattctcagttatctactatggcaagtggctcaagaatagtgaatctcctggcaacagcagcaacaatctaccacttaacatgaatcggagcccctcaacttccatcactcctatccgtgataggtactgttgtctctctagggaagatgtgctccgtttcatcattggttgtcttggcgctttggctccccttcctctcacttccattgcttctcttggagcaattaattcaaactacaactatattgaatcttctactccagccattgaagccactcaaaagcttcctcaagatccaagtgcagttgctgtaatagaaagcacgtcagatggtcagtgcaagatcattggagaaatttctgcatcatgggctttagcaaatctctctgccgggcagtttgttatgggagttgaagataatgtcaccccaaggtcactgcctcagttcagtttagatttagcatctggagaaaatgatttagctaatggtgggggttcaaggaaaccaaggaagtttagtagcaggagtgttgggttcttcagcaatactgcgagccatagctttggttctaggagcatgtataggggtaggagtgcacctctgacatgtaaaattactagttcattggctgcagtcttggctcagatgctatcccacagggcaactcatgtctgggtgaccgaggacgagaatgacgaagttttggtcggtgttgtcggatatgctgatattttagctgctgtaaccaaaccacctacagccttcattcctgctaatagatctacagaggggtttggaaacgaaattcagtgttga

SEQ ID NO: 12689 - DNA, 360 bp, Glycine max
  Peptide Sequence Number=SeqID_129467
atgagtaaagggaagaagagggatgtggattctgacaaccttacctacatagcaaggagggtgctcttgtatgacgaaccaactgctggacttgatcccattgcatctactgttgttgaagatctgattcgctctgtgcacataaaaggacgagatgcacgtggaaaacctgggaatattgcatcttatgtggttgttactcaccaacatagtaccattaaaagagccattgatagattgttgtttctacacaaaggaaagattgtttgggaaggaatgactcatgaatttacaacttcaactaatccaattgtccagcagtttgcatccgggagcctagatggtcctatcagatattag

SEQ ID NO: 12690 - DNA, 837 bp, Glycine max
  Peptide Sequence Number=SeqID_129468
atggggtttatagagtttcaaagatgtgatgatgatgatggtcaaatggtaatgaccagtgattttgagaagaagaaagagagtgagtttcgtggaagatggttgctgttgttgttgcttggtgtagggggagaccttattctgttttctatctttctattgagcaaagtatcaatcggagttaccctggattgggattgggaagcgaagaagacaaatcaacgctatgtgtgggctatggctatctatcatcattcatcaagcatgttcaaattcctgaaagaggtcgttggcggatctggcaccggcgtcaaggatctcccttacaccatcgccgaaccttacccttccgcttggggctcttggactcattctcgcggcacctccaaggatgacggttctcccgtctcggtgttctcactctctggctccaatgctcaggacggtcacttagctgccgcgcgcaacggcgtcaagcgtctccgaactgtcaggcatccgaatatcttgtcgtttcttcacagcgctgagattgagacttacgatgcgggttctcctaaggtcacgatatatattgtgaccgagcctgtgatgccgctatctgagaagatcaaggagttagggcttgaaggtacacaaagggatgaatattatgctttgggtcttcatcaaatagctaaagctgtgagcttcttgaataatgattgtaaacttgttcatggcaacatttgcatggctagtactgttgtcacaccaactttggactggaagcttcatgctttggatgttctatcggagtttgatgggagcagtgaagcgtcttctggccaaatgctg

SEQ ID NO: 12691 - DNA, 2106 bp, Glycine max
  Peptide Sequence Number=SeqID_129469
atgggacacaccacacccctcacactcctctgtatgattcttctttttgcaaccccttctctctcaattgatgttcacccacaagacagaatctcactctcactgttcaggtcatctctgccaaaccccaaccagagtttgcccagctgggtaggctccaactgcacttcatggagtggaatcacctgcgacagcagaactgggagagtgctttccatcaacctaactagcatgaacctttcaggcaaaatccaccccagtttgtgccacctttcatacctcaacaagttggggttgtcacacaacaacttcacagccccacttcctgagtgttttggaaacttgcttaacctaagagccattgatctcagccacaacaggtttcatggtggaataccagactctttcatgaggctcaggcacctcactgagcttgttttcagtgggaaccctggtttggggggtccacttcctgcttggattggtaacttctctgcaaatctggaaaagttacatcttggtttctgttcattcagtggtggcatacctgagagcttgctttacatgaagtccctcaagtatttggaccttgagaacaatctcttgtttggtaatttggttgattttcaacagcctttggttttgctcaatcttgcttccaatcagtttgctggtactttgccttgctttgcagcttcagttcagtctctaactgtgttgaatttgtccaacaattctattgcggggggattgcctgcttgtattgcttcttttcaagctttgactcatttgaacctttcagggaaccatttgaagtatagaatatatcctaggcttgtgttctcagagaaacttcttgttttggacttgagtaataatgctttatctggtcctattcccagtaaaattgctgagactactgacaaacttggccttgttcttcttgacctttctcacaatcagttctctggtgaaatacctgtgaaaattactgagttgaaaagcttgcaggccttgtttctctctcacaatcttctctcaggagaaattcctgctagaattggaaatttgacttatctgcaggtcattgatctctcacacaactctttgtctggaaccattccattcagtattgttgggtgctttcagctgtatgctctgatacttaacaacaacaatctttctggtgtaattcaaccggagtttgatgcgttggatatcttgaggatactggatataagcaacaacaggttttccggggctatcccactcactttggctggatgcaaatctttggagattgtagactttagttccaatgagctttctggatcgttgaatgatgcaataaccaaatggacaaacctcaggtatttgtctcttgctcagaacaagttcagtgaaaatctgcctagttggttgttcacatttaacgcaatagaaatgatggatttctcgcataacaagtttactggcttcataccggatattaattttaagggtagcttaatatttaacactaggaatgtcactgttaaagagccattggttgcagcaagaaaggttcaactcagagtttcggcggttgtttctgatagcaatcaactcagtttcacttatgatctttcctcaatggttggaattgatctatccagcaactcgcttcatggggaaattccaaggggcttatttggtctatctggcctagaatatctgaatttgtcatgcaactttctttacggacagcttccggggttgcagaaaatgcagagtttgaaagccttggatttgtcacataattccttgtcaggacatatcccaggaaacatctctatccttcaagatctgtctattttgaatctttcctacaactgcttttctggatgtgttccccagaagcaagggtatgggagatttcctggtgcatttgctggaaatccagatctgtgcatggaatcttccagtggattatgtgatgatggaaggactcaatctgcgcaaggaagtacttttagggaagataggatggatgacccaatttctgtggggattttctttatcagtgcatttgtgggtgaagggtcagcaaggaacatgcctgattga

SEQ ID NO: 12692 - DNA, 603 bp, Glycine max
  Peptide Sequence Number=SeqID_129470
atgaaatctcaaaaagatgtgaagaagcctaaatggatgtttgatagagtgtggaacggtttgttagccaaatggaatctacccaagtatcgcattaagtgtttacaagcacaaaaaaatcaaaattctgaaaaaggtgggagcttacacataggtggctccctcaacacacacaagcacgccatttgcatggcaatggagtacggtcgtcctgtacatgttgatgagacaagattttctcaagctaggtctaaggctgaatcatgtggtggtagctcagatatctcccctctagatcctgccgaggaggtgagacttaggactcaaacttttgttgttggtgctagtggtttcaaaaagggatggatctatgggaccggagagctcactcatggttataaatgtgtggatatcttgacacaaatgatacatgaaggttctagccattctcaggatttagaagagattgttcagctgaaaaaggagttgatgcatgtaacatgtttcaccaacaacaagagcaaccacatcagcaagagcaacaaccacaacaagagtagcaacatgaccaatagcaacaacaccaacagtgtgactctctga

SEQ ID NO: 12693 - DNA, 624 bp, Glycine max
  Peptide Sequence Number=SeqID_129471
atgtggatgtatccatttgaaagtaaattgcgttgtcctcttaaattgacccattgggcgatatatttggacagctcgttcttgcaatctcgacaactaactaagtcaaatccttatagacgtatacatgtagattttcctaaatggttcaaggaacaagttaagaatgagcctttaagtgtgaagaacctacacttcatggatttatcacttggccctttcacttgcattaaagaattgcatacattctttgaaaatggatacaaattccacactcatgcatggagcgaggggaaaaacaatggggtttatgtaaagggccttacaaaaggaggcgatgatgatttctatgggatcattcaacatatatataagctagagtacgatacttcaacttctcctaagagggtggtattattttattgtgactggtttgatccaacatgtagagaattggatgaagaagaagaaaaagccaatgattttgacaataaagaagaggaatttaaagataatgatttggaagaagacaatgaagaagaggaatttgaagatagtgattttgaagaagacaacagagatggaggatttaaagatgacattgaagactctagttctgaatag

SEQ ID NO: 12694 - DNA, 222 bp, Glycine max
  Peptide Sequence Number=SeqID_129472
atggcgtgcttgtgtgtgttgagggagccacctatgtgtgaattactaaccctcgatggtattgacaatgatcttggtactggtagtggtgagggtattgcaagagatgaggaaggtattggtgatgcaacagtcgaggatgaggaagatgtaaatgcaggtagtggtgcaacagttggtgcaatttggaaaggtatcggtgcaacaactagggatggatag

SEQ ID NO: 12695 - DNA, 459 bp, Glycine max
  Peptide Sequence Number=SeqID_129473
atgtctttaaataacttagaaaaactttgtataaggtttttgacattgaatattgatggtttaggagaccttgttgggaaatctgagaggagtaaacaccaaggattacgacaaaccatgcttatgtttatgggtcttatcctcacttatatggtgttcaaccttcccattcctaccagatgtgggacttcacctcacacttgtaatccaacaattgtcctctctagtagcttaaccatgattgccccgcccttgcctagccattgtcgccaacatgctctagtacattgcattgtcatgctctccaccacttcatggtcacaggacacaccaccttgcctccatgcatggactaatacacaaggaagactttcaattcaagggatttccatgtccacagattcactgccgccattttactcgtttgagtcggtcactaagtcaaactatttactctaa

SEQ ID NO: 12696 - DNA, 337 bp, Glycine max
  Peptide Sequence Number=SeqID_129474
tagagagtacatctacttggttgttcaaagagaacaaggaagggcacatcctttatggctctttgcttgtaaaggattttacaaggttattggaaatctcaagaaccgtgggttgcttagggactggatagatgatagccggaaggtcttgcgctactttgcggtcttcctcaaaatatctaatgcctctgaagctaagttagttagtgctatcaatgctattgagcaagcttataatagaaattggcagtctctcaggcttgagtgtgattcttctttggttattcaagttgtaaataaccctcacattgtcccccaggagctacttaacaagtga

SEQ ID NO: 12697 - DNA, 486 bp, Glycine max
  Peptide Sequence Number=SeqID_129475
tgggtgcctaggaaagggccactgctctactctgctctaattagtttggatcagcatgacttgtctatgacagtcaaggaattcatttgcaaagatggaccctgggatctaaataatttggagcaactgttgcttagacctctctgtgaggacatttccttgttgaatcctccaaaggatgatgctggtgaggattatgtgatttggaaaggcacaaatgatggtattttttctgctaagtggaagggcaccaagagaatgagaccgttgatgtggaagattgttaacgttgatgtggcgattagatcatctgacaatgaggttgcgtgcagtggaattgttcgccatcatcatggttgtgttttctctcatgttttcagaaaccataaccgggtagctgatgagctggctaggagagccttcaagggaaaaacgaagagcttgggagaggaagaatctagttgggctaagaggcccagcaacaag

SEQ ID NO: 12698 - DNA, 297 bp, Glycine max
  Peptide Sequence Number=SeqID_129476
atgtcgtttcctgaaactcacaggggactcatgaatgatgcttctagctcaaacttcaacccccaatttgattacattacagaagattataatatgggattcccattcccccctcgtgaaaaagtcattactcctatagatttaactctagaaaacataaaatcaaaaggaaaaaggatgcctatagaaccaacattcaatatgccatctcttttattaaatataggaagtattgacccacaactacttccaaattacatggaacaatggacttctgttgtaataagagactataag

SEQ ID NO: 12699 - DNA, 607 bp, Glycine max
  Peptide Sequence Number=SeqID_129477
acaattggtggagggtggtgctcaacacaaagcagagtatggaattgaaggggagattgaacaagatgaaaacagaagaaaagatgagaaaacatctcccaaatgttcagcatggatggttttatcgcgctcctttgtagaatatgttgtctggggttgggacaatctcccaaggacccttcttatgtactacactaatttcatctcctcccctgagggctactttcaaactattgcatgcaatgagccagaactagccaagactattgtgaacagtgacttgcattacatttcatgggacaaccctcccaaacagcaccctcatgtccttaccatcaatgacacagccaagatgattgcaagcaataccgcctttgctaggaaatttaagcacaatgatcctgtcttggatgtgattgataaaaaactactacatagggagaatgaacaactgttcacaccaggtggttggtgttctggcaatcccagatgtttcaaggttgggaacatttacaagattacacctggtccaggatctaaaaggcttcgtttccttgtgactaggctaacttggatggctaaatttggtcagaaacagtgtaaatag

SEQ ID NO: 12700 - DNA, 396 bp, Glycine max
  Peptide Sequence Number=SeqID_129478
atgagattttggtgggcgagtcctagtgctgcggttaagttgtgccttggtaatcagttgatcatgggttccccatacttttacatagcgaggagccttctgacaccgggatacattacattgactcctcaattgaagtctaccttggatcaagttattgcttcaaataaagtagttgtgtttatgaagggaactaaagattttccacagtgtggattctcaaacacagtggtgcaaatattgaagtctctaaatgtgccttttgaaaccataaacgtgcttgaaaatgacttgttgcgccaagggctgaaggagtactccagttggcctacctttcctcaagtctacatagaaggagagttttttggtggctgtgatatcactgttggtatgtaa

SEQ ID NO: 12701 - DNA, 873 bp, Glycine max
  Peptide Sequence Number=SeqID_129479
atggtgttaatgggaggagttggagtaccctcaatctcaatctgttgtttgttccaaacaagacccaccagacatttgtgtctcaaattcagattgaaaccttcgctttcacattcaatcactagcatggcattgaccaacaacaacaacaccaacaccaacgaaaggaagcttccgattctgctgtttgatatcatggacacccttgttcgtgacccattctaccaagatgtccctgccttcttcggaatgtctttgaaggaactcatagattgcaagcaccccactgcttggattgagtttgaaaagggtctaattgacgaggtaaaaagaatgaactttgagtatgaaccctctttcgtgatggagctagcaagaaaattttttaaggatggaagggattttgatttggaagaacttttgagatttttagttaaagatcaagctgattcagatgagctgaaaattggcgatggcctaaaatcttgcatgagaagtggatattcgtacatagaaggcagcgaacagttgcttctttccttaaagcaaaataactatgagatgcatgcttttacaaattatcctatatggtaccagttgattgaagacaagttaaaactatcaaaatatttatcgtggacattttgttcgtgggcatttggaaagaggaagcctgatactgaattctataaggaagtcgtaaggcatcttaaagttgacccaacaaattgtattttcgtagatgacaggcaaaaaaatgtggaggcagcaattgaagttggcatcagaggggtacatttccagaatgtcaattcactgtgtgaaaaactgtcactgatggggattgacatctcaacagatgaagatatatag

SEQ ID NO: 12702 - DNA, 1251 bp, Glycine max
  Peptide Sequence Number=SeqID_129480
gtttaccctcatgttgctactgggttctccgatacatctgcttttctcagggaactgactcttaagtctattaagttattgtctttaataaaacagaggtctaagctgtgtcagagctggggaaatagcacagatcttttattgctctttgttgtctcaaaggacaatgtcagggtcattattgaagtatctgtcaaagttgcaggacatagatccttttttgaagttgatgaagagccagcaattagaacaaatactaccatattattaggcaatattggaagttacttaaatgaaggaacaagaaaaagagttttgattaatgcatttacagtccgtgcattacgtgatacttttccacctgctagaggagcaggcattatggctttatgcgccaccagttcctactatgacatcactgaagttgcaacccggattcttcctaatgttgttgtgctcacaattgatcctgacagtgatgttagaactaaggcatttcaagctgttgatcaatttttgcagatagcaaagcaacattatgaaaagacaaatgcagcagataccagttgtggtgtgggaagctcatctgttccaggaaatgctagtttgcttgggtgggctatgagctctttgaccttgaagggtaaaccttctgatcatgctccagttgcttctgcaagttcgactgcaatcacttcgacgtcttctaatggcactgcaggtatagagacaccatcaacagcagcagcccatgtaagctctactgcagatttggctgaacaccctgtccctacatctcctacatcaacagatggctggggggaacttgagaatggaattgatgaggagcatggaagtgacagggatgggtgggatgatctggaaccgcttgaggagacaaagccagctccagctcttgcaaacattcaagcagctcaaaggcggcctgtttctcaacctatttcacatacaaagcaagcctcaaatttgctatccaaaagtacaccaaaattgaacaaggatgaggatgatgatttgtggggatctatagcagctcctgcgccaaaaactgcaagacctttaaatttgaaatcagctcaaactgatgatgatgatccttgggcggccattgctgctccagcacccacgatcaaggccaaacccttatcggctgggagaggtaggggagccaaacctgctgctccaaaattaggtgctcagcggataaaccggacatcatcaggcatgtaa

SEQ ID NO: 12703 - DNA, 1008 bp, Glycine max
  Peptide Sequence Number=SeqID_129481
atggttggcaaagccaataagaaaaacgaagtttcagatgtcaccggcattctgttatttgagggacggcatttcttccagctgcttgaaggacccgatcaggccgttcagggcatttacgaccgtatctgccgcgacgcccgtcatcacaatctggttgagctgatgcatgacttcgcgccagcccggcgctttggtaacgtcggtatggagctgtttgacctgcgcgagcatgacaaatccagcgtgctgcaggcggtgctggataaaggcacttcgcgttaccagctgacctatgacgaccgtgcactgcagttcctgcgcaccttcgttgaggcgcgggaaaaagagaactatttcgagatcccaccggcgaatacctgggaatttattactgatgcggaaagccagcgtcagctggagagtctgcagcactatgtgcaggattgccggtttgcgtttcagccgattgtcgatcccttctcgcgacgtattacggcctatgaagcgctgattcgcacgccggacggcggttcaccgcaggagtacttctctgcgtttggcggcgatgcgatttaccatgccgatattcagtccaaaagtctggccttcaacctggcgaaaaatctcggcctcggcgagcagacgctgaccatcaatctgctgccaatgtcgctggtcaccgtcccgaatgcggtggatttcctgctgcaggaaatcgcggccaacggtctggtaccggagcagatcgtggtggaagtgacggagaatgaaatcatctcgcgtgccgaagagtttacggcagaagtaagaaaacttaaggcggcaggtatcagcctggcgctggatgactttggtgccgggtttgcgggtttgtcgctgctgtctaaattccagccggataagatcaaaatcgatcgggaaatcatcagtgacgtgcacaaaagcggtccaaaacaggcgattgtgcatgccatcattaagtgctgcgcttcgctggagatcgcg

SEQ ID NO: 12704 - DNA, 411 bp, Glycine max
  Peptide Sequence Number=SeqID_129482
atggcttcttgtaaatggaaagcaccagcttcagtgtcccaggctagaaggaaagtcgaaaggaggaactggcataaggagctcattaacttctcagagggaagcattaatgttgttattgttaaagaattttacgctaacctctatgaccctgaagacaaatcgcctaagcaggtgagggtgcgagggcacctaattaaattttatgctgacgccatcaacaccttcttgaagacacctgtggtcatagaggaaggggagagcttgcccgtctactccaggtttgctaatctgaggcccattcctcaagagcttgcagcccatctatgtatccctggaaggggatttgagctaaatgcagacgggttgcctctgaagattttgaggaagaatcttactactctggcctag

SEQ ID NO: 12705 - DNA, 714 bp, Glycine max
  Peptide Sequence Number=SeqID_129483
atggagttcaatataacaactgtatctagtatgagctgtgcaaatctacgtaatctaggtaatgtagttactgggaatcctggctttatcgaccaaagagttgttcctctgtcgactttagcaaactactcttgttacaactcaagcacggggccaactgtagtattcaagtgtaaaaattgcaaggtcatctatgatcacatgtacatttcgtggcagtttgttgatctccccaataatcctgccactgctgttggttttgagttcaaactcacttcaatggatattgctaagaaacatgtgagttttgttagtggaacattaaagaatggaagcaatttcgataatagcccggttacattcagagggaagcaatcaaatattttgaaattcaatttgttccctcgaatatatcataatttacatgagctaaagctcatacagcctttatttcacgagttcctcccaggttcagcttctcgtgatacaaatgagcttcgagcatcccttgaaagttctaccgatggactagtcaacaccacattgtttatcaattttctctctgattatgttgtggagatcgataaagagaatattttgggtcctgtgagcttccttgcggaccttggtggcttgtattgtattagcataggcatctttttctacctgttgatacagaattgcatgtttcaatgcaattcagcaacacagtga

SEQ ID NO: 12706 - DNA, 330 bp, Glycine max
  Peptide Sequence Number=SeqID_129484
atgaaaacaaaaacaccgccatcgctcttgtctctcacggttgactctgcggttcttaatctctccgacatctccgatctctcccatgtccctgatcacatcctcctcgacctcttcctggcgagttatgcagctgcaagctctttggcctttcttttcttatcattttctagaatattgaaggctgggaagctgactgagaaagttctgagactttttatagcaactggtaaggatgaagtcctctcatttgttcaggcactcaatatccaacatattttgacccctgtgcttcccaccaggtgttctgaggcaaaatcagacttttag

SEQ ID NO: 12707 - DNA, 312 bp, Glycine max
  Peptide Sequence Number=SeqID_129485
atggccagcaatataattagcaacagggacagtgaagaactcaccctgggcacatttgacagaatgatgaagctagaagagactctttctcagtttatgcaagtatccatgtccaatcgaaagagcacagagtcaaccatcaagaatctagaagtccaggctattatgactagaagtaaaatggtgagcatgaataaaggtgagaagaggataggtgaaggaaaacaacaactggtgattgaaacagaaattgacccaatggtagaacctttgagtgagattgaggaagatgtgaaagcagaagatgattag

SEQ ID NO: 12708 - DNA, 672 bp, Glycine max
  Peptide Sequence Number=SeqID_129486
atgggtagccagctctattgggttaccaatagttcattaaccctcattcagcaaataactcttagacatcctgctgtccttgcaaagttggggttactggacaatagtccaaagggagcttctgaggaaattggtgcttctaaaacagctccttcaccagggttacaagataatattccaacagcagctatcaaggaaactgtttcgcctgaaaaaaatcctctggattcacctgaaaagtggcatagaatacctatagaggagatgtccccaaaagaactgattactcttgcagtcctatttttaaacagtgatgataaagaaagtgcaattcccttactaaaactagcccttgataaggaccctgaatatgtacgagctttagttttgatgggacgggttctattgctgaagcatgtaaatgatgaagctcatgagtacttcgagcgtgcaatatcgaaactttctcttgcggaagaagttgatcttcccagagggctggaattgcctgcgaacggcaggggaaacacattgttctctgagaaaacttttgtctcacagagggaatctttagataccttgcgagtcgaatgcatgcccaaacctgatacattatgttgttacctgaaagataattgcacctctattcctaactattggcaggcaatatga

SEQ ID NO: 12709 - DNA, 468 bp, Glycine max
  Peptide Sequence Number=SeqID_129487
atggcaagcttcaccctagtcacatccctccctaagtttggccatgctggagcaagaattgctaggtctcgtgcctggaatcctagggttttcgcagctgctacccctagacctatccaagttcctagagaaggcccagcaactgctgaaggcaccacacaaggagctagtgaaacagtcattaacagtttgaacgaagctcaagacaaggcttactccacagcggaacatgtggctaacaagaaaaacgagatggctaacaagacaaataagatggctggtcagatgtcagcaagtgctcaaaacatggctgataaagcaaagcagacaatgcaagaggcatgggaatccactaagaacacagccaatagagctgcagacaatgtcgtaggaaagactaaagaatcagctgaatacgtcaaagataatgcagagacagtgaagcagaacatgaactcaaagaactga

SEQ ID NO: 12710 - DNA, 324 bp, Glycine max
  Peptide Sequence Number=SeqID_129488
atgactagaggcaatctaggtgacttacaaccctttgatcctgaaatagataggacatttcatagattagttaggcatagtgtgcatcttgattactctgaacattttgtaccttttgagcatcctgagcattctgttattggtgagtccgagcattctgtggttggtgattttgaacatcctgattttgagcattctaattttgaacattgtgaaaatatggctcaacctccacctcgtgagaggactctaagggaaatggttgcacctgatttcacttatgaaagcttgtgcatacaataccctgatgaggatgtcccatat

SEQ ID NO: 12711 - DNA, 474 bp, Glycine max
  Peptide Sequence Number=SeqID_129489
atgggaaaattaggcttaccaataatgtcaagagtacctctacctctacctctacctctaccttggtggtttgctttcttctgggttgtccattcatcaattgcactcttcaagtttgaggcatcacagggatcgttcgtctcccatagacgtcaggatgtcctgattgctgccatcgggcaaccagagcaccctagtcgtgtccgtgctgctaaagccgatgccacaataaagcaatatttcggatcagctccacgaactgactccgcagctaatggcatccttcagctagatgcagtcccaatttcagtcgcagatgcaatcatagggacttgcactgcctccggagccagaggaagactttatgagggatccacaatggttcacaacatccctttgttgcatgaccaagtgaaggttggtgttgaggaggttatagatgcagaggctctcattcctgtacccactgacaag

SEQ ID NO: 12712 - DNA, 360 bp, Glycine max
  Peptide Sequence Number=SeqID_129490
atggcagtctctttgttctctcctcgctcagctgctctcacggtgtggcttgaagcagttcttcatccttctgcttctactgctatgctagagtcacttgtagctcacatctcagttcaagtcttgcctaccatctcatcttcttcctttcttgtgcttttagccagaacgaaagcatacaacatctttatctttcgcacattgagaattgagaaaggtattcaatgtgggatccctccctacgaaaccctcagacaaggtgaattttgttctccttccctcagagttagagattcattcccccaagttgtctgcatagataacgaagtaaaggctggtctaactcaagatcttatgtaa

SEQ ID NO: 12713 - DNA, 228 bp, Glycine max
  Peptide Sequence Number=SeqID_129491
atgtacaaatgtatcttttctgtgcgggattcctttgaggcgcaggtgacacagggatccttcgtcccccgtggacgtcaagatgttctcatcgctgctattggatgtccagagcaccgtggacgtgttcgtgctgctggagctggtgtcaccatcaagcaatacttcggatcggctccacggacatcccatatctcttcctcactgcctcctgaagaattgcaatag

SEQ ID NO: 12714 - DNA, 1707 bp, Glycine max
  Peptide Sequence Number=SeqID_129492
atggagggcttggcaaaggtgggggcgcccaatgaagttctggagtttttgtctggttgggttgaagggggtggcttgcaacccaaaattcctgaggcaaaagggtcaatcaaagctattcgaagtgtggccttcttcattcccttgtatgaactttacctcacatatggtgggatttttaggttgacctttggaccaaagtcaccttgtggttatggagaccccatgaaccttgatgttgaggtcgaaattgcggttgtagacccttttttaaaaccttgtgtgataccaatggggtttgacactttgacttgcttgatcttatgtttatggttttccatggcattggaaaagggagaaactcccttaaccccaaactttatcaatgaacagaagggcaccggtatcttggctgagatcctagactttgtaatggggaaagggctcatcccagccgatggtgaaatatggcgagttagacgtcgtgccatagttccagcattgcaccagaagtatgtagcagctatgattggccttttcggacaagcttcagataggctctgccagaagctagatgctgctgcatccgatggagaagatgttgagatggaatcacttttctctcgattgaccttggacatcattggcaaggcagtattcaattatgattttgatagtttatcaaatgacactggtatagttgaggctgtttatactgtactgagagaagcagaagatcgaagtgttgctccaattccagtctgggagatcccaatatggaaagacatatcaccacgtctaaggaaggttaatgcagctctcaaattcatcaatgatactcttgatgatttgatagcaatatgcaagaaaatggtggatgaagaagagttacagtttcatgaggagtacatgaatgaaaaagatccaagtattctacacttcttgttggcatcaggagatgatgtgtcaagtaagcaacttcgtgatgacttaatgactatgctcattgctggacatgaaacatcagctgctgttttaacttggaccttttatcttctatccaaggagcctagagttgtgtccaagctccaagaagaggttgactctgtacttggagatcgatatccaactattgaagacatgaagaaactcaaatatacaacccgagtgatcaatgagtcattgaggctttacccacaaccacctgtgttaattcgccgctctcttgaggatgatgttcttggagagtaccctataaagagaggtgaagatatctttatatctgtatggaacctgcatcgcagtccaaaactatgggatgatgctgacaagtttaaacctgaaagatgggcattagatggaccaagtcctaatgagacaaatcaaaacttcaaatatcttccgtttggtggcggaccacggaaatgtgtaggtgatttgtttgcttcatacgagacggtagtagcacttgcaatgcttatgagacggttcaactttcaaatagcagttggagctcctccagttgagatgaccactggagctacaattcatacaacacaagggttgaagatgactgtaacacacagaataaaacctcctattgtgccctcattacagatgtcaactatggaagtggatccatccataagcctttctgatcaggatgaagtaagtcagaaaggagaaatttatcaggctcagtcctaa

SEQ ID NO: 12715 - DNA, 594 bp, Glycine max
  Peptide Sequence Number=SeqID_129493
atgactacaagtctagaaaactatctgtgggattatttgcagctattatggcatactcatgtagctgaatatctaaatgttccacttcacatattcttcacaatgccatggacgcctactagtgaatttcctcatcctctttcccatgttaagcaaccaattggctacagactctcatatcaaatagttgatgctttaatctggcttggaatgcgagacttgataaatgagtttaggaagaaaaagctgaagctaaagcctattacttatctaagtggatcttacactcacccttttgatgtgccccatggttatatatggagccctcacttggtccctaaaccaaaagactggggacctaagattgatgtcgttggattttgtttccttgaccttgcttcaaattatgtaccaccaaaatcgctagtagattggcttgaagagggagaaaaacctatttatgttggatttggtagccttcctttacaagaaccagagaaaataacacgaattataattcaagcactggaagaaacagggcagagaggtatcatcaacaaaggctggggtggtcttgggtcttgtgagtcatga

SEQ ID NO: 12716 - DNA, 207 bp, Glycine max
  Peptide Sequence Number=SeqID_129494
atgtcatttagttctatggcatataaggctagggagtgcggattgaagaggtggtgcattctggcaatgattatgacttatgcccaaaactcagcatctccacctgtgacattcttaaggcagttcactgccaccaatctatcgtcatacgaatgtagcaagccatacgaatgcagcaagcatatgcagacttcatcacatacatag

SEQ ID NO: 12717 - DNA, 447 bp, Glycine max
  Peptide Sequence Number=SeqID_129495
atggacaaaattgagcctaaagttgaagacgctaatttgcttagacaacttgatgtgcttttggtaaggatatgggcagttatgcataaggtggtggagaatactcaatctgcattcgttggaaggagacaaatgttggacagtgttctagttgccaatgaagttatccatgaagccaagagcaaaaggaagccttctcaaatttttaaagtagattttgagaaggcctataatgctgttaattggaagttctcatactatatgatggccaaattgggattctgcaataggtgggtttcgtggataaaagggtgccttgagtcatcctctatctccgtcttggtgaaggggagggcaacccgtgagttcaacgtccacagagggattcgtcaaggcaacccaattgcaccatttttgttccttatagtcgctaaaggactagggtga

SEQ ID NO: 12718 - DNA, 1206 bp, Glycine max
  Peptide Sequence Number=SeqID_129496
atgcgtattgccttatcgggctcaacgcatttgttggtgctggacgagctacggcatatgctggggggaagcatgcaactcgaagttgtcctagctaccgaagcacatctggagcaagccttggacaagttttatggccatagtctgtcgctagatagcattctgcaggacatcgagcaggaacacaccacaggattgccttcacttcaacaagagtcacggccggtaatcaggctggtcaatgcgttgcttattgatgcagtgaagcaaggggcatctgatatccactttgagcctgagcaggcatttttgcgtatccgctatcgtattgatggcgtgctgtggcaaatcagatgtttgcatggtcgttactggccagcgatatgtgtgcgactcaagatcttggccggcatggatattgccgagcaacggctgccgcaagatggccgggttgatctgtttttatgtgggcggcaaattgattttagggtgtctagccatccaaccttgtatggtgaaaacattgtgctgcgcgtgttggaccgtgataaggcaattattgcactggatgcgatgggattggctgcaccgaaactcagtcaggtcaaagccatgcttgccaaaccggaaggcttgctgatcctgacagggcctactggtagcgggaaaacaacgactttgtattccatgttaagtcatctcaaccacgagcacgtcaatatcatgacgctcgaagaccctgtcgaatatccccatcccctcatgcgacaaacatccatcaatgccgccaataaagtggattttagtaatggtatccgcgccattctgcggcaagaccccgacatcatcctgattggtgaggtgcgggacgagtcgacggctgccatggcgatgcgcgcagcaatgacaggtcacctagtcatgacgaccttgcataccaatagtgcagctgctgcttttgcacggttgcaagacttgggggtgagtcctcatatgatggcgggttgcctggtgggagtcattgcacagcgcttgctaaggcgcttgtgtttctactgtaagcgtaaccttgaggtggatcacgaactcacgcaatggttagggcaagttacaggcgtagagcaatccgcgcttcagttgtttgaagccgaggggtgcgtgcactgtcgtatgagtggatatcgcggcaggcttgtgattatggag

SEQ ID NO: 12719 - DNA, 279 bp, Glycine max
  Peptide Sequence Number=SeqID_129497
cttcaacgcgtcgtcacaggaggtgaagtagatgttgttgagatgggtgatcacatgcgacacgtagcaagagcactagtcattggtgagatcgctacgacactggaagatgccatagatagcatcagaggaggcaaggatggtgaagttattgtggttggcgaaggagatgaagttgacaagggaggtgaggaacgagttatcggtgttttctttagcaaaacccaatatgaacttggactgaaaggagacttgcaagagagtgataggaattcttag

SEQ ID NO: 12720 - DNA, 372 bp, Glycine max
  Peptide Sequence Number=SeqID_129498
agaccgacccagggtgatgcaccacaggccgcagacgtgccgccgcctcatcaggctggcccagctgggtcatttgattcagagcaatatttacgacatttggttcgccagcaggcggccaaccaccgagcgcacgtacagatccatgactgtatttaccagctgagcctcaacctgcagagccagggttttacttcttttccatgccctactccggatcagttcagggcagaggttgtgtggcccagagattggcctgaggcccaggcaggggaggcacccacagaggctcccggcgaggcagatgaggctcgcaaggacgaggagatgaccgatttgcttgatttattgggagggagcggagccacatga

SEQ ID NO: 12721 - DNA, 273 bp, Glycine max
  Peptide Sequence Number=SeqID_129499
atggcggtgctggacgagtcaatgggatgtatgctaggacagcatgacgattccgaaaagaatgagcggggcgtctactacttgagtaagaagttcacggtttgtgagatgaactactccctgcttgaaaggacgtgttgtgccttggtgtgggcggcccaccatctaaggcaatacatgctgagccatactacctggttgctatccaagatggatccgattaagtatatcttcgagaagcctgccctcacgggatggatcgctcgatggcag

SEQ ID NO: 12722 - DNA, 312 bp, Glycine max
  Peptide Sequence Number=SeqID_129500
atgaggggcctcccaggcgctggtggcataagcaccggagggctcataaggcactgtttgatccttgctgttgcaacctacccttcggcgggagggcgaagcgtgactcgcgggatgtgtcttccaagaaaggaatacgcgcggagtcaccaccaacgtttatttgaggaaaacgtcggaaaaaccggaaaatacgcgatctacgaacttttaagtgaaaaggttcgggagttgtatttacgcacggggaagggtgtttccctttgctcctacgtattcctcaattgggatgaggaaatcagacctacgtag

SEQ ID NO: 12723 - DNA, 312 bp, Glycine max
  Peptide Sequence Number=SeqID_129501
atgccgatctccccctacggaagtatcagttgggatcgcgcccacaagacacccagtggacccaaagaagtccaacagggccctggggtttccagctctagttacgggcctctgtcggtcccacaggggatcgcgcccgcaagacacccagtggacccagagaagtccaacaggctcttgaggtttctagctctgattacaggcctctgtcagttctacggagtgcctattgcccccaacaaggtcatcaggccccctattaaccgggctttcgtcaagaagtactacgcctcccaggcaggcgcagggtga

SEQ ID NO: 12724 - DNA, 756 bp, Glycine max
  Peptide Sequence Number=SeqID_129502
atgcgatcctgggtgaggggtcagtggatcccgttcgatgcggatgctctcagtcagttcctgggatatcctttagtgctggaggagggccaggagtgcgagtatggccagaggaggaaccgggccgatgggtttgatgaggaggccatcgcccaattgctgtgtatactagggcaggattttgcccggactgctgctggaagacgggtgcagatcatgcgcaccaacatgaccaccctgactcagatctggatgactttgctgctcagcaacatccagcccagcgatcataattccgacctccccctgccgaagtgtatggcgcctaccaggcaccctctggacccggataagtccaacagggccctgggatttcccgttttgatcacaggactctgccagtcgttcaaagccgcagacgcgccgccacctcatcaagctggcccagctggatcatttgatacggagcagtatttacggcatttggttcaccagcaggcggccaaccaccgggtgcatgtacagacccatgattgtctttaccagttgagcctcagcctacagagccagggttttgcttctttttcgtgccctactccggatcagttcagggcagaggtcgcatggcccggagattggcctgaggcccgggcaggagaggcaccagcagaggctcccgacgaggcagatgaggcccgcgaggacgaggagatgaccgatttacttgatttcttgggagggagcggagccacatga

SEQ ID NO: 12725 - DNA, 252 bp, Glycine max
  Peptide Sequence Number=SeqID_129503
atgcagagaattgcagggaatcaagcaaaaatagaagctttagggttgtccaaattggccaccattttcaaggatagaattcaaaaagttaagaaaaaggataaaaagaaggccaatgatgatgatgaagactatgtacctgaatatgaatggggacttggatcaaattcttcaagtgaaaattatgagaactacaaacgtgatgagtttgctgctacaaattatctcgagtcacggaaaagaaaggcgtga

SEQ ID NO: 12726 - DNA, 441 bp, Glycine max
  Peptide Sequence Number=SeqID_129504
atgtacgaacacttgatcataaattggataaaagggcactatgttatatgggagtatcatggagaagtgattagtgagcctgatgaatttgatgatgatgatgatgatcagaataattgcaatgatgaggttcatgatatgttacatgatcttggaagtgctatgaatattgagaacatcataggagctgaggaaataaattatacaactagcacgaacactaatagtgtgaatgaagaagaagacaagttttctaaactactttttattgctgaacaagaactatatcccggttgtgagaacttctctaagctatcatttattgttcaactattgaatatcaaatgtctctttggcttgagtggaaaagcaattgacgccttgctttctttgttggcaaaaacatttccacatgaaaataaagttcatgtgtcttactag

SEQ ID NO: 12727 - DNA, 207 bp, Glycine max
  Peptide Sequence Number=SeqID_129505
gtgtcatcctccgaagaggatcctgaagaggacccagaggagttacctcctgaacctgctgtggatgcccttgacttacctgaggatgatgaagacccactccttgatgttgattttccagaggatatcatgtcagcatctgaggcagactctacagaggagagcggccctggagggacagcgaatagtgaagactcttcatcatag

SEQ ID NO: 12728 - DNA, 975 bp, Glycine max
  Peptide Sequence Number=SeqID_129506
atggcgcttgccgccatcatcgtcgccgcggccattttgaccgaagccgccctatccttcctcgggctcggcgatcccaatatcgtcacctggggttcgatgatcgcagaaggacgcaatgtccttcgctcggccgcgcatcaacaaagcgctggcgacagggaggcgagcgccatgagcggaaatgcgctgtgccggatcgacgatctcagcgtttggtatgcggcaagtgatgcgccggcattgcagaatgtctcgctgacgatccggcaaggccagaggctggcgatcatcggcgaaagcggctcggggaagtcgacgctcggcaaggcgattgcggggcttcttcccggacatgcgaaggtttccggtgatatttcgtggagccgcgacagcctgttctacggcaggccgctgccagggcgggatatcggcacgatctttcaggacaccggcgcaacgctgaatccggttctcaccatcggcgaacaggtggcggaaggggctgtccggcatctaggcctctcatggcggcaagcgcgcgatcttgcccgcgatcttctggagcgggttcggctgccgcacccttcccacctcatccgggcctatccgcaccagctctccggcggccagaggcaacgcgtgacgattgccgccgccattgcagccagtccttcaatcctgattgccgatgaagccacgagcgcgctcgatacggttagccaggccgccatcgccacgctgctggacgatctggtgcggcgggaaaacaagacgctggtcttcatcacccatgatatcggccttgcatccagccttgccgacgagattgccgttctgcgcgcgggattgctggtggaacatggcccgacgaggcgggtgctgtccgcacccgtccatgactatacgcgtgcgctgcttgccgattacctcgatctgtccacgccgccgctggtcagcgaggccgcgtcatga

SEQ ID NO: 12729 - DNA, 249 bp, Glycine max
  Peptide Sequence Number=SeqID_129507
atgacggaaaccgtttgtacggataaccgcttgggtatctccgtacgtcacctgacttcacgggtcaggatgacagaaagcgcggaagacgatgtaaatctccatgtgtcaacgggttcgttggcccaaattgacaaagggtcatcggagtcacaggtcacgatagaaaaaggtggggtggtcgacaaaaagcggggcttttgctcctatgtatcctccatttgtgataaggaactcagacctacgtag

SEQ ID NO: 12730 - DNA, 345 bp, Glycine max
  Peptide Sequence Number=SeqID_129508
atgtcggcttcccaatttggaggggagtgtgcttattgcaactctttggctgttgaagagagtgaatatgcttttatggatgttgttgaatctgattctcttgaaattggttctactaatgttgattcagattcctctgacatggaacttgacatgggtgatgagatgactacactttcaatgatgaagaacaagcaagaaaaacaacagaaaatgcagcagacaagaaatgtcatacacatcgaattgtgcagcaaaggtgaaagagagaagaataagaaagaacacgcacaggattacgtggttcaccttgagaaaggctacacccacggaagggaaaaatag

SEQ ID NO: 12731 - DNA, 636 bp, Glycine max
  Peptide Sequence Number=SeqID_129509
atgacgacaccacaacccgactggcatgcgtatctggcgcaaatggagaccgttctcggcgtgacgctggatgatgcccgccgcgccgagctgcaagtacagttcagccgcattgccagcatggccgctccattgatggcgctgccgctcgatgaccgtctggagatcgcaggagcgctgagtgcgggcgagctgagcgcccatgagattgccggtcagacgctggaggcgatagcgcgcgtgaacccgcagatcaacgcctggaccgccgtgacggaagcgcgcatgctcgccgaggccgcgaatatcgacaccctgcgccgcgaaaagcgccccctgccaccgctggcgggcgtgccctatgcggtgaaaaacctgtttgacgttgccgggcatactaccctcgccggggccgagctgttcagccagcgccctcccgcggccactgacagttttgccgtacgtcagctgcgtagcgcgggcgggttactgaccgggatggtgaatatggatgcctacgcctacggctttaccaccgaaaacagccactacggcgcgacgcataacccgcacgacctgacgcgcatctcgggcggttcgtccggcggttcagccgccgccgtggccgccgggctg

SEQ ID NO: 12732 - DNA, 486 bp, Glycine max
  Peptide Sequence Number=SeqID_129510
ggtgcaaaagacgacgttagtctctgcgtgctatcaggttttctgtcttacagacagcaaaaagtttatacggataaccactcgggtatttccgcccgtcagcgtgactcaaaagtcagtatgacagatcttgtgagcgcggaagatgaccaaaaagtttatacggataaccactcgggtatttccgcccgtcagcgtgactcaaaagtcagtatgacagatcttgtgagcgcggaagatgacgtcgcagaagacgacgttagtctctgcgtgctatcaggcttttcgtcttatagacaacaaaaagtttatacggataaccactcgggtatttccgcctgtcagcgtgactcaaaagtcaatatgacagatcttgtgagcgcggaagatgaccaaaaagtttatacgaataaccactcaggtatttccgcccgtcagcgtgactcaaaagttagtatgacagatcttgtgagcgcggaagatgac

SEQ ID NO: 12733 - DNA, 1254 bp, Glycine max
  Peptide Sequence Number=SeqID_129511
atggcactggcatcaagttatcttgaagaaacagaggaaaaggttaataaagttgatgatttacatctgttcttaactcatgctcctacagatgaacataactctatggaacatgacaacgtttggaaggtctttagagccaaaacttatggatgcggaatccaatgtgtgatatctcatgctcctggagctggtaaaacttttctcatcattgcatttctcgttagctatttaaagcaattcccagggaagaagcctcttatccttgctccaaaaaacacactttacacttggtgcagagaattcagcaagtgggagatttttatgccagtgtatccgattcatgggcgtggtggaactcagagagatactgagcaaaattcaattgctcttcctggttttccaaatccaaataaagaggtcaagcatgttttgaactgcttggaaaagataaaactgtggcaagagaaaccaagtgttttggtcatgagttatactgcatttctagcattaatgagagagggttcagagtttgcccatagaaaatatatggttaaagcattaagggaaggtcctgggatcttgatacttgatgaagggcacaacccaagaagtactaagtcgaggttgagaaaagggttgatgaaagtggaaacagatctaaggatactgctttccgataacattgctaagaaaattgactcgggtattgaaaatgagagggtgcaaggtctaaacatgttaagaggaaccacaaatggttttgtagatgcttatgagagtgcgaattttgatagtactcctggtttgctaatgaacacaactgacaagcagcatgagattttgttaaaactgcacacgagaatggacgagtgcattggttactctctggagctagagcttttgttgctagaagaatacaagtatgatatgaaagcaggatcaaaagttaaatttgttttgagccttgttttccgtgttatgccaagagagaaaattctgttgattaatggggaactagacatctttgaacgcgggaaagtgatagacaagtttgaggagcatggaggagcatcaaaggctattgcacgcgcttttcgtcccggtcaagaaaagatggtttatgtgtatcagctcttggcaacaggcacattggaggaagataagtacataagaaccacttggaaagagtgggttactagcatgatttttagtgaggcttttgaggagaacccttcacactcgcgagcatag

SEQ ID NO: 12734 - DNA, 503 bp, Glycine max
  Peptide Sequence Number=SeqID_129512
atggtttcatgtgtacacacagatgaagacgtgcacaacatgattgccctaatagaagcatgcaaccctaccacacaaagccccttatatgtctacgtggtacatctcattgagctcgttgcaaaaagcactcccattcttcttcccatgaacaagaacaatagaaaatctttgtccgtggactaccccaacaccaaccatattttacgtgccttcgagaactactccaacaactcaagtggtcccctaaccgttcattcatacgttaacgtggctccctacagaagcatgcacggaaaccacgtggccaacaccattcgcaaccttaacacaaagggtacgtcggggatactagtggatagatactcagtgctaagttggagtagctccaagttgtcttttgatgttggtatcttcttcattggtggaaaagacgatagagaagcattggcattggggattcaaatgttggaacgccccaacactcgtgtcactttgttccg

SEQ ID NO: 12735 - DNA, 306 bp, Glycine max
  Peptide Sequence Number=SeqID_129513
atgtatgattctttaattggcttccccggtggtgttctctccacaacaatattcactagtggtcgtataataagaagtaataacacagcgaatccagttgcacctgtcaaaaatacgattgtaaattgcaagctgaattttgtgttgaattggagttccatcgtaatccattgcaatatttctctaatcatggctgaagatagagcaatttggcccaattccgtggccacgaggttgcgttccatcaaggtttcggataaaacagcaaaactgctcaaggtgaagatgttggggaagtggtattga

SEQ ID NO: 12736 - DNA, 159 bp, Glycine max
  Peptide Sequence Number=SeqID_129514
atgtttctcttaactagtgctttgaagagattcaacgatattcaaggaagtaaatccaaggctactactaaatggattgcaattaaagttaactttgaatctcttattgaatttagtataataaacaaagaggaagcactgagtgcaactattatgtga

SEQ ID NO: 12737 - DNA, 2422 bp, Glycine max
  Peptide Sequence Number=SeqID_129515
tcttgttgtgctcccttcatgcgtgagaccagctttgtgtgaagatgaaagttgggacggagtggttgtgacagcatcaaacctcttagcacttcaagctttcaagcaagagttggtggacccagaagggttcttgcggagctggaacgacagtggctatggtgcttgttcaggaggttgggttggaatcaagtgtgctcagggacaggttatcgtgatccagcttccttggaagggtttgaagggtcgaatcactgacaaaattggccaacttcaaggccttaggaagcttagtcttcatgataaccaaattggtggttcaatcccttcaactttgggacttcttcccaaccttagaggggttcagttattcaacaataggttaactggttccatcccttcttctttaggtttctgtcctttgcttcagtctcttgacctcagcaacaacttgctcacaggagcaatcccttatagccttgccaattccaccaagctttattggcttaacttgagtttcaactccttctctggtactttaccaactagcctaactcactcattttctctcactttcctttctcttcaaaataataatctttctggcaaccttcctaactcttggggtgggagtcccaagagtggcttctttaggctccaaaatttgatcctagatcataattttttcactggtaatgttcctgcttctttgggtagcttaagagagctcagtgagatttcccttagtcataataagtttagtggagctattccaaatgaaataggaactctttctaggcttaagacactagacatttctaataatgccttcaatgggagcttgcctgttaccctctctaatttatcctcacttacattgctgaatgcagagaacaacctccttgaaaatcaaatccctgaaagtttaggtacattgcgtaatctttctgttctgattttgagtaggaaccaatttagtggacatattccttcaagcattgcaaacatttccatgcttaggcagcttgatttgtcactgaataatctcagtggagaaattccagtctcctttgaaagtcaacgtagtcttgatttcttcaatgtttcttacaatagcctttcaggttctgttccacctctacttgccaagaaatttaactcaagctcatttgtgggaaatattcaactatgtgggtatagcccttcaaccccatgtctttcacaagctccatcacaaggagtcattgccccaactccagaagtactgtcagaacagcaccatcgtaggaacctcagtaccaaagacataattctcatagtagcaggagttctcctagtagtcctgattatactttgttgcatcctgcttttctgcttgatcagaaagagatcaacatcgaaggctgagaacggacaagccacggggagagcagccgctggaaggacagaaaaaggagtccctccagtttctgctggtgatgttgaagcaggtggggaggctggagggaaactagtccattttgatggaccattggcttttacagccgatgatctcttgtgtgcaactgctgagatcatgggaaagagcacctatggaacagtgtataaggctattttggaggatggaagccaagttgcagtgaagagattgagggaaaagatcactaaaggtcacagagaatttgaatcagaagtcagtgttctaggaaaagttagacaccccaatgtcttggctctgagggcctattacttgggacccaaaggggaaaagcttctggtttttgattacatgcctaaaggaggtcttgcttctttcctacatggtggtggaactgaaaccttcattgattggccaacaaggatgaaaatagcacaggacatggctcgtggcttgttttgtcttcattccctggagaacattatacatgggaacctcacatccagcaatgtgttgcttgatgagaacacaaatgctaaaattgcagattttggtctttctcggttgatgtcaactgctgctaactccaacgtgatagctactgctggagcattgggataccgggcaccagagctctcaaagctcaagaaagcaaacactaaaactgatatatacagtcttggtgttatcttgttagaactcctaactaggaagtcacctggggtgtctatgaatggactagatttgcctcagtgggttgcctctattgtcaaagaggagtggacaaatgaggtttttgatgcagacatgatgagagatgcatcgacagttggcgatgagttgctgaacacgttgaagctcgctttgcactgtgttgatccttctccatcagtacgcccggaagttcatcaagtgctccagcagctagaagagattagaccagagagatcagtcacagccagtcctggggacgataccatatag

SEQ ID NO: 12738 - DNA, 171 bp, Glycine max
  Peptide Sequence Number=SeqID_129516
atgtcggagctgagagatatacccttcgcattcttaaccgttgggatttgtgagaaatattcacagagagagaaaacagaatcgcacaaagcagtacaaaatggaggcctcaatccctttttctctctgacgtttgggaaccctatcagagtaatcaggggaagaacttga

SEQ ID NO: 12739 - DNA, 340 bp, Glycine max
  Peptide Sequence Number=SeqID_129517
atgaatcaaagattcgatttcgggaacttaccggttgaagaccgaagaacgaagaagaacgatgaagaatattcacgaaatcgctcttctgaaatgtctcggaagcgttacggaagcgcctcggcttggattttcgtcacagaaaccatttttctcactaatttcaagagaatcctaaataccagaagggttgaacgaaattactctgccctctttcccatatttatagggaaaatgagggagatggttgccgcccagctcgcccaggcgagctgggttgcttccaccagaaaggcaccaccttttgttggaatctcctggaaggcccaagtgggcctgg

SEQ ID NO: 12740 - DNA, 395 bp, Glycine max
  Peptide Sequence Number=SeqID_129518
atgcaattcatagaaacaactaaatcaactcaacaagcactccaaagtgtagaaatccaggttggtgagttggcaaaagcagtaactcaatttatgtccagacaagaaaaatcctttgtagaggctgaagctcaagagaaaagccctgtaaaagagcatgagtcaagagaaaaagatgaggagaaagatgaggaacaagcacaacaacaatgggagaagtactcaatagtagaaaaccaacaagaaaatattctccaaagcaataacctaactcatcaactgattgacatgaaaggaaggcaagaagagcatgaggaaaccttaagtgccattctttctttaataactaacacctttcttgaaatgatttggaatgtccttccagattatatgaa

SEQ ID NO: 12741 - DNA, 429 bp, Glycine max
  Peptide Sequence Number=SeqID_129519
atgggagaaatcaaggaggagtgcacgagcctcgacaagagcgagcaggagaaacagttgcatagcaaggtctcgaaggtggcgctatactcgagcggggagagcaaggcaatcgcgagtgcgtgcgaaacggcgtcatcgcttggaagcaacgtcatcgacgaaggtggctacagaattgtgtaccatggcttgtttcccgatggcaccaagattgctggagacctggatcttatttgcccaaaggtatttggagcacctggaggctcacattatgctcattatcatttggttggaagaaggacggcccgtagagagattcttgctgagatgggatatgagttcacagtaatgactgcagacattgatgagaaaggtattaggagggaaaagccagaagatttggtaatggcattagttgaggcaaag

SEQ ID NO: 12742 - DNA, 1494 bp, Glycine max
  Peptide Sequence Number=SeqID_129520
atggcttacaacttccctgatgtgttttgctggattcagagtcttccaccaatctcagaatgggaaacaagttccatgtccttaaacatatgttcttcttcaagctcatcatgccaaccacgtcttaatctcaccgtatccaaaaacaatagcaataatcattcctcatcaaacctctattttgttattattgcagactgcaacattcccatccatctttggacctctaaacctttcaagccaagcagcaccactattactaataaaacccacaataataataagttaatagatgatgaagaaaccatttccaatctctttgttaatttcattcaagccatccttctttatggctccaacaaaaacagcactcccttcctcagatttccaaaccttgactccatcacttccaacaacttttcagatgttttcaatctttctttcttcaccctcttgttcctagtttgcatatatgaagctcctgctgcagattttcgttctgggtgtattagcaacttgaaagaccacttgacagggtctaacttggaagagcattggatgcgttcattgaacctcgcagttactaactgggttggggaacttgaagcacataacaaccccttcagaacaccgtgccctttgttttcttatgcattttcaacaattgggttgtggaaggtgcagctttattgtcccctcttggtcatggatgttgagaattcaaaaagcaatccagctagcgagaggcttcaattctccctcagatatcaccatgtggaaggtgttcttcagttcaatcacaaagtcttgatcaaagaggagtgggctgaaatcatggtggacattgacaacataaggtgtgatgttataaaattggtgaatgagtcccttatgagccaacgaggggtaggtgcagctgaaaaacattttccttcgagaatatcattgcaacttacaccaacactccaagaccaagtgttgagcctatcagttggcaagtcctcagagaaccctcgaaaagaaattggtgttgacaaaagcgtggaagcttcatttgaaccatccaatcccttggcacttaaggtgtcagctggagaatcctcaaccgttagtttgaagccttggaaattcgaggaatctgtttatggatacagtgcaaatttgaattggtttcttcatgatagtgttgatggcaaagaagttttctcatcaaagccttcaaagtttgcaatgcttaacccaaagtcatggttcaaaaaccgatactctagtgcttaccgacctttcaacaaggaaggaggggttatatttgctggtgatgaatatggagaaaaagtgtggtggaaagtggacaaaggagccatagggaaaacaatggagtgggagataaggggttggatatggttaacatattggcctaacaaacgtgtaacattctacaatgaaactaggaggttggagtttcgagaaatagtccatctcgacgttgcttag

SEQ ID NO: 12743 - DNA, 996 bp, Glycine max
  Peptide Sequence Number=SeqID_129521
atgtcccatgtgcgagcctcccttgagaagcaggctgtagttcccattcataatgccggatggaactctaaaagtaggcttttcatccagcatttggcatatggtcagaagcacattaattcccacacgaaggggaaaaacacactaatttcatgtggaaaaacagctgaagctatcaacgcatccaaatctgatgcttcttcagataacactccacaaggctcattggagaaaaagcctttgcaaactgctacttttcctaatggatttgaggctttggtattagaggtctgtgatgagactgaaattgctgaactgaaagtaaaggttggagattttgaaatgcatattaagcgaaacattggagcaacaaaggttcctttgtctaacatttcaccaactacaccaccacctattccaagtaaacctatggatgaatcagcacccggtagcctgccaccttcaccaccaaaatcatctccagaaaagaacaacccatttgcaaatgtttccaaagagaaatcaccaagattggcagcattggaggcttctggtaccaatacctatgtcttagtatcatctcccacggttggcttattccgaagaggtagaacagtgaaagggaagaagcaacctcctatctgtaaagagtttagagcccaactatgcactgtgagctgccccataccaggccagcaggttgaaattgggcttagtcaaaacaaattcccaaagccttggaaagagaagagaatcaaccctgatgagcagagagttggtttggagggaattgccaggggatatggaggagggggtgtgcgcattctcttgggtagctcttggggtgatgtaatcaaagaagggcaagtcatagggtatttggatcaatttggcactggacttcctattaagtctgatgtggctggagaagtgttgaaactacttgttgaggatggaggtataataatgtctattacctgttacaaaaatgcctag

SEQ ID NO: 12744 - DNA, 502 bp, Glycine max
  Peptide Sequence Number=SeqID_129522
atggcatcgtcgttagtgaacagattcatctgggtggcaaatgcatctacatgttcatctagtttgttccctccatgtcatgtcaacttcatcggtctctggcagatgagtttgatgggtgctggttgcagagaccgagtgcacgttgttgtcttcctgaatcttttggtactattctctaagggcgatgttctcccttcggaggtcctgcatctcttgggcattctgctactacatgccattcatctccctttgcaaggcaacgatcaaggaatgattctcatggctggcatgccaaacaagttggccacctaccccagtggtggtctttggttgcctgtggaggtgttgtcgttgtttgtcaccattaatgatgatgatgtggttgaaggaaaatttttccttggtctcacggtggacgccaaatgttcttaccatattcaacaagacctgctcacgatggtgctctttcataagcctctccatgaattgcgatgggaag

SEQ ID NO: 12745 - DNA, 2199 bp, Glycine max
  Peptide Sequence Number=SeqID_129523
atggccgctgcatctgaaattggaaacaagtcaatggtatgccaagatccccacagttttggtcaccttgatatctggaaaggaggcaacccattagaatcccccagttgtcttctctatatgcaggtctctttgatgaccatggtcacacagtttatggacgcatgtctcaagtcactaggtcaatcctccattgtatcccagattatgggtggagtgctgtttgggccatcaatgttggggaacaaaaagattctggggctagccttatttcctacgaagggcgctgtagtgcttgacacagtttcattgtttggtcttatgttcttcttcttcatatggtgtgttaaaatggatattgccacattaatgaagactgaaaaggtggccatcactcttggtatttctgtattcgcatttacattgataatccctactggactggccttcctgatgatgaaatacattgcgatggacgggagcctcgcaaaggcactgccatttctagctatgtcgcaaaccttaactgtgttcattagcatagcagtgctcttgaccgatctcaaagtccttaacactgatataggacgcttaacgatgtcagcagcaatgtttgctgatgtagctggctttatcttgacagtgattctgtttgcaatactgcaggatcagagtggtagctttgtgagactagcatgcatccttctgtccatagttggagtctggcttcttgttatatttgtaatgaggccaacaataatttggatggtaaagcacccaggtcgaggttcggttaatgaaatctgccttgtttgcatctttctcttagttctcttatctgcatttgtcagtgagttaattgggcagcattttataatgggacctatacttttaggcttggctgttccagaagggccacccataggaacagctttgatgagtaaattggagacaatctgtacggcatttctttatccaatctttctcgctgttaatggactgcaaactgatttcttcaaaattgataagcagtctctgtggattgtgtgtgtcattctgattgtcgctttctttgtaaagattggtgctgtcatgttgccaggatactattacaatctacccttgaaacaatgttttgtcattggcctctttctaaatggaaggggtatagctgagcttgccacttacaatatgtggaaaagaggcaagttaatatcggaacaagagttcgctttgatggtggcctcgattatagtagtaaattgtatcctagtaccactcataagatacatatatgatccttcagaactatatcagaccggaaaaagatgcacaattcagcatactaggcgagatttggagctccgagtgatggtgtgcattcacaacaacgaaaatctccccatgatcctgaacctcttagaagcatcctatgcaagcagagagagcaggattgaggtaacagcattagtcctagtggagcttcaaggaagagccaggcctatcctttttgctaatcaagaacaaccccatgatgagatgcgctcaatgtcttgcaatgcaagtcacattgacaatgcattgaggcaatacgcacaacagaacgaaggatatgtatctgttcaatccttcacttcaatctccacctttgaaaccatgtatgatgatatttgtaaaatctcactagacactggatccaacattttgatcttgccattccacaagaggtgggaaattgatgccaccgttgagatttctcataggaccatccaaaccatgaacattgaagtcctcgaaagggcaccatgttctgttggaattctagttgataggggcatcttgagtccttctccttcactcttgatggctagagcagcattctatgtcgctgtgttcttcatcggcggccaagatgacgccgagacattagcctatgcttccagaatggttaggcatgaatgtgtgtatgtaactgtgggacatgatcaatggagtgagtgccaagaactaggggtaattggggacatgctagcatcaccagattttgtgaccaaggcatcgttgttggttgtgcaacaacagaaaataagagggacgcttgttaaacacaatgtcaatgcgaatccagtgcctaatcacagagatcagctcgtatatgatattccaaatgatacagtggacaagtatgacagagtgtag

SEQ ID NO: 12746 - DNA, 207 bp, Glycine max
  Peptide Sequence Number=SeqID_129524
atgactgcagttaatttgaattatgtaattggtatgctattagctgcttctcaacttcaggttactgtctatactgtaacaaactttgtttataggggcatgtttggattagtaaagcatcaagaaatcgaaattcagtttggaaagtgtgcggtaaacggccaggatacagagcaagcgattctgattcatgaattggagaactaa

SEQ ID NO: 12747 - DNA, 633 bp, Glycine max
  Peptide Sequence Number=SeqID_129525
atgatatttattgtgtcatttgaattgaaggtaattgattgccgaatttgtggtgatccacattctgttctccgttttgcttttgttgagtttgcagatgagtatggtgcaaggaccgctctaaatcttggtggtactgtgcttggatactatccagtcagggttcttccttcaaaaactgccattcttccagtgaatcctacattcctccctaggtcagatgatgagcgtgaaatgtgtgcccggactgtctattgtacaaatattgataaaaaggtttctcaagctgaagtgaagaatttttttgaatcagcttgtggcgaggttatgcgcctgaggctcttgggggaccacgtgcattcaactcgaattgcttttgtggaatttgcaatggtaaccaacttcaccaagtgggataaagtttttgttgttttatgcacaatggcatttaccatgttaacttgcacaagaggaaccattatcttggctgactttgtttttcttcttgagcaggctgaaagtgctattattgcactaaactgtagtgggatgctcttggggacccagccaataagggtgagtccttcaaagactccagtgaggccaagggtcactcgtccggcgtctcattaa

SEQ ID NO: 12748 - DNA, 189 bp, Glycine max
  Peptide Sequence Number=SeqID_129526
atggatgttgcattaagggagaagttgaacaagattatgtcttcggagtactttactaccacacctgagatgaaggctctggttgaagttgttgcggcagctattgggggcaattacgtttccttccatgtgctggtgcgtgggtctgtggttccggttgaagtggagcagcctgtttttcagtcttag

SEQ ID NO: 12749 - DNA, 555 bp, Glycine max
  Peptide Sequence Number=SeqID_129527
atgactagccctggtccaagatctataattgagagtgcaagtgttacacctattcatccaatagctgggggaacacccaatgaattacaactaggaaggattaatcataggtactcaacaaattttgtcaggacttggaaaattgacatgctaaaaatactgtccacaggggtctatgcaggagatccttcaaaattaagtatgaaagtagcatttgggaaagtttggaggctggaaaaaaaatggtggtaccataattggtggaactgtcaaagcaatagaagagagaaatggaggcgtccaccaaaaccaaagggtcaaactgttggatctttttggaagggacttaccatgttgcctggtgcaatttttgcaagattaggcaacaaagtaaagttatcttggaagctttcaagtattagtaaactggatagtggagagtacaatttgacatatgaaacaccagaaggagtggtttctttgcagtgcaaaattgttgtcctgaccattctttcctatgttgctagtacattgttgtgttctctgtctgtatga

SEQ ID NO: 12750 - DNA, 894 bp, Glycine max
  Peptide Sequence Number=SeqID_129528
atgaacctccacggagctgtcttgcttggccagtttgacagtgagcttgcagtagtcggaggggcgacgaccgtcgactcagagaacttagacgatgtgcgtgtggttgagggacaaaatgtgcgtgaggtggggagaaaatggctgaagaacaacacaatggctcagagaatgggggttagagctgaagcttgtcaaccgcgatgcccaggtgctagtgccccttactcatctgcaactcaacaacctggatgcttgccactagtacgcatgggaagtagctacactggcatgcctttacaaccatctctcttatgcaagccatcatgggtgtttacgcatttgcctagtgttggctacttagagccagaggattatgtggttgaggacccgatagccaccagatggaaggcattgaaaggtattaggtgtgcccttccagttaggaagaaactggatgacttacaaattgatgttgtcttgtggtgtccatatgaggaccataaggatatgaggcctttggcacaacaaacctttttctttggctttaccagatgttggacttacgtgaggccttattgtttggagagggtgttaaggcaatttggccatgtttgcacctccaactatcttccatggttttacaaggcttcttatccctgtgtcattcttccgaaggagggacaatcactacctagtcttgtatgtttacctcctattaaagtacagctaaagcataggcaaccactagcaaactatgtaccaagatcaattctggatgacattagaagctatgcaaagcatgttgagcctttgagttgtgccagagagcacgagtcatcatcatctcatacaacaagctttgcaacggttggaggagggcttagcaactga

SEQ ID NO: 12751 - DNA, 1082 bp, Glycine max
  Peptide Sequence Number=SeqID_129529
gggaggcgcctgcaggagctcccgacgatgcagaggaggcccgcatggatgaggagatgacagacttgctcgatttcttgggaggaagcggagccacgtcaccgagttatttcgtcaccgtttttgcgacttaccatttcgtgtgttttttgtttaccttgtggttagacacaaattatgtgtacacacccccaattgatgtggataaggaagtattaggtgcacatgtgagcacaaagggtagcaatgctgaaatttttgtccacacatcaggggaagaacatgatggtaatgttatatcgactatggggttgtatgtgcatggtgataattgtacatgcttggtggccttaggaaacatacatgatggggggtccatcatacacaacgtcgcttatgtagatgatgtagtaagggcccttgacgcattcattgcatggacgacaaatcttgtgaaacttgtatcacatgaggattcacatgttactcctaagaaagtggatgaacatgttcaaagaaagaatgatgttggtgcagaagatccgttgtgtcagttgattaggaccctatatgacatttacaacaagcctgttgagttgttgtgggatgggagtaaatatgggattccaaatgcggatgcatcgttcttcttaacattttcttatgtaaatgaaatagtaacagataggtttatggatgagtggagtttgaccttaggtcatggtttggtgtatggaatcccaacggcccattggcagctgcttgttttgtgccctacgaaggatgttgtcgtttggttctgttcgttgcataagaagcctgataatcatatcaaagctgtagctaacaacagtgcaatgaagacattaaagagcagtttggatggccatattgataaagttgcaacgcagtggattgaaataaaaagtcatgttcaaaccggtaggtatgagtgtggttattatgtcatgcactggatgtggaacatagtaagtgaggggttgaagaatgatttgagcatgtggtttggtgtttgcacgccattagacatggagaccatgacaacaattcgcaagaaatag

SEQ ID NO: 12752 - DNA, 771 bp, Glycine max
  Peptide Sequence Number=SeqID_129530
atggctggtttggatttaggcacggcttcacacttcgtccaaagtctccatagaccagacttcaaccaacaacaacaacaagaatccgaggaagacaccaaaccccaagatgggccccaacagagcgacgtggtggggcggcgcccgcaggctccaagaacaagcccaagccgtcgatcatcattatgcgggagagcaccaacaccctctgcacccacatcctcgaagtcgacagcagctgcgatgtcttcgaaagtgtcgccagcgtgggtcctgtatcctcaacagcagcaaaatgatactctccctgacgggatcgttccttcctccgccggctccgtcgggggcaacgagtctcagcatatacctcaccggaggataggggcagctgaggaagtatcatctatggtcctgacaaagatgcgagaaattgtagaggattatttggaagcacctgtaaaaaatgttgttactatgcctgcttatttcaatgattctcagcgcaaagccaccaaagatgttggtgtcattgttgccctcaatgttatgggcataataaacgaacccactactgcagctattgcatatggccttcacaagtgcactatttgcgttagagagggaaatattttcatatttgaccttcgtggtggtacatttaatttgacgtgtctctcctcacaattctccattaaggttaaggagtttcaagttaagactactccaggaaagactcaccttggggagaggactttgacaacagaatggtga

SEQ ID NO: 12753 - DNA, 846 bp, Glycine max
  Peptide Sequence Number=SeqID_129531
atgaccttcacatatttggttatctggctcactaataatcctgagctatggggtttcgaggctgagggacttggccatgcccatggtgatggcagtcttgcgggtgtcaggctggcctgcaaggaggactgtgaggtcgacgatcttgtcatcttttatcatttggaggatcacaccggtggccttaggagtgacaattttcctgaccatgccgtccaagatgacactcaagacgacgcgtgggaccaagccaacatctccagccactaccccaccatacaaattgaagccataactgtcaaaaacaaagtgtttgtggacccaaacaacatgacaaagttcctcgtacccaccatgaagaacattcacgattctctagtcaagacaacctcagcaaaaacattagaatctcctcacccatcacatttttgtttctctctgcaatttctttcacccgcaccgatgacaactcccactaccatcgtcagtggatccaacatgaatggtgtcctagcagaacctctcttgggtgacaaagacaatgtgggcgatgctcatgacaaccatgaggtagacctcgagggcggaggtagaggcaaggcacccgtgaaggttgtgatcatcaatacccaatacgtcgaaaccgatgccacgagcttcaaatccgtggtgcagaagcttacaggtaaagattctgacattttagatgcaaaggttcagaggaagaggcatgatcataaaggtggggttgagggtaggtcgtttttgatgagagacatgtcgtttaaggagttcgataggttgctcagcgagatgccaccgttaaacgacctttgggctgattaa

SEQ ID NO: 12754 - DNA, 621 bp, Glycine max
  Peptide Sequence Number=SeqID_129532
atgggtgtaaatcttcatcaacagattgaaaaggagtgtgaagcacatatatctgctgcactgcagtctttggttggccaaagcccagatttggttgtttttcggtctctagttgagagatgttggcaggatctttgtgaccaaatgttgatgattcgtggtatagccttgtatctagataggacatatgtgaagcaaacagcaaatgttcgatcattatgggacatgggcttacaacttttccgcaaacatctttcattgtctcctgaagtagaacacaaaactgttactggtcttctacgaatgattgaaagtgaaagtgcgttcttgtgcgaaaagcttgaatccgtggaccgtgaaatgagcaaccctcttagtgcggagatcgaatccaagtccttctcgccgagcagatcgatggcatcgtcggtgactcttggtctcgtggcaagggttttaagaagacgtgtcgttgatttggagctcttcggagagagcggtggagaaaggttgtcagagcttattgagctcatcaatgagggcgaggaaggaggctgtgatgaagcagctgaggcgacaacgaatgcgagaatgagagagagtggcatgtaccctgcgtga

SEQ ID NO: 12755 - DNA, 174 bp, Glycine max
  Peptide Sequence Number=SeqID_129533
atgtctattagccatattatctctgcagtttacactagtcttacttgtaagacatcttttcacagtgcttacaaatggaacggaagattacccatttacaccacttactggtgttgttatttttggtgcctgcgtagatctggtcctggagatgaaaaaccaagtagtgtctaa

SEQ ID NO: 12756 - DNA, 225 bp, Glycine max
  Peptide Sequence Number=SeqID_129534
atgcctatgaaaaagaaagggggaatgtctaagaaggagggtagctttttcacgttgacttcgtgcttagcacgggttttcgcgctaagcgtacctttgggcttcctcgtgagcatttttcacgctaagcctgaattgcgcactgagcgagagtgtgcactaagtctggacttgccggctaagcgagagtgcgcaccaagcctgaattgtgcgttgagcgagtag

SEQ ID NO: 12757 - DNA, 480 bp, Glycine max
  Peptide Sequence Number=SeqID_129535
aaccaaaccgggtacggatttcccgacccgaccggagacgctgctttcccagacacagggcaaacggccggcgccggagctagccggaacaatctcgccggaatcgtggatgcgggtgacggtgagggcggtgttgaagtactctctgatctgagtaattatcccatccgtgacggtgcaggcgtggacccaggcaatgttgcgggcggtgtcgcagccctcgacgatgacggtggagccgaaggcggcgatggactgcggaaggaagcggaaggagttgtcggcagcggagtcgccggtgagcatgcgcatcaaaaactgggcgtcatacagtgcgagcaccagccgcttgttgctggaatcagcgtccgaaccacttgcctgagagttagccagttcgagaaaagagattccgcgttgcgtcttgaaatgggaaggaagaggggtttatataggaagtccgcatggggaagcttgtga

SEQ ID NO: 12758 - DNA, 1698 bp, Glycine max
  Peptide Sequence Number=SeqID_129536
atggtttcggttgataatgggattgggaattccaaagatgaaattgaggaatctaatgggaataaagtgaatgagtttacatctatagatatttcaactactcataaaacatttgtgaacagtgaagatcctcagagaaggcttcagggcacgttaggttcttctgttcctaataggataaactttcttaaatttgattctgcatctgccaaattcagaaggcttgctactgagagagaccaggtttcactatctgtgccttctcctcgtccaaagagcttaagatcacgtttcagtggcatgtttgctcagaaacttgactggggttcagtcaagaaaatgttcattgaatggattagaagtccaatgaacatggccctttttgtgtggattgtttgtgtcgcggtttcgggagcaattctgttccttgtcatgacaggtatgttgaatggtctactacctagaaagtctcagagaaatacatggtttgaaataaacaaccaaatactcaatgcattgtttacactcatgtgtttgtaccaacaccctaagagattctaccaccttgttcttctgatcagatggagaccaactgacatctctaggcttagaaaggtatattgcaagaatggcacttacaagcctcacgagtggacacatatgatggtagttgtgattctccttcatgttaactgttttgctcaatatgcactttgtggtctaaacttagggtataaaaggtctgagaggcctgccattggagttggaatatgtatatcttttgcaattgctgctcctgcaattgctggtttgtacaccattcttagcccacttgggaaggactatgattgtgagatggatgaagaagcacaggttcaagttacggcttctcaagggcaagagcagctgagagagaaaccatttgagaagaattattcatttgcatccaaagatgatcgacaaaggtttgttgaaaatagacctaagtggagtggaggaatacttgacatttggaacgatatttccttggcatatctctcacttttctgcactttttgtgtgtttgggtggaatatggagagacttggctttggaaacatgtatgttcatattgccacttttatgctgttttgtatggcacccttctggattttttttttggcttctgttaacatagatgatgacaatgttaggcaggctctagcagctgttggaatcattctttgttttcttggtttactgtatggtggattttggaggatccaaatgagaaagaggttcaatttacctgcctatgacttctgttttggcaagcattcagtttctgattgcatactttggctatgctgttgctggtgcactcttgctcaagaagcaaggacggggaataactatgatcttgtagaagataaattctcaaggaaagaaactgatactagagatgaaaaaccatcaatttcacctttggctcgtgaagatgtagtatcaaccaaatctggcacaagttctcctcttggtagtactagcaattcttccccttatgtgatgaaaacatctagtcctccaaattcaagcaatgtcttaaagggatattacacttcagataggatgctatctaatttgaaccaagagaattgtgaaagaggtaaagatggaacaatgaacccgccggctccttcattgatacaaagagaatga

SEQ ID NO: 12759 - DNA, 546 bp, Glycine max
  Peptide Sequence Number=SeqID_129537
atggaacaccctgatgtgtacgtggacggtttgcgcattcatgaagaagctgatatggaattcaacatccctgaacctactgaaaatgaacacaaaacctatcactttctcttgtcctttatacgtgttcgagttgtaagaaagccattaaaggaatcaaagaggattaagcgagctggaggacaagctacagaggttcacttcaagtttgagggccttggacctttctgttacttgtgtggccttatggatcacgttgacaacagacgatgcatcagaaattggggtctagaactcaaagcagagctgaggaaaccaattggtagaggcggctcgcggtggcttcgcgacggagctgataagaaagaatggagcgcacctggtgggcctagcgtgaccaatgctgtcattaattgcaatcaatcaagtggtgcaattaatgacactaatggcgatgaaatacgttcactcttcatatatggtggaatatttaaaaactcatcaacgtccagaaataatcaatcacagccaaccaatgcacgttaa

SEQ ID NO: 12760 - DNA, 1314 bp, Glycine max
  Peptide Sequence Number=SeqID_129538
atgtcaccggtcgccggagtcagtgcccccctcctgggggaatccaaagcagcgacgccgccggcttccgtccccggcgcggtgttcaacgtggcgacaagcatagtcggcgccggaatcatgtcgattccggcgatcatgaaggttctcggcgtggtgccagcattcgcgatgattctcgtggtggccgttctcgcggaactgtcggtggacttcctgatgcggttcacgcactccggcgaaacgatgacgtacgccggcgttatgagggaagcgttcggatcggccggagcgttggccgcgcaagtttgcgtcatcatcaccaacgtcgggggcttaattctctaccttatcatcatcggggatgtgctatctggaaagcaaaatggaggtgaagtgcatttgggcattttgcaacagtggtttggaattcactggtggaattcccgggaatttgctttgcttttcaccttggtcttcgttatgcttccattggtattgtacaaacgtgtagagtccttgaagtacagttctgcagtgtcaactcttcttgcagtggcatttgttggcatatgttgtggtttggctatcacagctctggtgcaaggaaaaacacaaactcctagattgtttcctcggttagactaccaaacgtcattctttgatctgttcactgcagttcctgttgttgtcacagccttcacatttcattttaatgtgcatcccattgggtttgagcttgccaaggcatcccaaatgacaacagcagttcgattagcattattgctttgtgctgtgatctaccttgcaataggtctatttgggtacatgctatttggggattcaacccagtcagacattctcatcaattttgaccagaatgctggttctgcaattggttcctttctcaatagtttggtccgtgtaagctatgcactccacatcatgctggtgtttcctctattgaacttctctttgagagccaacatagatgaagttctcttccctaagaagcctatgctagccacagacaacaaaagatttatgatcctcactctggtgctgcttgtattctcctaccttgcagctatagcaatcccagatatttggtacttctttcagttcctgggatcatcatccgcagtgtgccttgccttcattttccccggctctattgttttaagagatgtccacggtatatcaacaagaagagacaaaattattgcactgaaaaatttatttggggagagagggtgtgactggggagattctaggggcaatttggttgctgtggcgattgtgttacttttgtaa

SEQ ID NO: 12761 - DNA, 474 bp, Glycine max
  Peptide Sequence Number=SeqID_129539
atggtttctagagagcaaaaaagagcagcactgcatgagaagctgcaacttcttcgttctataaccaactctcatgctctaaacaaaacctcgatcataatagatgcatcaaagtatatcgaagagttaaagcaaaaagtagaaagactgaatcaacacgtagccaatgcacaaacttcaagtgaccaaaatactttgcctatggttacagtagaaaccttagagaaggggtttcttataaatgtttattcagcaaagacctgccctggtttacttgtttccatattggagtcatttgaagagattggtcttaatgtgcttgaagctagggttacttgtacggacacctttcgatttcatgctgttggaggaaaaaatgaagaacaaggtgatgagggtattgatgcacaaactgtgaaacaggaattgggacaagcaataaagaactggagccaaaatgctgaccaaaagtaa

SEQ ID NO: 12762 - DNA, 376 bp, Glycine max
  Peptide Sequence Number=SeqID_129540
atgtgtacttgtgttgtatgttctagacttctagtagtaaatgatgagctaaccattgaggaagaagctgagaggaaagtcggatggctattgaagacgatattttttgtgactgcaggggtagcaggataccatttctttccttatatgggagataatttgatgcaacagtctgtttcacttttgcgtgtcaaggatcccttgttcaaaaggatgggagcttctagattggctcgttttgcggtagatgatgaaagaaggaagaagatagttgagatgggcggagctaaggaactcttaaatatgttaagcactgctaaagatgaccgtacacggaaagaagcattgcacgctcttgatgcattgtcacaatcag

SEQ ID NO: 12763 - DNA, 801 bp, Glycine max
  Peptide Sequence Number=SeqID_129541
atgctgacggtgcgcttcggctcgatcctttctccggcgatcggcggcctggtgatcgcccatatgggcattgcctggaactacggcctggcggcgttcggcaccctgctgacgctgctgccgctgctgagcctgccgcagctgatgccgccgccgcagccgcgtgaacacccgctgcgcgcgctggcgggcggtttcgccttcctgttccagaacaaggtgatcggcatggtggcgctgatcggcgcgctgctgaccatggccagcgcggtgcgcgttctgtacccggcgatggcggaaagctggcacatcgacgccgcccacctcggctatatgtacgccgccgtgccgctcggcgccgccatcggtgctttcaccagcgggcgcgtggcgcacgtggcgcgccccggatgggtgatgctgctgacggcgatcgcggcgttcgccgccattggcctgttcggcctgatgccgtggtacagcctggcgttgctgtgcctggtggcgttcggctacctgagcgcgctgaactcgctgctgcaatacggcctgatccagagcctgacgccggataacttcctcggccgcatcaacggcctgtggacggcgcaaaacgtggtgggcgatgcgctgggcgcgttgctgctgggggcgatgggcgcctttatgctgccggcgatgagcgccagcggtttcggtttcggcgcggcgctgctcggcatcctgttgctgttcgccatgaccggtttacgccaggtgacgctgcacaaaccggagccgcagcccgccacagaaaagtag

SEQ ID NO: 12764 - DNA, 261 bp, Glycine max
  Peptide Sequence Number=SeqID_129542
atggtggggtacgcaccttcaagctatgcagatttggtcttcactggcaaaaggatcgaagcgggtctgaaaagagtcaaatttgatcatcgtgctttgatgaatgagaaaactagggcaaatgaaatgaggaaggaacccatgttgaggctaccattcctacatggccaaatttcccatcagcccaacaatgtcattactcagccaataccagcacttctcattacccaccacctagtcatccacaaaggccatccctaa

SEQ ID NO: 12765 - DNA, 151 bp, Glycine max
  Peptide Sequence Number=SeqID_129543
aagccattttcaaaaaaagaacagggggacgaagagggaggagtggaagcggttggtgggagaattcatgcttgttttgagaggaagggttctagagggtgacgttgtctacgatgttggagatgcagaggtggtctttgcagtaacctag

SEQ ID NO: 12766 - DNA, 708 bp, Glycine max
  Peptide Sequence Number=SeqID_129544
atggacattttcaccttcagagggctacacgccctcaccttcagaggactacatgtcctcgcctttagaggacttcatgtcctcaccatcaaaggacaacacgtcctcgtcattagagggttgcacgccctcgtgttcagagagttgcacgcccacgccttcaaagggatacatttcctcacctttagaggactacacgtcctcgccttcagaggattgcacgccctccccagcaggggaggactacacgtcctcccctgcaggggaggactacacgtcctcccctgcagaggactacacgtcctcccctgcagaggactacacatcctcgacttcagaggactacacgtcctcgccttcagaggaatggacgtcctgaccttaagagggctacacgccctcactttcagaagactatacgtcctccctttcagagggttacacgccctcgcctttagagggctacacgccctcatttctagaggactacacgtcctcaccttcagaggcctacacgccctaaacttcagagggctacacgtcctcgccatcagagggctgcatgccctcaccatcagaggactacacgtcctcgacatcagaggactacacgtccttgccttcagaggactacacaacctcgccttcagaggactacaagtcctcaacttcagaggactacatgtcctcgccttcagaggactatag

SEQ ID NO: 12767 - DNA, 1602 bp, Glycine max
  Peptide Sequence Number=SeqID_129545
atggagcgctacacgctacccgcaccacccattaatattattctcgaggaagaagaagaagaagaaaacattgccattgccatgggtgcccctcttatcccttcctttaaatccatgcttcaacaccaacaacaacaacctgactcttacttcaacttcaactttaactcttcaattagttctgctaccataccctttgttcctaacatggaatcttttccttctcttgaccctttctccccttcactttcatcacttcctttcttcaacaacaacagcagcaacaacatggcatttgacccgggttttgacttgggcctggacactactgggcttcactcttctgttcctcctgctccccatcttttttcccaggcccagatgggctttgagttctcggaactcgaggccctcactggacctgggaatggaaataatgccccttttgcggacggggcaaaggtggctgcggccatgctgctgcggccacctcctctcgatggggcgcagcagcagcagcagcagccgacgctgtaccggaagcggagggggacggcggcggaaattccggggctggagacggtgaggaggaaggggaggaagtgggaggaaggaggaagaggaggggagggggaggaagggagcagtgctgacgtggatggttccgggttgaactatgagtctgatgagcagaatgagaataatgggaacaatggtttgaagctgagtgagaataatggtggagataacaaggggaagaggaaggggttacccgccaagaatctcatggcggagaggcgccgccggaagaaactcaatgataggttgtacatgctcagtttagagtactgtgttggtctgattgttgttgccattgactggtttattaaggctaagacacttcctttatgtgttgggaacttaagaatgatggatagggcttcaatacttggggatgcaattgactacttgaaggagttgctgcagcggattaatgatcttcataacgagctagagtcaactccacctggctcgttgctgacaccttcttctacaagctttcagccactaacacccaccctgccaacccttccctgccgggtcaaggaggaactgtatcctggcaccttgccaagccctaaaaaccaagctgcaaaggaactaggaaaaagtgttggacaatgctccaattacagttatgaaagcagggaaaaatttacacctctcctcatacctccaccactcccttctttaatgtcctgctgccacctgtcattttggctagacccctccctttttcatctaacagacttctccaactcatttccactactgctccttccttacttgcttgtcttctttctggttgaggttagagtaagggaagggagagctgtcaacattcatatgttctgcacccgccgaccaggtcttttgctttctaccatgagggctttggataacctcggattggatgtacagcaggctgttattagctgttttaatggctttgctttagatgtgttcaaagccgagccaagtagtcaaccaagactagtgggagattcagagaaggcttggtggtggtgtactgattgttga

SEQ ID NO: 12768 - DNA, 2313 bp, Glycine max
  Peptide Sequence Number=SeqID_129546
gaacctcggcgccttgacatcttctccaaagcgacacctttatgtcgacgcttccatgatcaagacaggcttcgatcccaacacgtaccgttacaatttccaagttcagatccacctccaacgtggggatttgggcgctgcacgcaaactgttcgacgaaatgcctcacaagaacgtcatctccaccaacacaatgataatgggttacataaaatctggcaacctttccactgccaggagcttgtttgacagcatggttcaacgctcggttgttacgtggacaatgctgatcggtggctatgctcagaacaaccggttccccgaagctttcggtctctttgccgatatgtgtagacacggaacggttccggatcatatcatcttggccactctcttatctgggttcactgagtttgaatctgtcaacgaagtggcacaagtgcatgcccatgttgtcaaattggggtatatttccaccctcatggtttgcaactcgttgcttgattcttactgtaagacgcgtagccttggattggcctgtcaactcttcgagcatatgccagagaaagataatgttactttcaatgcattgttgatgggatactccaaagagggattcaatcatgatgccataaacctgtttttcaagatgcaggatttgggatttaggccctcggaatttacttttgctgcagttttaactgcagggatacagttggatgatatagagtttgggcaacaagttcacagttttgtggtgaagtgtaattttgtgtggaatgtgtttgtggctaattctttgcttgatttctactcgaagcatgatcggattgttgaggcaaggaagctttttgatgagatgccagaggtggatggtatctcttacaatgtgctcatcatgtgttgtgcatggaatggcagagttgaagaatctcttgaacttttcagggagttacagtttactagatttgaccggaggcagttcccttttgctaccttgttgagcattgctgcaaatgctttgaatctggaaatgggtaggcaaatccattcccaggctattgtaacagaagccatttcagaaattctggttaggaattcgttagttgacatgtacgctaaatgtgacaaatttggggaagcaaataggatttttgcagatctggcacatcaaagttcagttccatggacagccttgatctcgggttatgttcagaagggactccatgaagatggcctaaagctattcgttgagatgcaaagagccaaaataggtgctgactcggccacttatgccagcattttaagagcctgtgcaaatctagcttcactgacactaggaaaacagttacactcacatataatcagatcaggatgcatttcaaatgtattttctgggagtgcactggttgacatgtatgcaaaatgtggatccataaaagatgcacttcaaatgtttcaagagatgcctgtgaagaactcagtctcctggaatgcactgatttcagcttatgcacaaaacggagacggtggccatgctcttagatcatttgaacagatggttcattcaggtctgcaaccaacttccgttagcttccttagcattctatgtgcctgcagccattgtggtctagttgaagaaggacaacagtactttaactctatggctcaagattacaaacttgtacccagaaaagagcattatgcatcaattgttgatatgttatgtcgcagtggaagatttgatgaggctgagaaattgatggctcagatgccatttgaaccggatgagataatgtggtcatcaattctcaactcatgcagtatccataagaatcaagagttggcaaagaaagcagcagaccaactattcaatatgaaggtccttagagatgctgcaccatatgttagcatgtccaatatctatgcagcagctggtgaatggaacaatgtgggaaaggtgaagaaggccatgagagagcgaggggttagaaaggtcccggcatacagttgggttgaaatcaaacagaagacccatgttttctcagccaatgacacgtctcacccacagatgaaagagataacgaggaagcttgacgaactggaaaagcaaatggaggaacaagcgtataaacctgactcaggctgtgccctttacaatgtggacgaggaagtcaagaacctacgagcttgtgatgattgtcatgctgctatcaaagtaatctccaagattgtaaatagggaaatcacagtcagggattcaagtagattccatcattttagagatggatcttgctcctgtaaggaatactg

SEQ ID NO: 12769 - DNA, 636 bp, Glycine max
  Peptide Sequence Number=SeqID_129547
atggtgacatctggttgttacaatacttgtctatttcaggctgctgatggtcagcatctaattcttcatcctctgaacatgaagtgtttgcttcaccattatgggagctatgatatgcttcctcacagaataagtggaaggattctacagttggaaacagttactcagactgaagccatcaggaggcggtatcgatttcttagtcattttccattaaccacaacctttcagctttgtgaagttgatttgagtgagatgttgcctcctgaagcattggccccatttatagatgaaatcaagaagcgtgcaaatcagaggaagcaacttgcaaaaaaggaaaagaaggaaaaaataaaggctgaagctactgctgcttattctcttcccatatcattaagtcatcagtttacttctcgcgatgatcctccaacattctccatggatgactttgaagggttctgctgtaatttatctgcaatccctcaagacagggtaattgttagaggtagttccacaatggaaatagtacagaacttgaacacaaataaagaacaaggaacggaaccaccaggattgactcctgagagacagaccagttgcaggcatagtaccaaagggatactcaattttggatag

SEQ ID NO: 12770 - DNA, 1917 bp, Glycine max
  Peptide Sequence Number=SeqID_129548
atgcacttgaggtttcataggatgaaagggcacttacaattgatggcaaaggaagaatcttattctctggttccattcattatcctcgcaggactcctgaaaggtctcccagtttggttgcacaatattcccaacatggaatttaggacacataatcgtgcatttatggaggagatgaaaaccttcacctctaagatagtggacatgatgcaggatgagacactatttgccatacaaggaggacccattattattgctcagattgactcgtctaacggttattattgtgatcaatttcaacctaacgacaaccacaaacccaagatatggactgagaattggactggcgggtataagaattggggtatgcaaaatcctcatagacccgctgaagatgtagcttatgcagtttccaatttggtggcacatttcaaaattattatatgtaccatggtggtaccaactttaaacgaactgccggaggcccatatgtcactacttcgtatgactatgacgctcctttggaagaatatggccatagtgtacacttatgatggaaaatcagtttgcttcattggaaatgcacatcaatcaaaggatgctacaattaatttccgaaacaatgaatacaccattcatgcctgggaagagctgtttgtccaaattaaagatggactaatcaccggcatcattgacttgactgctcgaaaactcttggatcaaaaggttgtcacaaatgattctagtgattacttatggtacatcaccagcattgacatcaaaggagatgatgaccctagttggaccaaagaatataggctaagagtgcacaccagtgggcatgtactccatgtatttgtcaatggaaaacatgttggtacccaacatgctaaaaatggacaattcaagtttgtttccgagtccaagatcaaattgactaccgggaagaatgagatatctctacttagtaccactgttggattacccaactatggtcctttctttgacaacatcgaggtcggtgttcttggtccggttcagttggtggcagcagttggtgattatgattatgatgatgacgagatagtcaaagatctcagcaaaaataaagggagttataaagttggactgcatggggagcatgagatgcattacagctacgagaatagcctcaaaatatggtatacagatgctattccgaccgaaagaatttttgtttggtataagaccacattcaaaagtcccattggagatgatcctgttgtggttgatttgagtggattaggaaagggtcatgcttgggtaaacggtaacagcattggtaggtattggtcaagctaccttgcagatgagaatggttgctctccaaaatgtgattatcgtggtgcatacacttctaacaagtgcttgtcaatgtgtgcacaaccttctcaaagatggtaccatgttccatgctcatttcttcgtgacgatgatcaaaacgcattggtcttgtttgaggaattgggaggtcacccctatgatgtcaactttctcacggtaactgttggaaaagtttgtgcaaatgcttatgaagggaatacgttggaattagcatgcaacaaaaatcaagtcatctctgaaattaaatttgctaactttggcttaccaaagggtgaatgtgaatcttttcagaagggaaattgtgaatcttcggaggctttatcggtcatcaaagcggtaatgtgtcatgccatgcctttaaatttcttctcggttcctttaggtaaaatgcaatgcattggcaaggataaatgttctattcaagtttctgagaaaacacttggacctacgaggtgtagagttgctgaaaatagaagattagcagttgaagcggtttgtgatataaacgtaagcggcgaagggaggaaacactag

SEQ ID NO: 12771 - DNA, 384 bp, Glycine max
  Peptide Sequence Number=SeqID_129549
atgcctaactcagtcttgtatgtctcctttggaagtgtatgtgctctcaatcaacaacagattaatgagctagctttggggttagagctgagtgatcaaaaattcttttgggtttttagagcacctagtgatcttgatgttaaaaatgatgaccctttagagtttttgccacacgggccacctcaaacccaaatccttagtcacacttcaactggtggatttgtgacccattgtggttggaagtcactaattgagagcattgttgcggggaaagggattcaccaaagaattggaaagcttaaggatgctgctgctgatgctttgaaagaacatgggtcctctacaagagcactttcccaatttggcactgaattggagaactga

SEQ ID NO: 12772 - DNA, 186 bp, Glycine max
  Peptide Sequence Number=SeqID_129550
atgaagaagcaacacaaaggtggttgttatctatgtcaaagcttcatcaagattgtcggagggaaggttattgcagccgatgagattgttgtggtaactactacttccaaagggaatcaccttactaccattttcggctgcaaagcaaagtatgggaagaagcaagaaggcatggcaactgaatga

SEQ ID NO: 12773 - DNA, 171 bp, Glycine max
  Peptide Sequence Number=SeqID_129551
atggccacaagcctttggattatggaccgggcctttgaattgatgcagagaagagtgtgtagccatatgatacatcatcatcttcttcttcttcgttctggacacacgacaattaacatagggtttgggattgatgcgcaggttacatggcatgttgccgttacttgctga

SEQ ID NO: 12774 - DNA, 255 bp, Glycine max
  Peptide Sequence Number=SeqID_129552
atgaccaaacttggtctctgcttgtcatcgggcccgccgcctctggatgacaaaagggtgcgaataaccataagaatgaccaaacttggtctctgcttgtcatcgggcccgccgcctctggatgacaaaaaggtgcgaataaccataagaatgaccaaacttggtctctgcttgtcatcgggcccgccgcctctggatgacaaaaagggtgcggataaccgtaaggtatctccgcgtatcatgggtgcagaatga

SEQ ID NO: 12775 - DNA, 327 bp, Glycine max
  Peptide Sequence Number=SeqID_129553
atggcgggagatgcatcaaagattattcatatttctcccaaagatagtgaatatgtgatctatggagacaacaaacaaagaataatcaaacaaggttgctttcaagatcacttcaacaaacattcaaaggttaagcattgcttcaagattaagacaaggttgcttcaacaaataaacattgcttcaagattcattcaagatcagcttttgcctcaaaacacattgtttccaacacgtcaaggctctggtaatcgattaccaggcagtgtaatcgattaccagaagacaagtttgcaaatcagctttttaaaagggtttgaaatttga

SEQ ID NO: 12776 - DNA, 218 bp, Glycine max
  Peptide Sequence Number=SeqID_129554
atggataatgaaaagggtgtgcaagaacagatgaaggccgacctatcagccttaaaagatcaaatggcttctatcacggaggccatgctaaaactccagaaaactatagaggataatgccacggcgaccgcctccaatacaactagggaagcggaaccggtgctacaacccgcaataaacttgggccgagatagaaatatgacagtgttcagtcggag

SEQ ID NO: 12777 - DNA, 576 bp, Glycine max
  Peptide Sequence Number=SeqID_129555
atgggtttaccttggtatcgtgttcatactgttgtattaaatgatccaggccgtttgctttctgttcatataatgcacacagctctggttgctggttgggccggttcgatggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggggtggcttgttttggttttggcgcatttcatgtaacaggattgtatggtcctggaatatgggtgtccgatccttatggactaactggaaggatacaatccgtaaatcccgcgtggggcgtggaaggttttgatccttttgttccggggggggtagcttctcatcatattgcagcaggaacgttgggcatattagcaggtcttttccatcttagtgtgcgtccaccccaacgtctatataaaggattacggatgggaaatattgaaactgtcctttccagcagtattgctgct

SEQ ID NO: 12778 - DNA, 252 bp, Glycine max
  Peptide Sequence Number=SeqID_129556
atgtgtcacaaaatttccaaatcatctaatactttacaaagtaaccatcattgttatagtacccatgatttctttcaagctgctcaccataattattgttggtaccaagaaatggtttatccaagtggtactagacacgaatcccttaagcatgtagtaaagggtttgaatcctgacgaatgcatatatggagaaaatcttgttgagagggagatcccacttatgagtgccaacaggtcccttggaggataa

SEQ ID NO: 12779 - DNA, 891 bp, Glycine max
  Peptide Sequence Number=SeqID_129557
atgaaaaatcagatgaaaggttgttttgccgccgtactgttcgcctgcgcgggcagcgcggcagcggctaccactacgcttaacgccctgtttatgacgcaggcggcctacagtgaaaacgatatccgcgccatgacgcaggcgtttcagacagcgcacccggacgtgcaggtcaatctcgagtttgttccttacgaagcgctgcacgataagatcgtcgcggcacgcggcgcgggcggcaatggttacgatgtggtgctgtttgatgccatctggccggcggaattcagcaagttcgacctgctgcaggatgtcagtagccgcatcagcgcagatgaaaaagagaaaatcttccccggcgcaatgaacaccgtggtgttcaaaggaaaaacactgggcatgccgtggatcctcgacaccaaatatctctactacaacaaagcgatgctggaaaaagccggcattaaagatctgccgcaaacctggcagcaggtgatggatgatgcgcgcatcattaagcagaaaaatatcgttaaatatccgctggtatggagctggtcacaggcggaagcgctggtgtgtgactacaccacgctgatctccggcttcggcggcaaattctataacaacggcaagctcgatttctctacgccagcctcgctgcaggcggtgaagctgatgaaaagctcgctcgatgagggcctgaccaacccggcttcgcgcgaatatctggaagaggacgtgcgcaaagccttttccaacggcgatgcggctttcgcgctcaactggacctacatgtacaacatggccaacgatgccaaacagagtaaagtcgccggccaggttggcatcatgcccgcacccggcgatgcgcccaatcgtttcggcgcg

SEQ ID NO: 12780 - DNA, 198 bp, Glycine max
  Peptide Sequence Number=SeqID_129558
atgtgggatcagcacaggcttaaaggagcactcaaatcgagtgcatttacccccaaggaagatccaatggttaaagagtccatgatcgtgagtttactggaacaggtgtatgcgggaaaaagagagggttttggaaaaggaagaagggaaaacgaaattgagaggaagaggaagcgtagagacatattgttagtctga

SEQ ID NO: 12781 - DNA, 285 bp, Glycine max
  Peptide Sequence Number=SeqID_129559
atggtgggagataggactagaaaacaaagggttaggagagataggtggacgtttagcactaataggacacaactaacaacttttttcttcactaatttcccgaaggatcagaatgaggaaaacttgtgggggattactagaccaggggtgaaggggggtggggtaaaacatctcagaggaacaatgaatgatccacaggcaaggaggggcgtgtcatacgcacaaatggtgagcaaggggaagccaatatgggtgaccaaagacaaagggagcataggacaatag

SEQ ID NO: 12782 - DNA, 582 bp, Glycine max
  Peptide Sequence Number=SeqID_129560
atgaccgcaacgactgagattgagaataaggagaaaatgattggaaaacaaaggatggagatggtgtcgcttgaggtctcattcctgcaccctgagctatgcagcttggaatcaatggtggagatctcttctcgaggcggtgatgtgggtggtggtggtcattcttgctacggtgacagtgttcgtggtcagaatctagtcagtccagcgtcgctggaagccgattcacggaatcttgtggcagtggtcgtagcagtaacaacggtgggtgatgcggagcaacagggcaacggatggtcggctggaagtggcactgcaatgggaagtagagctggcttgggtgcaggacttggttgcatggaagtggggcatggaattggagcttgcataggggtgtctgttggaggtgactgcgtagaggaagaagacatggagtgttggctcgatactatggtattcattttcaagagaatgacatcaagtttggaggccatggaggcttgggtcatgctggatgaggaaggttcgacttctaccattggagggcggctggtcaaaccaattgataggaacagaggatag

SEQ ID NO: 12783 - DNA, 558 bp, Glycine max
  Peptide Sequence Number=SeqID_129561
atgaacaataggaaagttgtcggttcttatgccagaaatggagggaagaggacttttgatgagcttgaagcagagatgcctcaaggccagaaattgcagggtgccttaattgcacaagaggttcatgaggttctaagtcatcacgggtggctacacatgtttcctctcttctcagtagtgcatgcaatcagcacaggtcatcttccaccatcagccatagttaaaatcagctaccaaaaacccaggtatactctttgttacaggctcagggtagcggcatgtataattaccaagcacactttagatgcatttacaaggatagaagggcgcgacaactctgaaaagggaaacattgtagcttgcggtggtccaacaagacgcgacgcagagaccaaggacgcacgacaatgtacgctaccttccttcgaccaacgtcacgatggtgcgacggagatgcaggcaaacagcagaggtcacaatagaaatttcagacaaatggggagggagctcgagcgaggtaggagtgttcatcaattagagcgcaaaagtggtatataa

SEQ ID NO: 12784 - DNA, 774 bp, Glycine max
  Peptide Sequence Number=SeqID_129562
atgtgttcttcacaggatgcgtttgaggagcaggcctcacagggttcctttgttgcccatggacgtcatgatgtactgactgctgccattgggcgaccagaacaccctggtcgtgtgcgtgctgtaggagtcggtataaccatcaagcaatactttgaatcggcttcaaggacctcctacacatcttccttcattgctcccgaagacctgcaacaattgacacaacaaatcagggaccagctggaggattcgatcacagaaaaagtcactcaacagctaatgttatccctcagccagatgcagtctcagtttcagttgcagatgcaatcacaaggactcgcactgcctcctgaacctgatgttggtcctttagctactcgtgtcagcacaaaggagagttgtgttgatcccttagggaacgatccatacacgagtgactcaaacaaatgcgagttgtatattgaagaatatcctcctcgcctagtttccctaggaagagtttatgagggatccacaaccgttcacaacattcttttgctatatgatcaagtcaaggttggtgttaaggaggttagagacgcagatgctcttattcctgtacccactaaagaggttaaggtcatgggacaggctcttaacacattccttgcttggccgacacatcttgtcaagcgtttatcagaacagggagctgtggaactcgcgaaacctgcagataggccggatcatgagatcgatgatcccttatatctgatgacattgaccatcccataa

SEQ ID NO: 12785 - DNA, 234 bp, Glycine max
  Peptide Sequence Number=SeqID_129563
atggctgagtctagcgaaagacccatgcaaagtgttcttaccaaaatctggaaccgtgacacgtcaggatggatgtggttgagtggtgtcccaaacttcacatgtcagctaggagaggtgcctttgacgggagggagggacctgcaaaacaaaaggggtgcgacggaacctgtatttatattagttgagtgtggttatcggtccttgtttgtaggggctgttgtagccttgtag

SEQ ID NO: 12786 - DNA, 186 bp, Glycine max
  Peptide Sequence Number=SeqID_129564
atgaacgaaaggattgagggcttgttttccatcaaatccttgaggtggattctaaggattccgctccgattaaaatgttcctttttgtatggtggtagagcggcaagcaatggtggctcgtggtgggcactagtggtcgtgggtggtgaagaagaagatcttgctttaacaagcttgtctcgctaa

SEQ ID NO: 12787 - DNA, 441 bp, Glycine max
  Peptide Sequence Number=SeqID_129565
atggcccagtctaactcctttagacttgggttccttgctcttatcacagctctatgtaggtccagaggggctgcttctgacagcctagtcttggaaaacttgagtccggtcattaacttggcctatatcaggaagaactgttggaaccctgttgatctgatagttactattagaggggctaggagagcgaaggcaaggccaattgaggctccttccacatctgcagctcctcctccagcacccaggcccgggactcagcctccccttcacagggaggccgaaagtctcaccgctcaggcagcagacccctccactcctgaggatcagactaccccaatcctatctccgaacacctctcctccagctacccctatgcttcacttaatagatgaggaggatgttcagacacaagatactcaagacagatcacaggatttttaa

SEQ ID NO: 12788 - DNA, 906 bp, Glycine max
  Peptide Sequence Number=SeqID_129566
atggcaggtccatctattggagaaaggggtcaacctgttaaagaggttggacctattgctattgttgttgctgttgaggtcacccccagtgctccttcctctattttggaaaagacgaagagggataatgctgttgggccgtctggccacaagaagtcgaaggcccatatgagtcttcgtgccctgaggcaggctgcagggttgatgcccattgtgggtcacccttcgactgtgcaagatgtgcctttagctccaccgattatagagtttgttcctggtattgctagtactcctgttacttcttctactcctgctccttcacctacttctactgtcgttgaagctgttgtgccaaccattcaggttgattctattgtggcgtcgtcatccaccattgtggcacctttgttaagtggtggtgtggctactactggcgctcccacggtgcttcctccttcctctacgtctccagtggcttctccttctactgtcttggcggtggtggcgtcgcctatttcgtcctctcgccctcacatctcactttatcacttgtacacctctagtgatgctgactcactgtggggtacaacttataagacaaaacagaagatcccggttgtctttgtgtcagcctttgacaagaaccttattaggttggctgagtttggtgattttggaggagaatggactgtggcaccaagaggctatgcaaaaggtggcatccttggaggcggaggtcgccaagctgagaaaatagacccgggtggaaaagtggagagcttggcggctgagagggatgggctagccaaagtacttgttgatttagaggctcgacttaaggagtcagattccaggttggaggagtccgagggctgccaaggagaaggaggccagacgagagcttaa

SEQ ID NO: 12789 - DNA, 183 bp, Glycine max
  Peptide Sequence Number=SeqID_129567
atgagtacgccaagatatcagcagaaagggaagcaagggaaagggagtcaagaacttccccgattgctagccaaggccaaagcaatggcggacacctactccgcccccaaggagatccacggacttctcagctattgtcagcatatgatagacttaatggaccatatgattagaaaccgctag

SEQ ID NO: 12790 - DNA, 291 bp, Glycine max
  Peptide Sequence Number=SeqID_129568
ggtacatcctttgtagtacaagtagagggtacatctacttgggttgttgtaactgagaacaagagagagtacatctcttgtggatcagttcaagtggagggtacatccacttggttgttcaaagagaacaagggaggtaaaagcctaattaaatctagtaacattaagaaggatagatccaacaatcaggtgcgggacagacgtgtggccttatcttccagaaagggtgctgaggcaatttggtcatgttcagagcaacctatgccatccactgcagcatctcacgtatga

SEQ ID NO: 12791 - DNA, 336 bp, Glycine max
  Peptide Sequence Number=SeqID_129569
ggtacatccattgtggtacaagtaaagggtacatctacttgggttgttgtaactgagaacaagagagggtacatctcttgtggatcagttcaagtggaggatacatccacttggttgttcaacgagaacaagggagggtacatcccttgtggatctttgcttgtaaaggtttttacaaggttgaaagaaatctcaagaaccagtggttgcatggggactggatgtaggcacgggttgttaccgaaccagtataaaattcttgtgtttgtcttcttcttccctacactctttaatttcctttgtgcacttttaattatcgcttttacttttggttaa

SEQ ID NO: 12792 - DNA, 417 bp, Glycine max
  Peptide Sequence Number=SeqID_129570
atggatttcttttctgatgagagtttcgaatgcattcaagcatttcaaaactcaaatctcattccctttatgtctttaaaactgcctgtgtattctgaattggtaaaagctttttattctaaccttgaaattcaagaaagtaccttgatttctgaggtctatgggataaagatgatcattgaccaatccctcttctatgatttgacccaattgtctagcaaaggtgtgccatttgaaggaacactggatgatgattggatatttgatttttctgtgcatgatgcctgccggttggtttgcaccaacaaagcggatatgaccggaaggctgcttgccggttcattggctcttgaaagccaaatccttcattatctaattgttcatatcctactccctagatcttcaaaccttgcacag

SEQ ID NO: 12793 - DNA, 660 bp, Glycine max
  Peptide Sequence Number=SeqID_129571
atgagagaaaaggaaagaaagcctcaagaggctaacattaacctcccatacttctatgggaaggacaatgtagaggctaacttagattgggaaataagggtaaagcaacaacttaaaaggaagtctacttcaaaatcttatggctctcactcttatccaaagaaagaccaaggtcaaggcatcttaggggtgacaccttttaagctcaaagatgataaggggaagacaatagaaaggcaaccccttaaggctagtatgcaagagaagactagatttataaagtgctttaaatgtcttggaagaggacacattacttttcaatgccccaccaagaaaaccatgattatgcggggccaatacatttatggtagccaagatgaggctactacttttccttcctctagtgaaagtaaagaagcaaaaggggaagaatctagtgaagagatctacccacaagaagaaagacaacctttaatggttaaggaggagtgtaaggaggcaagtgtctcctccaagaggttagctaagaaggaaaggtatcttgaaatacagacaaatattacagttatttcccctcttagacaacctccacattttctcctttgtgaaaagacccttgttagcattgccacacctcttaggcttgagtttattcctcaa

SEQ ID NO: 12794 - DNA, 120 bp, Glycine max
  Peptide Sequence Number=SeqID_129572
atgttgcgcttagcgccatccacgcgcttagcgcgacgcgctgaggctgcgcttggcgatggatacgcgcttagcccaattgctgagctaagctcaactgtcacttttagcacttcatga

SEQ ID NO: 12795 - DNA, 513 bp, Glycine max
  Peptide Sequence Number=SeqID_129573
atgcaatggataaaacaggcttccatacttaaggatgacggtacagttggaattaaagttccaggagcaggaagtaatattgagcatgatgttaaatgcaatgaatcttatgatgaaatttacaatgcaatacacagtcaggatattcagcctattgagccacttcaaatcgtaatgcttatagttggcacacggggagatgtccagccatttgttgccatggggaagcgtcttcaggcttgtagttttaccctttgggtggagatcccaaagttctcgctggtttgtttcttctctgttcatgctttcaaactatttaaatacatgatttcttcagatatggtcaagaataaaggcttcttgccatcgggaccttcagaaatacatatacaaagatatcaaatcaaggatattattaatagtttgctcaatgcatgcgacagtcgttacccagagtctaatgccccatttcaagcagaagcgataattgccaatcctccagcatatggttag

SEQ ID NO: 12796 - DNA, 1113 bp, Glycine max
  Peptide Sequence Number=SeqID_129574
atgtttggcaacaaagtgtttctaacttacaaaagaaagcggcaatctctaaatagtagttttatccatgggaattgtagcaaaaattcggtatatgaagatgcccacaatgacaagcaaaccgcagagaaatcatcagaaaaacatgaagaaaaaccaatggatactactagtgatgggaaaaggccatgtttcaaacagccaatttgttcatcattgcttccacttcaaaatatttgtgaccctaagacaggagagcttgtaaattatgatgcaacacaaattagggctactacacatgaatcatcttcagcaacaaatccaagtgaggataacatcaagagggatgttagtgaattacccttagtagaaaatgcttcacagaatgattgtgatacccagagaaattcctatgccgatgaaagctctggtaatggatgtgacaactgttctaataatattaattcccttccagttgaattggatgctggcgatgatttaaatttagtcaaatcagaaacattgatcataagggaattcagttctgcatgtgtcaataaatctcctgtttcaaataattcagtggatgaacctactgattcacactccaatgttaatttcaaaaacccatctggagacatggttttgcagaccaacttgaccagtccaataataaccttcaatcgatgttacaaaagaaaaaagggtttggagcagagcaacttatcgcacaagaaggaaagcatttcggcattaaccaaatggagtatgcttgcaaatggcaatccaggtttgagcaatgagtcatctagtgaggaaagtccagtagataatgtaccagaccttaatcaatcagtgggactttcagaaagagggcaggcattgagtgaaactcaagatgaaacatcttgtagaagctgctctatggttttccaaacagaccttaatcaatctgctgagctttcagaaagaggggagctttgtcaaactgaagaaaaagtaaggcttcctggtaatcttgatcttaaaatctactcagtttctcagagagattttgagtttgtgacttgttttgatgctgaccatcatcgattacagacctcatgtgaataa

SEQ ID NO: 12797 - DNA, 120 bp, Glycine max
  Peptide Sequence Number=SeqID_129575
atgttgtctcgattcgtggctgaagctcaatggctcttgccccgtttgcagaaactcgccgcttccgacgccgctttctacgccgctgcaggaggtggtgccgctctctcaactaattga

SEQ ID NO: 12798 - DNA, 2145 bp, Glycine max
  Peptide Sequence Number=SeqID_129576
atgatagaacaatataaagcagaaatcaagagacttcaagcatccgaggcagaaattaaagcactatctgttaattatgcagctctattaaaagaaaaagaggtattcccttgcttttcatcagattatctttcatttgagccacttttctcacttggtactccattgaatttggaggctacaagtccagcatctgcaaatggtgcttacacagtcaagggaagtaatgaccaatcaccaaatcgactgcataggttcacaactcaaatgaaaaatcgttatgctacaaacaatggaaccacatctgctttggaatctgatgctagtcaaagtaagatggtatctaaacattcaaacttacaagtaaagggcaaggagcaagcagatatgatagagggaaaaagtagtcccccagcagcagtacaacatactcatgatatacgaaaaatgaagttggaactagagcaagaacgcaaaaagttggtaaatattcagctaaaactccaggaaactgctaacaatctggatctttctttgatgccagaagaagagaaattgaacaagtctttccaggaggagcttaaattgctaaagttggaaagagacaaactgactagacgagaagatgaagaagcaggtgattctgtggatagcttcaaaagactaattgaaactatagagaaggaaaacactactcttaagttggaaaaggatgaacttgaggctgcgctcaaatcacgtaggatggctagtcaaatgtcacctgatgattctcagattcagaacaaggttccaagcagtaacagtgatgagcagttaccagatccttccaaaagttttccagggaaagaagacttggaaagatccttacataagctaagtaaagaattgaaggaaacacaaaaggagagggacaaagcagtacaagaattgacccgtcttaaacagcatttgttagaaaaggaatttgaagagtcagaaaaaatggatgaggatttcaaaatcattgaagagctacgtgatagcaataattatctgagagctcaaataacacatcttgaaagaactctgaaacaggcaactgcaagtcaggagaaactgacgatggcaaatgacaatgaaattctaaagtccagggaaatcattgatgacctgaacaagaagcttacaaactgtatgagcacaatagatgctaagaatactgaacttttaaatctacagacagctcttggacaatattatgctgaaattgaagctaaggaacatttagaaggagatttggctcgtgcaaaggaagaaacatctaagctttctcaactgttgaaatttcatccttatagacaaaagagaattatatctggggagagattaaatggttgccaggatgcagattgcagagcgaatgtattgatcagtgaaaaagaagaaattttagccaagctttctcgatctgagaaggtacaatcagaatggagaagtagagtaagcaagcttgaagaagacaattccagattgaggctagctgttgagcagagtatgacacggctaaatagaatgtcagtggattctgattttcttgttgacaggcgcattgtgataaaattacttgtcacttatttccagagaaaccacagcaaagaggttttggatctaatggttcgcatgctgggattctctaacgaggacaaacaaagaataggtgttgctcaacaaggtccaggaaaaggtgttgtccgtggtgttcttgggttgcctggccgcctagttggaggtatcttgggaggaagtggttcatctgaatcagctgcaaatgtaggagcagataaccagtcctttgcagatctgtgggttgattttcttctcaaggaaacacaagaaagagagaagagggagtcagaagaaagagataaatcaatggatgattcacatgataaaagtcttaatactaattcttcttctccacccccttccaatcagagctttagcactagaacagcatcaattaactcacccacttatcaaaacatcagttctcaccctcgtgggtactttaaacattccgaacaaattggttcagagttctcaacagttccccttacatcatcagatagtaaaacaactagttcaagacttcctagatactaa

SEQ ID NO: 12799 - DNA, 2001 bp, Glycine max
  Peptide Sequence Number=SeqID_129577
atggaactttttcacaacctcaaaattctcagcacaattctgctcctatgcatgtttcctcactcactcaagtgccaacaagcatacctcaatggcactgtctatgactgttctgataacccttcagtcccaaaaggttacctttgcaatggccttcagaagtcatgcacttccttcttacttttcaggtcaaaacctccctatgatagccccgagaaaattgcttaccttcttggctctgaggcatcaaccatagcctcaatcaacatgatttcaagaaatgacaagattccttccaataagtcaatcattgttcctgtgttctgttcatgttcaggaaacatctaccagcataacacaccctacactgcaagcaagaatgacacctactatgagttggtaaaagaaaccttccaaggcctcaccacatgtcaggcaatgatgggtcggaattactatgctcctgtcaacattgtaattggtgctgagctcacagttccaaagttatgtgcttgtccaactgaaaatcagacagcaagagggatcacctctttgctggtttacttggtgaactatggtgacactattaagtccataggaagggcttatggtgtggatgaacaaagtgtgctagaggccaataagttggcagagccacaaagttcaaacaggagcatggacctctttgccttgacacctattttagttcctttaatagggaagagctgcaaagagaacccagataaattctattgtagatgttaccaagcaccagatggaatcctcaaggggcccttctgtggtgaatctgacggtcagaaattcccagccaaattggttgctggtttaggagttggaattggtgcaggctttctgtgcttgtttcttttggggtacaaatcatatcaatacatacagaaaaagagagaaagtatccttaaagaaaagttattcaggcaaaatggtggctacttgttacaggagaagctctcttatggaaatggagaaatggcaaagctttttacagctgaggagctgcaaagagctacagataactacaataggagcaggtttcttggtcaaggtggctatggcacagtgtacaaaggaatgttaccagatggaaccatagttgcagttaaaaagtcaaaagagattgaaaggaaccagataaagacttttgtcaatgaagtagtcattttatctcagatcaaccacaggaacattgtaaaactattaggttgttgtcttgagacagaaactccaatactagtctatgaattcattcctaatgaaacactttcccatcacatacataggagagacaatgaaccctccctttcatgggttagtcgccttagaatcgcatgtgaggttgcaggagcagtgacatatatgcatttttcagcttctattcccattttccatagagacatcaaacccaccaacatacttttagacagtaactacagtgccaaagtgtctgattttggaacatctagatcagttccactagataagactcacttaaccacagctgttggaggaacttttgggtacatagaccctgagtattttcagtctagtcaattttcagataagagtgatgtgtatagttttggggttgtgcttgtagagctcataactgggagaaagcctatttcattcttatatgaagatgagggtcaaaatctggttgctcaattcatttctttgatgaagaagaaccaagtttctgaaatttttgatgccagggtgctcaaggacgcaaggaaagatgacattcttgctgttgcaaatcttgcaatgagatgcttgagacttaatgggaagaaaagaccgacaatgaaagaggtttcagcagaattagaagcattgagaaaggcacaaagttcattacagatgagccatgatcatgagcacacaactagtaacatagttcaagagtgcacagaggaaagcatatcactgtccttacatctagagtccacatccttttag

SEQ ID NO: 12800 - DNA, 1212 bp, Glycine max
  Peptide Sequence Number=SeqID_129578
atgctgatatcagaaggaaaggctatagatggtgtttgctcaagtagtactcaacctcagttaatgatgtctgaagaaagaatgaatgttcagcatacaaaaactgatcaaccaaaactcatgccagtgatttctctttctttgggtttgtctttacctatggagcacaaaactggatgcagtgattcagttaatagtttgtcggtattgtctttgtcaaattcaaccactgaagccagagatattgtccaagatggattctgttggtcttcatcagtaaaccggagatcattgcttcccaggcaccaggtagtgcttgacaacattgtacacagaacaagagctttaaatgaaagaggaaattttcaagaatatttgaagccacaccctatcatgtggtctgaagaggagttggattttctctggattggtgtgaggagacatggtaggggcaattgggatgccatgctaagggatccgagattgtggttttcaccattaagggtaccaggggaccttgccgagaggtgggaggatgaacaattaaaacttttgaatgatatcagcgttccacagttcatgtatccagcagcggcgtcattgcaaggaaacttctgctacttggatcctaaatcaagtttctgggagagtaaccccttgaagaaatctcttcccagatataattttcaaagtaacaccactgcacacagtcataggccaactattcattccagaaaggcctcttacaacaatatagacaagtatgaattaggatttttcaattctccaggaagcttgggcatttctagggaaaactcttactcgaacgattattcctttaattgttcggctgtgacaaatagtttgcctcactggctcagagaagcagttaacactcctcctattcaaccaaatatgtctgcagcgatttcgttgagttctcatcctgagataccaggaacttcagatcgatgctttagtgctggtaagtcatgctttgtgcctcaaaattggttcaatggtttgacgccaaatgagatatacatgtcaaatgggtctcactattcaacctattcaagaagaaaatatggggtggtgaagatgaacaagtctctggaacaacgtgtccacaaaccggataacttgatcatcattgatagtgacacttcttctgaagagaccatatctgatgatcaccgttccagcttgtag

SEQ ID NO: 12801 - DNA, 282 bp, Glycine max
  Peptide Sequence Number=SeqID_129579
atgcagatttataattttgtttactttgtctctccttataacaagttctggagggaagcaacgggaagggggaagaagaaacataacatgaagaggtgtagcccgtggtggagccgagatctaaaggaggatggaagctatgaaggaaaggttggggtagaggagagagtggaggatgagacagacaaggaggttttgggctcatggaaggtttggcggagaaggaaatgtgaagggagaagacaagaggaaacatcaagggggagaggagaaagagattaa

SEQ ID NO: 12802 - DNA, 1995 bp, Glycine max
  Peptide Sequence Number=SeqID_129580
atgaataaaaggaacaacttggtgaataagtctagatcattgcttgtggaggtgagggtcgtgggtgacaaaatggagacggagggagagggagatgacgacatggggagaggaatgaagggggaattagctatgaatgtgttggagggcaacgcagaggagagagaaaagagcatttatggttttagtgctgtactatcttcagaagagttaaaggctattaagaacactcatggtttagttgcagcatatccagacagaaatgttaccttagacactactcacacttctgaatttgtctcccttgactcttccagtggcctatggcatgcctcaaatttcggggagaatgtgattgtgggtgttattgacactgtacaagacttcaacacttccatgtgcaacttaaaactgattggagctagatatttcaacaagggtgtcattgcagcaaattccaaggttaaaatcagcatgaactcagctagagacacctcacgtcatggaactcacacgtcttcaacagttgcaggcaactatgttagtggagcctctttggctatgctaaaggtgtggctagagtcattgcaccaagagctaggcttgccatatgttttggctggaatggaccaagccattgctgatggagttgatgtgatttccatctctatggtgtttgatggtgttccactttacgaggaccctaaagcaatagcttcttttgcagaaatgaaaaaaggggtggtggtttcatcttctgcaggtaatgaaggtcctgatcttggtaccttgcacaatggaatcccccggcttctgaccgcggctgccagtaccatagaccgcacatttggtactctaattcttggaaatggccaaaccattattggttggaccttgtttccagcaaatgccttagtggaaaatcttccacttatctacaataggattataccagcatgtaattcagtaaagctgttatccaaagtggccacaaaagggatcattgtatgtgattcagagccagaccctaacttgatgtttaagcaaatgaggttggttaataaaaccagtttgttaggggcagtttttacctataattctcctttattaaatgaaataggaagtgtgagctctccaactattgtaatcagtgcaaaggatacaccacctgtgatcaagtatgcaaaaagccataataagaagctaacagccaccatcaaatttcaacaaacatttgttggaataaagccgacaccagctgttaactttaactcatcaagaggtccttcaccaagttatcatgtggtcttgaagcctggcataatggcacctggctctaatgttcttgctgcttatgttcctacagaaccgacagctacaattgacaccaatgtgatgttttccagtggctacaagttgctgtctggaacatccatggcttgtcctcatgcttctggtgttgctgctcttttgaaagctgcacaccctcaatggagtgctgctgctataaggtctgcactagtaaccacagctagtcctcttgataatacacaaaatccaattagggactatggttacccttctcaatatgcttcccctcttgccattggagccggtcaaatggaccccaacacagcacttgatccaggtttgatatatgatgccaccccacaggactatgttaatctcctttgtgctttgaacaacaaaacaaggccaattgttcacaagtttaggaggacagtgaccaatgttggaagtggtactgccacatatagagccaaggtgacacaacctaagggctctgtggtgatagtgtcacctgagagattagcattcagatataaaaatgagaagctgagttacgatgttgtgataaagtatagcaagtacaacaaggaaaatatttcatttgaggatctagtttggattgaagatggtggagaacacagtgttagaagttccattttagtggcaccaagtggaattgtatga

SEQ ID NO: 12803 - DNA, 768 bp, Glycine max
  Peptide Sequence Number=SeqID_129581
atggctgaaccttcgaagaagcgaaagggcacttcgagtcggagtcaacggcattccgggtcacaggaaacgccaattccttcctccattccctctagatcattgttttcatcagaggaacaacgtatacgtgaaggtgtaccttttgagggtgcactgattgatgaatggaaattcgatttctctgtgcatgatgcccgccggttggtttgcaccaaccaagcggatatgaccggaagacttcttgccggttcattggcttttgagagccgcatcctccattaccttattgttcgcatcttactccctagatcttcaaaccttgctcaggtttctgaagaagatctcattgtcatgtgggcctttcataaaggtttacaaattgattgggcacaccttgttagatatcgcatgaataaggcattgcgattgaatgccccattgccttatcctcatcttattacccttttccttcaacacttcaacatccctcttgattctgaaccttatgttccaatcaagagatcattccttataggcgcttcagtcatagcatcctttggttatattaaggaggatgatggctcttggattttgaaaaggtttgatggtcttcaaacctttgttggtgagagatttgatactttggaattgcaagtggatatgcgcttcaatgaaatggagtcaagaatgacaaaggttgaagaggatgtatcttacattcggtcaagctttgatcttccaccaccgccgccaccatcatcttag

SEQ ID NO: 12804 - DNA, 765 bp, Glycine max
  Peptide Sequence Number=SeqID_129582
atgactggggagggcttaaaaaagattaagacagagtataataatatcaacaaaaaactaatgcttaaagccaaacccatacttgaagaaactataatgagactatatcgtgatttttctccaaactgcatgaaagtggcaaacttaggttgctctgtaggaccaaatgcacttctggtgatatcaaatattattgacattgtcaataccgcttgcactagcttgaatcgtgaaccaccaaaattccaattttatctcaatgatttatttggaaacggattcaataccatcttcaagtcacttccaaatttctatacaatattggtagaagataagggacacaagtttggtccatgctttgttaatgcaacccctggatccttctatgggaggctctttcccagtaattccataaacctatttcattcctccaacagtctacactggctttcccaggaacttgtgccaggaggagcaatggtcttggtggttctcggcaatcatgaaactcctagaagaattggttgcgaattagttagtctaaaactcaatgacatgttcttggagggtttgattgaagaagaaaaattggactcctttaacataccagtgtatgaacctacagttgaagaaattaggcatgtgattgaggaagaaggatcattctttgttcaacgatttgagattttaaccttgccttgggttgaaggcctaaatgaaggtggtgataattcatttcttgatggaaatataaaagccagataa

SEQ ID NO: 12805 - DNA, 459 bp, Glycine max
  Peptide Sequence Number=SeqID_129583
atgggttcattgggtgcatcaaatggaagagagccattgcttcacgtgaatggtggcaagggagaatcgagttatgcaaacaactcctcgttccaagagacaaaatcacttaacaagggaaactgtcacatagttagctcaagcccttcagagggtttgattgaagaagcaaaattggactcttttaacataccaacttatgagcctacaattgaggaaattaggcatttgattaaggaagaagagtctttgtttcttcaaagattagaggttttcaccgtgcctagggatgagggtgtaagtgaatgtggtgatgattcttttcttgatggaaatatacgagctgaattcatagccacatacacaagagctgcaatggagcctctcttatctccaaagtttgaggcacaaattataaatgaattatttatcaaattcaaaagaaacttgtgcaaataa

SEQ ID NO: 12806 - DNA, 360 bp, Glycine max
  Peptide Sequence Number=SeqID_129584
atgcctggaggagcaatggtcttggtgtttcctggcagaaatgaaactcctagaagaagccttcgggaagtaattagcctaacactcaatgacatgctcttggaggttttgattgaagacgaaaaactggactcatttaacataccagtgtatgaacctacagttgaggaaattaggcatgtcattctggaagaagagtcattgtttcttcaaagactagatattttcaccatgtcttgggatgaaggtataaatgattcttttctagatggaaatataagagccgaattcgtagccaaatacacaagagctgtaatggagcgcctcttttatctgcaaagttcgaggcaaaagttgtaa

SEQ ID NO: 12807 - DNA, 828 bp, Glycine max
  Peptide Sequence Number=SeqID_129585
ggccaagacgtcggggggggggaggtgcctggaaatgtccctgatgcaccattggacaacatctcattccactccattggcaatgttgaaagaactgggaagagatgccttggattgcaaggagatcatggacctcatcaaggctgctggattgctgatactgtcaccaagttgggagattgctatgtttgtcagattaaacatcgaattgccaaggaaatcactgccaaacaagtccagcattggccaaagaaagggaagctttctgcagggaagctaagtgtgaagtatgcaatcctgcataggattggcgctgcaaactgggtacccaccaatcatacttccactgttgccacagaatcctttgctgtcaaattacccattgccttcccaactgtattgtgtggcattatgtcgagtcaacatcccaatattttaaactacactgactctgtgatgaagagagaatctcctctatccctgcattacaaactgtttgaggggacacatgtcccagacattgtctcgacatcagggaaagctgctgcttcaggtgctgtgtccaaggatgccttgattgctgaactcaaggacacatgcaaggtgctggaagcaaccatcaaagccaccacagagaagaaaatggagctggaacgcctgatcaaaaggctctcagacagtggcattgatgatggagaagcagctgaggaagaagaagcagctgaggaagaagaaaaagctgaggaagaagaagaagcagctgaggaagaggaagatgcagcagaagatacagaatcagatgatgatgattctgaagccaccccatga

SEQ ID NO: 12808 - DNA, 1014 bp, Glycine max
  Peptide Sequence Number=SeqID_129586
atgatgagttctagagctagtaagcttgtttcttcctcccttttggcagcttcaaaattgttacttaaatcttcttcttctgctcctccacttcaaactacagctcttgttggctcaatggtccctaaagttcaaggcccgaagcacagttctggtttccctagatcatacatgtcagctaccttagcttctctggccaaggaagaggaagtgccaagtaaaggcattaatacactcagagcaattgaagaccaacatgggggagttattgtaaacattgagaaccctatggattcctcagttttctcttctttgcttgaagcttcaatatcacaatggagggaacagggaaagaagggagtgtggatcaagctgcccagagaacattcaaatcttgtggattctgcagttaaggctggattccgattccaccatgctgaaccagattacttgatgctcgtgaattggattcccaatactcccgatacacttcctgcaaatgcttcgcaccgcgttgctgttggtgcttttgtcatgaatgccaatagggaggtgcttgtggttcaggagagcaatggcaggtttagtggccaaggaatctggaagttgcctaccggaggcgttgatgaaggtgaagatatttgtactgctgcagttagagaagtcaaagaagagacagggatagatacaaagtttgtggaggtcatagcattcaaggaaaggcataaatctttcttccgaaaatcagagttgttcttcatttgcatgttgcaacctcattcctttaaaattcagagacaagtttcagaaattgaggcagctcagtggatggcaattgaggattacatggcccagccttttgtccgagaaaatgagctatttgactttcttaccaaaatagggttatcaaaatttaatggcaaatacagtggcttttccaccgtactctctagcacttcctcttgcaagaaatcttacttttacttcaacaacaacgacgctggtcacatttag

SEQ ID NO: 12809 - DNA, 444 bp, Glycine max
  Peptide Sequence Number=SeqID_129587
atggaaagccaagacccaccaaacccaccaccccaaaacaaccctttcatattcactcctaattcgatgttgcaaaaccctaattgggaccctcaagagcaatcagggctatgtgacattgattggggtaaccttttctctgcccaaaacggcttattgcttaatggggatgctaaagatgcaattgaatgtgcttcttctttttcttttgtggctcaaaataagggagtttgtgaggaggaaaagggaaacaaggagaaaaggaaaggtgggaggatgaagaaaacaacacgagtaccaaggtttgcgtttcatacgagaagtgcagatgatattttggatgatggttatcgctggaggaaatatggtcagaaagctgtgaagaatagcacatatccaagattatcaaaatataacttcaattctaatttgaaaataacataa

SEQ ID NO: 12810 - DNA, 1599 bp, Glycine max
  Peptide Sequence Number=SeqID_129588
atgctgttactccacgcgccaccactaccttttctgagaacattgcttcatttccctcttaatagtattcatcattcttctcgcgctttctcctcactatctcacttcacaaaacccttttctgtttccaatcgtttctcctcacattctcgccgaagctcactccaaatgaacggagaaggcctcgccgccgacgactcctcgccggatcacgtcaccaaagactggtactccgtgccggagctccggttgcgcgatcatcgcttcaaggttcctctcgatcactctctgggaccccattcttctcccaagatcactgttttcgctcgtgaagtcgttgcagaatatgttacttacgggcattgggcaattaataatcggttcccacagtttatatattgcttattggatgagtgctcatgcttagtcttgtacatcacccattcatccccttcatcaccttggcatgctttccttcaaaactcagtaattttgttgcagttgggaaagaagagaaaaacttgccatacttattatatttgcaaggtggacctgggtttgagtgcgggcggccaactgaatcagcgaggaacaggcttatcaactccgttgactgtgtcatcaatgtcacagttcaagtctgctgatgaattagctgacttcttaaaatatttccgagcggataatatagtaaacgatgcagagtttattcgagtacgccttgttccagatgctggtccttggacaatattgggacagagctatggtggattttgtgcagtcacatatttgagttttgcaccacaaggactgaagcaagtccttataactggaggaattcctccgattggcagtggatgtcctgcagattcagtgtacaaagcaggctttgagcaagctatacatcaaaatgagaagtactacaagagattccctcaagatattaaaattgttcaagaacttgttaattatttggctgaacaagaaggaggaggggtagctcttccatccggtggcttcctaactccaagagggctgcagactcttggtctatctggcttaggatccagagctggtttcgaaagcatgcactatttgtttgagagtgtatgggatcctactttagttccgggagcaccaaagagaataagttacaacttcctaagttctggttctgctaataaatggtctgctaatagtgtaaggactgcagttggagacaagtttgatgcaattagagctgccagagaaagactccctgtactttttacaggagagatgattttcccatggatgtttgatgagattcatgcattgaaacctttcaaagaggcagctcatatattggcagagaagaaggactggcccccactatatgatgttcaggttctgaataacaacaaggtacctgttgcggcagctgtgtactatgaagacttgtacgtgaattttaagctggccatggaaacagcttctcaaatagcagggattaggccatggataactaatgagttcatgcattctggcttgcgtgatgatgggagcaaagttattgatcaattgttggggatgctaaatggaaggaaacctctattttga

SEQ ID NO: 12811 - DNA, 426 bp, Glycine max
  Peptide Sequence Number=SeqID_129589
atgcaattcctagtagcactttcaagagcttcttccactgtaaccaaccattgtctgcgccacctccgcagcacgtgcaacgtggcggcggagaaggtgacgctgacccggttgaagcagaagcaccgcaagcaagaacccatcaccgtggtctccacccacgactacccttcagcggtgcatgtcgacgtggcaggcatagatgtctgccacgtcggagactctgtgtccatggtgatccatggacacgacaccaccattccgatcaccctcgaacaaatgcttgctaagaggcctcttctcgttggagacttgccatttggaacctatgaatccagctccaatcaggattttcataatcccactgtttgtctttttttaccgttaaaaggaagtacaggaggtggtgtaaaaacatatacataa

SEQ ID NO: 12812 - DNA, 381 bp, Glycine max
  Peptide Sequence Number=SeqID_129590
atgggggtgtactcaggaaacttcatccagaacactctagaaggggaggtgaacttatcaattacggggtgtgttcatgaatcttcctcaggaagcctttgggcgacaaccacctccattttgttaaaaaatggcatccggggcatctggggcttccgtaatgctttcgtaaaatttcagaaaaccttgggtgttttgggtgaaaaaacgtgtttccgtgaagaaaatccaagccaaggtgctgccgtaaggctttcgagacgtttccatgagcaaatcagtgaagattttccgccgcgcgttcttcaccgttcttcatccattcttcgttcgttcttcggtcttcaaccgcttttaacgagctttttaccgtttatttaa

SEQ ID NO: 12813 - DNA, 663 bp, Glycine max
  Peptide Sequence Number=SeqID_129591
tcacccgaaccggttctcgacggtctggtccgaaccgtcctctcgcagaacaccactgaggccaattcccaaaaggcttttgcttccctcaaatcctcctttcccagttgggaacatgttctctgtgctgagtccaaggacgtggagaatgtcattcggtgcggaggtctagctccgactaaggcttcctgcattaagaacgtgttgcgttgtttacgcgagagaagaggataccacactttctctggctccttcattatctcactattctctctcttgcaacagcttctcccgaaaaccttcgcacttgttcagctgccggcggtggtttctggtgactgcatcggaaaggaagaagaaaaagaagctgatggtggcgctgccgatgccgcaggacacgcctctcagggcggtcacaatggccaaggttgttgcctccggtcagcagagcgacaacactggtattttgatacgcttgttggagatgccgccgccaaacgttggagatgccgccgccaaacgttggagatgccgccgccaaacgttggagatgcctccggtcctcgacgccaccaaacgttggagatgccaccgttgccggatccggccaccactggactagtcttgctgcgctcagcctctgcggttgtggcttgtcggtga

SEQ ID NO: 12814 - DNA, 2784 bp, Glycine max
  Peptide Sequence Number=SeqID_129592
atgggtacggtggaggctcgatcaaaggagccatctgggtgttcatcgccttctccagagaatgacaagaatgagctcagggaagctctgtgtgctttgaaaaatggggcttcagaaaaccaaggttctggtgatggtggggttgttgaaatggggaagagcagggtctctgagaccaaggtttccgatgagaagggttttgaggggagggaactggaggatggttgtgtaggtctggctgattctgagatgaatggggtctcctctttgttgaaaatgagagagagtggtaggaacttaatgttttcctatggtggtgagactgagagtgctgggaagttgaaccctgagggtggttcttttgaggttggagtggaaggaggcaaaagagattggaagaaaattgagggcgaggatgatcgaaatgggaaaaccgtgactatggatgtttcaattgctgatacaagtgaaaacaaggatgtggaaatggaagatttgggtgatgaaggatgtggcaggttttcggttggtgattttgtttggggcaaaattaagagtcatccctggtggcctggcaggatttatgacccttccgatgcttctgatcttgctttgaaactgagacaaaagaatagactacttgtggcttactttggggatggaacctttgcttggtgccatccttcgcaattgaagccttttgaggataactttaaggatatggtgaagcagagtagctctcgggcttttgtcaatgctgtacatgaagctgtaagcgaggttggaaggcttttgaatttgaagatgagttcttcatgtgctgcggataaaactagctctgaatttgttcggccattggcggccaattctggtgtcaaggagggaattcttatacctgaaaacggtatagagaaactttctgatgttctgattgatccagcagaattactttctcaactaaaacaaattgccaaaattatttccattgctaatattctggagctggaaatattgaaggctcggctttcagccttttatctatcaagaggaggttatagattacctatgtatgaggtgccccagccagttcctagacttgaagatagtttaagggatagaacagtgaatgtaggcagcagtgagtgtgcagtggaagcacctgcacatgggccatttgaagaggagtactctacaatgccaatgagcccaaaatctggtgaattgagtcattcacatgggatttcaggaaatagattgaatcataggattaagcagaaaagcattgctgaaattatgggagaggacaaagatgccaataccaaaaataagcaaggagatgcaactgaaaaagtgtctgttagaaagaagaggaaaggcagtgaggatacaatggcatctaaatctgtgcagaagagaaaagggttgttcctaaatactgatagaaatgcggcaggtgctgaaaatgatggtggtagttggggcaaagaggatggtgacaatggaacattggcgcagttgaaaaagaagaaaaaatcttttggtattggaaacactagtagtgggagcaaaaaggaaactgatcatgaaggaaaggccaaagtaaaaaatgggaagggttctttgtcaagagaaaggaagaaaagcaagtacctgtcccctccttttgctattccagccagagagcagaggaaaggagagagggaaacagaatcccctaaagtttctggcaaagatcagcaatcagagccactgaccagagcttctgatcaacttctgaagtcccctgtacctttgaagttgaatgatgagccatttcaggagaatgtttcgaaggaacttgtcatagaccaggaccttcctgatagctcaaattaccgaacaccagaatatgatgagaacaagactattgatacaacaaaaatccaggttccatcaggggaagttctgtctgaagtctgttatgcagctattaatccacaaactccaatgaatatcaattctcttgaaagaattgtggactttatttttatctacagaagctcgttatatcgccaaggatcctactacaaaatatacaagaagcataaacctagcaagaagggaaagaagccagaatctgatctggggattttgaggaaagatcaaatacaatctgataaaaaatcagctaataatgattcggagccaaagaagagaagaaagaatgagacaacttcaagtttgcctaaagagaagcaatctgctgcagctaagactggcaagaaggggattgataaaaaagcttcaggtgcttcccttttcatctcatttgggccaggatcctctctgccttcaaattcggatcttaccacactgtatggtaagtttggagctctgaatgaatcagaaacatctatgctctctagtgattgcactgctcgtgtgttcttcctgaaagcctctgatgctgaaaaggccttgagccattcacagaacatgaacccctttggctcttccgaagcctctttcagacttgagtatctttctgctggttccaagtctgaaaaatccaagtttaaagcttcttcaacaaagaagaaagacaagactccagccaagccatctgcttcattgtcaccaggtggtgaagcatccaaattgaactacataaaggaaaaacttcagggtctgacatcaatgctagaagcatcggatgctaaattacctgatatcaagacaaaattagagagtgagatgaaacagcttttggaggatgtgaacagaatggttgaatcttcttcctaa

SEQ ID NO: 12815 - DNA, 324 bp, Glycine max
  Peptide Sequence Number=SeqID_129593
atggaggaagcgttggaactgccacacacgaaggaggggatagcgagcgtggagtgccactaccaacttctagaggcttgtgtgagagaaatttgttgcatcgagcttacaaatggaggtttagttcctattagtgaagctttgaaggtctgtgtgttgtgttgtgttgcacattctccacacttacacaaagagaaaagagagagaaagaagcgcaagaggaagcagcaagtgaagcgcgacgaagagccagagcccaaactagtttgtgcgggtccaatccgaatcaacaatgtgaaagatccattttcatctcacgcttga

SEQ ID NO: 12816 - DNA, 201 bp, Glycine max
  Peptide Sequence Number=SeqID_129594
atgccatctattaggttgtggtccacagtacattatggatttcgttggcaaaaactaggaattgtcgtgatccttgatgctggaaactacgaagagatggtttgtttaaataccagatcccgttgcccacataattttctgattggctgttacagacatggaactatggaagtgaaaagatctattgatcttgcaatctag

SEQ ID NO: 12817 - DNA, 318 bp, Glycine max
  Peptide Sequence Number=SeqID_129595
atgagggcgaccaaagaaaatcccaagattggtgagaatgagtgggtagtatccttcacagggaacaaagaggatcaagtttcatcatcatcagatagggagtccacaaatgacgctcctatctctcatctctgcaaacatgttccatctacacaaccgtgtccacctccagccccatccatctggaaagctccatgtggagcttgtaggccttggatattcttcatcaatggagtcctttgcttcttgaagatcaatggcagcggaattggagatggaagaaagatgattggagatgccacttcaagtagaagatga

SEQ ID NO: 12818 - DNA, 1017 bp, Glycine max
  Peptide Sequence Number=SeqID_129596
atggaatccaaacacattgatgatgcaatgcaagatgacaactgggttagagcaatgcaagaagaacttgatcagtttcagaagaataatgtttggaagttagttaaattgccaaaaggaaagaaagctattggagcaaaatggatcttttgcaacaaattggatgaaaatggaaaggttgtgagaaacaaagcaaggaatgttgagtttgtcaacaagaagacgatagcatccaaggttttgggagtccaaattatgttgtccaacgacattatcactaaggcaacagggtgccttcgtgaaggcagtacctatcaagagggatgggagaagaactatgactcccatgtaacaagggcactctactgggaaaacattgagaaagcaggtgatcagaagactacagtctacaaccttatgtgcgagaaggcaaagatttgggctaacattttgaataagagtgttctttataaggcagactctaaaacaactctattagacctccacaaaaaccttaagggattagctggtctagacgacatctatcacgctgctttcatcaacaagatgttgtgggataaaggtgtgtatcacgtctttagcaagatggacgatgattctaagcacaccttagtagtcaagggttcagtggatttggatgccatcaacaagaggaagcagaagaggctagccaaggctattgctgatgatgatcaaggcctgaaaaactttggtatttccaaaaatatacagaagataatgactgaggaacaaaagagaaagaaaacaaggaagcactacaagaaagaagaagaggaggaagagttactcgtaagggagcataagacaaagaaaagacatgagctatctactgcatccacctatgtgcatccaacggttgcaacctcaatcccacaaaggttgaaaaaactgagcgagattgatgaagaagatgaaggcttcgtacaagttgtccttcagaagaggaaagcaactgcccttgttgctcctacctga

SEQ ID NO: 12819 - DNA, 216 bp, Glycine max
  Peptide Sequence Number=SeqID_129597
atgtggttggtacagaacttccacaatgctagaaaccacgctcccttgaacaacaaagatttcattttccttatcaacaagaggttgatatggaacatgatttcaagacattttcagagaaagagaaagagagacagggagagcatttcatggtggaaggaaggtatcacaatagcagactggcagaggcgtcccaccacatgtgagagcaattaa

SEQ ID NO: 12820 - DNA, 468 bp, Glycine max
  Peptide Sequence Number=SeqID_129598
atgaaggttgtggagatggcattggcttttcaggaagctgggtgcttttctgttgttatagaatgtgtgcctgcacctgtggcggctgctgttacagcagcacttcagattcctactattggaattggggctggtccattttgcagtggccaggtgctagttttccatgatctgcttggtatgctgcaacaccctcatgctaaagttagtccaaaattttgtaaacagtatgcctgtgttggaaaagttatcaaacaagccttattagaatacaaggaagatgtgataaatggttcatttcctggctctctccatatcccatataaaatctgtgaagctgaagcaaatggttttataaatgaattgcaaagattgggtttggacaaggcagcatctgcagcagttgaagcagttcaaaatatggatacttccaaatcaaatggtaaaggaaactcaacaaaggactaa

SEQ ID NO: 12821 - DNA, 177 bp, Glycine max
  Peptide Sequence Number=SeqID_129599
atgagtataagatacaaattaataaagtttgatgcaatcccacttcctaagaggttcaggcttgcaaaggacacaacatttgggcaaaggcacttgaataagtggagtcagtcatcattttccttatggatggttagcttcttcagacaattctctggatctgttaaagaaagttaa

SEQ ID NO: 12822 - DNA, 273 bp, Glycine max
  Peptide Sequence Number=SeqID_129600
atgtctaactctaaagcttatctatcccaattcccaaactctttggttagttctttcaagtaccaactaaatcatgttgctcactccccaaccagaacatcaagcttttatgaaatatatatagaaattttacaatgtgggaaagacaaggggcttatgatagatgaagaggaagtagaaggaattggatattggtgtgggaagattgtttctgcaatttttctcatcatgtttcttgttgaaattgaatttagtagagaagaatggagatga

SEQ ID NO: 12823 - DNA, 1021 bp, Glycine max
  Peptide Sequence Number=SeqID_129601
gccctgaacaacttggcacaagttatggccaatcagggaggcgatggaggagcagctgcttaccagggtttggaccgctttcaaaggaatgacccacctaccttcaaggggggttatgatcatgagggtgctgaggtttggctgagggagattgagaagatcttatgggtaacaaaagtactagtggacaacactcacccacgtctggaaggagcaagtgatgttgttccatgggggacttttagacaaacttttctagagaagtattttccagaagatgtgaagaataggaaggagatagagttcctcgagctgaaacaggagagcatgacggtggcagagtatgaaactaggtcaaaatgtgtgaagtttatgaatggcctccaactagaagtgaagatgatggtgaactaccacgacatcaacaacttcgcacagttgaccaacatgtgtaggatctttgatgagggtcagtgggagaagggcgcattctacaagaataccaatgccaatcatgggaaagagaagaagcctgttactcacagtcgtgctaagtctaaaggatttcagccagctgatgggagttctcaaccaactaacaggttcgaccatattgctcatgagtgcatagatagaaaggtgacttggtttaactatcgaggtaagggccacatcagtaccagttgcccacatctaaggaagcagaagaggagtgaaagtttgaataaccaaagtggacgatcgaggactactcggagagtgttttctcttagtggtactgatgccacacagtctgatgatctcatccaaggtgcgacacattcatttatttctcgtgtttgtgttgaaaaacttgccttgcttgcatcttctttgaaatctggcttaattgtggatacacctgctaatgggtttgttttaacttctgatgtcggcttacaatgtcctattttaatttctgataggcagtttctgattgatttggttgttttacctttgagccagattgatgttattcttg

SEQ ID NO: 12824 - DNA, 297 bp, Glycine max
  Peptide Sequence Number=SeqID_129602
atgaggggcctcccaggcgctggtggcataagcaccggagggctcataaggcactgtttgatccttgctgttgcaacctacccttcggcgggagggcgaagcgtgactcgcgggatgtgtcttccaagaaaggaatacgcgcggagtcaccaccaacgtttatttgaggaaaacgtcggaaaaaccggaaaatacgcgatctacgaacttttaagtgaaaaggttcgggagttgtatttacgcacggggaaggtattagcaccccacacgtccgtcccaagggacgtcagcctttaa

SEQ ID NO: 12825 - DNA, 678 bp, Glycine max
  Peptide Sequence Number=SeqID_129603
atggcggtgctggacgagtcaatgggatgtatgctaggacagcatgacgattccgaaaagaatgagcggggcgtctactacttgagtaagaagttcacggtttgtgagatgaactactccctgcttgaaaggacgtgttgtgccttggtgtgggcggcccaccatctaaggcaatacatgctgagccatactacctggttgctatccaagatggatccgattaagtatatcttcgagaagcctgccctcacgggatggatcgctcgatggcaggtgttgctatccgaatttgacattttctatgtcacccagaaagcgataaagggaagcaccttgcgttttgactgggttttgactgcaccaaccacatgggcgagtatgaggttaattaggcaagctttgaaaagtgttgtttttcaccttctcgctaagtcaatctgccttggtgtgggcggcccaccgtctaaggcaatacatgctgagccatactacctggtgttgctatccgaatttgacatcgtctatgtcaccctgaaagtgataaagggaagcaccttggcagattatctggcccaacaacccctcaatgattatcagcccatgcatcctaagtttccagatgaggacatcatggccctattcatggaaaagctggaagacgaagacaaggacaaatag

SEQ ID NO: 12826 - DNA, 223 bp, Glycine max
  Peptide Sequence Number=SeqID_129604
tggcatctcctctctctctcttcctttctccatttcgctgccattcatcttccaagaagcaaaggaatccattgatgaagaagaccctaggccttcaagctccaatggagcttacatcacacatcttgtgaggggttatgccaagcttctgttggagaggcctctattgagggacgaactcgttgttgagtgtcagatgcaagccaatgtggaggcatattga

SEQ ID NO: 12827 - DNA, 352 bp, Glycine max
  Peptide Sequence Number=SeqID_129605
gattcctgaacacaagggatgggttgtccctgtgtggttcagactttgtaatggattttacaaagatagtggaaatctcaagtgggttgctggagtactggatcctatccctcttaagagtattgaggccacaaggtccatcaccatgggcccgaaatctaccctaagactcatgagaaccctagggccttctcttgcatctttggtccaatcttcttggagtcttctatccaatgcccttgggggggccactgatgttaagatagttgttgacaaggtgtgtccacatctccctgtttgttatgctgctaaaaacaaaggcttcgagctatactataatgaggagtgttag

SEQ ID NO: 12828 - DNA, 612 bp, Glycine max
  Peptide Sequence Number=SeqID_129606
atggtggaaaggggaaaattggatcatatagaggaaaggctcagggccattgaaggaggtggagattatgcttttgctgacatggaagagttgttcctagtacccaacatggccattcctccaaagttcaagacgtcggattttgataagtacaaggggactacttgccccaagaaccacctgaaaatgtactgtcagaagatgggggcatactcgaaagatgaaaaattgtttatgcatttcttccaagaaagtcttagtggggcagccgtcacctggtatactaatctggaaacttcccgagtccattattggaaggacctaatgctacagaacttgtgcaaaaaggagcatgattcgttcaaagagtacgcccaaaggtggagggatctagcagctcaagtagcgcccctaatggtggagaaggagatgataacaatgatattagacacattactagtgttctactatgagaggatggtgggttacacgccttcaagctttgccgatttagttttcgttggcgaaaggatcgaagtgggtttgagaagaggcaaatttgattatcctgctttgatgaatgggaagcctggggcaaatggagagaattag

SEQ ID NO: 12829 - DNA, 330 bp, Glycine max
  Peptide Sequence Number=SeqID_129607
atgtttgaagatgatgagctaaacatcaaaatcctcaactgtcttacaagaactagggaaccaatgatcacaatgatcaaggaattcaaggacttggcatcattgtcgatggaagctttcttcggaaaattgctcgaagaatgcaaagaaagcttcagtgatgatgaagatgcaaagaatttaagcttgatggagttgaggtcgatctgtggtcatgttgggtctccgactagcttgatgacaatgaagcctcatctagagttttccccttttagtgatgcattgtcgctgatagtacctatcgccataatgtattacctaagaggatga

SEQ ID NO: 12830 - DNA, 512 bp, Glycine max
  Peptide Sequence Number=SeqID_129608
gggaggagcttgccacccagctcgcccaggcgagctcagctcgcccaggcgagccaggttgcttcctccagaagcaacagccttctggaggaaggatctggaaggcccaagttgaaattccatccgagtctccctcatcacctatggatgttgtgatgtcttccgcaggatctgactcttcctctgatgactccaaggctagtccttatgttctaatttctccatggtcaaggccacccgagcctcaagtaccactatctgggccttatcgcttgtctctaactaagacgaaggctcagagggtggcactaacagtagtggacttggttgaccttgagtctgatgatgaagaagaggattcagaggaggatccatctatcgaggaggacctgtctatggaaaagaaatacttaatgaagggcttgctaggagaacctcttacatctgactatacttcttttttagtacaattgactttgggcttgggtataggtgactgctctgagtcttag

SEQ ID NO: 12831 - DNA, 315 bp, Glycine max
  Peptide Sequence Number=SeqID_129609
atgcagcccccatctgtaaatggaatatctgatccaggtattagtacccagaatgtcaatgtacagtatgcagcacctggccagcttggaactgggcatgcaatggtaccacatgtgtatccatatccagatccttactatagaagcatctttgctccctatgatacacaaccttatcccccacaagcctatagtgggcagccaatgtggcttcttgtgtctttttctgatcctccaattattaagccttatcctgtgccaggtccatcttcagttaatgggaattcagcaagctggtgttcctctgccaactga

SEQ ID NO: 12832 - DNA, 489 bp, Glycine max
  Peptide Sequence Number=SeqID_129610
atggaagtagttaccttcgccctcgctgtcttcgtgccactcattctcgccggagcttcctccgccagggagctccggccgtcggaccacggcctcaccttccagacactctcgccggcgggggcgcattcctcgccggagatgcgatccttcttcaacagcgccgactcctcgccgtcgatgtcctcctcctccgacgtggcacttcccagggccatggactccggcgacgcctcgccgccggagtggtggaaacctgacggaggacactccggcgagggcgtggggaaggcgcttacggtggcgagcttggtgtgcggcgtggccggcgcggttctgctagtggcttcgggtttgatctatttgttcaagtaccgaaacagaaacagaaagcagaagttaaacgcagcgttttgcggtgagaatgagaatcaaggtggaaatgatgaggacaagaacaagttgcaattggtggtacgcaacccttga

SEQ ID NO: 12833 - DNA, 936 bp, Glycine max
  Peptide Sequence Number=SeqID_129611
atgaaggatttattgcttcaaaaagataatcgcttttgtgctgattgcaatgctccagatcctaaatgggcgtcagccaatattggagtttttgtatgcttaaaatgttgtggtgtgcacagaagtcttggctctcaaatatcaaaggttttgtctgtgacattggatgaatggtcaagtgatgaaatagatgcaatgattgaagttggaggaaattcttctgctaattcaatttatgaggcttattttcccgaaggatatacaaaacctggatcagatgccagtcatgagcagcgtgcgaaattcatccggttaaagtatgagcgtcaagaatttttgaaacctagtttgcgcattgtgtcaggaaaaagcaatcccccatcaagtatatccaaaggggttaaggatagttttcgaattactagtgattcacagcatatggaaggaatggtagaatttattggaatgttaaaggtgaaagtgatcaaaggcacagatttagctgtcagagatatgatgacaagtgatccatatgttatcttgaaacttggccaacagactgttcagacaactgtaataaagagtaatttgaatccagtctggaatgaggaacttatgctgtctgttcctcagcaatttggaatattgaatttgaatgtatttgattatgacttgttttcggctgatgacataatgggggaagcagatattgatcttcagccgctgataacatccgcaatagcatacggagatgctagaatgtttgatgatatgcagataggaaaatggctgaaatcccaagacaatgcgcttatatatgatagcacagttaatattgttgatggtaaggttaaacaagacatgtcaatcaagctccagaacgttgaatctggagaattagacttagaactcgaatggatacctcttgattattag

SEQ ID NO: 12834 - DNA, 3855 bp, Glycine max
  Peptide Sequence Number=SeqID_129612
atggcttcctcggccttgacccaaagcagctccttttcgtatgacgtgtttctcagcttccacgctacagacacacgcagcaacttcacagactttctttttcaagctctcataagaaaaggcatcgttgccttcaaagacgaatccagagcacccgaccaagcgattgaggattctcgccttttcattgtggtcctttccaagaactatgctttctccactcagtgtttgcatgaactatcacagatcttccattgcgttgaattttcgccaagacgtgttctgcctattttttatgatgttgatccatcagatgtgcgaaaacagactggatggtacgagaaagccttttcgaaatacgaagaaagattcttggtaaataaaaaggggatggagacagtgcagacatggagaaaagctctgactcaagtggccaatctctctggttggtatatccgaaataagcctcaatatacagagattgaagaatttgttcaatatacaataagtatattgagttctaaattttcaactcttcaaaataaagcagagggaacattgtcagataaagatgaattttcatacaatgagctgtcaggtgaagcagagggaacattgtcagataaagatgaattttcatacaatgagctgtcaggtgaagcggagggaacattgtcagataaagatgaattttcatacaatgagctgtcaggtttgatgaggataagagattttatcagccttgtgttgacttatcctgtgaaattagtagaggaagatattttaagatcttggattagtgcatttcctgaatggaaagctcagttattgtccactggtgatgatactgttatggacaaaccatggtgtgtactaacaaagaaggcactgggatctatgaagggatttatgccaatggaaataataagtaaagtagaacgtggtaggagatccatcttcagccgcaatgatgttgaggcaataccagaagccattctccaccaaactgttgacctcgcagttaaccaactaattcaaactttgttttgtggggattactgttcacgctatatcagactgttaaccagaaacttggctgaaaaaagatatgtagtggacaaaatagttgcagccgttgaagataagcacaacatgttcggaattgacaaagattttcttagagccctatggatcaatgcctcaacatatgagactgatgcagagtttcgagttcaagaagaaatcaatacgatgatggaagttgatgacatgtggccgatggaagttgataacatgttgggtacacttttcattgaagaaaagatgggaagcaatgggcagttggtgattgtagtggatgcagatagcaacaagaagctggacctccaaaagttgcgttttccaactggaattgtggtgttgataacaactgagccgtcaacacaagcagagaaagatggtgacttcagaattgcatgcacaatggatttgaatatttggacccaggatcatctattgccttggaaagtcttctgcagctatgtgggcagttgtatcagcagtagcatggtaagttcatcaatggccattcagaaaattgcagtggaaatagttaaggaatgccatggtcatcttcttgccattgtccttttgtcaaagtatcttatgtatgtgcaagattttaaacagtgggaacttgcacttgacaaattaagcagtctgaatccttcctatgattatcaagatagtgaccgaattggcattagtagagtcatggtcaatgcattcgtaaatattatctgggaagacattgatgatgcacaaaagctttgccttgaactcagtttgcctgttcacaacattaaaaatggggtgagagatgatatcttggtgtctgattgggccaagataatattaggatacacgcaagaacttggtgaatacagaaggcaattacaatatcacatgaaggagcttctagaccgttttgtcttgttgaaatatgaaagtggagatgtctatttgccaatagaaacctatgatataataaaatcattgcacacctcaaagccttccatcctaaggcatggtgcattaggattgacggagccaccctacattggacgatggcatagtcttattcggatagaattgatggacaataaaatatgtgaattaccacaatcaccagattgccctaaactcaaagtgttgttgttgcagggcaatgttgatttgatggatatccctgactcatttttcaaccacatgcccctgcttcaacacttggacttatcctacactagtataagggatttacccccttctgtctctaaattaatacaacttcagaaattttatcttagaggctgtgatctcttcatggaactaccacatcagattggacagctaaagaatctcaaagagcttgatcttgatgggactttgatcacccatctgccaatagagatccgagaattgatcaacctgcaaatcttaagcctctgctttgatggaacttccaggtcaacaattattcctccaggattggtatcaaatcttactcaattgaattatttaagcatcaacgttgaccctgaagatgagcaatggaatgagaatgttattagtgttttgggggaaattttttttggattatggaatttgcagaggttgagtatatatatcccaaaggctgacctcttggaattcataccagccgaaaaatctctcaatttcagattggttgttggtcaacatatgcgacgtttaatatcgcgtgtaccacctgaactggagacaaaatttaaacactgtgactatagcataaagtttgttaatggtgtgaatattccaaatggagtgaaaatgaatcttgggcgcttcaaagccttgtacctagaccgacatatgaccatcaagagtctctctgattttgatttgaggaatttatgggggttggaagtatgcatattggcagagtgtaatgaaatggaaacaattgtcagtggaagcaattcacctgatgggccagcttctctaatgttgaagtttttgagtgtattctatatgaagaatttaagaagcgtctgcgaagggagtagtcccttctttctcttcttaaagtctatagcattacacacttgccccatgttaactaccatcttcaccttagattctcttaaaaaactttcctttttggaggagattattgttgaagactgtccaaaactaaccaccctgataagtcatgccacaccagaacaaaaaccagtgtttttcctccccaagttgagaataatatcacttctctatcttcctgaattggtcaacatttttaatggcatgcatgttggaccttttatagaagaaatgatattttattattgcccaagactccaaagtctttccaaatctgagttgtcaagcaaatctttgaagatcatcaaaggtgaaagcatctggtgggaagcattgaaatggaatgaagcagagtggggagatgctggtcgacccaattattttgagcgaattttttcaccaattaatgaggaggctgacatgatgaaccaactagctgcacttcaagagactcaactaaatgaatatcacaatacgacatatcagacaccagccaaaccccagggtgctacaaaaccttgcactcatttctttgctgacattagtcattccttccaaataacccaacataaactcaacgggaaaaaatttcaagaatggtgccaatcagttcttgttatcaaggggaaaggtaagatgtgctatcttactggagacatctctacaccaaaactctattgtgaagacatggttaatcaatttgatggaggctaa

SEQ ID NO: 12835 - DNA, 807 bp, Glycine max
  Peptide Sequence Number=SeqID_129613
atgtctcctcgtaacaaatcatcggaaccaacaccgtggtttcagatctggtgcttgtcaacgactccgtgggtctcttcatcaccatcgctaacattcatcgtcttcgtcagagcaacaacacctccttgcattgctcctggttcgcttaaacatgggctaggattcgattcccgactagggttcaacaacatgaaggttcgagatggtggcggcatgaagagagagtggggcaacgctgctgtgggaaccacactgagatgttcaatgccaaggccatcatcctcttcggtgacatctggtttcactaattcaattctgatcgaagcccaaatctcgttggtgaggaacacccttcgtgaccaaatcacgtcattgtcctctgtagtgaagttcactgcgctctctgagatctttggtgacggtggttctggttgtggcggcggaggattctgccaagagaaccacgatttccgccataactcgcgtgtcgtggttctggaagggcttttcttcgttttatgtgtcgaacttgtgccagttggagaaacaagaggcccttacgattacggaggaagaaaacaattccaaggtgcccaagttcttcaacacgatgttccagagcaagaggaagacaccggcggtgttcatgtcaaagtgctccgtggcggcgattgtggcgaagtttgcggcagcggcgtgggggctgaggttccgcgtggcggaggtcaaggacttcaagatccggctgcaaggtgcgacggaggggaggaaggggaggctagcggtcacggcggaggtgtttga

SEQ ID NO: 12836 - DNA, 186 bp, Glycine max
  Peptide Sequence Number=SeqID_129614
atgaagatattcacaaggtgttccaaaaacaaaaaagtggatgtagaaattcaggaggctgtttcactggtgctgtccatggtcgaatcagcaaatgcacgtgagcaataccatcgcatgcttgagaaatatcgtaaagctaagatattacagtccggtgtccatgtcgatatcggtgtttcatag

SEQ ID NO: 12837 - DNA, 225 bp, Glycine max
  Peptide Sequence Number=SeqID_129615
atgcacttctatggaatttcaagttctaaacagtcgatagcaaaaatattagccccagtttcatctgtgggtaggggtagttcaaacagtgaagcccaaaagcggaaagtcgttgctgagccaaagatatttcaagaggtaacaaaaaagttgccaatagcaacaaatagtggtgctagcgcggaattgcattatagagcggctagagcatgctacgaaaattga

SEQ ID NO: 12838 - DNA, 273 bp, Glycine max
  Peptide Sequence Number=SeqID_129616
atgtctgggcttgaggttgtagcccctcttgttggagaggtaggagcgcatggcattggagaattacattctacaattgcatctaaaattgcgtcttccagaaaccttgatgacaactacaacattttgctcaaagacatggagatgctacttgcaataaagaaggataaagagagggaggttcaaagaaacaaccacaaagataccactaatgcttacaaactgtggacaaacagggtatcagatgctgcagaagaagtgcagaagctgaaa

SEQ ID NO: 12839 - DNA, 1089 bp, Glycine max
  Peptide Sequence Number=SeqID_129617
atgtcaggtgttcctctcttcaatctcgctcctaatctcactgtctcgaggctctgcttaggaaccatgactttcggggagcagaacacgctggcggagtcgtttcagcttctggaccaagccttccatgccggcatcaacttcttcgactccgccgaaatgtatcctgtgcctcagcgccctcgcacgtgcggcaggagcgaagagtatctcggccgttggatttcacaacgaaaaatccccagggatagcctcgtaattgcatctaaggttgctggaccttctgggcagatgacttggattagaggtggtcctaaatgtttggatgccgataatattactgaagccattgataatagtttgtcgcggatgcaaatggattatattgatctttatcaaattcattggcctgatcgttatgttccaatgtttggagaaactgagtatgacccggtccaacaatatgcttcaattagtatagatgaacaacttgaagctctcagtgcagctgtgaaagctgggaaggcaagtggtattatcagatttgttggtcttagtaatgaaacaccttatggcttgatgaagtttattcaggttgctgaaaaatatgcttcacacctgaagatagtatcattgcagaattcatatagcctgctgtgtagaacttttgattctgcaatggccgaatgctgccatcatgagagaattagtttgttggcctacagtcccctagcaatgggtatactttcagggaaatatttttccccaggcggtggtccaacagatgctcgtttaaatctttttaaagggaagtattcagaaggagaatctaggtacaacttgtccaataaaattataaaggcagctaccgtgaaataccttaatattgcaaaaacacatggtcttcatcctgtatctctggctatagcttttgttttgcgacacccccttgttgctagtgctgtttttggggccaccaaatcatggcagcttcgggaggttctaaatgcatgcaagattgagctcacatttgaagtaattgaagaaattaacaagattcattcaaggtttccaaatccatgtccctga

SEQ ID NO: 12840 - DNA, 2664 bp, Glycine max
  Peptide Sequence Number=SeqID_129618
atgagcggcaaaggcggtggcggccagaaggcagggattcctccggccagtcggaagatggttcagagcttgaaggagatagtgagcaacatccccgaacacgagatctacgccactctcaaagactgtaacatggaccctaacgaagccgttagtcgcctcctctcccaagatacttttcacgaggtgaagagcaaacgtgagaagaaaaaagagggtaaggacacaacggattccaggtctcgtgtggtaagcaatacatctagccgtggcggtggtgctagggttagcgctgaccgatatgttgggcgtggaggcgctactcaatttagtagtggtggtggtaagcggatgctgggaaaacctgtactcaaaaaggaaaacggaacacctgcttatggaggtcttactgctcctgcttctagcgcattggacaataatgtaaacaggcaactaccatcctacaggatggagcatctcatgaatgttcgaaactgttgtagtgattctgtccgtgtctgtgatggtctatcttcatcacaatatggtgggatgcaatctccatgggtggcgaacccaggtcaagtatcaatggctgacattgtcaggatgggtaggccacaggccaaggcatccatgcataactcttctctccacagtggcagccatcagaatgtttttgcacccccagaagcttcacataacaatttgcattcattgcaaggtcatgcttccaaggtgtcagaaacaaataatgaccgtggctttgctattaactccaatgttgaacagaatgatgaatggccattgattgagcatcaaccagctgtttctgtatcctcagttgtagatgatcatccaacatctgagtaccatacaaactcatctaactctggtgaagctaatcagcagctgaagacccatgtaaatgaatttgtagctgaagatgatcctgttgagaatccagacaatgttggatctgcttctatatctgaagagaatcccgaaagtacatctgtttttgatggtagcacgtacaaggacataaattcctaccaatctcatcggcatccttttgaaactaatgaagctgaaggtggtgtttcatcagtggccgcgaacttagagcagctaaatttacactcaaatgatcaggggactgaacaagaagaggaaaattcttctgtagtaattccaaatcatttacaactccattctgctgaatgcttaaatctgagctttggaagttttggatctgcaaacgatgcttccctttctggatctggcccatatgcatctaggcccttgaaaagtaacttggaagatacatctggagcaaacgatgtttcaacaattggaaaccctgactattatggcgatgagcatcttactactacctctgatgggaatgtagctcacataactggtgtggatgctgggacttatgagcattcctccatttcgcaatcagaggctttaaaatctgaaccccctgaaactgctcaggaaaatcaatattcatttccttcttcacacgagtttacttacgaaaatgcccaacagccagatgttacataccctcattcacagacaagctcacagatacagaacctgtctcccttctctagtgtaatggcttatacaaattctttgcccagtgcactgttggcttcaactgttcaaacagcaagggaggatatcccatactcacccttccctgcaacacaatcaatgcctgcaaaatatagcaatattgcttcttcaattggtggtcccactataaacatgtcagagggtgttcgatatttagaaaacagagggaagtctaaaaccacaaatatggatgtgagtgtatcagtattgaatatggatttgatacaagtatctgtgcattacatgcgggctctaagggcaaataacatttcaacacctcaacctaatccacaagccctgcctggtgccaatgttgccactggacctgcacttcctcaacaccttgctgtgcatccctattcccagcctactcttcctctgggacattttgctaatatgattagctatccattcttgcctcagagctatacctacatgccatcagcatttcagcaggcttttcctggaaatagcacataccaccaatctctggcagccatgcttccacaatataaaaatagcatttctgtcagtagcttacctcagtctgctgctgctgctgctgttgcatctggatatggttttggaagttccaccagcattcccggaggaaattatccattgaacccacctgctgcgcctactagtacaactattggatatgatgatgttataaactctcagttcaaggagaacaatcatattatttctctacagcagaatgagaattctccgatgtgggttcacggacctagctctcgaacaatgtctgcagttcctcccagcacgtattacagcttccagggacagaatcaacaaccaggggggtttcggcaaagccagcagccctcacaacagcattttggatcccttggataccctaacttctaccattctcagactgggatttctctggaacatcagcagcagaatccaagggaagcatcccttgctggttctcaaagccaaccaccaaagcagtcccaacaaatatggcaaaacagctactaa

SEQ ID NO: 12841 - DNA, 408 bp, Glycine max
  Peptide Sequence Number=SeqID_129619
atgggatttgtgggacatgccacaaatgtcatggccctttacaagaacatactttcatttagtgtggcaagacaagctcgttgggtttcgtttaaaattttctctaaggcggtggcaattaaatgtggaggggatgctaatgtggggtatgcttggtatggtggctccttggatgatctcttagagattgtatctgctggattcaatggatgcaaaaaccataatgctaatgatgatgatggtgataaagatgagtgtcatggtattggtatgcctttatttgctgccaatttttccattgataggcatgtgctactatgcaaggtgatattagggaatgtggaagctgttcctgctggctcaaagcagagccaacctagttctaagcaatatgacacgggtggatga

SEQ ID NO: 12842 - DNA, 2631 bp, Glycine max
  Peptide Sequence Number=SeqID_129620
atggagaagaagtgcaactatgttcgtgaacttaagaaggatgaatgtttaagagattttcttgttgataaaccaccagagcctgtcttaaaggagttaaatgtcccacagataagtggatatccaacccttcaaggtgccttgaaaaatatgctgggtttgctaaaaaataataagattaaagtcattggagtgtgtggaacaaaaggggtggggaaaacaacaataatgcagaacctaaacaacaatgaagaggttgctaaactgtttgaaattgtcatttttgtgaaagccacagcggatgaccataagcttcaagagaaaattgctaatcggttgatgctggacatagaaaccaacaagaagcatagcggtgatgttgcaagaagaatacacaaagagctagagaagaagaagtatttattgattttggatgaggttgaggatgccatcaatttggagcagttgggaattcctagtcacgtcaacaatggcggtaaggtagtaattgccactcgactccctcgagtttataagttgaataaggtgcagagggtcatcaaagtcatggagttatctcctgaggaagcatggaagatgttcagagatactgttcatgcctttaatcctaagattgattcccttgaaattcaacctatagccaaacttgtatgcaaaaggtgctctcgtcttccacttcttatttacaatatagcaaattcttttaaattgaaagagtctgcttcaagttggtcggcgggacttgaagatcttaaaccttggcctgaacttcaaaatcaaggtttagaagagttgtactcatgcctgaaattctgttatgatgaactcaaagataaaaagaagcagaaatgctttttatacacttcactgtatcctgcaaatagcaaggtttacactgattatttagtggagtgttgggcagcacaaggtttactcggtgatataaatgacaaaaggtcatatcgaagtgcacgcaattgtggtattaacatattagaacatcttgctaatgtctctttactagagaaaggggaatcaatgatatatgtcaacatgaatcattgtatgagacaacttgcattacacatatcctctaaagatcctgaatgtagcttttacctccaagatggcgaagaatctgaaaatctctcaaattcaagagcttggcagcaggctaggtgggtctctatgagacaactgcttgattttccaacaagccaagatagcagcatgattttgacgttgttgctgcgaaaaaatccaaaactaactacaataccaccaactttttttgagaacatgagcagtctacttctgttagacttgtataatagcatgattacacaactgccatcgtctttatcaaaattgacttgtctacggggtttattcttgaacagttgcgagctcttggaatcattatcatctgaaattggatcacttcaatttctagaggtccttgacatacgagatactaaagtaacattcatacctctacaaattggatgtttgactaatctaagatgcctgcgaatcccattcattgtaagtgaagataatgaagctcaaaatgttcatgtgatttcaaagcttcataggttggaagaattaaccattcaagtcatatcctatgaacaatggtgcaatgatgctgaaaatgttttacaacatgtggcttctttggaaaatgtaacacatctcagatgttgttttccctcctcaatcattcttggagaatttctttcaagaagtaaatcatggagttgtaagcagcaaaattcatttagattctttgtgggatgccaaaactcaaggcgacctcaaatacttgaatcttttgagtataaaattactaattatttgaggtattgcaatggtggacagaaggatgactcggcaattattgaggtactaccaaaaactgatgcatttgaattagtttgccataaagatataaaaaaattgacaaattttgctggcgtagtgtgtttggaacgcattcgtggtcttttgattacaagatgcaacaaagttttaacaattgtgtcagcggatacaagtagcaacaccatgaatggaatccaaatagaaacaagagtcatcttaccaaatttggagcaattatatttggaaaatttgctcaatttaaaatgtgtttttagaggtcccttgcacagtggaaccttttccagattacaaacgttgtcattgaagaattgtccttcactgagtgacattttcagcaatggagcaattcaacatttttcagaacttcaaaatctgaaacttgaagattgttcaaaaattgaagtacttatcagagaagaagacattgaaggagaaagggatgtgcttccaaaactagaaatacttctgctggttaacttgcctaacttcaaaactatatgctcaactcatacattggcttggtcctctttggagctgttaaggattcataactgtcctaagttgaaaactttaccactagacagtgacaatgcagtcaacttaaagtccattaaagggcagcaagagtggtgggatgagttggagtggacaaacaacaaggtgcgtcccatctttgctgcctccaatgagtatttttcttag

SEQ ID NO: 12843 - DNA, 636 bp, Glycine max
  Peptide Sequence Number=SeqID_129621
atggcgcaaggcatggcgagtaaccgcaaccggagcgcgagcgcgcaagaagcccgcaaggtgatggtggtggcggacccgacgcgggaatcggcgggcgcgttgcagtacgcgctggcgcatgcggtgatcgagcaagacgagctgattctgctgcacgttgagaaccctagctcgtggcgccacaccatttcgacgttcctgaagatgccgtcgttgggaagctcaaccactgcgtcgctggaccttggaggagggggagccgcggcggatggagaagggttcgattttctggaggagatgaagcatgcatgcagggtttctcagccgaaaatgaaggtgcgtgtgatgaaggtggagaccgatggaagagacaaggctagcactattctttctcagagcaaaacgcatggggttgatgtcgtagttataggccagaagcgcaatattacttcggcgttattaggatataagcgacctgcaggtggatctatgaaaggggtgaaagcgatagacactgcagagtatttgattcaaaacagttcgtgcacctgtgttagtgtacagagaaaaggccaaaatggaggctttgttctcaactccaaaacccacagaaatttctggctcttagcctaa

SEQ ID NO: 12844 - DNA, 135 bp, Glycine max
  Peptide Sequence Number=SeqID_129622
atggagttttactcctttagatccaacccctcggcgttgcaacgaaataagaatttgtgcgattcctctgcttcctgtttatggtggagtcatcgtggagattgtacgggccctcatgcgcgccctagctcgtga

SEQ ID NO: 12845 - DNA, 534 bp, Glycine max
  Peptide Sequence Number=SeqID_129623
atggcaaggtatgacatgactggtgttggaataaaccttaaggaagttcctgatgaaaatggagacctcagactggaggttctgggaattatattggatggtcctgctcattctgctggtgttagacagggggatgaaatattggctgtcaataacatggaggtaaagggaaaatcagcatttgaagtatcatccctgttgcaaggccctaatggaacatctgtgactattcaggtcaagcatggcaactgtggacccgttgaatcaatagaagtccagcggcaacttgttgctcgtaccccagtcttttatcggctggaacaattggacaatggtgttacttctgttgggtatatacgcctcaaagagttcaatgcattggccagaaaagacttggtcattgcaatgaaacgacttcaagacatgggtgcctcatatttcatattggatctcagagacaatcttggtgggctagtacaggttgcttttgcatataacccaatctacctttaccattttgactcacttctttga

SEQ ID NO: 12846 - DNA, 528 bp, Glycine max
  Peptide Sequence Number=SeqID_129624
accgtcacagatgtgtcctggttgccgaacacggagcatcggggtgttagggcgtttcaggagatttcatcgttccagggtcagctcagatggggtcctatgatcgtcacagttcgaccggagagggtggtacgccagttcggttacatccagagcatcccttcgccgcctcttagtgcacgattgtcacacgatcagatagatgacatgaggatggagttttgcggatcacttactacctgcgggcagctgaccagcagagggatgcaccagctgcagaccctgaggactacatacagcccgcccagcccccaggttccagtggcatttgacccccctccacatgtggatgattacgagggatatgaggcgattgcacagaggttggagcgtgtgctcaaccttaggatagtcactgcaggcacagagttatatgacattatgcaggactgcctgacgatcgcgagagggggacccagtgctgatgggacgatctgggctcgtcagagacgccgcacggaccattga

SEQ ID NO: 12847 - DNA, 135 bp, Glycine max
  Peptide Sequence Number=SeqID_129625
atgtcttgtgagaagctgttgattgaagcattgcaaaaaggagaaaattatgaaggtgcaaaagttggtgtctcgctaagcctgaaccatgcgcttagcgagaccaaaccgctaagcgagacagcagtggcttag

SEQ ID NO: 12848 - DNA, 144 bp, Glycine max
  Peptide Sequence Number=SeqID_129626
atggcagtgaaaaacctcatcgagcgcctaggagtacatgataggaaacaccacatggggaaaaagatagctacatgtgagggaagtttctcttaccaaagatattatttcacaaatcccaattttagggatgtgcataaataa

SEQ ID NO: 12849 - DNA, 276 bp, Glycine max
  Peptide Sequence Number=SeqID_129627
atgcgggggtccggggaatctgtccccttcttagatacgacgtctaggggtagcgaaatgccccaacgcacgtttttaagaaggcgacacggaccctccgttggtttgtttacagtagggatcaagacagaacccatatgcaatgcctatgcaaaagacacaatgcgggaatgtgcacaaggtatcatcccctttgaagaacatattgtagcagtagggactactagcaacaataggttttcaaagagaaaagctctagatgagggttcactgtaa

SEQ ID NO: 12850 - DNA, 751 bp, Glycine max
  Peptide Sequence Number=SeqID_129628
aggactacacatcctcgccttcagaggactacacgtcctcaccttcagaggactacacgtcctcgccattagaggactacacgtcctcgccatcagaggactacacatcctcgctatcagaggactacacgtcctcgccatcagaggactacacgtcctcgccatcagaggactagacgtcctcgccatcagagggctgcatgccctcaccttcagaggactacacgtcctcaccttcagagggctacacgccctcacctttagaggactacacgtcctcaccttcagagagctacacgccctcacctttagaagactacacatcctcgccatcagaggactacacgtcctggccatcagagggttgcacgccctcaacttcagaggactacacgtcctcaccttcagagggctacatgccttcaccttcagaggattgcacgtcctcgccatcagaggactagacgccctcgccatcagagggatgcacgccctcaccttcagaggactacacgtcctcgtcctcaccttcagagggctactcgccctcaccttcagaggactacaggtcctcgccttcagagggctacatgttctcaccttgagaggactacacatcctcgccttcagagggctgcacgccttcgccttcagaggactgcacatcctcacctttagagggctacgcgtcctcactttcagtgggctccacatccgcaccttaagagaatttaaggttttctgcccttaa

SEQ ID NO: 12851 - DNA, 285 bp, Glycine max
  Peptide Sequence Number=SeqID_129629
atgactacctgtaataaagcacaggctactacgagccgaccagaacttagattaccagatcctggacacaatcttcctagagatggagagccccttgccccgccttttctagcctctccttcttgcttacctagctcttgtcttagtgactcttcttcttttctagtggagctttcgatcaagacgttctcgcctcccctgtttgggctctcgctcgaatcggaacctttatgcgttggtaggctttcgactcaatcgaatagcctacctatcgggcgccaataa

SEQ ID NO: 12852 - DNA, 327 bp, Glycine max
  Peptide Sequence Number=SeqID_129630
atgggtgaagtagacgcggtgcaagagtggataaaggccgacatagaggccctaaaagagcaaatggccacaatgatggaggccatgatgagcatgaagaagacaatggaggtcaatgtggctgcagttgctgctaccagcgccgttgttgaggtggacccaactcccccatctggcctcaaccaaataaatcatccaacctcggatatggtaggtcagggaggcaaggagtggggaagtacgggcgactcccattttgtgcaagttcaaaacaagcatgccttcccgccatatagcttgcctcccatctacacaccacccaatctg

SEQ ID NO: 12853 - DNA, 525 bp, Glycine max
  Peptide Sequence Number=SeqID_129631
atgactgatatacctttccttttgaaaaagcaaatatttagagcgacggcggtggcggacgacaccacccaatccctcctcaagtacatcctcttcatgagggtttacgagggttgttgcttgcgatgccagaattgtgatagatcctttctcgtcatcacgatttcattgctacagtcgcttcttcggttctcattagaaaaagaagctgctcctgtggcagcggtgccggtgcaggcaccacctcctccgtcacaacaggcttcttcgctaccaaattggattccggtgccaattgagaatggtgttgggagtgttattccgatagcgatggcgagggtgacaaaattacacagtaggaggcctggaagatggttgaagaactggagcagctcgctcaacgcgtcaacaatcgctcagcgagacgagccaacttggaggtcaggcttagtgagcatctgcggcttagcctgcatgtggcggcttagcgcgcatctgcggcttagcctgcaccttgcggcttag

SEQ ID NO: 12854 - DNA, 492 bp, Glycine max
  Peptide Sequence Number=SeqID_129632
atggatccaatgggatatagtttgataataaaggatacaggaggaccgcagaaaaaaattaggaaaccattattcaaaaatattttagtaaatgacaaaactgctagtgcaagtgaaatagttgcttctgcacttcatgataattgtagagctgttcttgttggaaaacgcacatatggcaagggtctaatccaatctgtatttgagcttgatgatggatctggtgtggttatcactgttgggaagtatgtaacaccaaatcacaaggacataaacggcaatggaatagagcctgacttccagaaacttccagggataaagcagtctctttggtattccgatgcaatctattgctttggacttatcattttaattgaaacttttgatgaatctgctcgctggaagctgctttgtatatctcaagaatttcaagttaatatagatatatgcctgaatggtctgcctagccttcttggctacaatggcatttaa

SEQ ID NO: 12855 - DNA, 891 bp, Glycine max
  Peptide Sequence Number=SeqID_129633
atggcaaaatatgaaacctatctgagagtctcagctctattgctggcctctctcttgatgtgtctctttggagtcactgctgagggcaatttctatgaagatattgacatcacttggggtgaacatggtggtgtaaatatactaggaagcaactctctcgtgctttctcttgaccagtcctctggctctggctttcgatccaaggcagaatatctatatggaagaatagacatgcagattaagcttgtctctggtaactcagctggcacagtcactgcatattatttatcttctgaagggccaaatcatgatgagatagattttgagttcttgggaaacctcagtggagagccctacatagtccacaccaatatctacacccaaggcatagggaatagagaacaacaattctatctttggtttgaccccacaaaacatttccacacttacactattgtatggaaccctcaacgcatcattttcatggtagatagtatccctattagagtcttcaacaactacgaagccaggggagttccatttgctagcagccagcccatgaggctatactccagtctatggtgtgcagatcaatgggcaacaaaaggagggcttgtgaaaaccaattggtcttttgctccttttaaagcttactataggaactttgatgctaaagcttgtgtgtggtccaaaggatcatcttcctgtccttcaaactcagcttccatgactcattataataatacttggcaagctcaagatttggatgcttatggtagaagaagtctgagatgggtgcaaaaatattacatgatttatagctactgcaaagattacaagcgatttcctcagggtcgacctcgtgaatgcaggctttctagattctcttag

SEQ ID NO: 12856 - DNA, 2346 bp, Glycine max
  Peptide Sequence Number=SeqID_129634
atgcctcgtaaagtaaattacggactcgattacgacgacgatttctatgatgatgattatgatgactatgcttatgatgatgccgatgcagaagactatgcagaaggacctgatacaaagcaagagaccattaagcctgggctttggcaatgctccatttgcacttatgacaacgatgagagtatgactttttgtgatatttgtggtgttgtacgccgttccttggttaacactggaacttccaacagtaacaaaacagttgaagacataagcaaaagtcctggagcatccaagttggccaggtctctttttcaatcattacaacaacagattcccaaagagattgtattatttccaaagccagatgatggttttctgacagatgacagtaacttctacaagcttgaaaatgtccgaggagaatttcatgaaattcataaggcttttagtactcaaagccatccacatttaaacatagatcctttcaagtttgatgttccatccccagatgatgtggtttatactggcctacgttcttccaaaacgggtttgaaagacaaagctacaaacactaaaagttctcagctttcatcaagcatcagagagaagaatgaactttctgtacaatcaaatgctgaaagttctgacaacttatcatccttaacgcgaaagagcaaacaggatagttcagctaagagcaagctttccaaaaatgtagcaattgatctacaaacaagtggtaaaacttcaaacagcttgccagaatctttgtcaaaagacaaaggtaacaatattaataaaataaattctttgaaaaatggtacaattgatattcaatcaagcaaagaaaagtcaggtagtttgtctgcactgtcaaaagtcaaggaaagtgataacattagtttctcttctatcaaagatggaaaacctgaaagtatttccagcagtttcaacaatatggctctcaatgtaagatctggaaattcatctggaaattctgataatactaatgctaagggaactcgctcacatgtttcttataagccagaaaaatggatgctccctcaacaagctgaagatacattgactcagctgaatcttgcaattgttggccatgttgattctggaaaatcaactctatctggtaggttactgcacctattgggacggatttcccagaaagaaatgcacaaatatgaaaaggaggccaagttacagggcaagggatcctttgcttatgcttgggcacttgatgaaagttctgaagaaagagaaagggggataactatgacagtggctgttgcttattttgacaccaagagatatcatgttgttgtgctcgactcccctggccataaagattttgtcccaaacatgatatctggggcaacacaagctgatgctgcaattcttgttatagatgcctcacttggttcatttgaagctggtatggatggcagcaaagggcaaacaagggagcatgcacaacttatcagaagctttggtgttgatcgggttatagttgctgtaaataagatggatgctgttgtgtactccaaagatcgatttgattttataaggcagcagctgggagtttttctccactcttgtggtttcaaagattcttcgctatcttggattcccatgagtgctatggaaaatcaaaatttggtggcatccccttctgatgcccgtttaaaaaactggtatggtggaccttatctattagatgcaattgactctctccaacctcctactagagaattctcaaaacctctactaatgccagtgtctgcctctggtaaactagaagcaggagctcttcggagtggatcaaaggtcttggttatgccttcagctgttgtgggaacagtacgttcattggagcgtgactctaatgcttgtactgttgcaagagctggagataatgtagctgtaatgttgcaaggtgtcgatggaaatcatgtgatggcaggagatgtattatgccatcctgactttcctgttgcagttgctaagcatttggagttgaaagtgctagtgttggatggtgcaagtcccatattggtgggcacacagttagagtttcacatacaccatgcgaaggaacctggtagagtttcaagaatattatcagtacttgatcccaagacgggtaaggtgaccaaaaagtcaccccgctgtctcactgcaaagcaaagtgcagtaattgaggtgattttgaatgagacagtctgtgtggtagagttctctagttgtaaagctcttggaagggtgtccctaagatcaatgggaagaacgattgctgttggagttgtgacaagaataattgaagaacaaggttaa

SEQ ID NO: 12857 - DNA, 1170 bp, Glycine max
  Peptide Sequence Number=SeqID_129635
atggacgctctgaggaaacaagccagcaagctcagagagcaagttgccaaacagcaacaggcagtaataaagcagttcagcagtagtggttatgagagttcagatgttgtggtcatcgatgaggtcgaaatgcagaggcaccaccagctggaaaagctgtacagggccacacgtgcagggaaggacttccagaaagaaattgttaaagcagcagaaacatttacagctataggttataagcatattgaaacaggaacgaaactttctgaggattgctgtaaatatggagcagagaacaacagtgacaacatattatctaaggctgcatcagtatatggtgatgcccgcaagcatgtggaaaaggagcacgaagaattaaatcggcttttatctacacaggtggacttttcatatgttgttcaggtattggatcctttgagacaaatgatcaatggtgttcctttggaggatgctcgccatcttgctcaacgatatagtcggatgagacaagaagcagaggcacaaactccagacagctgttacatgataacaatgttgatagagcttgagaagttgagcccaaagaagagagaggagattgctagaagacaagcacgggttcgggaagctccaactgctgaacaggttgccaaactgcatgctgcggaagcaaggatgcaggagctgaaagcaaacatggcagttctaggtaaagaagctgcagcagcattggctgctgttgaagcacaacagcagagacttacttttcaaaggcttgttgccatggttgaaggagaaaagacttttcatttaagagttgcagctattcttggtgaaattgaagctgagatggtctcagatagacagaagaaagaatctgcccctccagtaggtatttctgagaatggcacagagaaaacaatgtacttcttggctgaagcaacgcatcccttcagtggtgaatcagaaaaggaactgagcttttctaagggtgattttgttgttgtgcgaaagcctccatgtttaccaaatttccaaatgcttacccaggtgagccaatcaggatggtcagaaggcgaatgcaatggcaaagcaggatggtttccttctgcatatgtggagaaacgacaaagaatcccctctagcaatatggctggtgaagtttactag

SEQ ID NO: 12858 - DNA, 1491 bp, Glycine max
  Peptide Sequence Number=SeqID_129636
atgggaattcaggggtttttgccgctattgaagtcgattatggttccaatccacattaaggatctgaagggttgttctgtagccgtagacacctactcttggctccacaaaggtgccctctcttgcagcaccgaactctgcaaagggatgcccactaccaggcacattgagtattgcatgcacagagtaaatttgctgcgccattttggggttaagcctattctagtgtttgatggagggcttctgccaatgaagagtgaacaagagaacaagcgtgccagggctagaaaggataatcttgcacgtgcagttgagcatgagtcagatggaaattcagctgctgcttatgagtgctaccagaaagcagttgatatttcacctcaaattgcatgtgaactaattcaggtattgaagcaggagaacttgcagtatattgttgctccttacgaggcagatgcccagatgacattcttggcaattagtggacaagttgatgcagttataactgaagactctgatcttataccatttggttgcccaagatccttgtcaggtatgggtctcaaaagggcccatgcaagcattaaaaaatttagaagttatgacaaggttcttaagcacttgagatatagtggagtttctgtgcctcccttttatgaagagtcattcaagaaggctatacttactttccaatatcaacgggtttatgatccaattaatgaaaatattgttcatttgtctaatatatctgatgatattggtgatgattataccttaacctgggatacaaccatgccaaaagatatagcacaaagaatagcaaaaggggatcttgatccaattaccaaaatgccatttgagggagagaatcttacagccagattagcaattgtggaaactagtcaattcaaaactcattctgaaagtgcaaagaaaaagattgatttgcccgtgcagaagaatctcttaactaagtatttttgtatcctacaaagcattcttcttgaattgattttaatatgtttagcatgtttaaaggggaggaatgcagggcagcattctatgcaaaaaggaaattcagagctcctcgggtgtcacctactgctgctaatgaaacaaagaactctactgcatattgactctgagaattggggcagtgtccctcctcctaatatccatattggatatagttctgccacaaacaattctgaatttacagagtctccatgtcatgagaagaaaagccctgaacatacagtactgcgaaagcccaggcagccaattcataaaccgtgtctagggttgcatgggcacacaaacgtccaagacacagctgaaggaaaaaccagggaggaggcaacaagaaaggtaactgtaaggagtgcttattttcagcacaagcaagtggaaaagaatgtttatggcgaaaaacaagattgcctgtcatctggcattgccattgatgagagaaaaaatgccttatctgaatag

SEQ ID NO: 12859 - DNA, 213 bp, Glycine max
  Peptide Sequence Number=SeqID_129637
atggcaatggggcgggtcgggtacggaaagtcatgtttcgccgatgcctttggtgattttagaggagatagtggagaaaggaaactcacagatggctacggaagtgtcgtagttggcagcgaagtgagcggttcggacatcgtcgctgtcggcactaatggtgaagaggtcgaagttgtagtgtgcggaggtggtgtcagtgccgttttgtga

SEQ ID NO: 12860 - DNA, 891 bp, Glycine max
  Peptide Sequence Number=SeqID_129638
atggctattgtctttcttttgaatgaagaagagcgtcaggggagcatttctgactctaacatgattgaaaatgaagcaattgacacttcggtacttcgcatgtttcaaaaggaagagaagctgccagtagttagcagtttgccggagggacagaacaaatataagattttaatgaaatcaccttgggaaatactccaatctccagttggatctggaggccttattagcttgttttcaaaacatagcattgtagataatcttattgacatgggtgttgagtacattgagttttgctgcccgagtgaaagaacggccggtggaaactctctactttttgggttgattaattcacgggaagccaaaattgggatacaaatttcccctaaaatcactgatttggaagaaaattttgacatgatattctcgatggactttgtaaagaagttaacgaagcaaagcaacaaactccaatttgatgcaatcccaaaggcacattcctttgttgagaaagttgacaaagaatgggttactgtcacctcgtccacccccaattcatatgagctctcttgtagtatacatgattccttaaacgcatgttcattggataaggcggtcaagaaacatattgggaaggaagagaacaagaaacattttatagaatttgtaacctcagagttccgtaacaaccgaaatttgtctgacaatgtggctatccaacagaaaataaagcttgctcgtgattatacttttcttcttaacagtgtacaccatcacaaggatttacttttttcgtacaatattgccgtggataggtcagatgaagtaaaaaggactcttggaaaatctgcttctagtgttggtcttcagcttcctgaggtttatcagccataa

SEQ ID NO: 12861 - DNA, 2718 bp, Glycine max
  Peptide Sequence Number=SeqID_129639
atgtctcaagtaggtatattttgctgcctgcgttataacttgcttgtgttgcctggtgtcattttatccattactgccaagcgtatgccagggaacaattataactgcgtccctttaacaccaaggtctagattggaaaggcttctgagggaaagagagctaaggaaatccttcaagcttattcaaccaacggaggaagcaagagatggcagcaaagagggagaacaattttatggtgattcatgcataagtgagaatgaaattttgggtattcataaagaggaagaggtcacggaaacgagttttacagatagaagccaaaggcaagatgagaggccaagcaaacaacgtttgttggtggtagctaacaggttgcctgtgtctgctgttagggagggtgtggagtcatatcgccttgagatcagtgtaggcgggctagtcagtgcacttctaggcaagaaaattttgtcaccttgcattaattgtttctttggtgtaaaggaatttgataccagatggattgggtgggctggtgtgaatgtgcctgatgatgttgggcagagagcattgacaaaagctttagctgaaatgcgatgcataccagtatttcttgatgaggagatagttaaccagtactataatggctactgcaacaacatcttatggcctctatttcattaccttgggcttccacaagaagatcgacttgctacaactcgtactttccaatcccaatttgatgcatataagaaggcaaaccaaatgtttgctgatgtagtaaataagcattatgagaaaggagatgttgtttggtgccatgattaccacctaatgtaccttccaaaatgtttaaaagaatacaatgaacaaatgaaagttggttggtttctccatacaccctttccttcctcagaaatacataggactctaccgtccagatcagagctgttgagatctgtacttgcagctgacctggtgggattccacacctatgattatgcaaggcattttgttagtgcttgtactcgtattcttgggcttgagggaacacctgaaggagtagaagatcatgggaaactgacccgtgtggctgcgtatgcagtatctgattccattctcataatgacaatgttttattttttgggagtgaaacttcagtttcctattgggattgactctgatagattcattcaagcccttgaactccctgaagtccaggaacacatgaaagaactgaaagaaagatttgctggccgaaaggtaatgttgggtgtcgatcgtcttgatatgataaaaggaattccccaaaaactcttggcatttgaaaagttccttgaggagaattcactctggcgtgataaagttgtcttgctgcaaattgctgtacctacaaggaaagatgttccggaatgtgcagcacagtctcttggtgctggtgctatcttggtaaacccatggaacatcacagaggttgctgcttctattggttatgcgttggaaatgtcagctgatgaaagagaaaaacgacatcagtttaatttcaaacatgttgaaactcacacgtcacaggaatgggcagcaacttttgtgagtgaactgaatgataccattgttgaagctcagcttaggacaagacaagttcctccattacttcccaacaaagtggcagttgattgttactcaaaatccaataaccgactaattatactgggtttcaatgccactttgaatgaaccagtgggaagggctggtcaaattagagaattggaacttaaattacacccaaatatgaaggaacctttaaagaagttaaccgatgatccaaagacaacaatagttgttctgagtgggagctctcgagcagtcctggacaaaaacttcagtgaatttaacatgtggttggcagcagaaaatggaatgtttttgcgacgtacttcaagtgagtggatgacaaccatgcctgaaaatttaaacatggattgggttgatagtgtgaagcatgtttttgagtattttactgaaagaactccaaggtctcattttgagcttcgggagacgtcagtagtatggaattacaagattcaagcaagagatctgcttcaacatctgtggacagggccaatatcaaacgcatatcttgatgttgtccaaggtggtcgatctgttgaggttcgcacagttggcgtgtcaaagggagcagctattgatcgtatccttggagagatagttcatagtaaaggcatgaagacgccaattgactatgtcttatgcattgggcactttctagccaagtctggtagcaatcctaatgatagaacatcaattgataaggatgaagatgtgtatacattttttgagccagagctcccttctgaatcacctccattaccaagagctatgctatccaaatctaattcttacaggccatcatctctgccaaaattaccagccaccaaaaccgggtcgaaggcagctaaatacaggaaacaacgttcgttgtcaaacatagaaaagagagaaattgatcaatggagaccaaagtatcgtgataaaatagcactgcatgagggttcctcagtgcttgatctaaatggtgataattacttctcttgtgttgttggacggaaaagatcaagtgcacgttaccttcttaaaacctcagatgatgttgtcaacctcttaagtgacttggcagaacattcttcatcaccaacttaa

SEQ ID NO: 12862 - DNA, 543 bp, Glycine max
  Peptide Sequence Number=SeqID_129640
atgaatgctagaagctgccacctcgtgttgttattctccttatgtcttttctttggttcaggtctaggaacaaccaaaatattaacaaatgacaaaaaacaggaaatcttctcatcatcggaattgggtactcaattagatgatgtccctatcgtgggaaaccctaacactcctcctcaaacacctgacacatcagggcaaaaccccacggccccaaacacaaatccaacaaccccaaccacaacaccaacatcatcaggtggtcaatggtgtgttgctaaacagggagcttcggacgctgatctacaggttgctcttgactatgcttgtgggattggacgtgcagactgctcagcaatacaaccaggagcaagctgctataatccgaacactgtccgtgatcatgcttcctatgcattcaataactactaccagaagaatccaatacctaacagctgtgtatttggaggaacagcatcccttacaagcaatgatccaagtaagaatttcttcaaacttaaaagcatgattatcttcttgtga

SEQ ID NO: 12863 - DNA, 861 bp, Glycine max
  Peptide Sequence Number=SeqID_129641
atggcttggcggaattctagtaaaactgtcatctgccctgagcttttgggattggaaaattttatcccgccctttgcaaataccggtgtttcagacatactcaaaggcgtgaattatgcatccggcgcagcggggattcgcaacgagaccggcacacatttgttgcaaaatcataaagtcatagtttcccaaatcactcagaaacttggaggccctgaccaagcacaacaccacctaaataagtgtttatattatgtgaatataggcagcaatgactacttaaacaattacttcttaccggagcattacccatcaagtcgaacgtattctcctgaacagtatgctgtggcccttgtccaagaatatgcaaggaatttaaaggatttgcacgcacttggggcaaggaggtttgccttgataggcctgggacttataggctgcattccacatgaaatctctattcatggggaaaatgggtcaatatgtgttgacgaggaaaatagagcagcactcatgtttaatgacaagcttaaaccagtagttgatcgtttcaataaagaattacctgatgccaaatttatcttcattaacagtgccgtgatctcattacgagactcaaaagatttcaatacctcaaagttacaagggatttcagaagttgctgtgtgctgcaaagtggggccgaatgggcagtgtatccctaatgaggagccatgcaagaacagaaacctacacgtattttttgatgcatttcatccatctgagatgaccaaccaactcagtgcaagaagtgcgtataatgctcccattccaactctcgcgcacccaatggatatcagtcatcttgttaagttaaaatga

SEQ ID NO: 12864 - DNA, 735 bp, Glycine max
  Peptide Sequence Number=SeqID_129642
atgggctttggctatgacaattcaagtgacacttacaaagtggttgcagtggttggcgatggggaatattcaccggaaacagcagaagtgagagttcactgcatgggtgataattgttggagaaaggttgtaagttggaatggatttcccaaactaatgacagttcaaggatgccatggaggacactatgtgagtggccatcttaactgggtagctgctgttaagtccagagctgatactcgctatctgtcttttgtaatttgttcctttgatttaaggaatgagacatgcagatatttgttgcctcttgaatgcctttatacaaccttggtgatgctggatctttacccagatcttggggagtttggagttgtagagtcttggatttcgttgctgaacattagttgtcttcaacttcatcttagggatccatctcttcggatgtctccattgatcatgactgaaaatggtgatgtcatttttacggcatctagcttgttgttgtctcttgcaactcctttccttttgacctctatgattgctgcaattgccatggagatggaagagagtattaggcctactcctatgcgctgcaagtgtgtaatgccagtgggaataccgccaactgggatgactggaagggatgttaaaatgttttgtgatccttgtgtccaatggtggagccttgttgaacagagaaggtttggagttgtgctaagcaaagggtcattatga

SEQ ID NO: 12865 - DNA, 360 bp, Glycine max
  Peptide Sequence Number=SeqID_129643
atggacttgtgtttccattgttttctaaaggaggtgcaaaaaaatggaaacgcaatggaattgtgtttatgtttgcctcttcttcttcctctactcttcacatcctcagaccttaaccataatcgtgtcgtgcgctgccatcaccaccaccataccgacaacattattatggtgccatcaacaccataccaacaacatcatcacatgctcaaacaacacccataccaacgccgcaaagcctcggaggttgaggtcgtgcgcatagggagcctcgaaggggtcgcatgcgcaaacctggagtttggaacgactcacaacattgttcgaactatgatggtgttgtgcgttggtgacaattag

SEQ ID NO: 12866 - DNA, 153 bp, Glycine max
  Peptide Sequence Number=SeqID_129644
atgacgatctcggactcattcatcgttgaaactcaaagctgtctcggtaaaactatgattccggattcgttaaccgttggatttttccgaaattttgatacattgttcgagactcaatttcgcacactttcaccattgggatttgcgagataa

SEQ ID NO: 12867 - DNA, 405 bp, Glycine max
  Peptide Sequence Number=SeqID_129645
atggcaactctatcactagcagagaactttgtgtcatacttcactggaattatacattatgaactagcagatgcagctaacatagcaaccgattacatgggtgttagttacatgctctccattgtggtggccggacttgcattgcttacggtacaggcacacatgggtagcctgacaccacccatttgcaatgttgctggtttgaaggcttcgttgccatcacatggtgctcctcaatttgatgaaagagaccccaaagaagcaatacaaatgtcaagcttcttcaatggtctcttgttagcagtttgcattggtggtgcagtgaccttaacgtctaatgtatatatacaagactgctatggatgggactggggctttggaatctccactggggctttggtttaa

SEQ ID NO: 12868 - DNA, 1803 bp, Glycine max
  Peptide Sequence Number=SeqID_129646
atgtcgattcttgacagacgggggcttcttccatgttcaaagatctccaattgtcctgcatattcacactgttttcatgttaattgtggtggaaagaatgtaaaggtgatggaaaatgatgaaaatattcaatatgtaggagatgatggtgcgttaggtagtagtgctgctaaatatttcattgattatgaaaatcactggggatttagcagcactggagatttcttggatgatggtgattacctaaattcacgttacattaggtctttgccgtcttcaaatttgcctgaactatataaaacggctcgtgttgctccaatttcacttacttattttcgctattgcatggaaaatgggaaatatactgtaaaactccactttgcagaaatacaattttcaaacgataacacatacagtagtcttgggaggcgcttatttgatatttatgttcagggagcattatttaggaaggattttaatattgaaggtgaaacgcatgttgctcaaaaaccgtatatactgtccttatataatgtcaatgtaacagacaatattctggagattcaattctactgggctggcaaggggactacaaggattcctgttagtggagtttatggtcccctcatatcagctttctctattgtttctgattctaaaccttgtacagaccaaaaaaatgtaaggcataagataatcgttggagttggatttggagttacagctctatgccttgtcattatcatagttggaatcttttggtggaagggctacttcaaaggaataattaggaaaataaaagatactgaaagacgagattgtttaacggggacatttacgttaaaacaaattagagatgccactgaggatttcagtcctgataacaagattggagaaggtggttttggtcctgtctacaagggtcaattatctgatggtacattggtagcagtcaagcaactctcatcaaggtcacggcagggaaacggtgaatttttgaatgagataggcatgatatcttgtttgcaacaccctaatcttgtgaaacttcatggattttgcattgaaggggatcaattgatattggtgtatgagtacatggaaaataatagcctggctcatgctttattcagctcaaaagatcaacttaaacttgattgggcaacaaggcttaggatctgtattggcatagcaaaaggtcttgcatttctacacgaagaatcaagactcaagattgttcatcgagacatcaaagctactaatgtgttactggatgggaatttaaaccctaaaatatctgactttgggctggctaggcttgatgaagagaaaacccatgtcaccacccgaatcgctgggacaataggatatatggcaccagaatatgcattatggggttacttgtcttacaaggctgatgtttacagttatggggttgtggtcttcgaagttgttagtgggaagaactacaagaattttatgccaagtgataattgtgtttgccttttagacaaggcatttcatctgcagcgtgcagaaaatttaatagagatggttgatgaaaggttgcgatcagaggtaaacccaactgaagctataactttgatgaaagtagctctcctgtgcacctctgtatcaccttcacataggcctacaatgtctgaggttgtaaacatgcttgaagggagaatcagcattccaaatgctatccaacaaccaactgattttagtgaagatttaaggtttaaagccatgagggacattcatcaacaaagggaaaatcacagtttgagtacaagctaa

SEQ ID NO: 12869 - DNA, 1824 bp, Glycine max
  Peptide Sequence Number=SeqID_129647
atggatgaaaatcgtgtggttgacgggaatgtggagaggatgcagcgggaggagagagcagatgagctggttgttcatggaaaagttgattggaaaggaagaaaagctttgaaacacaaacatggggggatgaaagtttcattgctcgtacttgcggcatttggtatggagaacttagcaactctgtctctagcagtgaactttgtgtcatacttcactggtattatgcattatgaactagcagatgcagctaacatggtcaccaattacatgggtgttaattacatgctctccattgtggtggccgttcttgctgacacttggattggtagatacaaatccgttgttatttctggaatcgtagagtctttgggactggcattgcttacgatacaggcacgcgtgggtagcctgacaccacccatttgcgacctgtacaatgtgagagatgcacattgtgaaaagcttagtgggaagcaagaagcatttctcttcattggcctctacttgttggcctttggcagtgcaggtttgaaggcttccctgccatcacatggtgctgatcaatttgatgaaagagaccccaaagaagcaatgcaaatgtcaagcttcttcaacggtctctttttagcactttgcgttggtggtgcagtcagcttaacatttaatgtgtatatacaagacaataatggatggatctggggctttgggatctccaccgttgctattgttttgggcaccattatctttgcctctggattgccactataccgaattcatgctgcacattcaacaaacggaatcttggagatcattcaggtctatgttgctgcaattcgcaacagaaaccttccccttcctgccaatcctatccaactatatgagattcaacaggacaaagaagccgcagtggaaatagagtatcaacctcatagagatattttcaggtttttggacaaagcagctatcaaaagtagatctgatgagcaacctgagaaccaagagactccaaacccgtggaaactatgcagagttacccaagtagaaaatgctaaaatcattctaagcatgctcccaatattctgctgctcaatcatcatgaccctttgcttagcacaacttcaaaccttctctattcaacaaggctccaccatgaacaccaggatcgccaagcattttaacatcccacctgcatctataccaatcatcccagttgccttcttaatcgttttcgtccctttctatgatcgcatttgtgttccttttctacgtaaattcaccggtattcccaccggcattacacacttgcaacgcataggagtaggcctgatactctcttccatctccatggcagttgcagcaatcatagaggtcaaaagaaaaggagttgctagagacaacaacatgcttaatgccttgccagtattacagcccttgccaattagtatattctggatttcttttcagtattttgtatttggcatagctgacatgtttacctatgttgggcttcttgagtttttctattcagaggcaccaaaaagccttaaatcaacagcaacatgctttctctggtgtgctatggcccttggctattttctaagttccataatggttaaaattgtgaatagtgcaaccaagaatattactgcaagtggaggttggttacaagggaacaatatcaacagaaaccatctgaacttgttctacttactcctttccatattgagcttgatcaacttctttgtctatttgttcgtttcaaagaggtacaagtacaggcctcaacaccctgcagttactggtggcaattcagaggagtga

SEQ ID NO: 12870 - DNA, 282 bp, Glycine max
  Peptide Sequence Number=SeqID_129648
atgcaccggcaagaatatcagcaagtgtggagtgaaggaggtattattttaatatttaccctcaagttgagtttgtgtttagaaagaaccatcttcctaactggcaacatgctaagtggtaatctacctgagtcactcttgaaggatggaagcagtcttgacctttcttacaacaattttacgtggcaaggaccagatcaacctgcttgtagagattacctgtcagaatgcaaagtctttcgcaataattattcctgtgcctttgttacttatacgccttaa

SEQ ID NO: 12871 - DNA, 342 bp, Glycine max
  Peptide Sequence Number=SeqID_129649
atggttgagaagggtgtggtcaatgtcaactttgatgatgaatttcatttagaacttggtactacttggaaattttttgacaacaagatgcatgttacgagtgatcagcttagcttttatggattagcttgttacatgtgtaggtcgtacacattaagaagtaacacatctgaggaacaattgatttttgatctagaaattgaaaagacattaaagaaaaatagatcaaagagaagtcacaataaggaaatatggccaaagagaccattcctccaagggttactcttgaggatcatgccacatacactcggcctttgcactaaaacacaattccaaggctag

SEQ ID NO: 12872 - DNA, 465 bp, Glycine max
  Peptide Sequence Number=SeqID_129650
atgactattgaagaatccattcatgtttcctttgatgagtctgatgttatttctccaagaaaggatgtgttagacgatgtttcagatttcttagaagagatgcatactcatgaaagggattctaaaaggaaaagagatgaaagcaatgaggattctcaggactatgaaactaaagtaaacaatgatcttccaaaggagtggaaagcttccagaaatcatccttttgacaacataatcagtaatatctcaaaagaggtagcatttgaactacctcaaggtgtttgtttttgcttgattgatattcagtgtttgattgtcatcatcaaaaagggggagattgtggaagcaaagctttctaagtttattttgatgatgccaaagactcaagtcaagaatcaagattcaagtgaagattcaagagaagactcaagatatgcaagaacttcaagaaaatcatcaagataa

SEQ ID NO: 12873 - DNA, 372 bp, Glycine max
  Peptide Sequence Number=SeqID_129651
atggtcgagctgatcgcgcccggccctgccatcagcggcagcgccagcggcaccacgccgatgctttcacgaatcgccgtttctgacttctcctgcttgttctgtttgtcttcacccagcttgccgctaatcatcgacatggcgatggtgaccaccagaatgccaccggcgatgcggaaagagtcaatcgagataccaaacagatgcaggataccgtcgccaaggaatagcgaggtccagaggataatcgccaccgccaggttcgcggtcaggggtaatcttagcccatcggaactcaaccctgtgacacaggtcatcctggcggaaaaacactttttagtaagcaacggcacgggcatcgccatcacttag

SEQ ID NO: 12874 - DNA, 180 bp, Glycine max
  Peptide Sequence Number=SeqID_129652
atgtcgaggctgttaactgacacccacttagaggattactacacaggcctaaactggttatccaccaagcgagattttagtggtgtcaagagagtagaaaccacatctatgaggaggatgaaagttaactctagatccttgaccacattgggttattatattaacaattttgtgatctga

SEQ ID NO: 12875 - DNA, 465 bp, Glycine max
  Peptide Sequence Number=SeqID_129653
atgtggctaccaccaaagccttggaacgagaaaccaagagggcttgtagggaagaacacggccggaacaaattccgaggggctctgtagggcttactcgaggtccaaaagaagtttgtctcagcggttatgcaagacagagaccaacatgttagctatcatcaccaagtaccaagaagaactaaatctagccgcgacccacgagcatagagtggcggacgagtatgcccatgtgtacacggaaaaggaggctagaggaagggtgatcgactcgctacatcaagaggcaatgatgtggatggatagattttcccttaccttgaacgggagtcaagagcttccccgactactagccaaggccaaggcaaaggcggacacctacttcgcccccgaggagatccacggacatctcggctattgtcagcatatgatagatctaatggcccatataattagaaaccgctag

SEQ ID NO: 12876 - DNA, 612 bp, Glycine max
  Peptide Sequence Number=SeqID_129654
atgaggcaggttttgaattttgattacaccaagcagagtcctgttgcatttgtacctgtgatgtcttgtgatggtgttgggggtgcgcatgattctgagaagggcattgctgttagagagtggatgggtagaagggttatacctgctaaccaaaaggtgcaggtcactgtttcattggttgtgccagagtcagaatacaacacaaatcttggcatctttcagatcagggtagacttcttgtcttctgatggcaaaacaatttggagttcaaaccaaccttgcatgttgaaattcacaagtgagcctatccgcctaatcacgacattcctcaagattgtacctcttgtcactggctatatatcagaaacccagacactgaatgtcaagatgagaggttttgttgaaggggatgtacctacttcatgcttaaaagtaacccttgagcagcgagcagaatattcacctggtgccggcattcctcaaatgtatgattcatcagtggttattgaatcagaacttcccttattcaagaggattatatggcatgggaagatttgcatatttttatggatcacaatgatggctttcatgatggagttactactcgttcta

SEQ ID NO: 12877 - DNA, 510 bp, Glycine max
  Peptide Sequence Number=SeqID_129655
atggtgcatttaaacttttataggaataggagtaggagagatgagctctatggggaaaaatggtctgaacgaacacgtgtggtaaaaaaagaagaagtagaagctgaaaccacgcttgcttcgttcaatgacagtgcttgcttcattcaacgacactggctgccaccacgccaccgccaaaccacgattgttcttggtcacacgtatccaccgcccagccacacggtcacacctatccaccacacaaccacatggtcacacgtatccacccttgttcttggtcgtggtcgcagatccgagctcgtgctaccaatgacgcagaagatccatgctgcagaacaccttcccagttgctcttgtttaaccctctcactgttactgactcttgaatttgttgatctggttattatgttaggtagattgaaaatcccttatgttttcctcacatttctacattcaactgatttatctttacatttctttctagatgatgacatgaaggagatttag

SEQ ID NO: 12878 - DNA, 510 bp, Glycine max
  Peptide Sequence Number=SeqID_129656
atgtgtcacctaactgcatatgtttgtgtttactacgacggccaaatttgcaatactaatgagggcaccaccttcgttagtaacaacacaaaaactttcatggtcgacaaggtcataacctttacacaattgcttgaacttgttcaccaaaaactaaacattgacccagaacaacatatccaacatctccattttcggtgccctatatttgagtcaggacaacgttatatgtacacatcttttattctgcgagatgatgctgatgttcgacaaatgttcaacattttttacaacaatccatcactaccatttgtggagttatttgccataatctgtcacaataatgacccaccaggcaaccaacatggctcaacctctaatcttgaggacttaggtgaatacgagacttgttggctcaaaaaccatgatagtgatacggactcctcttccgggcccgaaggaagtaacctgtctccatcccacgaacctatattcaaacgggattggtaa

SEQ ID NO: 12879 - DNA, 375 bp, Glycine max
  Peptide Sequence Number=SeqID_129657
atggttgtgtgtgcacgcttaacaaagtccataatggtttattcatatggagcttacttatttctcaaggactatgacaacctatccacaagagttaagaaaagttttccccgaagatataaaaacctacccggatataacaacctatcctcaagagttaagcttatttattcaagggatataacaacctatccacctgagggatataacaacctatccacaaaacttaagcttgtttgttcaggggatataccaagctatccacctgagttagctttaagctttagagttggcaccaagccttacagtggcactaagcctggaggtgacaacttgtcttgggaatgggcaccaagtcctggaggtggacaataa

SEQ ID NO: 12880 - DNA, 273 bp, Glycine max
  Peptide Sequence Number=SeqID_129658
atcggtgagttggccgggattgccgttgggtctactgtgctgttgaatgtgatgtttgcagggccaatcacaggagcatcaatgaacccagcaagaagcatagggccagcgattgtacacaaggaataccgaggaatatggatatatttagtgtctccaactcttggggctgtggccggcgcatgggtctacaatagtattcgttacacggacaagccactgcgtgagatcaccaagagtgcctctttccttaaaggagtagcctctaggtga

SEQ ID NO: 12881 - DNA, 177 bp, Glycine max
  Peptide Sequence Number=SeqID_129659
atggcgaaggcccatagtattcacgatgttcatcacgtggatgacacaactaaagaggtcttccaacaacctcaagaagcagctgttgatgcccagggttttcttggcgagtcgcgtgacacatcagttctgactgcctatgttgatcatgttgtagtcattgtttggaatggagag

SEQ ID NO: 12882 - DNA, 318 bp, Glycine max
  Peptide Sequence Number=SeqID_129660
atggtgtacgaaaagtcttgtcacttaccagtggagatggaatataaagcatactgggccttgaagtttttgaactttgatgaaactgcatccagagaacaaaagaggctgcaacttttggagatggaagagataagattaattgcttatgaatcttcaaagctatacaaagacaggatagacagaaaaagacttagaaattttttcgcaattgtctatatgctgagtgcagacctcgtgctaagtgctcagtcttcacgcgctaagccgagcttgctcacgctaagcgcacagacccctgattggttggctgaatag

SEQ ID NO: 12883 - DNA, 192 bp, Glycine max
  Peptide Sequence Number=SeqID_129661
atgaatgctttgggtggtgcaacactcttttgtaaaatcactcgtgcacccaacatcttcatgatttgtgtacatagggactcgttaggggttcccatgaaccctaagagaataaaggtcattcctgagtggcccgctccaccaagtgtgttgagggaaaaagcccagagtttcaagaacctcgggatttga

SEQ ID NO: 12884 - DNA, 201 bp, Glycine max
  Peptide Sequence Number=SeqID_129662
atgacctcctatggtggtgagcttcttctagactcatcttctccttccttctccactccgctgccattcatcttccaagaagcaaaggaatctgttgatgaagaagatcctaggcctacaagctccaatagggcttacatcacggggcccttgttcaagttcttcctgcagtaccctaattctgcacaagacaagctttaa

SEQ ID NO: 12885 - DNA, 399 bp, Glycine max
  Peptide Sequence Number=SeqID_129663
atgatcgttgtcgtcgacactaccgccatcgttcatgatgacgatgatcatggcggtggaggtggtgaatatagcaacgatcataccagcaaaggtggtgacaatcatggtgatggggcccatccagaatattctggaaaggcgattgcttcaggtggaagcaacccaagcgagctgggcagcaaccacctcccccattttcttataaaatggtgcgagggggctgagtttgaggggttcaacaccttgatagctcataaatcacttaaaattagtgaggagaagaagaaagaagggaaaaatacaagccgagattcttctataacgcttcagagatgtttccgtgatcaaatctgtgaaagttttacgatgcccttaccgaacgtgtgctacaactag

SEQ ID NO: 12886 - DNA, 495 bp, Glycine max
  Peptide Sequence Number=SeqID_129664
atggaagttgatttgggccagagtggggtttgggtcatcggcgcgccaaccccgccgcctgagccatcgttaagggttggagagcttggacttcccggcgtatctgtggggacaatctcgagacgaagcaacacaagagaaagagagatggcaagccaacaatacgattcgcaaggtcctcaaactcagagaggggcaaacagagattgcagggcttggataaaatctgaccaagatgtcaattggtcgttgctagtcctccactggaatcatgctaaacgtcaggcgttcatgctccagtgtcgcatgatattcgaagaactgattgatcttaaagatccaaccaagcgggagaagtcacaaaagagggaatggcggatgaagatgaagggagatggtgagcttcgtgatagcgtcctccagaagattggagttggctttggatctcgtggactctgccatggatatctttcaatgaaagcaccaaaacgctaa

SEQ ID NO: 12887 - DNA, 645 bp, Glycine max
  Peptide Sequence Number=SeqID_129665
atggcaatggcccagctccctcaggacctcatagaagaaattttgtcatggcttcccgtcaaatctcttatgcgtttcaggtgcgtttctaggacttggaattccctcatcttccaagcacactttgtcaaattgaaccttcaaaggtcatctagaaacacccacgtcctattaaggtgtcaaattaatactgtgtttgaagatatgagggatctcccaggcatcgccccatgctctatatgtagtttacttgagaacccatcatccactgttgacaatggttgccaccagctagacaacagatacttatttataggttcctgcaatgggttggtttgcttgattaatatggttgctagaggtgaattcagtgaataccgggtctggttttgtaacctggccacaaggatcatgtctgaagattcaccacacttatgtcttcgcacatgcaattataaactttggtggtatcaagtgaagtgtgggtttggttatgatgatcggagtgacacttacaaggtggtgttagtcctttcgaatattaagtcacaaaatcgggaggtgagagttcaccgcttaggtgacactcattggagaaaggttttaacttgtccggcattccccattttgggagaaaaatgttga

SEQ ID NO: 12888 - DNA, 264 bp, Glycine max
  Peptide Sequence Number=SeqID_129666
atgaaatgcaaagattggacctcctccaagctgctggcttatcgagaatttgctaagcgcaaccttcagtggctaagcgcgaggaagcatccagaagaagatgagttgtcaagtttgctaagcgcaccactccaggtcatcaagcgcaccgcttcagatcatccgcttagccaaacaagtgtgctaagccaaaatccacttatgcgcgctcagcgatacagatatgcgctaagcgcacgagcacgaacaaggccacctatttaa

SEQ ID NO: 12889 - DNA, 243 bp, Glycine max
  Peptide Sequence Number=SeqID_129667
atgttgacatctccgggaagggtgcagatgaccacattggtctctgcgtgtcaatcgggcttggggtccctgaatgacggggtacggataaccgaaaggtgtctccgcatgctaccagactcttgggtcatgatagcaaaaggtggggaggtcgacaaaagtgaggcttttgctcctacgtgtcctcaatttgtgatgaggaactcagacctacgtagttctttctttgtgagactaaaatag

SEQ ID NO: 12890 - DNA, 599 bp, Glycine max
  Peptide Sequence Number=SeqID_129668
atggtcgctcagcgcaatgatcagctgctgcgcggcctgttgcccaaacggcaccagcttgacgcccgccattaccgcgctctcgatccagctatagccgagactcagggccagctcgcgcacgccaatgccccagcgtacgccgagccacgccatgccgcagagctggctctgcataaacagcgcctgccaccgggccgggcagtccggctcccagcttttaatgagacgcgtaaaggctgcaccgcgattgcgctcttcttcccgcagttcacgggtttcccggcaggcgagaaggtaagccgtccagcgttttgctgccgcaaggtcgccttgttcacaggcccggtacagccggacaaacagcggcaggtcaacgcagaaaaagctctgctccatctgctgcgtttgccagcgtttaaaggcgtcggcatccgtgatccagcctgcttccacggcccactccagcccctgcgaccaggtaaacgacccgaccggcaggctgctgctggagagctgcatcaggcgcagccactggcgggaatgctccatcagctcatcagcgccagcagggcagagacgatcagcccgccgccgaa

SEQ ID NO: 12891 - DNA, 435 bp, Glycine max
  Peptide Sequence Number=SeqID_129669
atgccaatctccccctgcagatgtatcggttgggatcgcgcccacaagacgcccagtgggcctgaagaagtccaacagggccctggggtttccagctctggttacgggcctctgtcagtcctacagggtgtccgttcccccaacgaggaatcgcacccacaaagacacccagtggacccggagaagtccaacagggccctggggtttccagctctggttacgggcctctgtagtcctacaggatgcccgttccccctggcaaggtcacatcatcatagggatcgcgcctgcaaaacacccagtggacccgaagaagtccaacagggtcttggattgcctgtcacctccagcaagggcatcaggccccctactaatcgagctttcatcaagaagtactgcgtctccaggcaggcgcaaggcgaaacaccacaatag

SEQ ID NO: 12892 - DNA, 897 bp, Glycine max
  Peptide Sequence Number=SeqID_129670
atggctcaaatgaaaaaaagtattctctcactgttaatttgcgcagcagtagccagctctgcgtatgctgaagcagcgacaaaggtagagttcgctcaggagggcgtcacgtatacggctatcgtcgtaaaacttaagcccggcaagcccctgctgaaagctacaaacaccgccaccacgacggcgtcagatgagctcacgctcggcgatccctctttagtggcgaataaaatgtttcgctccaataaacttcgtagcacccaatcggatgaattaactaaactggatgctacctacgggtttgatcgctatatgcggatagatattcctgaaaacaaaagtcaggataaagcctttattaaccacgcgattgccgagctggaacaaaatccaaaagttgaattagtgtatgcggaagccatgccggtttcgctggatgaatatcaacatgataataccacgccgccgcttttacgccagtccgccggaaatgcgacgctgaccgccactgccgttcctgatttccgtaacctgcaggattatttaaaatcctctgcggaaaaacgcccgggttattatatgggtggggttaaccgcgacggcgttagcggttatgccggtagcgatgggactggcgttaccattatctccaccgaaaactgcgcctggaacaccagccacgttaacttaccggcgatggccctgagccagggcgaccgcacctggaaacccggctgtggcgatcatgactcctcttccgtggggattatggcagggaaagatatcggcagcggtattcgcggctttgcctggaacagtaaggtgggttatgccgcctggcagacgaacaatctttataacatgatccccctgctgaaagcgggcgacgtggtgcag

SEQ ID NO: 12893 - DNA, 186 bp, Glycine max
  Peptide Sequence Number=SeqID_129671
atgggatcaagtcaagcgccttggcttaaaaagaggttctatcaggtcaagatcaggagcctaggagtcgtcagtttgaaagagttaggacagttgatgggtcaactccagcgacaagcctttcgcaaagcctatgatgcagcggaagacaaaggagaagaggtaagaggcggcgccatccactag

SEQ ID NO: 12894 - DNA, 303 bp, Glycine max
  Peptide Sequence Number=SeqID_129672
atgtggcagacaaagacatacatccagaaagcatactggacgattgaaattactcaggacatgctcggtgcccctgaacccctgaaacttccaccttctacaaaagttcctcttaatgcttgtggtcatcacatgatagcgttgttcaactatggtatgacttccttgtggaaagcgacttcaatcatggagatgaagtctccttttactatagacattatgaaaaaatttgggaaattgtcattagaagacaaaaggattgggatgatagtgatattgattaaagtgtcttttgtagtttga

SEQ ID NO: 12895 - DNA, 1317 bp, Glycine max
  Peptide Sequence Number=SeqID_129673
atggaaattccaagaatacccatgcctgaggctacgacagctgtccatttccttggtttcttggtcttatggcatatggaaatttctaaaatgcccgtgcctgaggctgtggcagctgtctatttcattggtgtttgcttttgtttgttgcgttcttcagtttgttacgagaagtcaagtcaagtttgttacaagaagtcaaggtgtttgcttttgtttgctgcattcttgggtttgttacgagaagtcaagggagatgcaatccatgttgtttgcaaacaataccagctaaagttttggaagactgatttgaaggagaatttaacttatgtgatgcataattttaaagttacgaagaatgatggtcaattcagagtttgtgatcttgaatataaattatcttttactgaagtgacgattgttaggcaatctaatatggaggacctgccttttaggaaattcagatttgttgatttttcgactgccattgttggtgattttgaaactggactcttggttgacattatcggtgtggttgatgaagtattgttcagatatgtctcatccaaaaatacaagtgggcaggtgttatcttgcacactatgggaaaattattgcttacagttcttatcttacttgagtgaggttgaagatgaaaggcccatcgttattcttttgacccatgccaggatcaaagaaggtcagggatcatatgcaacctcaatcagtaattctttgaaggcgtctaaactaatgaccaacgagcttgtgtttgaaattcaagaattcaaaggaaggcttttagatttagggattgaggtcagatcagttttgacctctggtgggcaagggagttcacaggtttcagcttgcagtcaatgtcacaaaaagactgacatagcaactgtgtcatttacttgcccatgtggcaaagacaacgatcaagttgtactaaggtatagaattgaagttatggttgatcacaagggcaaacaaatgaaatttttgctcttggactgtgaatgtgtagagttaattggtcaatcagcggatgaagtcaacatgctcaaaatagcagatggtgatgctgatttgaatgcctctcctcaaacactagataggctactcggttgtttccttgcattcaaagttaaggtacatccaaggttcaggaatgttgttgttctggaatattcagatgaatcagacttgatcaatgttgtgctggatatgcttcctgatactgagccatgttgcaaaatccagagtttagtgcttgagtcaactgatgctacagagcttgaatctataaactaa

SEQ ID NO: 12896 - DNA, 1440 bp, Glycine max
  Peptide Sequence Number=SeqID_129674
atggagccacgcacctttcatcaggccataaaacacacatgctggcagcatgctatgcaacaagaatttcaagccctaatgaggaacaacacttggtcatttgttccatgtcctactaatgctaatattgttggttgtaaatggattttcaagataaaaagacgtgtcgatggttccattgaacatcacaaagctcgtctagttgcacagggttttaaacaagaggctggaattgattattttgacacattcagtccggtcattaaacctactaccattcggttagtgctctccgtagctctttcacatggctggtgtcgtagacaacttgatatcaacaacgctttccttaatggtgacttgactgagatagtgtacatgcaacaacctcgtggtttcgaagacaaatccaatccttcacatgtgtgtcgtcttcacaatgcaatttatggccttaaacaagcaccacgtgcttggttcaacaaactgaaatcctatcttatacaacatgggttcaaggcttgccgttcagacacatccttgtttgttcactactcttccaattccatcatctacattcttgtctatgtagatgacttaattctcacaggcaccaatgctgcgcacattcaaagtttcatcactaagttacatgttgtttttgctctcaaggatctcggttctctgcactattttctgggtcttcaaattcacagaacttcaactgggttaacactatctcaggaaaattacattcatgacattctctgtcgcagcaaaatgtcagaagcctcctccatttctacaccagctgacccaggttctcggcttcatagtgaaggagcaccttctgaggatccaaagctcttccgacgagtcgtaggttcacttcaatatgtcactattactcatccggatatcacttatgctgtcaatagagtatgtcaattcatgcattcacccactactctgcattggcaagcgaccaaaagaatactcaggtatttgaagggtacttccactcattgccttcattttaaacctacacaagctcaatctctcttagcttattcggatgctggttggttatcggatcctaaagatagccggtcacaatatagtactgaatctgagtaccgttctctagcatacactgccgctgaattgatatggattcaacaactgctaactgacctctatatgcctctcattcgtcctcctttactgttatgcgataatgttggtgctatttttatgacaaaaaatcctgtcatacaaacaaggtccaagcatattgcactcgattttcacttcattcgtgaacttgtagaatctaactctcttcatgttcgtcatatatcttcagttgatcaaatggctgacatatttacaaaggcattatccaaggatcggatatttcagctacgttccaagcttcaa

SEQ ID NO: 12897 - DNA, 963 bp, Glycine max
  Peptide Sequence Number=SeqID_129675
atggccacctcaaacctttcccttctagctctagcaaacaccaccacctctaatctaaatctccaacttccttctatcaacataaaacttgatagagacaactactctctttggcgctctacaatcatttctgcccttgaaacatttgaccttgaatccttcatactgaatccttctccaccattggaaacacgtattctaaccacctctgatggcatcactactaccgaaaccaaccctgagtttattctgtggcgcaagcgtgatcgttttgtgttactgtggctaaaatctaccctctctgaacaagctttatcattggttgttcgtgccacctcttcccatatggcatggacagccttcgggaaaaccttccaggcccaaactcaagccaggcgcatggcaatgaagtctcagcttcaatctctcactaaaggatcactctctatgttagaatatattgaacggaaaagatcaatttccgactctcttgctgaaaatcttcatccaattttggatgaggatcttgtcggatacatcccgaatggccttgatccttcttatggcccttttaccacaacttttatgatgaaatcggaggatgttttggttgacgatcttgctggtcttcttcttcaagaagaggcacaattggaacacgatcatgctcatcaacctgttattgtcacccaacctcccatagttatctctcaagctccaaattctgctcctctacttcctacccccactgcttataccacaaacctctctacctcgaggcccacttctaacacctatcagccctatggcgctggccaatctttagaccacacctttgacaatcgtcgtcgtcccaacattcgtccactatgtcaaatatgcaacaaatctgggcatgaagccattgactgctggcatcgtgcaaaccaaacagcctacccctctcgccgtcccaatccatga

SEQ ID NO: 12898 - DNA, 264 bp, Glycine max
  Peptide Sequence Number=SeqID_129676
atggatgatgttaagcaaggctattttgatgtttatgcaattaagggtcagcaaaccaaaagacttgccttgctagtaacagatgatgactctgaactcaagcttctgtgggttgagtcggaggatgagtcagaagtcatgcttgtgtcgattgactccgatgatgatctgggagtcagacaggagttggcgaaaatatgtgagtgggggaatatcaatgaatttgggaattgtccagcattgaatgctggctctaaagattag

SEQ ID NO: 12899 - DNA, 366 bp, Glycine max
  Peptide Sequence Number=SeqID_129677
atgcccctgcatcagcccgggatggaaataggaagggaaagggagaagctttttgcagtgcgagaaatgaagggaaataaaaaaattgttcaaatttttcttccaacaccggcttccaaatttgtatatggttccaaaaaatatattacgcttcaacggggcctaggaaaacgcacccaatggcaggtcaccatccacgatggtgtgccatctattgctgacccatggttccagtaccttcatgaaaaaaaattgatggccggagatgaggttgtcttctacttccggtttgatgaccatgcatgggagcttttgatcaggaaagatattgaatgggacgaggagtacatccaccttgacgactga

SEQ ID NO: 12900 - DNA, 507 bp, Glycine max
  Peptide Sequence Number=SeqID_129678
atgaaagttgaacaactctttgcttgtcatcatacaagaagaggcacatccccctcttactatgaaagagagcttatggacaagctccaaaggcttagacaaggaagtgtgagtgttgaagagtataggcaacaaataaaactactcgttttgagagctgggcttagggaagaggaaaaaataagtattgttaggttccttagtggacttaatatggatgtgagggacaaggttgagctccttccatatagggacctagatgacctagtccaactttgcataatgatagagcaacaacttaaaaggaagcctacttcaaaattttatggttctcactcttatccaaagaaagaccaaggtcaaggcatcttagggacttcaccttctaagcccaaagatgataaggggaagacaatagaaaatcaaccccttaaggctagtattcaagagaagaccaactctataaagtgctttaaatgtcttgaaagaggacacattgttttttaa

SEQ ID NO: 12901 - DNA, 450 bp, Glycine max
  Peptide Sequence Number=SeqID_129679
gaacatgaaatgaaactccaacgtcttaatcaaaatgaagaaaccgacaagaagaaaagaagtatagcactaaaagccttctcatcaatgcaagaggaaaatgaagaagaagatgaagaagacttctcactctttgtgaagaagtttcaaaaatttgtcaagaagagaagaatcgagaggcgtcaaaacttcaataatggaagaaaatctcaagaagactctcaaattcttagatgctacaaatataaccaacttggtcacatcaaagcaaattttccctcaaatgaggaatggcctgagaaaagtgataagaaaaggtatgaagaaagaaggaccaagaaggcctacattgcatgggatgataatgactcatccgatggttcagagaaggagatcaaccttctaactaaggattatgagagcgatgagaacatttctcaagaagattaa

SEQ ID NO: 12902 - DNA, 249 bp, Glycine max
  Peptide Sequence Number=SeqID_129680
atgggtgtcaagtacctcgaagcggttaagcgaaggttgcatgccatcaaacaatggtccccaaacgaaattagggcaatcaattcatggggctccggactcgacggtggaggatacatgaacagcgctaggcaatcaattcatggggctccggactcagatttgatggtggaggatgcacgaacagcgctacgcaatcaattcgtggggctccggactcgatggtggaggatgcacgaacagcgctag

SEQ ID NO: 12903 - DNA, 411 bp, Glycine max
  Peptide Sequence Number=SeqID_129681
ctcacaggtacagcagagatcgatattgctgccatgaagcacatggccgggggacccattgatgcggtccttgatttccttccgccgtctgcgcaggcctctgtcgcccggaatgcgattatgtcagtcagaccttatggtcgtgcagtccttatgggcggtgttggcatgctgggtggggacgatctttcgctaccttatccctggataatgcgtaacctcattaccgtaaaagggcagtggatgtatgaaccttcggcagtccatacgctctgcggccttatacgcgcgggactgcttgatctcagccactatgacgtaaccgagtttccgcttgagagagtgaatgattcagtcgcgtatgctgcgaaaaacagcgggccgtttaaactcaccgtcgtgcgtccctga

SEQ ID NO: 12904 - DNA, 294 bp, Glycine max
  Peptide Sequence Number=SeqID_129682
gcgattaaaaccaccgacggacgtactatcgtcaccgatggtaagccacaggtggatagtgatactggcctggtctcttataaagatgcgcaaaccgccattgtggcactgagcgccctgaccggctgtacccgtaccagctacgccattcataccaatgatggccgtaccattgtcagcgatggtaaaccgcaggaagcggaaagcggactgctgggctacgttgatgccaatggtgtcaaacagcagatcaacaaagcggatgtcaaagaagtctctgagattccgcattaa

SEQ ID NO: 12905 - DNA, 1029 bp, Glycine max
  Peptide Sequence Number=SeqID_129683
atggccgccgccgaagctggtggccagcttcaggtcggtcagcgcttcgatccagtcgtggcgtgcagcgatgtagccacagcgcgaagcggccgacagggtcttggagaagctgccgacgtggatcacccgcgacagcccatccagcgcagcaaggcgcggtgccggctgcagttcgaagtcggcgaagatgtcgtcctcgacgatgatcagttcgctgcgttcggccagccccagcagccgatgcgcggtgctggccgagagcactgcgccggtcgggttgtgcaggcccgagttggtgatgtacagccgtggcgaatgcgcctgaagtgcttgcgcgaacgcctccaggttcgggccgctgtgcgtgtacggcacgccgatggcctgcacctggtgtgccttgagcagcgcgtggtaattgaagtagctcggatcatccaccagcacgcagtcgccgggcttgagcaggaaacggcagatcaggtcgaccgcgtgtgtcccggattcggtcagcaggatctgctccatcggtgcatcgatgcccagcgtggcgctgcgccgttgcagcagctggcgcaatgcgggcagcccgagtgggccggcgtagtcgaccaggtgcactgcatcggcacgcgccagccgacgcaggccgcggcgcatgccatcgtgatacagccagtcactgggcaaccagccgcaccccggcttgaggtggcccggcggggtttccagcgactgccgcgacacccacagcgggtccaccgcgcggtccagccggggttccatctcggccagtgccagcggtgcggccggcccattgacgtaaaagccggaaccggcccgcgcgctgatcaacccttcggcagcgaggcgttcgtaggcctcgaccacggtggagaccgacacgcccatcgctgccgcctgcgcgcgcaccgaaggcaggcgggagccggggccatccacccgcgcggtgatgcggttgcggacggcctggatgaccgattcgatgcgggtaagggggcgtga

SEQ ID NO: 12906 - DNA, 270 bp, Glycine max
  Peptide Sequence Number=SeqID_129684
ctcggcttcgagcctgcgcagtgtgacctccccgtcgatggcgtattcgatggcgggacggtccagcgcgggcgtttcctgcgccacgtacgccatgcgccaactggcggggtaatcgaggtcgccctggtcggcgtgcagcgtgccgcgcaacaggccgaacaggctcgacttgccggcaccgttggcgcccatcaggccgatcttgtctccggggttgagcagcaggtcgaccttgtcgaacaagggcttgacgccgcgcatcagtga

SEQ ID NO: 12907 - DNA, 642 bp, Glycine max
  Peptide Sequence Number=SeqID_129685
atgtggaaaggttcaaggaatcttactagtgttttaccacctgagtataaaagaggtctgggtaagccaaaaaaaattagaagaagggaaccagataaggagtccaaccccaccaaacttaggagaaaaactaccaaatatcaatgtagtaggtgtgggaaatcaagccacaattctaggaggtgtcccttaccttctactgtggttgaggaaccacctgcttcaaatgatgggtcacctgtagatgcaagcacaattactggtaggaaccaagttgattggaaccaagatgctactattgccaaccaaggtcctttggttcagtcacaaatgtctgaaaatgaatcttctgccaattttgaaaaacctcaggtaaataaccagagaaaacttggaacaacatcaaagcatgataaggcttcaaaaacatcaaatggcattaaggaaaaaacacaaacttccacaaaaacacgaaaaaccaggaagcaaatgaccccaattgcaccaacctatagaaaggctaactcaacaccatcaactaacttagcaccatcaccatctatatctacatcaacaccaacccccagcaagcttcaaccaccatcgtcaaccatttctggagaaatccaactgatacactaa

SEQ ID NO: 12908 - DNA, 262 bp, Glycine max
  Peptide Sequence Number=SeqID_129686
caaggttggaaggagcacaacttataaagttaagacatacagacctaaaaatacatgtggaagggcctttaaaaacataaatgctacttccaaatgggtgtccaaggttgctgtagagagtttgaggaccagaaatgatgtgaaactggcacaaattatagatgatgtgagattcaagtatagcattgggatatgtttggttgttgcttggaaggccaggatgattgctagagcaatagtggatagggatgttgttagatag

SEQ ID NO: 12909 - DNA, 249 bp, Glycine max
  Peptide Sequence Number=SeqID_129687
atggaagcagttggagcttcatcttcgtcgattgggtctaatggtgttgaagttaagaattgtagattttgggttcgggatgatgatttgaagaaatcattgaaccaagactttgaaagtaatggtggcgttggaagtaatgtgggcaatatgggttgtggaagtaatatggatgtgaatcatttgttgtcacaaatggaggagctaaagctgaggattgcaacaaatgaagaaagaatttgtttgtaa

SEQ ID NO: 12910 - DNA, 915 bp, Glycine max
  Peptide Sequence Number=SeqID_129688
atgggaaaaacatcaagcagagagtggacacggatctacctcatctacggaatggatcagtggcaaaccttcgtcttccttctatgtcaagcggttctcttctcagttctctcaatactttaccttctctacttcaatgacatctctcacactttccaaagccttctctccatcgcctccgtgccctgcagcgccgcccgcttcgccgccgggtttatgggctccgtcacggcgctctccgcgctgtgcctcttctacgcggcggcgaatttcttctactcggcagtgccgctccattctgagatggcacagcacatcgtggacacagtcaatgactggccgacggtgcgacaggtgctcgatctcggctgctgcggtcgcggcattctgctgaatgccgtggccgcccgtcttaaaaaggaaggaagttcgggtcgggtgatcgggttaagcggccagaacaagacagaattagcggccacgcttcgggctgctaaggtggagggtgtggaggaatacgtaacgtgccggacaggtgatgccaccacgttgccgtttttagacgacagcttcgatgctgttgtgtccggtacgttcgtgcacaccgtgggatgggggcacgctgccgatgtggcggcagcggagagggggagggtggtggcggaggtggtgagggtgttgaaggagggtggggttggggttgtgtgggaccttgtgcacgtgccagagtacgtgcgacggttacaagagatgaagatggaagacattagaatgagcgagcgtgtgacggcgttcatggttagcagccacgtcgtgtccttcaggaagcccactcaccacgtgcatggcccaccagaggtcagaaaaacagtgcttggctgggaggcaaagtcgaaccatgcaaattgcaaatga

SEQ ID NO: 12911 - DNA, 340 bp, Glycine max
  Peptide Sequence Number=SeqID_129689
gtggctacgacgtgaaaatcagcatattggcaatgatgatctgatagtttttcgtcgcaaattggatatcatgaaacaacatgagtttctgtgggagccttacacaacaactgttatgtcagtgttgcctccaatttgtttggttggtagtgtactgtggtgcgcggtgggtccttcacaaccactgaatatccatggcctaacgctgaaaggcaaacaagatgaaaattggttccagctgttggccccaatgatcagtcaatggaacaatcgagctgattttagggtcgacgtttatcctcgacaggagggcctattgagttttaactccgactacatg

SEQ ID NO: 12912 - DNA, 768 bp, Glycine max
  Peptide Sequence Number=SeqID_129690
atggaggagctattcgtggcagttctatcgatgcttctcgtagcagcgttgatcccactctacctatggaaacgccgccaggattcgaaacctccccctccccaccgcgacgaagctcctcaggctccgcggagagaaacggtggcccgcgccaccgccactcgtcgcatgcgtcgccgacctaccgcgtctggagctagtacttcggcagatccacctgcgacgcaagaagaatctgctggtgagagtgacgatgaagctgctggtggagggtattatgaggctaaagcaccaaagaaaaaggaaactaaaaagcaagagagggaagcacggcgtcaggctgaggaagctgcacgagagtcaaggcaggcaaaacaagatcgttattcagaaatgcggaggttgaaggatgaggagcgtgaggcagaggagcgtaagttggaagaggaagccagagctcagaaggctaaggaggaggaggctgctgcattagagtttgagaagtggaaaggtgaattttcagttgatgatgaaggtacccttgaagaagtgcagggtaatactgaagacttgctaggcaattttgttgaatatataaagaagcacaaatgtgttcccttggaagatcttgctgcagaatttaaattgcgtacacagaaaaatataagagttttggaatggggcgatggaagaaggcaaaatggagatgcgaggcagatgcctcacagggagcaaactctttcaatacacaataaagaggaggcttaa

SEQ ID NO: 12913 - DNA, 216 bp, Glycine max
  Peptide Sequence Number=SeqID_129691
atggagaggagagggaagccatgttccgttagttttagcggttgtttcgggggacagattgaagtaagatcattctttgaaaatcaattccaagaaaagggagatgatagaccaacacttgatggagtccctttcaagaagatcaaagaggtggataacacttttggtaaagaggtttggagaggaagaagtactacaagctttgaaggattgtga

SEQ ID NO: 12914 - DNA, 1851 bp, Glycine max
  Peptide Sequence Number=SeqID_129692
atgacggagctcgatgcctgcaacggcgtgttcctcacgtacgcgctcctggggcgtgtgaaggagtacccgcacgtgacgaacacgtcgaagcaggcgtgggctttcaaggcggaggcgtccctgacaaacgtcggggacgaagaagtgccggggtggaagatgtttgtcgggttccagcaccgcgagattctagtctccgccgacggcgccgtgctcatcgacgctggagactttccggcggaggtggggaacgggaccacgctggtggggaccgccacgaccgacttgaagaccgccatagacaccgccggggatattaaccagatgagtgtgaggattcagatgacggggacgcagtttgggttgggtgcaggggctacgccaatgcctaaaaccattcgtctcgagaatgatggcttcaaatgccctgcacctagtcgaagagccacgagaatgttcgtatgctgcaaaaaggacccaaaagtaaaagccaagcaagcaaagaaaacaaagtacccacctcgtcgcaaaggagacataaccatagcatacgacgtgctccaagccttccagaacaactactacgcggaagtcagaatagacaacaaccacccattaggtcgtcttgatcactggaacctaacatgggaatggcaaaagggagaattcatatactccatgaaaggagcctttgctcgcagaaaggacccttctgagtgcttatatggtcttgcaggaaagttctacaaagacatggatttctcaaatgtcgccacgtgtgagaagaagccaacaatctctgatcttccatcagaaagaaaagaagatgagaaagttgggaagctcccttggtgctgtaggaatggcactgttttgcctcctatcatggacaagaacaaagctaggtcaatgttccagatgcaagtgttcaaaattgcacctgacagtgacaacagaactgctctcactccacctacaaagtggaacattgatggtgtcataaaccctaaatacaagtgcagtgccccagttagagttgaccctcaagtcttccctgaccctagtgggcttagggctattaccacagcagtggcaagttggcaaatagtttgcaacatcacaaaacctaagcctcaagaaaaccgttgctgtgtctctttctcagcattctacaacgaatcagccatcccttgcaacacgtgtgcatgtgggtgtgatgacacgaggaagtgcagctctagggcttcaccgttgcttcttccaccagatgctcttcttgtgccgtttgttaacaggaccgttaaggcacgtgcatgggccaagctcaagcacttgcacgtgccgagcaagctcccttgtggggacaactgccccgtcagcatcaactggcacgtgagttctgatcacaaggatggatggacagctaggatcacgcttttcaactgggaggaatattcctttgacgattggttcacggctattcagttgaagaggacttttgaggattttcatgatgtttattccttcaatgggacgaggattcctggtctcaaaactgtgttcttggaggggttaaagggtttgaattacttgtcaggagaaaccaatggaacacatgctaatgaccctagggttccagggaaacaacaatctgttctttctttcagcaagaagcatataaaagacttcgatgtcacacatgatgggttccccactaaggttttcttcaatggaatggagtgttcacttcctccaattagacctgccaaaagttcagggcacaaatcatcttccatcagtgtcattgccctcattttcacagcttttgtgactttcttgatgatctaa

SEQ ID NO: 12915 - DNA, 1047 bp, Glycine max
  Peptide Sequence Number=SeqID_129693
atgcaatatgctacatggaaagaagaatgccgccaattgtttcctcttgttggaagtggtagatttgtcacagcacctgtcattactgaagatggtcagcctattcaagatccattggttttgaaagaaacaagtccggccaagggattggctgtacatccacaacataataatagtccttcaagtatggatgctgcaaataatttagaaaaggtgacagacaaggcagtagtccagtggatgttaactctgcatcaaataggtcttgatgtggttcgcaccgataggacattagttttttatgagaagcaagaaaacttgtccaaactatgggatattcttgctgtttatgcttggatagataaggacgttggctatggtcaaggaatgtgtgacctatgctccccaatgataattcttcttgatgatgaagcagatgcattttggtgctttgagcgtttgatgcgcagacttggatgtgaatcatgtaataaacccattcttgaaccttcaaccatcagcttaaactttttgcgaggcaattttagatgcactgagagctctgttggtgtggcagctcaactaagtaatttggcttcagtcactcaaatgatgtgggctctagaatatgatcctgatttgttcttgatgtatgaaatgcctcaatcagcttctgaaaaggctgagggctcaaaagggaaaacaaagtcaatacgtcaatgtggaaagtatgagagagaaattgtgaagagtggagcaaaaaatgctgaagcacctcttcctatgtctgttttccttgttgctagtgtattgaaagataaaagtgcaaaactactccaagaagcacgaggcttggatgatgttgtcaagattttgaatgacacaactggtaatatagatgccaaaaaagcttgctgtggggctatgaaacttcacaagaaatatttgaaaaagtatttccgtgtaataggaggaaaagcaaactacatgatagctagcaagttgcatctgattatagtgatcaattcctcaagatgcaggggatga

SEQ ID NO: 12916 - DNA, 918 bp, Glycine max
  Peptide Sequence Number=SeqID_129694
atgatttcctcaagcaaaatcaaatccgtcgatttttacagctgcaattcaattcgctttgctgttgttatgcatttgatcaaggtttttaaaaatgatcgcagttacggtttttcctcgagttccttgatattgtgggaaattgcgaataattgcggctatattacggttggacactccagagaccttgaagttgcagctgaaaacactatcgtggatatgggtttacctgtttcttccgtctacagaaaaatcccaagagatttaactgaggcatcattatctggagcagggctatccatagtagcagctctcgccatgatatttttatttggaatggagcttaacagttatctgtctgtcagcacctctacacaagtgattgttgacaagagttctgatggggactacttacgtatagatttcaatatcagttttcctgccctctcctgtgagtttgcagcagttgatgtgagtgatgtgctgggcacaaacaggctgaatctaacaaaaacagttcgcaagttttctattgattcaaatttaagacctactggtgctgaattccattcagaaccagctgctaacagcattaagcatgataatgaagtaaatgaagaatctgttgaaggttctgttgtactcacaacacaaaattttgataaatatgctcatcagtttctgattacagttgttaatttttatgctccttggtgttactggagtcaacgcttgaaaccatcatgggagaagacagctaaaattattaaagagagatatgatccagaaatggatggtcgtattattttggggagggtagattgcactgaagacggagacttgtgccggaggaattacatccaggaggttagaatcatgccaagatcatggattattacaaacaaatttatgatatag

SEQ ID NO: 12917 - DNA, 624 bp, Glycine max
  Peptide Sequence Number=SeqID_129695
atggttgcaaggcgttgccacacaaagaagcaagaacctgcttccaagctgcgacaacatgagggaaaggaaaagggtgaaaggttgaggcacaagggaaagggaacgggtgctaaggttcaaaacaatggaaagggaaatgggtgttggggttcgacaaaaggattcaggggtgtttgcaaaataacgtcaagcgcatctggtgtagtggcaataaaaagtgacggcttcaaaaattttaacttaaggagacaatgctcatataaattggtgaaggggttaggaatcaagaatgagaagaagaagaaagggttggcttcggccccaaaacacacacacccactgcgaataatcaaactttcggagaagctaacgaacaggaacctcaacgccaagattgaggtcacgagggagataaggaagatggttcggaaatcgtcgtcaccgaagacgcgcgcgaagctcgccacagcgggtgtgattgaaccgcttgtgttgatgctctcttcttccaacgtcgacgctcgccaatcctcactcctcaccctcctcaacctcgttgttcgcaacgaacgataccccccttcttctctcccaagatgcatgcttttttgtgaattgtga

SEQ ID NO: 12918 - DNA, 159 bp, Glycine max
  Peptide Sequence Number=SeqID_129696
atgtggagagatccgggagttccagctgattctttctatgaaatccgccccgaatgcaccgatgttcccgttactcgatttaagatcaagaagtatttggttgatgaaaattggtgttggtcttttatgagcaatgcatgtgagtttgaggttttgtga

SEQ ID NO: 12919 - DNA, 672 bp, Glycine max
  Peptide Sequence Number=SeqID_129697
atggagaatttagtggcatctctcccttcagaatctcagaagttacctttggaagataaatccaatgttgcgacaaatacaaaaagaccagcaccatcaacagggggatgtagaattgatggatatgtgcgtgtcaagaaggttcctggaaacttgatcatctcagctagatccaatgcccattcctttgatgcttctcaaatgaacatgtcacatgtcataaaccatttatcttttggaaggaaagtatcacttagggtcatgagtgatgtgaagcgcttgataccttacgttggtagcagccatgacaggctgaatggtcgatcatttatcaatacacatgatttaggagcaaatgttactattgagcattaccttcagatagttaaaacagaggtgataactagaaaggaatataaattagttgaggagtatgagtacacagcgcacagcagtgtggcacagagtttacacattcccgttgctaagtttcatcttgagctctcccccatgcaggtcttaataacggaaaaccagaagtccttttctcactttatcacaaatgtctgtgctattattggtggcattttcacggttgctggaattatggacgcgatttttcacaacactattagactaatgaaaaaagttgagcttggcaaaaatttttga

SEQ ID NO: 12920 - DNA, 657 bp, Glycine max
  Peptide Sequence Number=SeqID_129698
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcacttgccttcgccgccctcgccaccctggccggagcaccccgttgtgccccttcaaggagcatcttgtctgcccgggcgcgccaccgccacacgcaaggaaaaaacgaaccgcagatcccgaaggacctgcggttaatcggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 12921 - DNA, 939 bp, Glycine max
  Peptide Sequence Number=SeqID_129699
atggttgaggcgcgctcgcttgcgggctacccggttctggtaagtgaagaggacggcgtaatcaccggctacgcctctttcggcgactggcgcgcctttgacggcttccgtcatacggttgagcactcggtctatgtccacccggcccatcagggcaaagggattggccgcacgctgatgaaggcgctgattaacgaggcccgcgccattgggaaacacgtgatggtggccggcattgaagcgcaaaaccatgcctcgattcatctccatgaaacgctcggctttgtgacgaccggacaaatgccgcaggtgggaaccaactgcagctggacgagcgcagcgatccggacgcgatcccatgaatcagtcactgacgctggcgtttctggtcgcggcgggcatcggtctggtggtgcaaaacactctgatggtgcgtatcacccagtcctcctccaccattctcatcgcgatgctgctgaattcgctggtcggcatcgtgctgtttgtcactattctgctgctgaaacagggcgtggccggattcagcgagctggccgagacggtgcgctggtggacgcttatcccggggcttctggggtcgtttttcgtgtttgccagcatcagcggctatcagaatgttggcgcggcgacgaccatcgccgtgctggtcgcaagccagctgattggcgggctggtgctggacgtgctgaggagccatggcatcccgctgcgcgccctgatcggcccggtgtgcggcgcggtgatgctggtggtcggggcctggctggtggcgcgacgccagttttgatggttacagtatggtgccgcctttcgtcagctgttcctcacgcgcgtccatctcctctttatgctgcttgccgtggtgcgaaatcgcggtgcgcagacgctgctgctgggtgtagcgatcttcacggctga

SEQ ID NO: 12922 - DNA, 659 bp, Glycine max
  Peptide Sequence Number=SeqID_129700
ggctacacgtccttgcctttagaggagtacacgtcctagccttgagagggctacacgtcattgccttaggaggcttacatgtccttcccttcaaaggagtacatgtcctccacatcagaggactacacgttctcgcctttggaggactacatgtccttgccttaagagggctacacgtcttcaccttcagaggactacacgccctcaccttcagaggattacacgtcctcaccttcagaggactacacgtcctcaccttcagaggattacacaacctcgccttccgagggctagacgccctcgccttcagaggagtacacatcctccccttgagagggctacacgccctcgccttcgtagggttacacacccttaccttcaaaggagtacacggctacacgtcctcgccttcagagggttacacgtcctccacttcagaggactacatgcccataccttcaaaggataccttcataggactacacgcccttggcttcgtaaggcttcacgccctcaccttcagaggactacacatgctcgcctacagaggactacacgcctttaccttcgtagggctacacgccctcaccttcagaggactacacatcctcgttttcagagcgatacatgccctcgccttcagaggactacacgcctaa

SEQ ID NO: 12923 - DNA, 123 bp, Glycine max
  Peptide Sequence Number=SeqID_129701
atgactcattccttaaatgatgctcaacctgtacctgcaacaccagcatcgttttgcaatcctactaattgcaatattggttgtgacgatgttgttcagaaccaaaaaaatgaggctaaatag

SEQ ID NO: 12924 - DNA, 438 bp, Glycine max
  Peptide Sequence Number=SeqID_129702
atgaccatcaagaagagggatttcctattagagacctctttgatcgacctgggtggacaaacttccttgaaaaatttagttcatggtattatagaccatatgccttttattagggtactgctcatgacgatagagtcatcattagaggcaccgtcaacgaaaaagagaatcatccacatcatcatcttcaatattgtgatgcccaaaaatagctcaagagattatgtgagtgacagaggaagattctacatctacaatgtgatggtgggaaagaagaaacgtaacatagagagtaaaatcattcggttcaaatttgtggaagcaatgccttccaaggttatttggatgatgccaaagaatcaagagtcaagcaaattccaaagattcaagaatgaagttttcaagaatcaagtttcaagaatcaagattcaagaataa

SEQ ID NO: 12925 - DNA, 123 bp, Glycine max
  Peptide Sequence Number=SeqID_129703
atgcccagggcactgaattccacaacacaccagagtgcctatttcaggaaaagagctctggaggcatgcttaaattctgtatgctcttggtttgatcagccatttgtgtgcctagttaggtga

SEQ ID NO: 12926 - DNA, 705 bp, Glycine max
  Peptide Sequence Number=SeqID_129704
atgcttaaggagtttgagaagcgaataaggtctgaggtaataccagcaaatgagattgatgtcacattctttgatattggtgccttagatgagaccaaagaatcccttcaagaactagtaatgcttcctcttagaagaccagatcttttcactggaggccttctaaagattatggtaggaccaccatatgtggagaacatggaaaagattttgaggactcttttggcaaaagaaaaggtggacaacgaacttgagtttaaggaacttgcaactatgacagaaggatatactggaagtgatctaaagaacttgtgcacaattgctgcttatcaacctgttagagagctaattcagcaagagaggctaaagagtctgacaaagatgatgacaaaaagtccaaagaatgatttcaagattgagtcaacaagttcaagatcaagattaatttcaagtttcaagaatcaagattcacgaataatcaagatcaagattcaagactcaagattcaagaatcaagaagaagactcagtcaagataagtattaaaaagtttttcaaaacattgagtagcacaagaagttttcacaaaatcttttaccaaagagttttactctctggtaatcgattaccagaaggtagtaatcgattaccagtagccagcattgtttttcaaactgatttacaaagctgtaatcgattaccataa

SEQ ID NO: 12927 - DNA, 342 bp, Glycine max
  Peptide Sequence Number=SeqID_129705
atgagtaccataagcaaagattcttcttcttccaagaatatgaccagtgagtgtgactcctccgaggagagtggttggactaagtactttgaggatttctttgacaaccataatattgatgatgatgatgatcagaaatgttctatgtcgtctttctctggtgttgatagctactactccacctcctttgtctctgattctgctacgaaaaaattaactgacaacacacaagctgaggaatatgatcaccaatcgagtttgaagaagagaaagaagatcaaaacagctttggttgatgatgctttggaagatactgcaagttctcctatcaaaggctccaag

SEQ ID NO: 12928 - DNA, 588 bp, Glycine max
  Peptide Sequence Number=SeqID_129706
atgatttggcatgctgaatttgtgtcatattatctattgttgaagctatctgatttcctctttgcaattccaataattttgaggatctacttcatattcaagtcagggaagtgctaccttgtcatatccaaaccacgtacaaatttttgggagctttcaccacatgctttaacaccaatgcatgggagagttaatgtctggccaaagcagatgctgtgtggatatctaaagagtagagaagctaatattgtggaagtaattgaaggtggagcaaaatctttgtttgacattatagcatatgcatattctgatgttgaccaccgtgtctggattgctatcatcaaatgtgaggctccatgtggatcatctagcccaacaacacaatttaccaaagtatctgttggtgaaaaatctgttgtgcctgcaaggatttctggccctggagtattacactactcatgtaagactgtgggaaactatgtaaaacttaaccatttttattcttgcaacttcacccggggtgtcacattattttggggtcttcaacagctctttacagacgaggttctggttcataacaaatgttga

SEQ ID NO: 12929 - DNA, 381 bp, Glycine max
  Peptide Sequence Number=SeqID_129707
atggattcatccagagattcagaaaatgaagtcgtgaatctaagtatcatggccaaaaactatgaaagtgaagaagagtttaaagaagaaatcaaagatctaaaaaattctcttgccaaatttactattggaaaaactaatttagatattgatgcaatcctccctaggaagggaccagtcactagagccatgagcaagaggctccaagaggattgggctagagctgctgaagaaggctctagggttctcatgaaccttagggtagattttttagcccatgggccaaggttgggtccaattatctttgtacatattagattaggatgtccttatatttggtccttgtatttagggctccataatgtaggtagggtaccctag

SEQ ID NO: 12930 - DNA, 1668 bp, Glycine max
  Peptide Sequence Number=SeqID_129708
atggcgctggcgcgtccgctcacctggggcatgttcctgtgcatcgccgccgcgttcctcgtgctggtgcacgcgtttgtggtcaacgattttaccgtcggctacgttgccaccaactccaattcgctgctgccggtgtattaccgcatcgccgccacctggggtgcgcatgaaggatcgctgctgctatgggtactgctgctcagcacctggacattagcggtggcgattttcagccgcggcatgccgcaggatgcgctggcgcgcgtgctggcggtgatggggatgatcaacctcggcttcctgttgttcatcatcctcacctcgaatccttttacccgcacgctgccgaactttccgattgatgggcgcgacctcaacccgatgctgcaggatatcgggctgatcttccatccgccgctgctctatatgggctatgttggcttctcggtggcgtttgcctttgccatcgcgtcgctgatggcgggccggctggataccgcctgggcgcgctggtcacgtccgtggaccaccgcggcatgggtatttctgactattggtatcgtgctcggttccgcgtgggcgtattacgaactcggctggggcggctggtggttctgggatccggtcgaaaacgcgtcctttatgccgtggctggccggtactgcgctgatgcactcattggcggtgacagaaaaacgcggcagctttaagtcatggacggtgctgctggcgattaccgcgttctcattaagcctgctgggcaccttcctggtgcgttccggcgtgctggtatcggtgcactcgttcgcctcggatccggcgcgcgggatgtttatcctcgccttcctggtgattgtcatcggcagttcgctgctgctgtacgctctgaaagggggccaggtgcgcagccgcgtgcagagcgaagcatggtcgcgcgaatccttcctgctcggcaacaacgtgctgctgattgccgcaatgctggtggtactgctcggtacgctgctgccgctggtgcataaacagctcgggctgggcagcatttcggttggcgagccgttcttcaataccatgttcacctggctgatggcaccgttcgcgctgatgctcggcatcgggccgctggtgcgctggcgccgcgatgagccgcaaaagctgtggaagcggctcggcgtgggtctgctggtgacgctgatcctgtcgatcgtgctgccgtggctgttgcaggatcgcattgaagcgatgacggtgattggcctgctgatggccatctgggtgatcctgctgacgctgatggagctgcacgaacgcgctacccatcggcatcgttttctggcgggattgcgccatctgtcgcgcagccactggggcatggtgctgggccatcttggcgtggcggtgacggtggtgggcattgccttcagcacccaatacagcgttgagcgtgacgtgcgcatgaaggccggcgacagcgtggatatccacaactatcactttattttccgcgacgtgcacaatctgcagggccctaactatagcgccagaagcggtgctgcatgcagagaagcgcttctataccgcagcgcgcaccatgatgacggaagcggcgatcagcggcggcttcacgcgcgatctctacgcggcgctgggcgaagagctggatga

SEQ ID NO: 12931 - DNA, 336 bp, Glycine max
  Peptide Sequence Number=SeqID_129709
atgggctcaaaaatctacccaaaggttcatgagaaccctagggccttctttagtagttctagcccaagcctcttggagtcttctatccaatacccttggggggtaggattgcatcatagtgatggtagagaagaagaagatgtacaaagttttgaaaaaaaagatgcagaaagttttgaaagtgaaaatttgacaccgattgttataaaattcaagagatttttgaagaagaaggatttgaagggaaaaacctttcaacataagaagaattttaagaatattgactcaactcttcaaacttcacttgttttgaatgtggaaaaccaggcaacataa

SEQ ID NO: 12932 - DNA, 666 bp, Glycine max
  Peptide Sequence Number=SeqID_129710
atggccgcgcaaaacccggtcgggcaaattgccattaaaacgctggatgacggcaccaaagtcaccctgagcgccaagagtgacatggaagtcacctactatcgacacgagcgccatgtattactcaaagagggtgaggcggtgtttgaagtgaccaaggatgctgaccggccatttgtcgttgaaacggataccgccaaagtcaccgtactggggacgcgctttgctgttaaccgcctggagcaaatggtgcgtgtcagtgtggatcacggccgggtgaaggtggagccaaaattagccggtgccacggcaaaaactgataacccgctggacatttcgcgtgaaatcaccaatggccaagtggtcgaagtctacccaaatcatgccatggtgctggtgaatcgcccggcctcagacgcttttgccttcctcaagggtaggctggtgtttgaccgtgccgataccagtgaaattgcctacaccgtttctcgctaccgcccaaagccggtccaatcccaaggcaagcagcctttctggaagatcccaccagaactgccccgtcgccagaggagctcgcttcactcaaacaacggctggaagctttgcagcgcatcattaaccgtctgccacccaaatgccgtgaggcgttctggttatatcgggtag

SEQ ID NO: 12933 - DNA, 492 bp, Glycine max
  Peptide Sequence Number=SeqID_129711
atggtctgcattgaccaggcggatatgaccggtagactgcttgccgggtcattgacatttgattgtcgcatcatgcattatatcattgttagaattttgatgccttgttcttttaatcttgctcaagcctctgaggaggacttgattctgatgtgggctttcttgaccggtcatccaatcgactgggcccatttggtttgttaccgcatgcataaggcattgcggtctggtgcacctctcccttaccctcaacttgtgactttatttcttcgacattttgaaattcctttggattctgagccttttgttctagttaaacgctcctttgctattggtgccagtgcggtaacctcctttggctaccgtaaggacgtagatgggcagtggctgaagaaggacgcgcaacctccgcaagatgagcgtactccctctcctccgcctccacaagatgattcctcagccctcatgaatgaagttctttcggaattatga

SEQ ID NO: 12934 - DNA, 427 bp, Glycine max
  Peptide Sequence Number=SeqID_129712
caaggtgattcggccgcccatcactcgagcttttattgagaagtattgcacgcagagacaggcccagggggatgctccgcaggtcgcagacgcgtcgccacctcatcaggctggcccagctggatcatttgatacggagcagtatttacggcatttggttcaccagcaggcggccaaccaccgggctcatgtacagacccatgattgtctttaccagttgagcctcagcctgcagagccagggttttacttcttttccgtgccctactccggatcagttcagggcagaggccgcatggcccggagattggcctgaggcccgggcaagagaggcaccagcagaggcttccgacgaggcagatgaggcccgcgaggacgaggagatgaccgatttacttgatttcttgggagggagcagagccacatga

SEQ ID NO: 12935 - DNA, 748 bp, Glycine max
  Peptide Sequence Number=SeqID_129713
atgctgagtatgcggcacatcagttgcaatgacccgctgggatttggtggtcccatcaccgtaccacctacccagaatggaccccaatcacttggaaccgctttccggggaaattacattcctcctggtgtggttgaaatgaaggttggggagttcatgaggctgtcccaagggacgaaatctgtgaaagagtatctacacgctttcaacaatcttgctcgctatgcccctgagtttgtgaacacagaggccaagaagattgctagtttccagaggggcttgaatccaaagatgctgaagaccatgggtacaggggccagggctactttcaatgcctatatcagcgactgtctgacccaagagaacaataacaacaactatagtgcatccaagtcacgtaagagggcttttgaagccggatcatcccagtccagggcaccagtggcagggcgaccgcagtatcgtcctcctgccccaggtgctagattccgaccgccgcagagaaggaacaccgggcctccaacacagcagaagccgtacaaggtggcaatagcctctgccaagctgaaggcaattcaagctgcagcacctaccgtcaacaatgcgcccaagggtccatgctataactgccacaagatggggcacttcgccaaggaatgtccctaccccaagaggcagcagccaacctacccagctcgtgtgcaccatacctcgatcgaggagatcccagatggagaaccggtatcag

SEQ ID NO: 12936 - DNA, 327 bp, Glycine max
  Peptide Sequence Number=SeqID_129714
atggccaagtttatctgcaagtatttcccaaggtcaaagagcaacaagaaaagactgttatatcttccttccaacaaacatacgatgaatcccttggaaaagcttgggaaagatttagagggattgaaagctctgagcaagcttatgcttgatgctttagctgctgggaaaatttctctcaagattccaagagaggctatacagataattgagaacatgattgtcaatgctacaacaatcaaggagaagttcaatacatcaacaaccaatggcaagggaactaccaaaactacaacaatcaaggatacaaacctcatccaagcataa

SEQ ID NO: 12937 - DNA, 204 bp, Glycine max
  Peptide Sequence Number=SeqID_129715
atgtggtatttgtggagccaattctgcataatggattatgagcatgcaggtgttggggctatagagtttattatatgccattcagaggtctcaattgcacttgcagaagagaagaagatacctgagctattcaagacatttccaaatgcaacaaagtatctcaagacaattaatgaatataacttttttgtgcaatggaaatga

SEQ ID NO: 12938 - DNA, 717 bp, Glycine max
  Peptide Sequence Number=SeqID_129716
atggcttctaggaaatgcaagagtatcggttcaagacccacaacacaatatgctagaaggagatttcactccttagatgcttggaactggtacacgaataatgtcctggggagaaacatcttgctagagaggaaggtggagctctaccacactgagttggatgattttaagactaagttggagaggcgtaatttccataaatgcctcaccaatttggttgatgggagcatagatttggctttggtgaaggaattctatggaaacttatatagctctgttggtccttcaccaaagcaagccagggtcagaggccacctagtgaagatcgacgctgacaaccttaacacattcttagagacacctgtggtgttggcagagggtaagactttacccacatactccagatactgcaggctgcccacagattacagagagattgaggctaccttatgcataccaggccgagggttcatcttgaacgctgagggccatcctgggaggatactcaggaaagatttgactactttagcccaggtgtggagtgttctctcatactccaacttggcccccacatcacatacctctaatctaacagtggacagagctaggctgatctttagcctagtctctcgcatggacatgaatataggagctcttatgaaaggatctgactcttcacaattgaatttgaattccaacgttcagatgcactggtaa

SEQ ID NO: 12939 - DNA, 510 bp, Glycine max
  Peptide Sequence Number=SeqID_129717
ttcctgaatgaggacatcatgaccttgttcgaggaggaggtagaggatgaagatagggacaaatggattgtgtggttcgacggtgtgtccaacgcactaggccagggagttagggcagttttggttacccccgacgatcaatgtatacctttcacaagtagattgggctttgactgcacaaacaatatggctgattataaggcgtgcgcccttgggatcctagcggcaattgacttcaaggtcaagttgctcaaggcctacatcaggatgctgatagagttcttcgatgacatatccttccaccacattcctagagaggagaatcaaatggccgatgcgctggccactctcgcatccttgttccagctaaccccgcatggggacttgttgtacatcgaattcagatgtcgcggcaggcctgcgcactgctgcttgatagaagaaaagcaggatggtaaaccttggtactttgatatcaagcagtacatcgaggacaagaaatacccatga

SEQ ID NO: 12940 - DNA, 273 bp, Glycine max
  Peptide Sequence Number=SeqID_129718
atgccattgcctagcactgttcatgcatcctccaccaacgagtctggagccccgcgaagcgctgttcatgtgtcctccacctacgagtttggagccatgcgtattgattgcttagtgcaattctccgtcctcgccttttttccggagccccataaatgtcattgcctagtgctgttcatgcatcctccaccaacgagtctggagccccgcgaaggtattgcgtaccactgttcgccaattctccattctccacttcttttcggagccccatga

SEQ ID NO: 12941 - DNA, 165 bp, Glycine max
  Peptide Sequence Number=SeqID_129719
atggaggttgagaaaacctatcaagggttatggctaccattgcagtatcaagtagataatggagcaaggatggcctttgtggataactgggtggtgggtaaggagaaggtttgttattggatgagtaatgacattgttggattggtggaaaacttggccgtatag

SEQ ID NO: 12942 - DNA, 195 bp, Glycine max
  Peptide Sequence Number=SeqID_129720
atgggagatgagatgccattagaattagtcgtattggatttagcaagaagatttttattcagcatatttgtggagcttctgcagggttgcagggaaaaagatggcagtggtggtggtttgctcttacttactcgatttggaagcataggaacaacaatattttctctaatgctgtttttcatggccataaattaa

SEQ ID NO: 12943 - DNA, 224 bp, Glycine max
  Peptide Sequence Number=SeqID_129721
acgctcagctcaagccaacttctatcagttcaggcggaaggtcagggggagtggtacaattaggccttcccttcgatatggagatttcagccctttccttccttgtttgcattccagacaagatccgtcgtggttcggagtctcgtactagcctcgccctatctaaaactaaaaggcggatggaagatggccttcttaatgagctctctcgctttactttatcg

SEQ ID NO: 12944 - DNA, 1557 bp, Glycine max
  Peptide Sequence Number=SeqID_129722
tgttgtggtggggatgccggagcaaatccgcgccctggccattgcgattttttcgcgtgggcatgtattgctggaaggtgatgtgggtgttggtaaaacgaccttgttgcgggcggctgcacatttacttggtggcggttaccagcggatagaaggggcgattgacctcatgcccagtgattttctctatcatgcctatattgatgagcagggacaggctgcagtcaaaccggggccgttattgcagcatgatgaggctttatccgttttctttttcaacgaaatcaaccgtgcccgcccacaggcacatgccttgttcttgcgcctgatggccgagcgttcggtcaatgcctttaatcgtgaataccatttcccgcatttgaccgtgtttgcagatagaaaccgtttagaacgtgaggaaacctttgaaatcccggctgcggcccgtgaccgtttcctgatggaaatttcaatcaaggccccggatgcccgtgacctgcaacgcgccctgatgtttgatacgcgtttttatgatgttgaccgtttggtagacgggttacccgttggattgacgccgtatgcgcagctaaaccaggtggcagaagcggtgcaggcctctgtgcgggcagaggtgccgttacaggattacgccgtggatttgtggcgcacgctcaaagatccccaggcagccgggattcaattgccggatgtcgatatgtcacgattgttggcaggcggcgccagtccacgcggcatggcgatgctgatgcgtagcgggcgtacgcgcgcctggctggaaggacgggattacctgaccccagacgatatccgtgccgtgtggccatttgtggtaacgcaccgggtgtttctcaacggcgcctatgcgctgcagcacgaacacctctccagccctgcgccggaagtgcacgcgacgtttgaaccccggttgtttttttacaatatcaactggcgatcaaggtcctaccacgcgggtgctaccctgaccggccatcatggcaatggcagtgattttgccggttttgccccgttgttatcctgcccggatcccaagcgcattgatattcgtgccagtgtgcgtagcacgccccggcaatggttggtcaggacttatctcgaacgcgcggccatccatgtgtatgccgtggtggatgtctcaagctccatgctgtttcaagggcatgatcagctgcgccagctggtgacagaatttgtgtcttcattggcctggtctgctacccgtcagggcgatgcctttggtatgcggggagcgcatgacacgccccaagcggtctggcaggtcatgccgacgtttcagcctgccacggcgcagggcgtggcacagaaaatcacgcggtactggcaagatgcaacagtcaacgctgccgaaaaaggacatggggccgctggcatcccggctgcgattgaatcgctgggggcacggcgggcgctggtattcctgctgtcagacttttactggcctgatgccctgatgcaacaagtactcaaggctgcgcaagcgcatgatgtgtcccagtg

SEQ ID NO: 12945 - DNA, 645 bp, Glycine max
  Peptide Sequence Number=SeqID_129723
atgctatttcagaaagattatggaagtcaaatcctagtcgtcaagatatatgtggatgataccatattcagtgctactaatgacttgttgtgcgaggatttttccaaacttatgcaggcagagtttgagatgagtataatgggagaattgaagttctttcttggacttcaaatcaagcaaacaaacaatggcatatacacacatcaaaccaagtacatgaaggaacttctgaagaagttgaagatggatgatgaaaaccaaatgaaaacacttatgcatccaaccactgtacttggactaggcaaagaatcaaagcgggtggatgaaaagacatacaaagaaatgataggatatcttttgtatgtcattgagtccagacctgacattatgttcagtagaaaaggaatatggttgcttgattactgtgatgcagattttgctagagatagagtggaaagaagaaacaccagtggaggttgtcacttcattggtggatgcttagtttcttggacgagcaagaaacaagggacaatagctttatcaacagcggaggcagagtatatttttgatacctgtgatgatcacgaacattgttcgtggaagcagaatgatagcagtagggtgcaagaagtaagattctggtga

SEQ ID NO: 12946 - DNA, 207 bp, Glycine max
  Peptide Sequence Number=SeqID_129724
atgagggttgatgtctcgcaacaaggatacgtagaatttgggaaaaagttaaaacaatacgagctttgcatcaaaaggtttatctatctctatctctatgagatacaagcaaaaaacatgaacataaaggttctagacgatagccaaagtattagtcaatggacgatactgtctcaacatccattcttaagaagacaactactttag

SEQ ID NO: 12947 - DNA, 183 bp, Glycine max
  Peptide Sequence Number=SeqID_129725
atggcgtttttcctaagctacacgaaagcaaaggctgaaacactcaattgcaaaccaagtttcgagaagatccaacagctaacgaaggctggggggtcatttttaccgaggcaacttcatgtagcttccttgagaagcttcattaagaggcttcctcaagaagcttcctcgtggcttctttga

SEQ ID NO: 12948 - DNA, 783 bp, Glycine max
  Peptide Sequence Number=SeqID_129726
atgaagggatatatactgacttctgagattgatggcaccatacaaatgaagagctatctttctggcaatcctgaaattcgattagcacttaatgatgacctctccattggaagaagccagggatcagctttcggttataggagctcatctgactctggaacagttatattagatgactgtaatttccatgaatctgttcgtcttgatagttttgatatagacagaactctatccctggtaccaccagatggtgaatttccagtcatgaactatcgtttgacacaggaatttaggcctccttttcgtattaatgctttgattgaagaagcagggtcacttaaggcagaagtaattcttaaagtaagtgctgagtttgcctcaagtgtaacagcaaacactatcaaagtgcagatgccactaccaaaatactctagagttgtatcagttgcttatgatcattgggttagttttgagctggaacctggagctgttggacaaacaactgattttaaggaagcaaataagaggctagaatggagtttaagaaagattgtcgggggatcagagcacactctacgagcgaaactaaccttttctcaggaatctcccgttaatgtaacgaaagaatcagggcctgttagcatgacatttactataccaatgcataatgtttcacggcttcaggtaaagtatttgcagatagcaaagaaatctgcaactcatgagccataccggtgggttagatatgttacacaggcaaattcctacgtcgctcgtatatga

SEQ ID NO: 12949 - DNA, 168 bp, Glycine max
  Peptide Sequence Number=SeqID_129727
atgattgtgggtattgattgcaaaacgataagagtaggaaggatgatatggaaaacacttaatgatagagacatatccggtggttacacgtacggtgcagttatcccattttgtgggatttccttacagccaaacatctatggtgatgagttgagagacctgaattaa

SEQ ID NO: 12950 - DNA, 354 bp, Glycine max
  Peptide Sequence Number=SeqID_129728
atggtttggtcaattaggtccagaataagttcacttctctgttcaaaggcacctttagtgggttcatacgtctatgactcatgttggtgcttatgcttttctgctccaaccagctcctccatagcaaggccttggccaaactttatggattgggtacaaatggaccgttgccgtgcagcagcatcgttgcctttgatcaaagagcagaatggaccatcagaaagtaatgctgctcttgagtttgcagtaactactcttcaggttgagaatatattagtcattggtcatagtagctgcgctggaattgaagctttgatgaatatgcaagaagatgtagaatcagggtatctctag

SEQ ID NO: 12951 - DNA, 756 bp, Glycine max
  Peptide Sequence Number=SeqID_129729
atggtcccgtttcggagattctacggcttcgagcgctggctggaccaccacgctgcccactctccgatggagttgaacgctgccagatccaaaacggagcggaaatcaacggaagcgtgcaagagtcacagggaagctgagaggagacgcaggcagagaatcaactctcacctctccaccttacgttccctccttcctaacgccgccaagagaggtaaattcaaacatcgtgtcgttttgcagtcggacaaggcgtcgttgctgggggaagtggtggagcacgtgaagcggctgaggaagcaggccgatgacgtggcgcgcggggactcgtcgtcctcctcgagaagcgctcagccgggttcggtccggtcggaggcgtggccgtttccgggagagtgcgacgaggcgacggtgagtttctgcgacggcggcgaaccgaagcgggtgaaggcgacggtgtgctgcgaggaccgggccggtctgaaccgggatgtggggcaggtgatccggtcggttcgggcaaaaccggttcgcgcggagacgatgacggttgggggaagaacgaagagtgttgtggtggtggagtgggaaaaggaagaggaggttggggagctggagcgggctttgagggctgtggtggagaatcgggctttggtgggctttggaatgggccacgtctttgtgggccagaaacggggtagggattgttgtgaggtcgactctgacttcttgctgaggaatgggagcttctgctaa

SEQ ID NO: 12952 - DNA, 99 bp, Glycine max
  Peptide Sequence Number=SeqID_129730
atggaagacttagtattccaaaagaactttgttgatgaggtcggcatagtcgatgtcatccataaacaatgtaagctaactttcagtaatcactactag

SEQ ID NO: 12953 - DNA, 174 bp, Glycine max
  Peptide Sequence Number=SeqID_129731
ggatcggggtacaagaacttagttgtgtatgtgtgtcttaatgcggtcttggttgagtttagtcttacaagaggaatctgcggacgaggcttgatcagggctaggctaggctatcatgatgaatcggggtctagcagtccaagagacaacacaggaacgcatgagcattgttaa

SEQ ID NO: 12954 - DNA, 720 bp, Glycine max
  Peptide Sequence Number=SeqID_129732
atggaggagatccgcaaacttgtgtcagcgatcgcagagaacctgaacgtcgttgtaatcgtcccctctaaagagcgcgcaaaattctggaaagatgtcgcgcatcaaactcttgacaaggacaacattcaggcaggtatacagcatcttaaggacggtattgtgggtttaaccgtgctgatcaataaatacgacggtatcgacttgccaggaaaggcctgtgagttgctcgtcattgacggcttgccggaggtttacgggctcggcgaacggcgcgaaatgttactgttggacggaaccaaacgccagcttgtgcgtcaagttcagagaatcgaacagggaatgggtcgtggtgtacggtccagtgacgatcattgtgtcgtactattgcttggcggcaggctgacgcaacgactccatcaacccgaggccgaaacgatgttttcttccgccactcgcgctcagattgacctcggcaaaagtgtggcggagcagttgcgtgggcaatctctcgagaagcttgaagagattatggacctatgtctggcccaagacgacaactgggtgcaggctggccgtaatgcggttgtgaacgcgcctcctatcacagagggacgcattgatgctaatcaggtgctgttgcgggaggccttcgatgcggcacgcgtatcgcgacatgatatcgctaagaacaagactcaggtagcggtgacgcaacaa

SEQ ID NO: 12955 - DNA, 762 bp, Glycine max
  Peptide Sequence Number=SeqID_129733
taccgccgcctcgccctcctcctccaccccgacaagtcccgctttcacctcgccggccacgccttcaagctcgtcgccgatgcctggaccctcttatccgaccccgtcaagaaatccgtttatgacaaggacctcactttcttctcccgcgtcgatttgtccgttcccgaatgggtccagcagcaggagaagctccccgtccggaggcctgggcctgggcccagcgccggccgcaacagcgctgcggcacgcgaggacattctcgcggacgagaattcgaggaggaggcggaggaggaggaaaaggagctctactttctggaccgcgtgtccttattgttatcgtttgtatgagtaccctagggtttacgagggttattgcttgcggtgccagaattgtgatagatcctttcacggcgtcacggttccgtcgttgccgccgcttgttccgggacaggaggcttattattgctgttgggggttcttccccgtggggtttgttgttggcggcttcggttctccgccggaaaaagaagctgctcctgtggcggcgatgccggtgcaggcaccacctcctccgccacaacaggcttcttcgctgccgaattggatgccggtgccggctgagaatggcgctgggagtgttactccggtggcgacggcgagggtgacaagctcgggggcggcgatgacgaacggggttggatcggggacggggccgaagaaacgggggaggccgagaaagtatccattgccgtcgtga

SEQ ID NO: 12956 - DNA, 939 bp, Glycine max
  Peptide Sequence Number=SeqID_129734
atgccatcaagcaatagtccccggacgaaattagggtatgacaatgcccaagcggacatcgactcataccctctattcactgctgagagaccagcacccaatgccttgcctcagcctaataccacgaaagtctctcaaccccgcccgatgcaaccacttcacttctccgttgggggaccgcctccggtagtggagggaagagaaaagcttgatctcatggaagagaaattaagagcggttgaagggttcggtgactacccctttgccgatatgaccgacttatgtttggtgtcagatgtcgttatccttcccaaattcaaggtacctgattttgacaggtacaaggggacgacttgccccaaaaatactttgaagatgtattaccggaagatgggggcatactcgagggatgagaaattgctcatgcactttttccaagacagcttggccggacccgtagtcatttggtacaccaaagcatctcttgtctgctcgtggaaacacttgattactgccttcataaggcaatatcaatataacactgacgtggctcccgatagggcccaactacagaacatgagcaaacgggaacacagatcgtttaaggagtacgcccaaagatggagggatttggcggctcaagtggcacaccctttggtggaaagggaaatgatcaccatgatagtagacactctaccagtgttctactacgagaagttggtaggctacatgccctctagctttgcggatctagtattcacgggtgaaaggatagaggtaggcctaaaaagggggaggtttgactatgtctcccttgccaacacaaacagcagaagatctgggccaactagggcaaaaaggaaagaaggggatgctcatgccgtgacctcggctcctgcttcgccaaaattcctgcaaacccctcataatactcactag

SEQ ID NO: 12957 - DNA, 657 bp, Glycine max
  Peptide Sequence Number=SeqID_129735
atgtgtcacaaatttgcatttgaggcactagataaaagtcttaaagacatcatgcaaaacaatcttccttttggtggaattgcttcattactattgcctggtggtcagaccgcacattccaaatttgctataccagtccctgcaacagaaaattcaacatgcaatattcatcaaggcagtgagttagctgaattattaaaggttacaaaactaatagtctgggatgaagcaccaatgtgtcacaaattttcatttgaggcactagataaaagtcgtaaagacatcatgcaaaacaatctgccttttggagggaaaattatcgtttttggtggagatttccgacagatcttgccaattgttccaaaagccacctatcccagcttgatagataactacagtgacacagattacttgcaaaaaagagttgttcttgcctctaaaaaagaaattgttgacaaaataaatgattatgtcctatcacttatacccaataacgaaaaagagcattgtagcgcagataatattgataaatcagatgaattgctcaatcctgctttcgcattattgccacctgaatttctgtattcattgcaaacatcaggtatacctaatcataaattaaaactcaaggttggaactccaatcatgctaatatga

SEQ ID NO: 12958 - DNA, 453 bp, Glycine max
  Peptide Sequence Number=SeqID_129736
atggtgcagtatcgattcagaacgttactagtaaaccttgaactttcctcattcccgacacctctcacacacttctcaaattcttcatcacctcacccgccacaccatcattactattactacccccctccacgtgccttccacctgaaaatcactccaccggacctgtgttctgtgccatccaacgatgttgtagcggttgttgctgccgtggcaacgtcgctttggcctctttcgacgtccgattctccctctaagtttcactttggcggcggcatcaccgtcatccaagatgaggacaacctcgcggggctcaaccttgtagtggcagagcggacacgtggaacgcgtgcttgcacttgggcaatagcctcaaaacctcgggatcctcgaacctggctagacaaaccttggaaaaaacccaaatcccactggagatcaaatcaaaattga

SEQ ID NO: 12959 - DNA, 246 bp, Glycine max
  Peptide Sequence Number=SeqID_129737
atgcctcctctctataatcaatgccatttttctgatgctaaaaggagtagtcgcgctaagcggaccctgtgggctcagtgcgcatccaccgctaagcgcagttttagcgcgcttagcatgacaagggaatctagaagagcacaagaattaaggccgcgcgctaagcacgagatcaactcgctaagcgagacgattgtctcttaccaagctcagcgcacgactggcaccgagcctaaatccacttag

SEQ ID NO: 12960 - DNA, 4036 bp, Glycine max
  Peptide Sequence Number=SeqID_129738
atggatgaagatgaggatgatgatgtgccacaaccaccaagcaacatcatggaagatgttaatccaaatgaaagcaatattggtgaagagtctcattcttttgatggagaaggatcacctgaagctgattcgaattggtgggagatggaaaattccgattcggcgcagtgcgttcgagttgccgtcaacattcggcctctgatcacatcggagcttatgctcggatgcacagattgcatctcccttgttcccggtgaaccacaggtgcaaattgggtcgcatgctttcacttatgactatgtttatagctcgggatctccatcgtctacaatatatgatgattgtgtagctccactcgtagatgcacttttccatggctataatgcaactgttcttgcttatggacagactggatctgggaagacatacaccatgggcaccaattacacgggagaggacaatgccggtggaattatacccaaggtgatggagacaatattcaagagggttcagactatgaaggaatcctcagagtttttgattagggtatcttttatcgagatattcaaggaagaggtattcgatttgctcgatcacaattcttccagaggagatgtggctcctactgcaaagcctgctgtgcccagcagagttcccatacaaattagagaaacagtgaatggaggaataacactggctggtgtgactgaggctgaagttaagaccaaagaagaaatgtcatcttatctttctcgaggttcactgtcacgtgccacagggagtacaaacatgaacagtcaatcaagtcggtcacatgctatattcacaatcactatggagcaaaagagtggtgatgatgtcttgtgtgcaaaactacacctggtagaccttgctggttctgaacgtgcaaaaagaactggtgcagatggcatgcgtttaaaagaaggcattcatatcaataagggtttattagctcttgggaatgtaataagtgcactgggagatgaaagaaagcgaaaagaaggtggccatgtgccatatcgcgatagcaaattaacaaggctactgcaggattctcttggaggaaacagcaaaaccgttatgatagcatgtgttagtcctgctgacaccaatgctgaagagacattgaacactctgaagtatgctaaccgtgctcgcaacattcagaacaaggcagttatcaatcgtgatccagtgggagctcagatgcagagaatgcgaagtcagattgagcaattgcagtctgagcttctgttatacagaggtgatgctggtggggcatttgaggaacttcagattcttaaacaaaaaatatccttacttgaagcaagcaatgaagagctacagcaggagcttcaagaacgtcgagtaacttgtgagagtttatcacaacgtgcttgtgatgctcaggttgaaaaggatcaactgatcatgaaaattgaatcaattcgaaatggtaaatcttgggatgaaattgactcgaattcaaatcaggattatgacctagtgaaatcttatgtgtcaaagatccaagatctggaaggtgaattgcggggtttgaaaaatttgaatgcgaaatctagacatgttgactgggttgattcagatgatagtggattccggtcaaagaatgtgttatttgcatgtgctaatgaatactcttctgattgtgacgccaaatcagtggacataacagatgacatggaagatcatgcaaaggagatagaacactcttctcttcaagaaaagttggacagggagctcaaagaattggataagaaacttgaacaaaaggaggctgaaatgaagatgttcaacaattctgatacttcagttcttaagcatcattatgaaaagaaagttcttgagttagaacaagagaagaaatttttgcagaaagaaattgaggaacttaagtacaatcttgcaaatatttcatcctcttctggtgacggtgctcaaaagttaaaggaggaatatcttcaaaagttaaatgctcttgaagcacaggtctctgtgctgaagaagaaacaagaatctcaggctcaactgttgagacaaaaacagaaaagtgatgaggctgcaaaacgacttcaggatgagatccagagaattaaatctcataaggttcaattgcaacataaaattaaacaggaatcagaacaattcaggttatggaaagcttcacgcgagaaagaagttctccagcttaaaaaagaaggaaggaggaatgaatatgagatgcataaactgttagcgttgaatcagaggcaaaagatggtattgcaaaggaagacagaagaagctaccttggctacaaaaaggctgaaagagcttttggaatctagaaagacttcacgtgaaagtgctgcaggtgggaatggtccaggaattcaggatgtcttggtgtttaagcttctacttgacatgtgtttctatttgaaggctttgatgcaggcaattgagcatgaacttgaggtcactgtccgagtgcatgaagtacgttcagcacatgagcgtcaaatggaagagagggctaaaatggccaatgagatcgcaagattaaaggaagaagcagatatgatgaagcttaacaattcaagtgatggcctcgcatctatgtctccgggtgcaagaaattcaaggatatatgcccttgaaaaaatgattgctacttcttctacaacattgctgtcaatggcatctcagttgtcagaggcagaagagcgggaacggattttcagtggcaagggacgttggaaccaagtccgttcccttcctgaagccaagaatttgatgaatcatttgttcaatctggcatcttcctccaggtgtttattgcgagataaagaagttacctgcagagagaagggcatggaaataagagatctaaaagaaaaagtagtaaggttgagctgttcacttcgacagttggaaatgcagaagtctgaacttattcatcagttgaaattgctgagtgcaaagagatattcagaatctttgggtggtttggtgtatcccgacataaatggaggacataagtatgacttgcgcaagatggatatggatttatctgtatccgatacagaatcagatgattatgttgcagatgcaactgatgatgaatgggtcgcttcagaaaaaatacacgttaggaaaaggaaatctagaagcagacatgtaagcatggaaaacaatcagtcaaatatcagttcagaagatgtaaaagataattcaacagaaggagttggaggtgcatctggggaaactgtatcagatatctgctgctcttgtagtaaatcttcatcttgcaagacaaataaatgcaaatgcagaactctgggtggcatttgtgggagttcttgtggttgcctagcatcgaagtgtgccaacagagcatcaggctcaaatgaatcaccagttgaagggactggtaatgattccagcattcaggaagcagacaaagatcaccttcttgctgctcaaggtgctgagttgcttcagggtgcactgattggggggcctgctgaggcccacagtgatcatgggccaagaaaaccactttctgatattggaaatacactggccaaatcaaatgcccagaagcctaatcagagaagggaatggaagaacatcaaacggaagtccacattgtctacagtagtactaaatgttgttcctccgacttcctcgcagtcagataattctgaagtccccaagaaagaaaataatagcatcagtgaagccaatgtatctaacataccacagaaaatgcactcatctagacctgaaaatgttccagttgtcccaaaggtagagaaaaatgtaattgagccagatatacgtttaccacgagctatgcgaaagtcagtatcaccaaatggtggtggccttccactaggggacatgaatgctagtaagccagatgaacctgtcaataaggagtctgaagtgatgatagaagctagaactccggtgaaacaaaaaagaacacttgagaaagagaacaatggac

SEQ ID NO: 12961 - DNA, 240 bp, Glycine max
  Peptide Sequence Number=SeqID_129739
atgtcatctgctgaagcctcatcatctcaagaaacatccactccaaatacttctcagaatgttagaggcaaaaattatccaacttggggacatttgatatgtatttattgtgataaacgagttaagggaggtggtactaataggtttaaggctcacttgactagacaaaaaggccaagtagaggcttgcaagaaggttcctactgatgtccaacatcaaatgaaacaactacttgaatag

SEQ ID NO: 12962 - DNA, 234 bp, Glycine max
  Peptide Sequence Number=SeqID_129740
atgagacctaggtgcggcaacgagttgcaaagagcagactcaggtgtgcggcattgtggcgttgcggtgagttcgtggcttcgtgcgacgatgtgcaaacctaggtggcgttgcggcgagttcgagtatgaagatgaagaaaagggcccagtcgggatttgtaaaatcggtcaagttgctgggttccctcaaaacggttgggtttgcccgggttatcccagaccacatgtataa

SEQ ID NO: 12963 - DNA, 291 bp, Glycine max
  Peptide Sequence Number=SeqID_129741
ttcttccggaagtgcgcgtcttccggaattcttccggatgaaccacttcttccggaaagttcccggaagaggttttccggaagtcttccggaagaagtgttcttccggaagacgtttgattacttccggaagaacacttcttccggaaactttccagaaaaggttcttccggaacttccggaagaacccctaacgggtcttccggaagtctccgccgtcagcctcttttccccattttttccggcgtcctctcctctcgtttgctaccctaaggttactatcctaaggtaa

SEQ ID NO: 12964 - DNA, 117 bp, Glycine max
  Peptide Sequence Number=SeqID_129742
atggttttgcgagtagtgtgcatgatggagggtcttattgcgagttttcaatctccaccaactctagcatcaacttattttgcacagaaagatgaagtgcttgcccagagacaatga

SEQ ID NO: 12965 - DNA, 2907 bp, Glycine max
  Peptide Sequence Number=SeqID_129743
atggaggagaaggtggctgagaccctcaccattctgtgtgatgagggggactcatttgctaagagggcagaaatgtattacaagaagaggccagagctggtgaattttgtggaagaagcctttcgagcatatagagccttagcagaaagatatgatcatctatcaaaggaactccaaagcgcgaaccgcactatagccagtgtcttcccagaccaagttccatatcatattgaagaagatgatgaagaagaaagtgacacaggaactaattcatcatcaccagaccccaacaatcaaacacataatagaccatccattcctaaagttcccaagaccccaaagaaggactttagaagtccatccatgttgctatccagaaaggccccacttaagaggatttctagctcagcaaaatatgttccaacaatttcaagctcaggtctgaccaaggttgaagccttggctgatattgacaagcttcagaaagaaatattgtcactccaaactgagaaagagtttgtgaggagtttgtatgaacgcgcctatgaaaagtactgggaaattgaagaccagatcaccgcaactcagaaaagagtttgcagcttgcaagatgagtttggtgttggcacagttatagaagacaatgatgctagagctttgatggcaaccacagctctaaaatcatgccaagagaccctggacaagttgaaagagatacaagcacaatcatctaaagatgctaaagaggagtaccaaagggttaagaaagctcatgagatgtttgagacccttagagaccaattcattgctaaatatacgagtcaacaagaccaagatgacgtggacaagtctgagagtgtaggaacagataaaaaatgcatagatgaagagatggatcacttggagcaagagaagcatgacgtggggatgttgagagagaagatcaaacaaaagttggatgaagactcaagtaattccctcactgtgactgaaatggctgagtgcattgatgagcttgtaaataaggtttgtaccttggaaactgcggtttcatctcagactggaatggtcaagagactaaaatcagaaacagatggacttcaaacaaatataaagaaattggaagaagacagggaaatgctcatagaaggctcagaagttaccaacaagaagctaaaggaattggaggaagagttgtggagagttaaaatgctcaaccgagatgtcagaactcaagacaacaccctccaaacacactttactgaagctagctgtaaccttgagcacctttctggaaaattgaataacatgaagccaaatgaggaggaggagaacttggtactttacaagaagaagagaactgcttctgatgttaacttgtttgttgataactcagatgtcaagacactaaaggaagatggtggtgcaaatgttgatactaacaagtccaatttgaatgatagtactttaatgaatgaaaggattcagaagctggtactacaacaggataaggatgatttatctgatacaccgagcaatcttgacactgaatcacaggatctggacattagtgaggaagatcaacctaattggaggcagatgtttataagtggattagatgacagagaaaagattctgttggaggagtacacatcagtcttaatgaactataaggatgtcagggtgaagctcaatgatgtggaaaagaaaaaccgtgacagcatttttgagttgacacttcaggttgaatattttaatactgttgccaaaacaatacaagaatttctccttacaaatagagtacattccactcctactaaggtagaatttcccgtgcagctaagggaaatgaaaaatgctctagataccaaggataaagagatacaggttttacatcagaagctggacaatccagatgcaaatccttatgaaagtccctgcaccatcaccacagaatacaaatatacaccacatgaagcacttctccgaaaagcaggtcaaggtgctgatgtgtcggactcagaaatttggccttcaaatttagatgcaaatgcagccacaacgcctttcacagaacaagttgaaactgaaagaacaggaaaaaatgccttctcatctgtgagaatgacactagagaagctcatggcacatcaagataagcgccaagacctttctaacttggaacagaagttccgttcagacatcaacgacttgctggaagaaaacctagagttctggttgaggtttagcacttcagttcatcagattcagaaattccaaaactctattcaggacttaaaagcagagctgaaaataataagggaaaagaacaagaaatctgaagggtattcacattctaaacaacagcctatacaatctcaactccggccaatatttagacacctgagagagataagaactgagttgtcactgtgggtggaacacaatgcagtgttgcaagatgaactgcaaggaaggtacgcatctatgagcaacatccaagatgagatagcaagagcagggaacacagaatccggtgctgacacggcagagctaattagtaagtaccaagctgcaaagtttcagggtgagattctcaacatgaagcaagagaacagcaaggttgcaagtgaactgcaagcaggccttagccttgtgaagggaatgaaaaatgatgttgagaagacactagatgagctagatgaagctattggtgttaacagtagtgttcctaagaataatggccagatgaaacactccagtagtcgtgctcgaatacccttgaggtctttcttgtttggagttaagttaaagaagcaaaagcatcatccttcactatttgcctgtgtaaatccggcattgcaaagacaatacagtgtcaatgatgaagcaccagccccaatatag

SEQ ID NO: 12966 - DNA, 489 bp, Glycine max
  Peptide Sequence Number=SeqID_129744
atgtctgtggcttttaccaacctctcttggtggttgtggagtggaaagcatcaagatccaagaatctcaaatgggtcttctataaattcttcgggcgattcgaatttgtgggaatcggatgttttgaggtttcctttggttaaggcaaatgtagggtcctcgtcaagaaaggtgaagcgcaaatggcatagtagggaggagaggaaggtggatagggaatatgatgttgttctggttccatctgatggtggatgtgtttctggttctgaatctgatgattctgactggtcaattggctggttagagcctcatggacctggcttcccaagtgatgatgaaacagataacagttttgctgtgattgttccctgttatgggcgagactatggcagaatagtggaggatccaaaaggcaatttactgaggggtgttgggaactttccagacagttattcagatgttagcaatttagcatttgattgcggttga

SEQ ID NO: 12967 - DNA, 1302 bp, Glycine max
  Peptide Sequence Number=SeqID_129745
ctcatcagttgggctaagtgcgcatccaccactaagcgcagcttcaacatgcttatcatgatagaagaatctggcagagcatcaatatcaaggtcgcgcgctaagcgcgagatcagtgcactaagcgcagcagttatcttcagtcaggctcaacgcatgactggcgctaagcgcaacgtcgcgtggtatgttttactgagccccacggtgggtgccaaatgttcttaccaaaatttgaaatcgtcgcacatcaaggtggacgtggctgagtggggtcccgagcgtcacacgtcggcttggagagttcctcatccaaggatactcattgaggtgcctctaatagtgagtcctcctcttctaaaagggcagcctatcctggttactgtgatcctcccctcgtctactttcgggggtgtaaggaaaggtagtggcagtggggatgtgagggtgtttccctacgtgcgatgcagcctaagtgctaggtcattgacgtccaccccgattgttgctggctatgagtgggtgagggatgacgtgctgaattataggacctatttgatcttggcggtgaatgtcgttgcgcttcagtgccaagtgaagctggcgaaccctaagggcttgtgggagtgtcattctaccattcaccgcttttcagtgtgctctgttggagcacttgaatgtggccctttcccagcttcacatggacaattgagcgatgctactaatgtcgtggctgatggcatgtcactaatgcttaatagggagtgggggagcctcgcttcccattctactagcagtctgatccctcctgagggtctaaaaagcaattttggtgcagttgctggcctcgctagctgcacatgccattttgtctcttccttcagcgagcaatcctcttgcttccttgatggtaagtgcctaacttgccctcgtttatgtctgaggccacttgtgaagaaggtcggacctgcaggtgggatcgtgccaccatctgttgttgctctgtctgctagagaaagaggccaacctgctagtgagggtggtcctattattgttgctattgaggtcacccccagcattccttcctctgttttggcaaagaggaagagggatgctgttgttgagccatctggccatgtgcctctagctccaccggctgctactgttagtggtgtaagctccattggagcttgtaggcctaggatcttcttcatcaatggattcctttgcttcttggaagatgaatggcagtggaatagagaaggaagagacagaggagacgccacttcaaggagaagatga

SEQ ID NO: 12968 - DNA, 552 bp, Glycine max
  Peptide Sequence Number=SeqID_129746
atgacatttagagggccaaggaaggccaggggtaagagatcagaggtccccactacttcagcagcagcagagacaacaactccttcttcttccacaactccagcacctcccatttcgaccctagcacagactccggccattcctgctccatctccatttcagcttccagctcctttatttgcaggaccatcagaatttgtatttgcaccacagatgcttcattccatgctccagagcttacgcagggggcagaccattatcatacagagccttcagggattgggcctaccatccatcatgagcatggatgagtttgatgcaaaggtggccaggccaggagcccagccttctccttctggaggggatgtacacagggctcaggaggaggagactggcacagaccagattccaaagccatctccagcatccatacctgatgattccatgccatctacaccagcatccgagttagagcagcctatctctcaagattcactagttgctcaggtgttagatcttaatgagcatgcacaggaggaatcacaggagtag

SEQ ID NO: 12969 - DNA, 747 bp, Glycine max
  Peptide Sequence Number=SeqID_129747
atgaccattattagctatgacaaccggctggccgaaagcgtcccgcctcgggcgcgctacttcgatagtgtctcaatggacaacgttgaagcgggacgtctggcggcgcaacatctgctggacaacggttgccgtaatatcgtctttgccaccgaaagcgggttaacgctgggacgcagccataaaatcctcggctttcagtccgcgctttcccaaagcggtacagcggccagaggcgtggtgatagaaggtaaaggcaatcgggaattcggcgacgccgagatgttcgaactgggcgtaagcctggcgcaaaaaattagcgccttaacgccgcgagtggatggcgtggtagcgattaacgatgctttagccatcggcctgatggttgggctacgcgcgcagggcctgaaaatagcggaagatatttcggtgattggcatcgataacatctccctgtcggcgttatcgtcaccgggcctcacctcggtaatggccccgctttcggcaatggcgtcgatgatggttgagcggcttgtccagagaattactgagccgggattacaaaccgacgaatttatctttgcaccggaagtgatacagcgtcagtcgggagacctataccctattacattcaaaacgcatattaatgtcgggatttccatcccattcttttgtactttaacgagtataaccggaaataatgatgaacctacaatctgcgcaatatatagaaaagagcgccattaa

SEQ ID NO: 12970 - DNA, 527 bp, Glycine max
  misc_feature (490)..(490): n is a, c, g, or t
  Peptide Sequence Number=SeqID_129748
atggccttagaggatagtctcggcctgacggccaccgcctttggctttgcttcgggaatatttttcatcggttattttatgtttgaaattcccagcaacgccggcacgattaagttcggtccgcggctgtggttcgcgcgtattctgatcacctggggaatatttgccactttgatggggttcgtcagaacgccgaccgaactctatatctgtcgttttatgcttggcgtgtgcgaagccggtttcttcccttcagtggtgtactacttcacgatcttttttccgcccgcctggcggaccaaaattctcggcatgttcattattgtccagccgctatccaacgccgtgggttcaccgatttcaggcttaattctgcatatcgataacggctggtttggccttgaatcctggcagtggttatttatcctcgaaggtattccgccgatcgttatcggcctgttcatcccttttattattaagaattcaccgnaagaagtcggctatctcaacgctgaagaaaaggcgtg

SEQ ID NO: 12971 - DNA, 277 bp, Glycine max
  Peptide Sequence Number=SeqID_129749
atggaaagggcaggacggacgaaatcagtgtcctatctttggtttcctcttatctccgatgagagatccttcctccagaaggctgttgcttctggaggaagcaaccttgctcgcctgggcgagctgggtggcaagctcctcccctattttgctataaatagggggaggagtgaagaagaaaagggttcagccttcttggcacttctctctctcgaaattgttgaggaaaattatttccgtgaagaaaatccaagccgaggcgcttcctcttcaacgg

SEQ ID NO: 12972 - DNA, 255 bp, Glycine max
  Peptide Sequence Number=SeqID_129750
atgtcatcttctataaacaggcatgtttcagaagctgcagtcacgaaaacttcgagctatggtgccccttttctcccaaaactcccaaccatcatatccgactcatttctcaaccaaatcacctcccacaaagcccatttttcatcattttttatcctctttcattccaaccgatcaaaatcttcaataacttcatcaaatggccgaatcatccaggaagcgcaagggttcatctacctccgctatgacaactag

SEQ ID NO: 12973 - DNA, 246 bp, Glycine max
  Peptide Sequence Number=SeqID_129751
atgagtgatgtagataatagggaagaggtagatgatggcgagccaaaccataagagaaggcaatctaaatttctgcttttcaggaatactgatgttggggtttctgaagtacctctgtctcagaagactgtcacagaacccaaaatcatcatgcaaacaagaagtaaagttgatcttttggatgatgggtacaggtggcgaaagtatggtcagaaagtggtgaagggaaaccctcatccaaggtga

SEQ ID NO: 12974 - DNA, 414 bp, Glycine max
  Peptide Sequence Number=SeqID_129752
atggcatactacgcactaaatcgttcgacgagggtgtcaaagttgttttcggaccttggtgggagtccattgtaccaagtcaatgttgctcctttgagggatgtagggaagacacgacataaaatcacgtcgtccttggtgtggaggttcgcctgtgttaagaaggcgtccagatgctcatttggatcagttgtcccatcgtactgctcgaggttgagtggcttccaccccaaggggtgtgattccccttgtgtgcgttcaagcaaggtttgggcggattgcttgtcgccttggggacgtctaacacgagcttctagttggtcatgctgccagatgaggatgcaagtctgtgagaggggtctcgcgtctgatgccagactgagtgctaactatggatggatgagagaggattga

SEQ ID NO: 12975 - DNA, 234 bp, Glycine max
  Peptide Sequence Number=SeqID_129753
atgctagccataatcccaacaaaggttcctcaatctccattttcccaaggatacaaccccaaaatgacatgtgcttatcatagaggagttccagggcattccattgagcattgtatgaccctaaaacataaagtgcaaagtctaattgatgcaggctggctaagattagaggaggagaatcgctcaaattgctcgttctacacatttggtgagggtgccgtaaacgacaagtaa

SEQ ID NO: 12976 - DNA, 351 bp, Glycine max
  Peptide Sequence Number=SeqID_129754
atcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttcgtgcgccaaggaaactcaaatctgttaagtgcgactcccgggggcccggagacg

SEQ ID NO: 12977 - DNA, 476 bp, Glycine max
  Peptide Sequence Number=SeqID_129755
gagggtctcttaatgccttccttttcttctcatcggagttattcacaaagacttgccatggtaaagaagaagggggaacaagcacacttggagagcgcagtacaacggatagttgtgcgatgatttacttcacgggcgaggtctctgctcagttggtagagctccgctcttgcaattgggtcgttgcgattacgggttggatgtctaattgtccaggcggtaatgatagtatcttgtacctgaaccgacgggctgtcaagaacgtagaggagggtttcctcatttgggatcctggggaagaggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccaggggtcgcggaccgaccatag

SEQ ID NO: 12978 - DNA, 291 bp, Glycine max
  Peptide Sequence Number=SeqID_129756
atgggggagatgcttgccacccagctcgcccaggcgagtaaggtggcttcatccagaagcaaccgccttctggaggaatcttctggagggcccgggcctagttattacataatcattccctttttgacttacggaatgttacggaacctcacgaattgtgcaacaatgcttccttttgagtttcggcatgtcacggaacttcacgaattgcctgacgatgggtgccaagtacctcaaaatggtcaaatgaaagttgcatgccaccaagcaaaggtccccggacgaaattag

SEQ ID NO: 12979 - DNA, 183 bp, Glycine max
  Peptide Sequence Number=SeqID_129757
atgatgcaagtgtctagagagtattggcggcaacggctaagctctaacagccccccaggcttgaaaaaggaagaaaggaagccacaaccaaagtgtgaaaaatgggttaatggcttgccaagtgtaacatccttgattgttgtcgtcttgacaactcagactctacgacacctcacacggtga

SEQ ID NO: 12980 - DNA, 639 bp, Glycine max
  Peptide Sequence Number=SeqID_129758
atgactggttctggttctccttgtggagcctgcaagttcttgagaaggaagtgtgtgagaggttgtgtttttgcaccttacttttgccatgaacagggtgttacccattttgcagccattcataaggtctttggtgcaagcaatgtctcaaagctccttgctcacctccctgtgagtgaccgttgcgaagccacagtcacaatctcttatgaagctcaagctagacttcaggatccaatttatggctgtgttgctcatatttttgcacttcaagaacaggtggtgaatttacaagctcagctagcttatctcagggaacaagcaggtcagatctatctgaatgcctctgccactgaaaaccctaatgagaaactccttggaaaacctactactttccctcaagatcttcaaagtcggttccaaatggaaaattccaacatggcttcacaatttctccctaacttgtccaccaatccctcaacacactattatgggaacactaatagtctcatggagccaaaccctattggaaattatgaaagttcaggaaccgtagaagaaagcatctcattttctagctttgaagagagttgtaactcaatgtcctatgacatgcaaaggcagtggggcctttcatga

SEQ ID NO: 12981 - DNA, 372 bp, Glycine max
  Peptide Sequence Number=SeqID_129759
atggagttggacactgcttgtgaattcatgcatttttctgtcattaagtatagcacatacccaattttgagttctaagcagatgaaatttttagtggctggggctattgctctcaagggccttggagggattcttttcatactcagcagctcttttggagctttccttttgcttttgcatcaagtgatcactactccaatactgtatgatttctacaattatcacagtgaggacaaagaatttatccaacttttcatcaaatttactcagaatatggctctcttcggggcattgttgtttttcattgggatgaaaaactctattcctagaaggcaacccaagaagaaggctgccaaaacaaaaacatattag

SEQ ID NO: 12982 - DNA, 135 bp, Glycine max
  Peptide Sequence Number=SeqID_129760
gaaattaaaggccagggagatcagaagatcacgtgtatatggacaaaggataatgctgacaagtgtctagcacgaccagtcaaattaaaccaacctcaagcgtttaatatggggccactgcacgtgtatggatga

SEQ ID NO: 12983 - DNA, 129 bp, Glycine max
  Peptide Sequence Number=SeqID_129761
atggcaaggttcgggattatggtggtgaagtcggctggattaagagcttttgatggtgttcttcaatcaaacatcacattgaagactcttgatctttcaggaaaccttgttggagatgaaggtgctaag

SEQ ID NO: 12984 - DNA, 273 bp, Glycine max
  Peptide Sequence Number=SeqID_129762
atgtcactatccactaccatagacttcaagacccctattgaggtatggtttaacaaaccagttgaatactcaatgctaaaggtgtttggatgtccaacatactatcatgtaagtgaaggtcagttagagcctaaagccaaggagggattctttatgggatatggagatgaggtggagttcaagagctccacaatcagaaacattaacgatcagaagcagtttgaagcacctaataagattgatcaagatcttcaaatgaatcctcaacattag

SEQ ID NO: 12985 - DNA, 576 bp, Glycine max
  Peptide Sequence Number=SeqID_129763
atggacgatagagataaggtggacaaaaaccttggttgtatggtccagtatcttgttttctatactggtcattcaatcttctgtaatctggtggaacattcagtcacttttggtcaagatcaattccacatctgttttgtggtagatcaagttaacaatgatcaaccattttatttgtcatctgtttgtgccgtgtcttcaagattctatcaagaagatggtcaaattggagaaattcttcatgacgaaatcaatctacaacaagttgcttttgaaatgacatttgtttggcctttgaatgtgggaaggaatggtgatgaagcctttgcgtctggattatcgatgattgattctactaaagggaagaataataagaaaggaaaaggtggcaagaagagaaaatttgatcctaaggacatatgcaattattgcaaagaattgggtcattggaagcagaattgtccaaagaaagcaaagaaatattatgttgttgctcttgttcagaatgacttttcatcgaaaaacaatttggttcttgttgttggtgaacaactacaacaatattctgaacaatga

SEQ ID NO: 12986 - DNA, 195 bp, Glycine max
  Peptide Sequence Number=SeqID_129764
atggaggagagaatgaagttagttttgccactgttgcagagctcgaaagaacttccttgtgctggaaaatttttacgggatgagaagatagaaattatggagaatcggtgtgatttagaagcacaaccccccatgtacaaggcattcttattggctagcatttcaaacttgaagcgtggacctatgcttaactaa

SEQ ID NO: 12987 - DNA, 321 bp, Glycine max
  Peptide Sequence Number=SeqID_129765
atggatgaagagatggaatcccttcaaaagaaccaaacttgggatttagttaagttacttgaaggcaaacgagtagttgagtgcaagtggatcttcaagaaaaaatctagattgtccattgaagaagttgtctttcataaagcacgtctggtagctaaaggttacaataaaaaggaaggagtggagtacgatgacgttcaatacacttccatacgtgtttttttggccctagtggcaactttgaacatggagttagagcaacttgatgtcaaaactgcctttctccatagaagattggaggaagacattttgatgcaataa

SEQ ID NO: 12988 - DNA, 1112 bp, Glycine max
  Peptide Sequence Number=SeqID_129766
atggcgttccaggatttcgacatgatcaccgagaggcggagaaacgagcagaggctcaagatgaagaagaagatcctcatcagcgtcgtctccgccgtcctcctcgcgtgcgtcgtaggcgccgcggcattcgtcgttgtccaaagaacaggcactaatgcaaagcacgctaccccaatgccacagaacaccgccacgccgcacgtggatcagaactccaggatggtgaaaatgatctgtggatccgcagaatacaaagaaaaatgcgaaagcacgctcgaagaagccctaaagaaggaccccaaattggctcaacccaaggatcttatcatggtgtcaatgattcttgcggagaaggaggttaccaatgccttcgatggaactgcaaagatgatgggcaatgcgtccgaggaagagaagggtgcgtacgaggattgcaagggtttgttcaaggacgccaaggaagagcttgagctgtcgatcaccgaggttggcgacaacgacgcggacaagctctccacaaagggtgctgaactgaacaactggctcagtgcggttatgtcttaccaacaaacctgcattgatggtttccccgaagggaagatcaaggatgatttcaccagcatgtttactaactctagggagcttgtgagcaattctcttgcggttgtttcgcagttttcttccttcttttcgatcttccaaggcgccggggggattcatcttccttgggagactaccagtgatgatgcactggcacctactgcttctggttctgcttctggtgccggtgctggtgctggtgctgggtctgtgttcggttctgatccctcttcttttggtcttggttatgcttctgctcctgctggtggtgttgctcttgctcctggtgttgctcctgctcccggtgctgcccctggcccagttccttctttgcctgctggttcaattcctgcatggacgggctcagttcctgtttgggccggcccatccgagttcttgggatcaaatgaaaagcccacacctaatgttaccgtggcccaagatggcagcggaaacttcaaaaccatctctgaagctttggctgccatcccaccacaatacgacggaag

SEQ ID NO: 12989 - DNA, 2307 bp, Glycine max
  Peptide Sequence Number=SeqID_129767
atgaagagaaaatatgaaggctctgtcagagtgaagcgtgcacaacttcaagccttgaggagagattttgagacactggctatgaaggatggagaatctgtgaccaactattttgcaagaacaatggagattagtaacaagatgcggttccatggcgaaaagatgacagatgtcactattgttgagaagattctgcgctccctaacaacaaatttcaattatgttgtatgctcaattgaagaatcaaaagacatagatgtgttgtttattgatgaattgcaaagctccttgttggttcatgagcaaaaaatgcatagaagctctaccagagaggagcgagcactaaaggcctctaccgctaccaatactcattcctctgatttcagaggaaggggaagggggagaggtagaggtaggggtagaggaagaggagaacgtggaaacagagaagataacaagaatcccagagctaatactacaagcaaaggcagaggacaatactctgacagatccaagctagagtgctttagatgtcataaatttggccactatgcttctgaatgctattctaggctgcctaatgatagagaaaagggggagagttcaaattttactgaaaataaggaagctgaaactctactgatggctattcaagaaggaggaaaaactgagtcagatatatggtatatggatatagtttgcagtaaccacatgagtggattaatgggaaaaggtgatgtcaagataaaaaacaagagtggcttcgtggaaacaatctcaaatgtgttgtatgctcctgatttaaaaagcaatttattaagtgcgggtcaattacaagagaaaggttatgtcaatacaattcagaagggagcatgtgaaatttatgatcttgttagaggtgcgattgcaattgttcaaatgagttcaaacagattgttcccattgaaaattgaaagtattcaaacttgcttcaagactgacatggaagatccatcatggttgtggcactttcgttatggtcacttgaattttagtggactaaagaccctgcaacagaaaaacatggtgacatgccttcctcaaattaatattccttcccaagtttgcgaagaatgtgttgttggcaaacaacatcgatctcaatttcccaaaggaaagtcatggagagcaaaagatgtcttggaactggtgcattctgatatttgtggtccaatgagcttcaaagcaagtgttgaaaatgaagcaggaaagtctataaagaatcttcgcacagatcgaggtggtgaatattgctccaaagaatttgaaattttttgtgcagaacatggcattcgaagagagcttacaactgcatatacaccacaacaaaatggtgtctcagagagaaaaaataggaccattttcaacatggtgagaagcttgctagcaagaggaaatgtcccaaaagcattttggctaagttcaaccttttctgttcaaaatatgacaccagaagaagcttggaaagggaggaggccagcggtagatcatttcagaatctttggatgcataacatatgctcatgtaccagagattgtgaccagcagggatgttgtttttgatgaagaaaacacttgggaatgggaaaggcaacagcctagtcaagtcatttacaacaacgatactgaacactaccaaatatcaacaccttacatgcccgaaaactccacaaattcaactcctataacagctgtaacttcaccaacaaccactagcatcaatgaagaagaagctcaatctcattcccgtgttagaagaaggccaatgtggatgaaagattacaaggtaactggaattcaaaatccaattactcactttgctttgtttgcagattgcgatcctacaacttttgagagtgttgtcaaagaagaaaaatggcgcaaagccatgaacgatgagattgatgctattgaaagaaatgacacatgggagctgtgtgatcttccaagaggacaaaaaacaattggtgtgaaatgggtcttcaaaacaaagttgaatgagaacggtgaagttgacaagtacaaggcttatttggttgctaagggatacaagcacaatatgggactgattacacagaagtgttttcctcggttgcaagacatgacacaattagattggtggtcgcgttggcagcacaacaatcctggcaaattttctagctcgatgtcaaatccgcatccttgcacggatacttggaagaacaaatatatgttgatcaacctcctggttatgttaagattagaattgaggaaaaagtttacaaattga

SEQ ID NO: 12990 - DNA, 454 bp, Glycine max
  Peptide Sequence Number=SeqID_129768
atgcagaattgcaattctgcaacaactccagcagcatttggttgcaagttgcacaaagatcatgaagggaaaaatgttgataacacatttttcaaacaaattgttggcagtttgatgtatctaactgcaacaagaccagacataatgtattctgtgagcttagttagcaggtacatggagtatcctacagaagaacatttgctagctgccaaaggaatccttcgttacttgcaaggaacaagagatttcgggctgttttacaggaagggtacaaagtcaaatttgttgggatttactgatagtgattttgcaggagatcaagatgataggagaggcactttgggttatgcattcatgtttggaacaggtgctattacatggtcctccaagaagcaaccgatagtcactttgtctagcacagaagttgaatttgttgttgcaactgcttgcgctt

SEQ ID NO: 12991 - DNA, 1788 bp, Glycine max
  Peptide Sequence Number=SeqID_129769
atggagtttgtaactcatatcagaaatctttttttgtctactcaaaattactcaatcctacgtcctagtcaaatacagggtagtttgaagagctcatctgagctggatacattgaaggaaaatttgtcttcagatattatgcctacttgcttttacgatacacagaaatctatgaaaagtgaaacagcagatgttttaatgccccttcaatgttctgggactgggaggaactatacaccttctgctcatgagaaaatgtctgataatgtggccaagcaagagggacctgaattgtacaatgatgaaagttccattttgcttcagtcaatatccaatatgatgaatgtggactgtaaggaatttgaagagatgaaacctctatatgggatgaagtatgaaggtggaagtagtggcgactgcaaagatatgagattggaatcagaaaaaaatgtctcatcatatttaaatgattttgttacagataatgctagcttcaatgatttaatatgtccatcagaaaaagtcagagttgattctgcatgctttccttcagtttttcttgatacagttgtttgtgaaagtgataaattgcattatgcggatattaaccaaaaaggggcattgaattttgcccaaccttcagaagcaaactcccagcaacatattgaaaagtcaaagtttcatactgagccttgttacaaggatatctcagactttcaaactgaaccttgttataaggatgcctcacagatgttgaattttcctgctggctgtgagctacatgaagcacttggaccagctttttcgaaagtgggtaaatgttttgattggccaacacaggttaatcaagaaatgaaacctgttgaaatgtcagatgagattagcactagccaattgacttctgaatcttgtccagaacatcttttggaagcaatgctggtcaacattaaccatagtaataatgatgttaatagtgaattatcattttgtacatcaaagcaatctgcaatggcctctgcaaaaaatcatgaagcttctattcacaatgtgcatactattaattcagaaggctatttgatggatcagctctctcttgtcagagaggacaaacaccattctttgagttcatcatcagggatatgtggtgtgatgtcctcaaaaggtgtttcatctacatttcatagttcaaatagtggacagcttgaaaggtcgtctgaaccatccaagaacagcaaaaaaagggccaggccaggggaaagttgtaggcctcggccacgggatagacaactgatccaagatcgtatcaaggagttgagggagctggtgccaaatggagcaaagtgcagtattgattcactcctggagcgtgcaataaagcacttgctctttctccaaagcataactaaacatgctgacaagctaactgactttgctgatacaaagtcaaagttgcatcacaaggaagcagacattcttggatcctctagttatgatcagggctcaagctgggccatggaggtagggggtcatctgaaagttcattcaatattagtggagaatcttggtaagaatggacaaatgcttgttgagatgctctgtgaggaatgcagccattttcttgaaatagcagaagccataagaagtttgggccttaccattttaaagggtgcaacaaaagctcatggtgaaaagatatggatatgctttgtcgtcgagaataccgattatctactagcacattgtatgcttaaattcaattattcacctagctccaccagtcaatcttag

SEQ ID NO: 12992 - DNA, 768 bp, Glycine max
  Peptide Sequence Number=SeqID_129770
atgggtgcggatcgtctgatactgccaacagttggaccgccattaaaacggcgagcggggttgcggaggaagcaggctggaagagggattcagattctcgggggtgttaaagtttctgacttgttaaggggggcaacatgggtaccaacttgcaccaatgactcaaaataccttgacattgcggacacaattgcggttgcagaacactatttaaaaccatgttccctcgttgtagatgttggcaacttagagtatggttttttgctcttggttgttgttcaatttggtttaaagaaaattgttgttgttgtcatcttgtttgggatcttgacatgggaggatgcatattatagcaatcctgatgattacgactcttcagaaaataagcactgccagaagaccttggaacagattggttgtgggaaattttcacacagtgcattagagttagcagtggctaagatgtcatatcatgcatattcattaggagaaggtatcattggacaggtagctgttactggaaagcataggtggatctgtgcagataatcaagttgcaggttctggcttgtcttttgagtttgcggatgggtggcagtctcagttttctgccggaatcaggaatagaagatacatagtaccagaggtactacaagaagccacaggaggtaggttctcctgggacagaaaaactattgctgttgttgctgtagtcccacttggtgttgttcagcttggctctctaaataaacaccatactgttggataa

SEQ ID NO: 12993 - DNA, 168 bp, Glycine max
  Peptide Sequence Number=SeqID_129771
atggtgagcaaagtttggagctttgatggaggcttcaatggtgaggaagaagaagggaatagcaacgtatgccacatgtctccttttgagtggagcaaaaaggggtccactttttctcttgatgtgactcatactcagccacaagaaaagaaaaatctgaccttttga

SEQ ID NO: 12994 - DNA, 399 bp, Glycine max
  Peptide Sequence Number=SeqID_129772
atgaggcagagagacgtagaagtgttggaatttagaaccccacaacacccatctttgggaacaaataattggggtggttcatctcctttgctagcaaggaacgtacccaaggaatcacttgaacaaaagtattcaagactcaactcagttcggaccaaagatgagatctttccagctgattatgagtactatgttgtgaacccttcgaatgagaccggtgcaagtgcaagtagtgccaagagatggaacaaagttagaggagttctgttgaagctaatatttgtgaggaaagagaacaaaacaacagttacattaggttcacgtttaaggaagagaagatggataccgagaatggatcctacaactaggtggccacaagaagatgaaataatattttaa

SEQ ID NO: 12995 - DNA, 700 bp, Glycine max
  Peptide Sequence Number=SeqID_129773
ccagcgcagcagtgtcgccggcgagagcgtctggcacagactgcctgaggttccggcgctcagcccggcgctgtcgctggtcagcgcgctgcctgcggcatggtatgccgctgaacatcagacgccccacccgtcgcctgtccccacgctcccagcccggcagacgctgaacctgcctgaggtggctgtgctgcgcgacatacagcaacacgactatgcggtggattacgatgacagcggtgagccgaaaatgtttagcggcacgctggcggcgggcgctcaggtgcatatttatatcgataatgtgctgatcgaggtggtaaccggcgacgaacagggtcactggcagttcgctcagcccgccgatttaagcgcgacacagcatgttttcagtgcagagttcgtcgatgaacaggggcatgtcagcagccgttacaataagttggttaccgtactgccgcagcctgccgctattatcacgccaattgatgacagcgatctcagcgcgattgattgtgcactgatggaactggcgatgcagcaggatgatattgcgcccgctcttctgccgctgaccttcagcgaagcatggctggatgagtggaacaatgctgacagcacactgaccgccagcggcaatcacggcggcaacctgccaggctgggatgaaccgctggaacatcacattgtctggcactaa

SEQ ID NO: 12996 - DNA, 2694 bp, Glycine max
  Peptide Sequence Number=SeqID_129774
atgtttagcaggcaaaggggtgccagtgcttttagtatattcaaatggaaacatccaggtgcgtcatctctgacagcaggtttacttcaggaagatccgccggagattgaattgtcttattatggaaagatccccagtccaggcagtgagagcccttcagggcttcttaatggtgaaagcctaaatgtagaaccaattgccgatttggatctcttctttgaaaggctttacagctactattgcgagaaagggctatggtgcatcattataaagtggattgttgaacttctaagtctagggttcaccatatgtttttcagggttttttttactatatgttgattggaatgggctccgtaatgctaagtgtgggatggatgcggttgaatctggaattaagccctgtgatcttgctaaagaagctcttcatcaacaccctttaaccccactaacacttaccaaagctattattgttggatacttgggaatattttccatctattggattttttgcttcttgagattctttgctcaactaaaggatactctggaaatccggcatttttactacaacagtctcaatgttaccgacaatgaaatccaaaccatgccctggactacaattcttgaaaaagttgttctggtacaagggtctcgacaactttgtgtggtaaaagatctttctgcccatgacattatcatgcggttgatgcggaaggagaactacttaatcggaatgctcaacaagggtgtgctagctttccctatttcacagtggtttccaggtgctggtcctactgggaaatctagttctaatggaacacagaatcgtgtaatactaaccaagacccttgagtggactttgaattggtgcatcctgcagagcatgtttgatcgaagggattttgtgtcaaatccaaagacattacgaaaaaggcttatggtagttgggcttgcaatgcttttactctctccatttcttgtcatatttatgctggtatatctctttctgaggcatgctgagcaattttataatcatcctagcacggcatcatctcgaagatggtcaaatttgtcaaggtggatctttagggaattcaatgaggtggaccatcttttcaagcaccggattaatagcagtgtattgcatgcttctgattatctcaagcagtttccttcacctatcatatctatcattgcaaaattcatctcttttgtatcgggtggctttgctgcaattctgatcatcattgcttttctcgaggagtctctactagagggccatatatttggtcggaacttgttttggtatgctgctgtttttggaactataactgccattagccgggctgccattaccagtgaggttctggtcttagacgctgatggagcaatgtctatggtggtccaacatacacattatatgccaaagagatggcgtggcaaagaaagtactgaaatggttcgtgttgagtttgaaaccttattccagtatactggaatgatgttacttgaggagatggcctcaattttcctcactccatacttacttttgtgtattgtcccaaagcgggttgatgatatcttgcagttcattgctgatttcactgtaaatattgaaggtgttggccatgtttgcagttttagtgccttcgattttcaagagcatggaaacagtcgttatggttccccatgcaatgcaccacgtagccagaggagttcccaagggaagatggagaaatcattgctgagtcgtttcaaagaatctctaaggttctaccactcctcttttaatcgttgtcctttatcctgccttcaagctttgatagcagttgcaatgagctttcagagtagttacccatcatgggaaccaagtgcacaggggaagcgctttttgctaaatcttagaagattcagagaggaaaagttatctgtacatggaaacatacatacaccttcccatcctagaatgtggaggggtagtcccaatatgggaagcaatagtggagacagaaacaggtttatatccagggaaatgccatatagtacttgtgataatcacttgggttctttgtggttgattgaagccaaccaaaacaatcatccttatcttcttgattggtactatacatcccgatcacatgacacaaatctgggagatgttcctttagaagaaccatttggatctcatgatgtgaatctgggagatgttcatttagaaccatttggagcaatagagcatcgttctagagagtatttgatgctctccaacttgacacagaatgaaagtgggtatgaggaatactcaaacgagtttcaggatggtcgggctgcatcacatcttggaatttccatttcagttcccatcttcagggaaagcatgattcatgatcaaagttgtaatgaactgtcccatactagcaggagtcattggtgggctagaagtgatccacggggtggacagactcagacaagcttttttgagcctccagctttcaacctccaaacatatgattatcatgataagttttctgatagagggtcagaagatcaagatcaagaacaacgcatgtactctagagatgatcacagattatctagaacatacacagatgacttaggggcaggggaatttaatcttcattttgatgatatttacagcagacctccagaaactccccctgcaagcttttga

SEQ ID NO: 12997 - DNA, 375 bp, Glycine max
  Peptide Sequence Number=SeqID_129775
atggatatagaacttgttggtcatggtctctctggcgtggtttggcatgggcttggtcaagtaatgaggaagttgtgtggtgcttgcttatcctgtgacactagaattggagttatgcatatgtttgaatgtgttgtaggaaaaaagggaggttattcactgcaattaagaattctcatacagccagatgtacttttagtgaaaggaaatatttcttactgcaagtacttctcccccttcaaatctttttggaatgtcagtgttgatgctgagattgatcatgatcaggatcgtccagttactctagaacctatcactaaaatacccctactagggggaggtagggctaagcggagtgaaaaaggttttccatga

SEQ ID NO: 12998 - DNA, 876 bp, Glycine max
  Peptide Sequence Number=SeqID_129776
atggcactgaactacaacccctcttacaatcttgtgcatcaagctccacatgctaacacaataatctatcacacaacacaacctgcttcagatttgccgatacttgccatcattgtgcccagcatctttgtcactgctttcatactcatcacctacttaacccttgtgacaaaatgctgctcaaactggcaccaacttaaccctttgagatggatttcaacactacaagcctcacagcatgaacatcaagaccatcaagaccccttcattgcactctctctttctcccatgatgtggaaccatggacttgatgaatctgccatcaaagaaatcccaacacttgaatgcacaaaagcagaagctgagaagaatattcaaagtgtatgtggctgtgtggatgatgtcatagctccaagttcttcccctcaggattctcaattgctatcttacatgggaagtgacgaagattttgtggtcattgaacttgggggacaacatgtggcaacactgcctcagatgatgcaacgagaaagaagtgacacaagggaaagaaatcaaagaatagtagggtatagtagaagtcactctacaaggaagtgtcaccatgtttctatcatgggagatgagtgcattgatgttaggaagaaagatgagcagttttctattcagccgattcgaagatctttctcgatggattcagctaatgataagcaactttacttggattttcaaaccatgatacaacagaataataggcatcaaaatcaggctagtgccagtgaagattgtaatagcagaagtcgaagatcattctttccatttcgatatgctcggggatcgaaaactctggtcgttcctctagagaacaaagtttaa

SEQ ID NO: 12999 - DNA, 129 bp, Glycine max
  Peptide Sequence Number=SeqID_129777
atgtattgtgataggtggttgaggttcaagtccactggacgactaggttgctctacgataatggttgtggagactgtggtcatggagacggtagttgtagttgtggagatggtggttgtgtttgagtaa

SEQ ID NO: 13000 - DNA, 213 bp, Glycine max
  Peptide Sequence Number=SeqID_129778
atggcgtgggcaaggcgttacaacagagggaaggtggagatgaaatcgaatgcttggaggtgcaaaactattcttgatagtggaggcatagacaagtaccccatggaaaaggttggaggttacataacatgttggtgtggtgaagagtgtgggagagggaaggagggattgaatgatgtctacagactaaaagggctaggcaataggcactag

SEQ ID NO: 13001 - DNA, 126 bp, Glycine max
  Peptide Sequence Number=SeqID_129779
gtgggtcccaatgcaaactttgttacattaagtacttctaacctgaaccctccaaagcggtcggtgatggagatggaatggggaattgggtcatttgcgggagatgaaggaaatgagagaggctaa

SEQ ID NO: 13002 - DNA, 300 bp, Glycine max
  Peptide Sequence Number=SeqID_129780
atgccttgggctctttcaccttacccatacccctcatccaacgacccacccccctccttacattggatcagacccaattttcagcaagccgagcagtgccagacaagcatccttgggtcaaaaccactagaggcctacacggcgatagcagctccacctactccaatagaaattgaagcaatgatacacactcttgggcttaatccttcgtatgccaattggtacatggacactagtgccacctcccacatggcatccgagcaaggatttattgatgggggtaaatctcatgagatgtga

SEQ ID NO: 13003 - DNA, 495 bp, Glycine max
  Peptide Sequence Number=SeqID_129781
atggagcatactgttttaactaatttaacggtaagcagcggcggcggctgtttgggtgtagaatgcgacgagggtggcggtgtggggcatgagggacctgcgatcgaggaggtactgcttaacgaggaaggcgaggaatttgacgtagggttgggggaggagcatggactcggcgaaggacgcggccaggaggaggacggtggggtcggtctcgtgggggcgcatgacgcggacggagagggagccgccggaagggaggtcgcagcggtagaggaaggtctccaggaggcggaggcggcgaagctcgtcgttggagaggaagcggccggtgttgaagggatcgtcggagacagtgagggaggaagaggaggaggaatgggtagaggtgagtttaaaagtggagaagggtttcggggagaggcgaggttttgcggaggagagagggaaagagagggtttggatttgagggtcgaagggaaaggagaaggaaaatag

SEQ ID NO: 13004 - DNA, 222 bp, Glycine max
  Peptide Sequence Number=SeqID_129782
atgcctttgatggaaaccttgacacccttgttaggaagagctaatcctagttctaatgcagagaagaaggcagagccatttggcactgtcaatggtggtgtagagggtggggaagaaagggtggttgagcttcttgtccatgaccttggcggtgaacatgacagaaagggagccgtcgttgagtttggcgaggtagacaaagttgatgtcgccggagcctag

SEQ ID NO: 13005 - DNA, 138 bp, Glycine max
  Peptide Sequence Number=SeqID_129783
atgaaaattgtgtcacacggagacagagcagagcagtttatattttcaataagggaactagtggatggcacaacgtttgaagccataaagaaagtgggtgaccctgtgactgggcctgtccacagtgcagttctgtga

SEQ ID NO: 13006 - DNA, 957 bp, Glycine max
  Peptide Sequence Number=SeqID_129784
atggaacatatcatcagaacacgtcatggttctgtatctgttgctgtatatggagaccaggataagccagctctaatcacatatccggatttggctttaaattatgtctcctgctttcaggggttattattttgtcccgaggcatattaccttctgctccacaatttctgcatttatcatattagtccacctgggcatgagttgggagctgctgcaatcgatcaagatcacccaattctttctgtagatgatttagctgatcaaatagccgaggttctcaacttttttggtcttagtgcagtcatgtgtatgggagtaactgctggggcttacattcttaccttatttgctgtcatgtcaaatttactatacttttatggcatgtgtggggtggttaaggaaatattgctgaagcggtactttagcaaggaaattcgaggtggcactcaattgccggagtcagatatagttaaatcttgtcgaaggttgttggatgagaggcagagtttgaatgtgtggcgattcctggaagctattaacgagtatgattacactttcaaaatagtgattctcgtatttctttttgagggaagagtaatgagacctgacataagtgaagggttgagaaaactacattgccgttcgcttatttttgttggggatatgtcaccatttcactcggaggctgttcacatgacttcaaagttagacagacgattcagtgccttagttgaggttcaagcatgtggatcaatggtaacagaggagcagcctcatgccatgttaataccaatggagtactttctcatgggatatggcttgtacaagccatccaagttgagtgtcagcccaagaagtcccttgagcccatcatgcatttcgcctgagctttattcaccagagagcatgggtttgaaattgaaacccataaagacacgaatttctctggaaatctag

SEQ ID NO: 13007 - DNA, 237 bp, Glycine max
  Peptide Sequence Number=SeqID_129785
atggaatcgcacggagacaacataaaatggagacttcaatcccttcttccctctgacgtttggcaaccctatcagagcaatcagagagaaaaaattgaggaatctcaggaacctgctaaagatgccgctatcactgttggaagacaccttcaatggggtcctttaatggtgattttccaccatggagatgcagcggaagacaaaggagaagaggtgataggaggcgccatccattaa

SEQ ID NO: 13008 - DNA, 1470 bp, Glycine max
  Peptide Sequence Number=SeqID_129786
atggctgttttctctaccaaacagctgagtacttcaactctgaccactacattcatcatcttctttgttcgttctgaattcacgggacacggtagcctgagagtttctccttctgaattcataggctcggtgaccacagtaggtgatgttttgcaaaacgttacctccattctcaagtctgagcttagaagtgtcaaaaatgactttcatcttcctgatgctgccgtttccacgtgtcttgatttgttagacttgtcagctgatgaactcagctggtccatttccgctgttcaaagttcccaaggaaatgataacagtacagggaatctaagctctgatttgaggacatggcttagtgctgtacttgcgaatacagatacatgcatggatggttttgaaggtacaaatgggaatgtgaagggtttaatatccactgtaattgaccaagcgaagtggttgctccaaaagttactgaccctggtgaagccttatgtgaatgatttcagcagtagaaatagtagggtaaaatttccttcatggattgaagcagaggataagatgttgctgcagacaaatggggtgcctgcagatactgtagttgcggctgatggaactgggaattttactaaggtgatggatgctgtgcaagcagcacctgtttatagcatgagacgctttgtgatacacataaagaagggtgtttacgaagagaacgttgtgattaacaagaagaagtggaaccttgtggtgattggtgagggtatggatgccactgttatctccggtaatctgagtcgtagtgaaaatttgaccacattcaagaccgctacctttgctgtgaatggcagaggattcatagcaaaaggcattaccttcaggaacactgcaggtccccaaagaaaccaatctgttgctctaagatcagactctgacctctctgtattctaccgatgtgggatttttggctaccaagacagcctctatgcccactcattgcgccaattctacagagaatgcagaatcagtggcacagtggatttcatattcggccatgccaatgctgcaacatttcaaggtgaaatgtaccccaatcgatcgtccggtttctcgatccaattctgcaacatttcagcggattatgaccttctgccatatctcaacaccacttcaacgtacctcggtagaccctggaagccgtattccagaacaattttcatgcagtcctacatcagtgatgtgttgagtccagaagggtggctagagtggaatggaacattgtatttggacactctgttatatgctgagtacaagaattatggaccaggagctaggcttgataatagagtcaaatggccagggtatcatgtgatgaatgattctagagaggcttataatttcactgtggccaatctcattttgggggagctatggttaccatcaaccggggtaacattcactcctggactttga

SEQ ID NO: 13009 - DNA, 267 bp, Glycine max
  Peptide Sequence Number=SeqID_129787
atgattcagaaacacggaccaatgattgggtactcatcgactaacgagaggttcaaccttgatgccgcccacgactgggtggtttcctgcaacatgatgtggttggcgctgtcgaccgcaatggatttggaatccgtggtggtgcacgagattgggcacttgctagggttaggtcactcgtcagtggaagaaacaattatgtttccaacgacttcttcacgaaagaataaggtggtgttggcaaaggacaatattaaagggatttaa

SEQ ID NO: 13010 - DNA, 303 bp, Glycine max
  Peptide Sequence Number=SeqID_129788
atgtttggcaatgctagaaagacttgtaagaagacaaggtggcttggagaaggcatgtggaaccgtctttgtctttgcttgaataagaggaataatttcaaagaacatattctcaaactaggtctgaggctgcatcatctattcgtgaataagagattacccctcttgaccctactttggaggagagtattaagtctaagtgttgggtcgaagttgttggtggaaagaccaagggatgactttacaaggctagagacattgctcgtgattatcaaggtggagatagaagcctcatgcaaataa

SEQ ID NO: 13011 - DNA, 716 bp, Glycine max
  Peptide Sequence Number=SeqID_129789
caccaacacagttggatcggagttgctgaaggttgctccttctgaatttgaggggacagtgagaaccgtcgttgatgtgttgcaagaagtcacctctattctctccgagttcggttctggcttcggcgattcacgtctttctaacgccgtttctgactgtcttgatttgcttgacatgtcctctgatgaactcgattggtctgtctccgccacacagagtcccaaagggaagcacaacagcacagggaacacaagttcggatttgagaacatggctgagcgcagcacttgcaaatcaagatacatgcattgacggattcgacggcacgaacggcatggtgaagggtctagtatccactggtataggccaagtgatgtccttactccaacaacttctcacacagggccaatacccttcatgggttaaaacaggggaaagaaagctccttcaggcaaatgtggttagttttgacgctgtggtggcggccgacgggacgggaaactacaccaaggtgatggacgcggtgctggctgcgcctaattacagcatgcaaaggtatgtaatacatataaagagaggggtttactatgagaacgttgagatcaagaagaagaagtggaacctcatgatggttggagatggcatggatgccactataatttctggtaacagaagtttcattgatggttggaccacgttccggtcagctacttttg

SEQ ID NO: 13012 - DNA, 744 bp, Glycine max
  Peptide Sequence Number=SeqID_129790
atggctctagctagccaaagaaattggtccgtgtatcacttagatgtaaaatctgcttttctgaatggatctctcaatgaagatgtatatgttactcaaccacctgggtttgagataaaaaggaaagagaagctagtctacaagctgaataaggctctatatggcctaaagcatgcccctagatgctggaatcagaaaatcaattcatttctgatcaagcatcgattcaaacagtgcacagttgaatatggagtgtactacaagaaaagagacttattggtgactggaagtgactcctatgagattggaagattcaaggagttgatgaagagcgagtttgaaatgtctgaccttgggatattgacatatttccttagcttggaatttatgtacactggtaaaggaatccttatgcatcaaaggaagtataccactaatattctaaagtggttcaaaatgatggactgcaatcacacaatcactccttctgaattaaactttaggaaggaagacactgaagatgaagaaagggtggacccaacccactacaaacttgaccttagctttgcagtaggagtagctagcaggcatatgcacgaactaaggaagtcacacttcatagcatccaagaggatccttagatacctgaaaggttattgtgacttggataggtgtggtgataagtctgatagaaggagcactataggatatccatttaagcttgttggagccccaatttcatag

SEQ ID NO: 13013 - DNA, 567 bp, Glycine max
  Peptide Sequence Number=SeqID_129791
atggcctcggaaacccaccatcatgtgcaaggcctaacacccgaggaactaacccaacttgaacctatcataaaaaaataccatctattcgaagcatcttccaacaaatgtttttccataataacacaccggattgaagcacccgcgagcagcgtgtggcccttggtccggaacttcgacaaccctcagaagtacaaacacttcatcaaagggtgcaacatgaaaggggatggcagcgttggaagtattagggaagtaactgtggtctcgggcctcccggcctcaaccagtaccgagaggctcgagattttggacgatgacaaacacgtcctaagttttagggtcgttggcggcgaacaccgactccaaaactatcgttcagtcacatccgtgaacgaatttcacaaagagggtaaggtttatactattgttttggaatcttacatcgtagatatacctgaagggaatacggaggaagataccaagatgtttgttgacaccgtggtgaaactcaatcttcaaaaacttggggtcgtggccatggcttcatcaatgaatggacgataa

SEQ ID NO: 13014 - DNA, 333 bp, Glycine max
  Peptide Sequence Number=SeqID_129792
atggcatcttcctttctcctcatagcttgccatatatcagctagcttaaggccagtaattcggggcacccaaatacccttcgtggatggtggtggctataaccttttgtcgcaacatgcccttttgcggacgagcgaggcgaggctcatgggagcgttttccaaaggaggaaaatgcgcggagtcgccaccaacgtttatttgtggaaaacgtcggaaaaaccgaaggaaaccggtcataaagaatattccaagttcgggagttgtatttacgtttgaggaaggtattagcacctctcacgtttgtctcaaaggacaacaaccatatttttag

SEQ ID NO: 13015 - DNA, 402 bp, Glycine max
  Peptide Sequence Number=SeqID_129793
atgggggtagtcgttggtggattgattgtaaggacaaccaatatagtagccatgtcttgcaacgtgatggtcatgaagtcaaaagagaacacaaaagtgttagctgtagtggaccaaaagctcaagaagctaaagatcaagggtagttactcatttgagcaacatgtagtaagggtcaaaatccctaggccaagttcccaaattaaagggaatagagcttatctgaaaccaataagtaatggtaatcggatagctatcatggtgaaggtaatgctagaggaaggtaacaacgtggaagatgatggcatcatcaacacaaggacgaaggtagaagtgtcctttgtgggttatggcattttcttaatccgtttgattgttcaaaaatctagtcgaggaagatga

SEQ ID NO: 13016 - DNA, 1716 bp, Glycine max
  Peptide Sequence Number=SeqID_129794
atggagaacaacatgtacagtgctcgactagacatggctggccgaaattctaccggcatagatgaaattgctcgccatttagcaccaaagccactgattcattgctattcatttgacctcaataaccaaaaccatattataaatggaattccagtgcttgctggagagcaaggtgaacctgcaaatgatgtccatgttgaaggttgcttcttaaaccctgctagtattgcggattcaaattcatttgttacatcacaaggaaagactattgtaggagatgcctcaaatcaaattaacaacaatgattttcaagagcatttagttggaggaaggccaattgcttctgcttcactttctgctgctagaattggccttcaagcaaatttagagagttcagaagctttgccttattcaatgtgttcattggaggcattaggaccatatctattcaataattggcagggcacatcaaaccctttgcctgcaacttttggtgatcatcatcatgcctacgatgaattatccagtattggtaagtggaatgtgaacaagattctgagagctccagaggctgatgggactgagatcctggcctattcatccataggaagcctggttcaaaatggatggacatcatcaaatgttgcaaacttggccaattttgcctacaattcccctcattgtagtaatgagctatcactaagtcttgcaagatctcctcaaactactggtcagtgctcagagatgagctgctccggcgcatcacatagcatgaatggaacgaggtcaggcttggagcaatcctcctgcagcagtaaggaactgtgtatgagattaggctctaacaaacatgtccagttttcatcagcaatattagggtccagatttcttgttggaattcaagagatacttgctcaaattgcaacatattcatttgaaaatgtggaacagataaattgctcagctgctggtgttagagcaggaggagataagtcagcttcagctttcacaccaaagagaacggtagagaataatcaaaatgcatccatgtttggagcacatgtagaagaatctccattggaaggacttgcaactgaatcaaacaaatcccaacttctcatgcttcttcagctggtggacaatggatatagtcaatgtttggatgagattcatactgtggtatctgcattccatgctgctactgaactggatccacacatgcatgcacattttgcgcttcaaacgatctctctcttatacaaggacttgcgagagcggattagcaattgtattcttgccatgggaccggattttaacagcttgtgttcagaagaggagaaggaatggtctcttgaaacatcattcattcaaaagcaatgggctctccaacagctaaaaagaaaagatcagttatggaggccccaaaggggcttgccagaaagatctgtctccgtactacgcacttggatgtttcagaatttcctccatccgtatccaaaggatgcagagaagcatttacttgcagtaaaaagtgggttgacgcgaagccaggtatccaattggtttatcaatgcacgtgttcgactgtggaagcctatgattgaagaaatgtatgctgaaatgagtagaagaaaagcttgtagaaatgaagaaggaatggagatcactcaaagaaccaggataagcatgaaaaatcaaatgttgaatatcaattga

SEQ ID NO: 13017 - DNA, 771 bp, Glycine max
  Peptide Sequence Number=SeqID_129795
atgtatttcccaatgtttatggccaaaaatccaaaatcgactaaagtagtagatcgtcatgccaaagatcctactctaggcgagtcccttcggatcaagtccaccacatctgatttggctcacttcttcatagaagctatctttggcattctagatgacataggttttcctttttaccttttgcaagccaatgatcattttcaaccagatcccattgctcaaactccaagacaacccaagtcttctcctcatccggtttcttttttggctaagaagaagaagagctccccagctagaatcaccattaatccttcactaactccacaaacaggtattattttcactactacaaaaatgatattctatgacatgggatcaaagaagagcggtgcaatcttcgctcgggcatcaccctcggtgtggcccacgacgcgtacaacatcttcttcagcgaaatcagatccgacaacatcagtccctcatgccatcttcgtttttctagaccccaccatcatcgatgaagtttgttgtggcacctaccgtcaactcttccaccctaaacaactcatctctggcaaggaagatgccgccaaaaacttctccagaggccactacactgttggcaaagaaattgtagatttgtgcttggatcctaaaaacaggcttgttgctcgagttggttatttctgggcttctattagaaagtctcatctccaaaacaacttttgtggcattgaggaaaccgatattgtcatgttaaaggattactag

SEQ ID NO: 13018 - DNA, 237 bp, Glycine max
  Peptide Sequence Number=SeqID_129796
caacctgtgtctattaccgctgatcatgatcggtcaatgcttggctcaagtgagcctacagagcttgaatctcaatctgtgtctgttatcggggatcatgaccctcttctcaagattccattgacaccaactaagtgcgtatcttctaatgagttggataatgagcgaaaaaactttcaaatttcacctgctgaagtttcctcgaacaaattagccaagcattctcagcttgaatga

SEQ ID NO: 13019 - DNA, 537 bp, Glycine max
  Peptide Sequence Number=SeqID_129797
atggacttaaactacccagaagagtgctactccaagagctcaagcgaagaaaccaacgatgatatgggaattggaagatcctatgagtgcatctattgcaagagaggcttcaccacagcccaagccttaggtggacacatgaacatacacagaaaagaaagggcaaacaagaccaaacccagtttccaacctccttcttcgagttcaaacaacgttgatgacatcaacaactatgcagatctcgggttctattcacagatttcaagcctctcatccactgctcctattgatgctaatagctaccgtgaagttttctttcctactaccactgcatcaagtgttaggccttcttcccatggtgaggttttgtgtgtggaaaaccaacggggtcatcacgtgtttgagcaagattggaggaagagaaatttgagcttgtacagtactaatccgttgtgttttcatgaaattaaagataagtttgaagagagtgaagagaatggcctggatttggagctgaggcttggttatcttccatag

SEQ ID NO: 13020 - DNA, 1800 bp, Glycine max
  Peptide Sequence Number=SeqID_129798
atgcgtagtgctcccaccatttcatcacaaaaccctttagaaacccttcgtgcctttttctcttgtgccaagattctctcttcagcgcagcaacttcacgctcaggtcatcatcaacgggcttcacaagaaggttttctatggttccaacatcaccaatgtttatatccaatcgggttctcttcctctggccaaaaaggcttttgatcaaatttccgttaagaaccttcattcttggaacaccattatttcgggttactcaaaacgcagtctctacggtgatgttttgcagctttttcgacgattgcgaagtgaaggcaatgcagtggatggcttcaacttggtgttttccgttaaagcgagtcaaaggttgctgcttttgcataatgggaggttgcttcattgcttggccatcaaatctgggttggagggagacctgttcttcgcgcctgcgattttggatatgtatgctgagttgggttctctggacgatgcccgcaagctgtttgaacgatattcttacagaagctcggttatgtggggctttatgataaaggggtatttgaatttttctttagaatccaaagtttttgagctattctcgtgcatgactaattattttggtttcaaatgggatgctttcacaatggaaggtctagttcgagcctgtgcaaaccttttggctgggagagaggggaaagcatctcatggggtgtgtataaagaacaatcttctggtgaatgtctgtttgctgacatctgttatagatatgtatatgaaatgtggagttactcattatgcatttaggttgtttgaaaaagcgaatgatcttaaggatgtggttctatggagtgctgtgattaatgggtgtgccaagaaagggaaattttgtgaagctttgtccgtgttcagaaggatgctggaaaactctattaccccaaatccggtgacattggctggcgtaattctagcttgctctggggtggggtctttgaaacaaggaaaaagtgtgcacggctttgtggttagaaacatggttcaattggatgtggtaaattatacttctcttgtggacatgtattctaaatgcgggtgtgtcaaaactgcttacagaatcttctgtatgatgccggccaaaaatgtagtctcttggactgcaatgataaatggatttgcaatgcatggcttgtattttaaagctctttccattttttatcaaatgacacagaattcatgtgttatatcaggaaaacacgtgcccaactcgattacatttacttcagttctatctgcttgtagtcactctggaatggttcaggaggggttgaggatctttaattctatgaaagattatggcatttctccaactgaggaacactgtgcctacatgataggtgttttagctagagttggtcaatttgatgcagcattatcctttctctcaaacatgcctataaaacctggtcctaatgttttgggagttctattaagtgcatgtagattccataaacgagttgaacttgctgaagaaatagcgaaaacactttcatctttagagcataatgatttatcctggcatgcttcattgtcgaacatatattctgatggtaggatgtggggagtagtagagatggcaatggctgaagaagggttgaataagagtcttggcttttcctcaattgaagtcaggaataagttgtgtctatttagttcaaatgatacacttgcgttcacaagcacaaatatcagtcatacttggaattctctcagtagggaaatgagagaaattgctttgttataa

SEQ ID NO: 13021 - DNA, 1014 bp, Glycine max
  Peptide Sequence Number=SeqID_129799
atggagaagttcctgtgcgagttgttgctggattcctcgcagccaatttccgagcgtttcagagcgctcttctctctccgcaacctcaaaggccccgtccctcgcaacgcccttatttgcgaagacaaacttcgtaccccattgcccagaggctcttcgctatgcgaagccacaagggattcgtcgaatttgttggcgcacgaagctgcatttgcgttgggtcaaatgcaggatttggaagccatccctgctttggcctcagttctcaatgatctttctttgcatcccattgttcgccatgaggcagctgaggctctgggtgctattggttcagatggtaatgttcctttcctgaaaagtagtttggatttggatccagccgaggaggttcgagaaacgtgtgaattagcccttcaacgaattcagaatttaaaagatgctggtaatactgatgaattgtctgcaaatggtgtatctccttttaagtctgttgatccagctgcaccagcgatctctggttcttctgttgatcaactaaggcaagtgcttcttgatgaagaaaaagggatgtatgagcgctatgcagctctttttgcacttcgaaatgatggtggaaatgaagctgttaccgctatcattgattccttgggctcaaaaagtgctctactgcgccatgaggttgcatatgttttgggtcaattgcaagacaaagctgcttcagctgctctatccaatatacttaaagatgtgaatgagcatccaatggttaggcatgaggctgctgaagctcttggttcaattgcagatgaccaatgtgtagcccttcttgaggagttttcggcagatccagagcctcttgtctcacaaagttgtcaagttgctctaagcatgctagaatttgaacgatcagggaaatcattcgagaatgagtggatgcttgagaatggagacacaaacacagtgacatacaaagaaatagaatgcaaatgtggaatttctgatttcaatggatga

SEQ ID NO: 13022 - DNA, 420 bp, Glycine max
  Peptide Sequence Number=SeqID_129800
atggaaggcggaatacgcgaagtcgggaagatcgtcatgcaggacgtgcaagagccccattgccagcgaaacgctgcgtctcggaaagatggttcaatccaccaaattcgatggcctcatgcccgtaacattgacatgcattttcttctcttttctttttccttcaatattcctcaccctcgttcaatacttgaagatgttgaaaacttagagtcacttcgttgggaagatcagcagaagatcagaaaatacatagagagtggcggcggcggcggcggcggtagcagcagcggcagcgcggcaaagtcggactccaagactgtcaaagatactaaatgtggtattgaagtgtcacaaaattctcgtgccacttgcaaggattgcggtcaaaaaattatcaaaggagaggttgggttgtaa

SEQ ID NO: 13023 - DNA, 2607 bp, Glycine max
  Peptide Sequence Number=SeqID_129801
gttcgtatatctactaagcctggtggtcaaggtgctaaaggtttggcttggcaccatgccaagtgtctcatggaactatcaccatcaattgacgtgtataagttatctggatggaacaatctctcatcttctgatcaatcagctgtcagtgacttcgctaaaaaggttttaagaattgatttcttgctcactgcattcttttcaggtggtagtgatacaaaaattgagactgaggagggtaaagaatccacacaacaacaaacttccaaaggtgggataaaacgggggaaggatgttgatagtgagcggaaatcaaaagttgctaaggccaagggagatgtgtctgtgggcagcgcaatgttagtgaaatcaggggaagcatgtgatctggagaagaaaatggagacccagagcaaagaactctgggatttgaaggacgatctcaaaaagcacgttacaacaacagagttgcgtgaaatgctggaagccaatggtcaagattcatcaggatcagaaattgatttacgtgaccgctgtgctgatggaatgatgtttggagcacttggtctttgcccaatatgttctggctttctgcgttactctggaggaatgtaccggtgccatggctacatttccgagtggagtaaatgttcttactctacctgtgaaccaaaccgtattgaagggaagtggaaaatcccagaagaaacaaataatcagtaccttaaaaaatggttcaaatctcaaaaagggaagaaaccagttaggatattgcctcttccatcaccaaggaaatctgctgaaagtcaaatgattgctagtcagcatcatcattcatcaaatagtgaaaatttgcgagatttgaaagttgctatctgtggattacctaatgactcaattgcagaatggaaacgcaaaattgatggcataggtggggtgtttcatgcaaaagtaaataaagatactaactgcttggtggttgttggatcactcaatgatgaagctgagatgcggaaggcaaggaggatgaaaaaaccaatagtcagagaggactatttgattgactgcatagaaagaaagaaaagacttccatttgatatgtacaaggttgaaatgattggtgagacttctagcatggtcaccattaaagtgaagggacgtagtgctgttcatgaggcttctggcctacaggattccggccacatacttgaggaagggaaaagcatatataacacaactttgaatatgtctgatttgtctactggtactaacagctactacattctccagataatcgaggaagataaggggtccgattgctatgtgtttcgtaaatggggtcgagttggaaatgacaagattggaggaacaaagctggaggaaatgtcaaaatctgatgcaatatgtgaattcaaacgattattctatgagaagactggaaacccttgggaggcgtgggaacaaaagactatccagaagcaacctggaagattttttccattggatattgactatggagttaacaaacaggtcccaaaaaataaaaaaaatgatgctgacagcaaattacctcctccattaatagaattgatgaagatgctcttcaatgtggaaacatacagagctgccatgatggaatttgagattaatatgtctgaaatgccacttgggaaactgagcaaaagcaatatccaaaaggggtttgaagcattgacagagatacaaaatctgttaaaaattagcaatcctgatccatccgtcaaggaaagcttactcattaatgccagcaatcggttcttcaccatgatcccttctattcatccacatattattagggatgaggatgactttaagtccaaggtggtgaaaatgttagaagcccttcaagacattgaaatagcctcaagattagttggatttgatgctaacaatgatgattccattgatgataattataagaagcttcactgtgatatatctccacttcctcatgatagtgaagagttttgcttaattgaaaagtttctccagaatactcatgcccccacacatacggactggagtcttgagctagaagaagttttttcacttgaaagggaaggtgaatctgataagtttgctccttacagggataaacttggaaacagaatgctcctatggcatggttctaggttgacaaactttgtgggcattcttaaccaaggactcagaattgcacctcctgaagccccggctactggctatatgtttggcaaaggggtttactttgctgacctggtcagcaaaagtgctcagtattgcttcactgataagaaaaatcctgttggtctaatgcttttgagtgaagttgcgcttggaaatgtctatgagctcaagaaagctaagtatatggataaacctcccgaaggaaagcactctactaaaggactgggcaagaaaatgccacaggaatcggaatatgtaaagtggaggggcaatgtcactgttccttgtggcaaaccagtgccatcaaatgtcaagagttctgagctcatgtacaatgagtatattgtttataatactgctcaagtaagtttcaagtctggtgtctttgccatatcatgctaa

SEQ ID NO: 13024 - DNA, 854 bp, Glycine max
  Peptide Sequence Number=SeqID_129802
catccgctaagcgcaacactcctgcgctaagcgcgaggaagaattcagaagaagatgagctgtacaggttcgctaagcgcaccgcttcagttcatccgctaagcgagaaaggcgtgctaagccaaaaatcactaactttggactgggattcagagctttgcatgtctagggtttctagagagagaaaggtccaagttccaaagagttttgagagattttgctgtgtgaagatctgcagagaccaaatcttgaagcaggagccggcttcttggtatggaaagctaaatcccctattggatcttccctgtagggctgagttgttgtgctttcatgaggaattggggtgcgataagttagttgagtatgtgtgtctcaatgcggtcctggttgagtttagtcttacaagaggaatctacggacgatgcttgatcaggattaggctaaactatcatgaggaatcgggttccccgagtgttcgatactcggttcttaccgttttatactacttgtgtgatccggtgcacttgccggaatcccgaacagttgtgctaatgctagctaagaacagtgtgaaggaaggatctcctttcttcatatccatctcaaaaacaccacctaacaccatggaggaattcttgaaaaggacaaaaactaacaagccacctaagtcggatgagagactgacttacaaaaccaaattgaggtacgatgagtatactcccttgaacgcatcacaagggagaatattgaatgagatcatgaatgtaaagctacaggatgtcagccttgatgttcaaaatattcttgctaccatcgaaaacctagacatgacaccgatgattgcttccagctaa

SEQ ID NO: 13025 - DNA, 450 bp, Glycine max
  Peptide Sequence Number=SeqID_129803
atgaataccaaggtcagaatcagagggaactatcagaaccttcatatcagaaaggaagatgagcaaatgacgtccattggagcagattcagacaacacaaccatggaagctttgtcctcattcctcaaagaaaatggtgacatattcatatggaagccgatggatatatcgagcatagatccaaaattcttctatcacaagttggcagtaaacccttcaacaaaacccgtgtgccaaagaatgaggaaaatgactcctaaacgcctaaaggaaatcgaaaggcaagtgaaggagttgcaagaagttagattcatcagagaaatcagatatacgacttggttgaccaacgttgtcctagtcaaaaagcagaacgagaaatcaagaatgtgtgttgactataccgatctaacaaacattgtccgaaagactcatacccacttgccaacatag

SEQ ID NO: 13026 - DNA, 939 bp, Glycine max
  Peptide Sequence Number=SeqID_129804
atggaattcctaacacaatctcagctaccaattgtagacttcaccaacgaaaatctgaaaccgggtaccgatgcatgggtttcagcttctcaagtagtgcgtagtgcacttgaggatcatggtggtttcttggcactctatgataaggtcagtttggagacatacgactctgtttattctgaaatgatgaatttttttgacctctcaataaaaacaaaacggaggaaaaccactgagaagcctatattcagctattccgggcagctacctgggattcctttatatgaatctgttggtatcatgaacccactcagctttcaggattgtcagaaatacacacacgttatgtggccccaaggaaatgaccatttctgtgaaagtgtcaattcctatgcaaagaaactagtggaattggaccacattgtgaagagaatggtgtttgagaactatggaatcgagacaaagaaatttgacactttactcgaatcaaccgagtatgtgctccgagcctacaaatacagaataccccaagtgggtgagagcaatttgggagtggctcctcattctgacacagctttcataactatattgaatcagaaggtagaaggcttaggggtcaaattgaaggatgggaaatggtttgaggtgggtgcttcaccctcgctatatttggtaatgggtggcgatgcattgatggtttggagtaatgacaggatacccgcttgtgaacacagagttttaataaactcaaagatagacagatactccatgggactactttcatatgctgctaagataatggaaccacaagaggagttagttgacgaggaacatcctctacgttataaaccatttgatcattatggataccttcgtttctttctcaccgaagaggccataaaatctgattccaggatcaaagcatattgtggtatttga

SEQ ID NO: 13027 - DNA, 258 bp, Glycine max
  Peptide Sequence Number=SeqID_129805
atgggtgttttctcaagtgtactaataacaacaagcattgtagttgatgttgtgccaattgaaggagtgagtagtgtagttgccacaaggctcgtcattaaggaaatatgcattctcgatgaactctctcctcattttgaaccgttcttcttcttgttgtttgtgggaagcactgatgtgaagcatcagattgatggactaaagaaatctactcagttagaccttggacataccaacactaacacactagcaacataa

SEQ ID NO: 13028 - DNA, 624 bp, Glycine max
  Peptide Sequence Number=SeqID_129806
atgaaaagaagaagtttgagcatgaattaccaccttgtatcttcacgaatcacctcatcatcaccctcttataattttctgcttggtggtggtgtggatgaaaattcagataaagcaatatctgatgggtacatagccaatgtcggtggtggtggactcacttcaacaactcgtcatcaagaaaggaaaaaaggtgtgccatggaatgaggaggagcaccggaaatttcttgaaggactggagaagctggggaagggtaattggagaggcatttctaaacattttgttacaacaagaacaccatcccaagtggctagtcatgcacaaaaatattttttgcgtcaaactagcttcaataaaagaaagcgccgtcgcagcctctttgatgtgggaagatatgaaaccacaactacacttgaaccattaaatacttgtttaaaggcaagtggtcaatttgggtccctatttgggactataattacttgtcctcagtgggtttcttacaaacattcagtgatgaattgggccaccacttcaacaaactacactcatcaaagtgctgccccagatctagaactcaagcttgctgttcccaaacaaacagagccatgcgaaagaacttaa

SEQ ID NO: 13029 - DNA, 1512 bp, Glycine max
  Peptide Sequence Number=SeqID_129807
atgagaaaaataattaatgaacgatctcaacttgacccttcaccaatcaccactttcaagtcctctactccctcttgtctttttgctctgctcctcgttttttctcacttctcaacttcttctctctctctccgccacgccggcaaacggtcaccgccgtccaacacgacgcagcaccgccacctgctaacgtgcgccggcggagcaatgtcgcgagcaagatcacgctcaccgtcaccgtgctgcggtgacactcacttagtgctgctgctgcctgtgatgctcgctgttttcttccactcgctccttctgcttcctcactcctcgctcgctattcgccctaccgagtcggatcggatcgaactcgccaacgcgaccgagtccagcagcaacgcctccctctcgcgccctcgcgaaggaaccttcgccgacatgattgatcgcgcgctcgagcacgagttcaccgagaacgaccagaatgaagcagcgcctgatccgggaagcttcaacaacagtgtagcagaacaacaggctgttctggaaactgtggccagagtcacaccaaacaagaatgacacgaaagatgaaaagtcatttcaactacatcatgtattcaatagagctgaggaaaccccaatgttgatagatcgaaaggacaatgtctttatcatttctaactttaaatccaagtatcccgtgctccagctagatttacgattgatttcagacctggtagttgctattgtttcagcaacttgtggtggcgttgcatttgcttttgctggacaaccggtcattaccggatatcttttagctggctccatagttggacctggcggctttaacttcatcagtgaaatggtgcagatattccttcaaaccttgcatctaaatatggataatattgtaggatccctaaatttcagaaatatgagtacctttcagcccccccaagagatccaccctatgttgtctctgcctttccaacgaggaaattcagtcatcacatttcaaaaacccggtctgacccgaccggtcggactggtccaatcgggacccggtggcataaccggaccggtggaaacagtggcacaatttggggtaatattccttttgtttgcattgggcttggagttctccacaacaaagcttcgagttgttcgagctgttgctgttcttggaggcctacttcagatttttctatttatgtgcatgtgtgggcttacagtatcactatgtggtggtaaagcttcagaaggggtttttgttggtgctttcctttccatgtcttcaacagcagtggtcttgaagtttttgatggaaaagaacaccactaatgctcttcatggacaagtcacaattgggaccctgattttgcaggattgtgctgttggattgctctttgcattgcttccagttctgggtggcacctcaggtgtttttcaaggagtgttatcaatgaccaagctttttttttctcttctcgttctcaccttcccaaaggaaaattaa

SEQ ID NO: 13030 - DNA, 783 bp, Glycine max
  Peptide Sequence Number=SeqID_129808
atgggctataggcttcgataccatgttagatttcaacttaaaatcaattcgcaccaagtgaagttgtccaacagatatataagctataccccaagaactgaggtagacgatgtgagacttcctaacaacagccccaacacccatgcaggctggttgtgtactagccatttatctagccccgggctaacactgcgatattggcatcaccatccacactcctcaattccagctaaaagatatggtcaagagtttgataaaaaactagccattgtagttggagaaccaaaactccaaaagccttttataaattccacacctaaatcccatacttccaatgtggactcaagtcccataccttgcaattggattctaacagtgggtcagttacatggatcaaatgatgcttttgtagattatgaggcgagaaactacataaatcagaaagttgaagtaaagagtgggacagttacagaagagtacctgcaaaaattagatgaagcacttgaggttgctgggcataggtttaaccctgagttggttatttataatgctggaactgacatcctagaaggtgatccattaggaaggttggagatcagtcctgaaggaattacccttagagatgagaaagttttccggtttgctcgtgaaaaaaacattcctatcgttatgctcacttcaggtggttacatgaagtccagtgctggagtcattgcagattcaatagtcaatctctcgaagaaatgcttgatagaaacgagtggagctccaaagtctacgtaa

SEQ ID NO: 13031 - DNA, 411 bp, Glycine max
  Peptide Sequence Number=SeqID_129809
agcatcattaacccttcagagggcagaggaagctttctctcctttctcaagagtagaggatgggctacatctctatctgcaggtgttggggaagaaggaatttatgggtcatctattgcttatgtctttgtcatgtccatacacctcactgactctggtgtagaaaagatgcttgatatcattggctttgtctatcaataccttaagttgttgagccaagattctccacaagaatggatatttaaggaacttcaaaatattggaagcatagatttcaaatttgtggaagagcagcctgagatgattatgctgctaggcttgcagggagaagacagggacgaactttcacaagggggagaggagagggaactagcagaagagagatcggtgggaggaaggggaaaagaatag

SEQ ID NO: 13032 - DNA, 141 bp, Glycine max
  Peptide Sequence Number=SeqID_129810
atgaggaaaattctggcaaagggatgtggaagaatcaatcagaggtgcatgtggatgcttgggccttgtgcttgcagtattgctgatggtgaggccaagcctgtggaaggtgaactttcaaaatcattgttggagaactaa

SEQ ID NO: 13033 - DNA, 435 bp, Glycine max
  Peptide Sequence Number=SeqID_129811
atgcttcaacgcctcatgattagtgtcgtctccgtcatttccgctcgacaacgcatatttcccgaatgccatgaattgcttcccgggatccacgtagtgctcacacgtgccgaagaggaagctcttgctccagttcagcagtgcaccgccaggttcgggtccaaaacctcccacgcggttctagaccgagccaagttcagatccataagcggtttcctttctccgatgtcggtgattgagttaatgtccagcattgagaccagacgcatggcacgctcaaagtacttcgcggcgaggtcaaatttccaaaggctatgccacggtgtggtagaggcgacgcagccgcaacaacacacgagtgacactaacatggaaagagagagaggtcgtaaagagactaaaaggggggctaggaaaatcactgttgaaatataa

SEQ ID NO: 13034 - DNA, 708 bp, Glycine max
  Peptide Sequence Number=SeqID_129812
atggcatttttgggagaaacaagcagtcatacaattgtgaactccatattagcttttatttttctgaatggatcgattattcacaatgaaactggtgtttatttccaaagttccactccaatacccattcaagtacctaaagattgtggttttcaaatgctaaaaagcagaatgcacaatacccttcaacaaaccgatgatcaatatttgggtgaaatttactaccgacggtcattcacagatggaggtaaccaatttctctttcaatctatgcaattgaaaaatgatgacgatgttaacacaaaaacaccgaatggtatattaaacttacttcaagtcactatgacccctactcatgatgccctgctatattacaacgggaggtggaacatgtcacgccaacacgactttgtcagttactcgttcacaggaaaaaatccaaaacaatttgacattccttcgggatgcaccatcaatgaactgaaggatttgttcaagcaagttgcacctcaagggattccctcttatggtattcatgaatcacaaacgataaggcgattgttttttcgacaaccaagtcattatgagtatttagacaaagttatcaaatttgaaattattgagctaaaaactgacgatgacatgctaaatgtcttagtacagtctaaggaaacaatttgggccaatacaaattttagctgtttttag

SEQ ID NO: 13035 - DNA, 466 bp, Glycine max
  Peptide Sequence Number=SeqID_129813
atggagcagttcattgataacttgccgccgatggatctaatgcgatcggagaagatgaccttcgttcagctcatcatccctgtcgagtctgcgcaccgcgccatctcctatttaggcgaactcggccttctccaattccgcgacgtaagttttctttcagatccaacctcgcttcctctagattccgattttccttcgcttcttttcttcttcgatttcgtgtccgaggtctgtgctaatactattgtaggaaatgcaatgttaagggggatatctggtggacaaaggaaacgtgttacaacaggagagatgctggttgaaccagctaatgctttactcatggatgaaatatctactggtttggatagctcgacaacttaccaaattctaaactcgctcaagcaatgtgttcacattctcaaaggaacagcagtcatctctttgaattttaatgaaatatctattg

SEQ ID NO: 13036 - DNA, 315 bp, Glycine max
  Peptide Sequence Number=SeqID_129814
atggagacttataactcagaaatgcaaaaagtgaaagaattggagacaaacaaccaaacattgcaccatacagaatcatctacaattatagaaacaacaccatttgtggatagctcaacatgtcttatatcacatatttgtttcaacatcaatgaagagcaaagtagggtggaaatggacatagtaagcaccacatttttagtaaatttggtacatgtgagtggtgctaagtgtagaagatgcatcaaagattcaaaagaatatcaaaggactagaattgacaggtcaagcttaaagacttcaacaagaaaatga

SEQ ID NO: 13037 - DNA, 591 bp, Glycine max
  Peptide Sequence Number=SeqID_129815
atggcggcttacagcggccaccggtggtcttgggtggtgaaaaggtgttacatggccagggaatcaaacgaggaggcagtgggcacgtggctgaccactcgtgatgcaatgatccaaagcttgaccaagaaattactcaaagcccaacaacgcatgaaggagattatggataagcagaggagggaagtgcagttcactaaaggagactgggtcctcgttaagcttcgtccatgtcgccagtcaacggcttcaggtggtcaatactccaagttagcaaaaaggttctacgacccatttcaaattgttcaaaggatcggacctgtagcatataaacttgacttaccttcaacctcaagaatccaccctgtcttccattggtccttactcaggccttatcactcttcactgaccacaacagaaacacccattcccttgcccaatgcggatgaagataaccaacccctcctcacccctctcacgatattggataaaagtggcacagttcaggggatgacaagcagttactcgttttggtccaatgggatgttctcttaccggaggataccactcgggagccctggacgatactaa

SEQ ID NO: 13038 - DNA, 300 bp, Glycine max
  Peptide Sequence Number=SeqID_129816
atggaggagttgattaacaaaacacaactctctccccaaaataatcccaacgtcatcacgtcggctcctcaacagaatcttatccctgcaccctactgttgtcattttgctcccatgaacaaggttctcgatcatcgcagaatgatgcatgcacctgacctcaactctcagatgcaatgtggtacgtactgtatccaataccaaggaaatagccctaagcgtgtctacacgacacctcacttaggaaaccatgcagtatttgtcgaggccacccagtcgtacaccgtaactcccccctag

SEQ ID NO: 13039 - DNA, 1053 bp, Glycine max
  Peptide Sequence Number=SeqID_129817
atggaggggccggtgttggcttggttccaatggatgactcggaaccaccaactcaccacttgggcaagtttcttggaggccatcgaggctcgttttgcacactcaccgtacgaggaccccactgggatcctcttcaagctaacacaaaaagggtccatgatggaatacctgacacagtttgaagctttggccaatcgcattgttggactgccgccatccgttctcctcagttgcttcatctccgggttggaccccgacatccgctgtgaggtgcaggcgcttcagccgctcaccttggttcacactcctcacaaccctcctccaccacccccgccgtcaaaccccactatttctcctccgccctcaccctctccaccaactctaccattgttacccatcttgcctaaacagccacccctgcctttcaagcgcttcacccccgccgagctggctagccgtcgggaacggggcctatgcttcaactgcgacgagaagttcatgaaagggcatcgttgcgcccctcggttctttctccttgtcgctgacgaagacaaccctaacgaacccctagaccctttaataccatgccctgacccagacctagaagaccaaccccaacccgaaccgcctaaggcccaaatcagtttttatgcgttgtcgggtcaatccgccccgaaaaccctacgcttgttgggccgtatcgccaatcaacccgttgtcattctggttgacggtgacagcacacacaatttcatccaggcctgcctcgttcgccacctggacctcgccgcgcaacccacaccaccacttcgggttcttgccggaaacggaaatgtgattgactcccatcaactgtgtgtcggtgccacgatccaagtacaaggccatgccttcaccacaaacctccttgtcctgcccatctgtggcgtcgacgtggtcctcggtgtccactggttaaaatccctcggccccatcttgacagattacaccacccttaccatgaagtttgttcaccatgggaaaatcattaagcttcgaggggataccacttag

SEQ ID NO: 13040 - DNA, 1158 bp, Glycine max
  Peptide Sequence Number=SeqID_129818
atgaactccacctttggcccatacacgtgtaaattcattatcatcttcttcgatgatatcttaatttacagtaggtccttcccggagcacatggcacatttgcagacaaccttcgaggttcttcatgccaatcaattctttctcaagttttccaagtgcacctttgcaacctcggaggtggaatacttgggacacatcggctctccgtggggcgtagaaccagtgtcggcaaagatagaagcagtccaacaatggccaacccctcaatcggccagggccttgtgggcttttctgggtctatccggtttttaccaaagattcatcaaaggatactccacaattgcagcccccttgacactccttctggcaaatgaggcattctgttggaatgatgcagcggaccaagccttccaccagctgaagcatgctttatgtcacgcactggtgctcagcctgccagattcagacgccggagcaacactggaacttaagaaggagctgagtgtcaacccgacattcgttgattatcaccgtcgtatccaagccaacccccaaaaacacccagattgttccatcagtcaagactttatcttgcaaaatggatgcatatggctacccaaaggatcacaattcatttccaccattttagcaaaatttcacaacacactcataggaggccacatgggtatcgtgaagaccatggcgcgcattggggagaacttcgtctggccgtcgatgaagaaggacgtacaactttacatctccacatgtttggtatgccagcaaaccaagaacgatcatcagaaacgcgtcggtttattgtgtccattgccaatcccgacgagaccttgggaggatctctccctggatttcatagtgggtctacccccatgccgagggaactcggcggtgctggtaatctttgaccgtttctctaaaggagtgcacctcggatcgcttccagctcagcataccgccttcgaagttgctcgcctattcatggaaatttccggcaagatacatggcccaccgcgaatccttgtctccgatagggatcctcttttcattagccatttctggcaggagttgttcaagcttagtgggacgacactcaagatgagcactgcgtaccacccgcagacggacggtcaaatgtag

SEQ ID NO: 13041 - DNA, 1026 bp, Glycine max
  Peptide Sequence Number=SeqID_129819
atgaaaaaacaactacttttatttgccttttcagcgctagcgcttacttcgtgtgaagatgacaacatgcaggcttatgaactggatatgatgaaaggagaatggaagacaagtaaaacagaaattatctccggaaaagacaataaaactgtacttgcctctgatactcccagcggatgtagtaccaaaaatactaccgtgttcagaaccgattattttacttcatatacttcttacgccggagttggtgcagattgtcagcagaatggattaagtgaaggaacctttaaatatgatacagactctaaagaccttaccataacatatggaaatagtggggaactaaaatacagagttgcgattttaaatagtacggaacttaagctccaacagctttttggcaatatagatattaatggagaccaggaaaaaaaaccgatgttctggcaggacattcaaaatttcaaaaaattagataaggaaactccacccccaaaagatgctattcttttaatcggcagctcatcttttacaagatggacagatgtggcgagttatttccctggtaaggtaatcatcaacagaggatttggtggctcaaggttaacagacctgaatgcctatgctgatgatcttctcgctccttatcaacccaaacaaatcatcatttattgcggggataatgattttgcagacaatcacgatttaaaagcagatgtggttgtcaagcgttttaaaactttctataaaaagattcgtcaaaggtttcctaacatagaagtcgattacatttcaattaaattttcgccaagccgggaaattctctggccacaaatgagagaaaccaacaaacagattgccgcctttatgaaaaaggaaaaaaatgctgaatatattgatatcactaaggcaatggaagatgcgaatggaaatgtaagaagagatattttccttgaagatatgcttcatttaactccggaaggaaataagatctgggcagatgtgataagaccttatatgaaatag

SEQ ID NO: 13042 - DNA, 237 bp, Glycine max
  Peptide Sequence Number=SeqID_129820
cacaaaatttcgtgctcttctctccgtctcccttcattcatctccttcttcctccaagctcttatccatggcctcctatggtgcaaaggaatctattgatgaagaagatcctaggcctacaagctccaatggagcttacatcactcagaccctccaaatgcactcaatgtcatattcaagtttggcatcatcaaagccaaaaagggagagattgttagagatagggggaacaacatg

SEQ ID NO: 13043 - DNA, 705 bp, Glycine max
  Peptide Sequence Number=SeqID_129821
atggctgcgtcaccgaatcttgctggacggctacatcacagcgtcccactgacgctactgacggccgccctcgtcgcctgcgggggagccggtgaaacggtcacccataccgtgacccagaccgtcaccgatcagacgacgatcatccatgaggacggcggatccacatccggaaagaagcccaaggacgacgggctcgcgtgggtgccctacggccccaaggaccccgccttcccgacgccgggctgggacgtatacgtctacttcctcaaacatgactgcgacagcctgaagaacgttcaaaaccccagcggcaatctgtacgacgccgcggtgggggtgtgccgtgccgcggtgaacggtgaagagagccaatgggatgcggcggccaatgccttcgcggcgcgcggggcgggaatcgagatcggcccggcgcagtgtgtggacgacaccatcgccgcgatgatcaccaaactcctggcctggcatcgggagaaccccgggcgccagcccgccttgacgttcccgcagaccgacggccgcaccgcatgctcgaaggacaacaacagctttgtgccgccggatgagaatggcgataccggttcctccacaaccagttccaccacgtcgagcaccacctcatcgacgaccacgaccacgaccacgacgacgacgaccacaacgacaacgccgtcggcgcgatga

SEQ ID NO: 13044 - DNA, 911 bp, Glycine max
  Peptide Sequence Number=SeqID_129822
atgacgttctcgtccgaacacgacgactttcgccgcactatccgcaggtacatcgaggaaaagatcaacccccgcgtcgacgagtgggaacgcgagcagatgatgccgctgcacgaggtgatcgccgatatggccaagctcggattcgtcggtctggaatacgaccctgaatacggcggacaaggagcggatcacctcttcacgttggtccttgccgaggaactcggccgggtggatcacgggtcctttccgatggccttcggggttcacgtcgcgatggccaccccctcgctgcacaaacacggcagtgatgagctcaagcgcgagttcctggctccggccttgcgcggtgagcagatcgcggcgatcgcggtgaccgagcccgacgccgggtccgatgtggcgggcatcaagactcatgcccggcgtgacggtgatgactgggtgatcaacggctcgaagatgttcatcaccaactccgttcaggccgactggttgtgcgtgctggcccgcacctccgatgagggtggctatgcgggcatgagtcagatcatcgttccgaccaaggcccccgggtacgaggtccgcaagctggacaagctgggcatgcacgcctccgacaccggtctgatcaccttcgacgatgtccgggtgccggtgtccaacaccatcggcgagatcggccgcgggtttcagcagcagatgtcgcagttcgtcatggagcgcatgttcggcgcgtacggcatccccgcgagtgtcaaccgggcgctacagcgcaccaaggaatatgcgttggcgcgccacgtttttggcaagccgctgaccaagaaccagcatctggcctaccaatacgcggggctggcggcgcgggccgacatgctggaggtctacaaccgtgacatcgccgagcg

SEQ ID NO: 13045 - DNA, 154 bp, Glycine max
  Peptide Sequence Number=SeqID_129823
atggcttcggcgacaggccgtatcgcgctaatgccgctgtggctcggcgctattgcactatccctggccatccccgcggttgccgcggcggcgccggcactcccggtcggcggggagtctccgtcgcaaaccatctccgatctcgaggatcagg

SEQ ID NO: 13046 - DNA, 943 bp, Glycine max
  Peptide Sequence Number=SeqID_129824
atggatgagttatgcaaacgagccaagggctacatcgatatggaagaaatgttcagattcaggaacgaagtcagacaagctggaaaaaagtgtgacaagcgggaagaaggcaccaaaactgactcacacaatttggataagaggcacaagccaaacaagcgccagcctctcccaaaagggctcaggtacgagtgttacatacccctgacggccaatcacactataattctgaaggaagctttcaactttgaggtacatatcgggctacccccgacacaacctcccacgccgagtttgttaaaaggccgaacaaccaccaaacaggagcaagacccagagaacagcaagaggagcaacaaaggaatcacgatgcaaacagaagaagagatagaatggaagatcaaggtagacagagacaccaacaacagcgacgcgagcgacaacctctacaagaacaggaacccacccaacaaatcagaggacttcaagggtatcaaccccataaatcgagacgatcccatggttgtctccatcatcattgcaaacttcatggtgtccaaggttctcatcgaccagggcaattccactaacatcctatattggaaaactttccagaggctcgaggtctcccatgacactgtccatccttatgtcggtccacttcttggctttgcaggcgagagagtagagaccagagactacgtggacctaatgaccactttcgatcaaggccagctctccagaagtttcataataagatacttacttgttgatgcaaatagatcatattttgctttgattggcaggaagacacttaacgagcttggagccatagtctccatgccgcatttgaaaatgaaattccccaccctgatcaaggagattgtagcaccatatccttatactagggagcctgccaagcctcaccccgtagctgctgaag

SEQ ID NO: 13047 - DNA, 617 bp, Glycine max
  Peptide Sequence Number=SeqID_129825
atggcgctctatgctggcatagactgcggtacgcaaggcacgaaagtcgtgattgtcgacagcacacagggcgtgatcctcggtgagggcaatgcccctcaccgcctcatcagccaagccaatggccggcgcgaacaggaggccgactggtggattgaggcgctagtcatcgcttttcgccaagccgtgactcacgccggcgttgatgcacgggagattcacgctctgggggtctcgggccaacaacatgggtttgtgccgctggacgcagatggcaacgtgctgcacagcgtcaagctgtggtgcgataccgaaaccgcagaggaaaacgaacggctcctgcaacagctcggcggagccaacggctcgctggaaacgcttggcctgaggatcgccaccggctataccgcgtcaaaaatcctttggttcaagacgcaccatccggcgttgtgggcacaactgcataccgtgttattgccccatgactacttgaacttctggctgaccggggagcgcgtagcggaatatggcgacgcttccggcaccgggttgttcgatgtgcgcacccgtcgctggagcaaaaccgccgtcgatctcatcgacgacagcggccgcct

SEQ ID NO: 13048 - DNA, 189 bp, Glycine max
  Peptide Sequence Number=SeqID_129826
atggagatgcagcagaagacaaaggagaagaggattgcatcagagtgcaacaccagagcagacctgctctccaagctgaccagcactaaaaagaccgagcacctcaagattatcatccagaagacactccaaactcccaccatagacactgaagaagttatggtcggagaagaggaggaactagactag

SEQ ID NO: 13049 - DNA, 264 bp, Glycine max
  Peptide Sequence Number=SeqID_129827
atgtcatcagataaagcggatcatcgacctccggatggggcttttaaggtggttttgtcagagacacagttgcttgttcatgaaacaaatgcaatctatgtgacacaatccaggtgggatgaaagccttgactctcttaaatatttgttccctaaaacatatacaaaggaatccatcattcctgcagataagaagaaaaggtacctagactctatgatgctttccaaaatgtaccctttcgggaatttcagtgttatggcctaa

SEQ ID NO: 13050 - DNA, 426 bp, Glycine max
  Peptide Sequence Number=SeqID_129828
atggaagcagccaactgtttgtcttatgaaagccaatttggatgcctctgtgaagaagaatatggggacttggaagtagatccagcttcaaagataggagctgcaggctcaatagtaggactagaatcagcattgataagagaactagagttggaatttgaatatgttgtgggatcaacagaagtaggactagcaacagaattgctagagagttttctttggaccttcacaggaacaactaagattaagaaactgaataaaaacacggaggccttaacagtgaaactgtcagaaaaggacccgagagaaatttctgaggcggttcccattactgatgtagcaggtggtagatactacaatggactggatcacttttcatggaagtatgctaacacacctccaaaagattcaaaaatctcaacctga

SEQ ID NO: 13051 - DNA, 309 bp, Glycine max
  Peptide Sequence Number=SeqID_129829
atggtgattcctcaaggtatgaatccagaaaagccaggtttagtgtgcagacttcgaaggtctttgtatgggttgaaacgagccagtaggcaatggtatgccagactcctttcacctgaggttgtcaacttgatccacaacaagaagcttcaccaagagacgcttgaagggttgaagactgctttgtgtgctactcaagctctgcttatggacgcagaacacaaacaaggagaacttgtcttggagggctccttcaacatctctagtgaaagggaatatatggcagggaggatgaccaagaggccatga

SEQ ID NO: 13052 - DNA, 861 bp, Glycine max
  Peptide Sequence Number=SeqID_129830
atggcccgcaccaagaaaactggtcaaatgacgtttgaggcagcaaaggaaattgctgacaagattacctcacagggaagttttgttgcccatggatgtcaggatgtactaattgctgccattgggcgaccagaacaccctggttgtgtccgtgcggctagagtcggtgtcacaatcaaacaatactttggacctgctccaaggaccttccgcacgtcttcgtccatggctcctgaagacctagagcaactgatgcaaaaaatcagggaccagctggaggagtcaatcacagaaaaagaactcgcactgcctcctaagcctgaggttggtccttctgctacttgtgtcaacacaaagaagagttgtgttgatccctcagggaacgacccaaacaagggtgagttagagaaatgtggattggacgtcgaagaaaatcctccccacctggttgcccttggaagactttatgatgagtcaaccaccgttcacaacatccctttgggcaatgatcaagtgaaggcaattaacaccttccttgcttggctgacacatcttgtcaaacgtttctcagaacaaggtggacatggccaaagtgggctcctggactttcgcacgtcggctttgagagtggcctttgttaagaggacaagaggggggacctgcaaaacaaaggacttcgatgctcaaggcttgatggaacttggtatttataggaatgggatggagctgcaggttcttgtttatagagcccttgagtatggacaagcattgtccggtgtcgagagtggtaacctcaacaggtgtgagaattgtaggtctgtcaagcttgtcaagcccttgtgcttggcaagtgttgtctag

SEQ ID NO: 13053 - DNA, 2065 bp, Glycine max
  Peptide Sequence Number=SeqID_129831
atgtctcttccctcagcaagcgatcccctcactgccttggacggaattattggtgacttcgcctggaggccactcgtgaagcaggttggacctgctagtggtgttgtgccaccatctactgctactcctgttgttggagaagggggtcaacctgctactaaggttgaccctgttgctactgagattgctcccaatgcccctttctctgtattagctaagaggaagcaggatgatggtgttgggccgtcgggccatgagaagtcgagagcctcttcgagttttcataccctgaggcaagctgcaaggttgacgctcgattcaggtcgcccttcaagtgtgcaagatcttcctccaactcctctagccatcgagtctcatactgctgttgttgttactctttctcctccacctccttctcatttccttgttcaggaggccactcctattgctattgaagtgattgcgccaggtgctttggttggttctgctgtggtgcccttgtccaccgtcactgcaactttactgtgttattactctatggcacctcctccttcctctttggctccaatggtctgtcccttcactgctttggtttcgacttccaccttctctcacctccgtatttccctggatcacatctacacttccaatgatgttgactccttagcggagtgccctaaggtagctagtgccaccatttctctagttgaggctatgagttcgaaccaccaattgtcttctaaagttggtagtgtattggccaagttgctactctccagggtggaggatgttgtggcgaagagggacgagcttgccatgaaggtggcagatctcgaggccctactaaaagagtcaaagtcaatgctgaaggagttcgagctgcgggttgctagggagagggaggccaacaaggagcttgaggagggactgcttattttcaagaagggccttgacttgggtctctttgaccctttcaaggacgtgaaggacagtgttttacttaacgaagatgatattgctactaaagaggaggccgacgaggaagagcagggtactgaggagaaagatgatgttgccattgtcatcatgatgataagtgtggaatctttgatggcacaggaagcaagaccttgtcgaagtagaggtaggaccatggtgggcttccttctgctttgtggagcttgtcccctaatgtttgtgagcaatatgtttgacttgcccctagatagaggtcttgccaaccagtctggggcttctcctctgagggttatcatgagtaagtatgacttccaaccgattgaagtgcgcaaaacaaggggataccttgggttttgtaagagtgtgtatcaaggggtgaaccttaggtttaacgagccttggatcgaggatgtatttgtctcgggttttgacaagcctgtagagctacatcggggcttaccaaggacggaccttgggttttatgagccttgtatgtgcagcatagtggtggcacatactggaggcgtaatgttgtgctcttgcaaacgtgtcacttatcataagtggcacgtactggagacatggtgtcgtgctcgtagatttagtggtgtgctcttgcatacatgtcactcgttgtgggtgacacacactggagacttagtggcacgctcttgcatacatgtcactcgttgtgggtctagagacttagtgctagaaggagggctcaccaagtgtgctccttgggttgcttgttgtgaccctaaatgggccttcccaattgggaccaatctttctcgctcggggatcctttctggctttacctcagacttgccatatgaggtcatcaccagtctcattgttgatggttccccgacttcaacgaggatcatggcatttgtgcgtgccatatgtgagtcgacccttagacttgtcaagtctagtatgcatggccctaaggatgactctattagttacctctatctaatagttggtttgaggatgttcgacagaggtgaattccttcacctcactggtcgtaatttcccgcagtggtcttgcttttatccatttggtgaagtagttaatg

SEQ ID NO: 13054 - DNA, 501 bp, Glycine max
  Peptide Sequence Number=SeqID_129832
atgaccatcacaaactcttgtcctctgataatcttcctatgcttcatgatgcccctttttgtattttgtgacgagggaacgcattcaggaccatcgacccagattttgcattcttctcatgaagacaaaaacaggtccataacagtgtcaatgaaagtagaacatgcacattctgcctctagaaaattttggttgcatggtacttgcacaagcaaagacataagcatctcacaaagccaaacttctacaccaggaatcccacagttcatagtgcaaattgttaacaattgtgtttctggatgtgctcctagtgacatccacttccactgtggcatgtttgcttctgcaagaatggtgaacccaagattgttcaagaggatctcctgtgatgattgcttagtgaatggagggaaccctttagcccctagccagatcatcagattcacatattccaataccttctcctaccctcttgcttttaagtctgccaaattttgctga

SEQ ID NO: 13055 - DNA, 1364 bp, Glycine max
  Peptide Sequence Number=SeqID_129833
atgactgaagagttggataagctctttgatgggttttgcgcctctatcggaggtgtcatctcactcaaactctctatccaagctcacttggctgacgtgcctttagctgctgtgggtgaggtagtcgactctcagatggaaggatatgccttgacggttacaatctccccagtttatgtagggaatttcattgtcagatggggaatggagactatggctccaagctcattgagtgtctttctaccgattaaggcgaagtatgatgtgtttgcgtcaaccaatagatatctgatggatgtcaacggaactgtcctggtcgacaaggaccctagacaccatgaggttcgtgatgacaatggagacaaccacaaggtcttgggtgacggggttgatgcccttgaagtgccattttcgggactagctggactgtcctccgtagaaaaagccgccatcaatggtattgattacacctctaatgtgttgggtgggttatcgttccggaggtctttattcgccatcatgccacttttgctgggcccaacagtcttcgtcattgtgaccagtacagtggtggttgaatgcttccttgagaatcgtggtgcgattggtgaggagcatggaatgcaacgctacctcaggattgagattctggatctagacagctgtgcgcccaaatctatccatgaaccttttgaaggactcatcatctgcttgtcgcagattggccaaggcgaccgaggtcatgcagtgagacttgctagtggcgtactacgcattgaatcgttcgacgagggtatcgaagctgtctatggacctgggttcgcatgtgtcaggaaggcatccagatgcttgtctgtacctgttgtcccatcatactgcttgaggttgagtggcttccaccctaaagtgttgcctatgcgttgggggtgtgattccccttgggtgcactcaggcaagcctcaagctggtcatggtcagcctgtagccttgtcaacttttcctcatggcattgctccatctccgcaatgcggttttggagttaatgtagagtgtcctgaacttcacacgtcggcttggagaggtgcctttgacataaagggggacctgaaaaacaaaggacttcaatgctcgaataagaatttgtgtaaagagagtaaagcaagtatatgttataatggagctcgtatgagcgaaaaagagagaggcataggcttgttgccgtgtgctgagtgtgtaagcagggaaggatggcacgacgtgatttggtcgaatcttgactgggaagtggtggtgcaagacgatttagtcgaatgtccaatctatggtcaaggggaaggggaagggttagggggtgtagggatttg

SEQ ID NO: 13056 - DNA, 234 bp, Glycine max
  Peptide Sequence Number=SeqID_129834
atggcttttgcattatatctctcttcagaattcccaatagcacgtaggcattcacttcaaaggtttcttgagaagcgtcgtgataggcttgggagcaagacaccttatccttcctcatcaactacaaaagtggctgacaacatagagaacaacttctgtgctgacaatgcaccagaactgatttccttgaatcgatccgaggaggaatttcagccaactgtctctgcctcttga

SEQ ID NO: 13057 - DNA, 546 bp, Glycine max
  Peptide Sequence Number=SeqID_129835
atgctagcttcttcgctctccttcctccattcttgcacatccccctcttcctcttccttattgtcaatttcacctccaaaccccaaaccctctcacttcctacctttcgtggtcgaagccaaagacaggacccgcagggaagacaggaccgctcgccacactcgcatcagaaagaaggtcgaagggacgcccgagaggccgaggctgtccgtgttccggtcgaacaagcatctctctgtgcaggtgattgatgacaccgcaatgcgcacgcttgcttcggtgtcgacaatgcagaagacggttgctgatgagttcaactactccgctggccctacagtttcagctacatcagttgctgcagttgaaggctctattggcaacctcaccattagtggggaagtagcaaagaggatgggtgagatcattgcaaaatcctgtttggagaaggggatcacaaaggttgcctttgatcgaggtggatacccataccatggccgtgttcaagcacttgctgaagcagcccgtgaacatggcctagatttctaa

SEQ ID NO: 13058 - DNA, 405 bp, Glycine max
  Peptide Sequence Number=SeqID_129836
atggatgtggttgagtggggtctcgaacttcacacgtcggcttggagaggtcgtgtagagtggttcgatggaacctgtgtttatagtagtttgagcgtggttgctggtccttgtttggctgacatggagggtggacacatgtctccgggtgccatgttggatgcccacatagattttgtgggccatggatggcatggtaaccttgacgaatgtgagagttgcaagtcgatgtggcttgtcaagcccctgaacctagacatatctgacaactctgccctttttctgaccgttggagactggattgaagatagcctttacaggctatctcttgtaacaggcgcgtgcggcacacgtgcaatactcttgcatacgtgtcacaggcagagtaggcatgtactggagtaa

SEQ ID NO: 13059 - DNA, 294 bp, Glycine max
  Peptide Sequence Number=SeqID_129837
atgaccaggatggatgacaggggcctagcactcacgctaggtcatacgcagggagacaacctcacatctccgtcgtcgctagctctcctcgcacccctagaagtagaaggggggaggatcacaataaccgagactagctccccgacagcagcagaaggaagaaaaaaagacattgaggtggacgaaagtacctttagaagtcgaaaggggaaggaagggaaactgaaagccaagagagcacaaggaatcgagaatgaacaaaagcaggcaaggaagcaagaggataatgaatag

SEQ ID NO: 13060 - DNA, 1005 bp, Glycine max
  Peptide Sequence Number=SeqID_129838
atgccgttttgcaacgtcggaacgcagctaccctcccccgtcgccgacgtgcccctcaacaatgacatcaagatattctacagaacttacggtggcgctgcgaaagttttgctgattttgtggagattgaaccaacgttcaggattggccgcgacgcacgaagcgtggggcccacaaatcaagggcttgactggagcaaccgtccccgacgacgtcgtttggagcgaagaagaaggcaatggtggcatccatgtatgcgcgtttgacaatcgcggcgtcggtcgcagctccgtgcctgtcgaaaaatctgaattctcaaccaagatcatggcgaaggatgcaattgctttgttagatcatctaggttggaaaaaagcccatgtttttgggcactcgatgggagccatgatagcttgtaaagtagcagcaatggttcctgatcgagtcctttccttggcattgctcaacgtgacgggtggaggttttcaatgttttccaaagttggaccaacaaacgatctctgttgcttaccgattcttgaaagcaaagacacctgaacaaagggctgctgttgacttggacacccattactctcaagaatatcttgaggaatacgttggaacagataagaggagagccatcttatatcagttaaccagcaatatatcagatgcatttataagacaagcgaaacttacaccagtgttgcacatccctcaatatgttaaaggtatatcaacaactgggatgcaatctaactatggtttcgatggtcaactcaatgcatgttgggcacataaaatgactgaaacagagattgaggtgatcaaatctgcaggctttcttgtttcagtcatccatggcaggcatgatataattgctcagatatattatgcaaaaagacttgctgagaagcttcatccagtggctagaatggtagatcttcatggaggtcatttagtaagtcatgagcggtctgaagaggatgcattggttatggactaa

SEQ ID NO: 13061 - DNA, 279 bp, Glycine max
  Peptide Sequence Number=SeqID_129839
atggcaacaccggagatagttactcctttgtacaaacagaagattttagttcagacagttattcaagctttgaggatgatgatcttattcatggaaatggtattgcttcaatttctaatgtccaccaaggatattatgatactggtgatcctattcattaatgtaattattgtaaagcgcttatctggaatcaacagaggatgtgaaagcacaagcacaccattactcccaaatatcatctttgttttggcaatggtaaagtctagcaaccattattga

SEQ ID NO: 13062 - DNA, 471 bp, Glycine max
  Peptide Sequence Number=SeqID_129840
atgcttcagtcagggaggttgtcctttataatatacaaccaatgtaaactgcgagtagaaaactattctaacttggatgatgtagattccaacaatgaaaatcaaggttctgatataggaaaacgtgtaatcttgccatcatcatttgttggcggtcatcgctatatggatcaactttactttgatgcaatggctatctgcaatcatgttggatttccttatttgtttatcactttcacgtgtaatccatattggaaagaaattcagagattgcttactccattgaatttgaaggttgtgaatcaacccgatattgttgctagagttttcaagatcaaatttcaagagttgctgacagaattgacaaagaaacatgttctcggcaaagtgattgcgtatgtgtacataatagagttccaaaagcatggattactgcacactcatctaattatcaactgcaaacatagataa

SEQ ID NO: 13063 - DNA, 408 bp, Glycine max
  Peptide Sequence Number=SeqID_129841
atggtcatctgcacccttttttctatttggagacaatcaagtctgatagcacacggagacaaaacatggtcattcgcaccctttttgctatctagagacaatcaagtccgatggcatacgaagacaaatgatggtcatccgcaccctttttgctatccagagataatcaagtccgatggcatgcagagacaaatgatggtcatccacaccctttttgctatccagagacaatcaagtccgatggcacgcagagacaaattatggtcatccacaccctttttgctatctaaagacaatcaagtccgatggcacgtgaagacaaattatggtcatctgcttcccatgccttctagagaaaatcaagtccatcgactattgcagtctcctttgccttccagagacaagtga

SEQ ID NO: 13064 - DNA, 138 bp, Glycine max
  Peptide Sequence Number=SeqID_129842
atgttggtggagactccgcgcgtatttctttcttggaacacgcacccgcgagtcacacgtcgccctcttgccgaagggggaacttatttcatggattaccaaatgaggacccctatgcacatctggcaacgtacatag

SEQ ID NO: 13065 - DNA, 315 bp, Glycine max
  Peptide Sequence Number=SeqID_129843
atggaagcgcagacacgaactccacaaacgcgaactcgacaatgtggttgcagtcacagaagcgcaacccggtttgcgacaaacacgaactcagacagaaggagaaacaataataacgccctgggagtaccctttccgggactctttcgtttcctacttttcttcgacctgcgaaatggcaaagacgatctccacagtgtggttgcagtcatggaagcgcaggccagtttgacacaaagacgatctcaggcagaagaagaaagaagaagaacgatagggttcaagcgcgcgggttgtgcaatttcagaagtttaa

SEQ ID NO: 13066 - DNA, 348 bp, Glycine max
  Peptide Sequence Number=SeqID_129844
atgctaaacatccaaaatctcatttatggttatggggggtttcatcagcagactctccttccccggtctgagttcctcattggtggatacgtaggagcaagagcttcgcttttgtcgaccacaccaccttttgttgccatgacccaagagctggtagcccgcggagacaccttacggttatccgcacctcgtcattcagtgaccccaagtgtgattgacgagcagaggccaatgtggtcatctgcgccctttccggaggtgtcagcatcttccggtggagactttttcaagtctcacaaagttatccagaactacgtaggtctgagttcctcattggaggatacgtag

SEQ ID NO: 13067 - DNA, 213 bp, Glycine max
  Peptide Sequence Number=SeqID_129845
atgaagaagatcctaggcctacaagctccaatggagcttacatcatggttgaaattacatttttttgaggggcgaggggagctagagatggcttttaaaggagagtttgaagaagcctcaaaaacttcagaaaataagattcagcagagagtttctcttgttttcaggagctgggtaatcgattatcctaagctgaagaattttccttcttaa

SEQ ID NO: 13068 - DNA, 450 bp, Glycine max
  Peptide Sequence Number=SeqID_129846
atggtcttagaagagagtgtagtgcatgatgtgaggctatcctcagttgggccgggccgggccaccgggtcggacgtattccacaacccgggtggcttggacttggccatgaagcttcactaccttagagtggtgtacttctttgatagtgaggctgcacaagacctaaccatcatgaaaattaaggatggcatgttcactttgttcaaccattacttcatcacctgtggccggttccggcgatcggattccggtcgacccttaatcaagtgcaatgattgtggagcaaggttcattgaggccaagtgcaacaaaaccctagatgagtggctagccatgaaggattggcccttgtacaagttgctcgtctctcaccaagtcattggcccagaactatctttttctcctcctgttttgttccagatgaatgccagtgaagaaatagcttag

SEQ ID NO: 13069 - DNA, 321 bp, Glycine max
  Peptide Sequence Number=SeqID_129847
atgacaaatgtaattttcggtaggcgattctcggaggtgcatgataacaacatgatggtggtagagaattataagttgataagttggagttcgcccagaataattgtcaatctcaggctctcattatcattaattaccatcatcaaagtcagaattatgcccaagaagaccttttacatatataaggccctcttggacaaacaagaagcagggacacacattcaagcagggtttgaaaagatgctcattgcaatccttgacaaaagagacattcacacttatgtgattagtgtcaatgttgatgcttacagtccaaattaa

SEQ ID NO: 13070 - DNA, 339 bp, Glycine max
  Peptide Sequence Number=SeqID_129848
atgaagaatgcgtttgacaagaaggtgcgcttgcgcaagttccatgagggggaccttgtgctgaaaaagatgtcccacgctgttaaggataatcgagggaagtgggccccgaattatgaagggcctttcattgtgaaaagggctttttccggaggggccctggtgcttaccaacatggatggcgaggagctacctttacttgcgaactctgatgttgtcatgcgataccacgcttggaatctggggcaattgaagatgtcgttgcatgttcttttatatttatgtgttcttcatggtttcccccagggattcctgtttgctgtatatttctcgtcatag

SEQ ID NO: 13071 - DNA, 255 bp, Glycine max
  Peptide Sequence Number=SeqID_129849
atgcttgtccatttagttcaagataaaaccgggtggaagctggatatcagattcaggctatttgacgatggtttaggtttccggtatgagtttcctgtccaaaaggatttaaggcattttaccataagcagtgagaaaacaagctttaatttaggaaaagattataaggcattttggatccctgccgattatgatacgaatgagtttccggttactacatcaaatctgtccgaaatttcaaatctgatcgatgag

SEQ ID NO: 13072 - DNA, 526 bp, Glycine max
  Peptide Sequence Number=SeqID_129850
atgtcgacacttatggggcggatagcccataccgtatatacctatggcctggatggagttgatcttgacgacgaatatgcagattatggaaataacgctaccggacagccgaataacagttcttttgttatgttattacaggagttgaaagctgccatgccggataaattaattacatggtattacattggcccggcaacaacaaggcaagcttataatggagataatgccggaaactatatcaattacggatggaacgcttattatggcacttataatgctccttcaatacctcctcttgccaattctaaaatttctgcggcagcaacctggatccagaatacttctgcttctacactttctactttagcaacgagcacaaagaatgacggctatggagtttttatgtggtatgatcttaaaggaaccaatgctgccagctatctgagtacgggatctaacattctctataacgagaacacacaacttagtggtcagctgtatacctggacacagggagcatcat

SEQ ID NO: 13073 - DNA, 174 bp, Glycine max
  Peptide Sequence Number=SeqID_129851
atggcaatgagcgaaaaagccacgtcatcatggcgcgatgtggcgatggcagggaccattcttgtcatcatcaatggaaatgcaagaaagatgtgtgagatagagaatgggaagagagtcactgtggtggtgtgtggcaacatcaacggcttcgtcgctgcttggatcgaatga

SEQ ID NO: 13074 - DNA, 435 bp, Glycine max
  Peptide Sequence Number=SeqID_129852
atgtcaagacacgacctggtacacgtagaggccatggcaggtactaaggtagtcattggagcatcttcagactttgcccatattaaaggtcatcaaccttacgcaagaacactcactctcaaacccctctatgctcagcaaaacaatgccctactaacgaccttacactatcttaaggatcatccatactcggatattgatgtaagctctattggagcttgtaggcctaggatctttttcatcaatggattcctttgcttcttggagaagagagagaggagacgccacttccaggagaagatgagtctagaagaagctcaccaccataggaggccatggataagagcttggaggaagaaggagatgaatgaagggagagggagagaagagcaagaaattttgtgctctaagagagctctgaaatctgaagtttaa

SEQ ID NO: 13075 - DNA, 234 bp, Glycine max
  Peptide Sequence Number=SeqID_129853
atgtcgagggacaaaattatgttttatttgagattgagagtatgttacatgcgcttggcttcgcggcctcaaaggattacacgacccaaggagttgcggtcctataatctggtttttggaatggacaagagatgctggttcatccctgcttattcagaggaagatatacgaaggatggctgttcttcagggccttgagtatccatcaacaccagacttcaatgccccagagtag

SEQ ID NO: 13076 - DNA, 237 bp, Glycine max
  Peptide Sequence Number=SeqID_129854
atggatatgcataaagttgcaacacaaaacttagaatataggaaaaaaaaagggggttatgttgaaggcgagtggtggattgtacacttaagcagacgtgtgaggcccaacaacctaactaaagagctggtggggaatcaacaggagttgattgcattctgtgaagggagtataggccaaaagcagactctcgtagtgagattgaattataagttatccctttatgaggatgagtga

SEQ ID NO: 13077 - DNA, 492 bp, Glycine max
  Peptide Sequence Number=SeqID_129855
atggtttttcacttaaggcttgtaatgagctcaaaacaaagaaaggggaacataggctcaaaggggctatcaaaggaattaattcagggtaggctcatttggctagaggcttataagaataaaatgcctaaatcatctcccaacatgcatgtgaagcaagaagtatcaacaagagtcaagccaaggctattgtgcaagcaatcaatggggcaaaacacaccaaataaaatagatgatgatgactcaaattctcaccaaggcacaataataagatcaagaacaatcaaagtgtcataccctaatttcgtccggggacctttgcttgatgacatgcgacctttctttggtccttgtgaggtgcttggcatccatcattgggcaatttgtgaaattccaggacatgccggaaaaccaaaaaatattgatgcacaatccgtaagtttccgtgacacaccggaaatcaaatggaagcatcgttgcataattaagtga

SEQ ID NO: 13078 - DNA, 354 bp, Glycine max
  Peptide Sequence Number=SeqID_129856
atgacccaaaagttaagattggaaagtgctgtgacaaagggcatagatggattgtgttcaaaaaccatagctgattgtgttgaagccctcataggcgcttattatgttgggggtgggcttactgctgcacttcatgtaatgcagtggctgggaatgaatgttgggcatgattcaccattggtacatgaagccatcaccaggacattattaaggtccaatgtcccaaaagcttattatatcaattccttggaactaaagtttgggtatgaattttccactaagggtttgttattggaggccatgacacatccatctcagcaagagctggaaccgggaatttgttattgttaccag

SEQ ID NO: 13079 - DNA, 435 bp, Glycine max
  Peptide Sequence Number=SeqID_129857
atggcaaaacctatatctaaaaagggttcgcgtaaaaatgtacgtattggttcgcgtaagcatactcgtaaaataccaaagggagttattcatgttcaagctagtttcaacaatactattgtaactgttacagatgtacgaggtcgggtgatttcttggtcctccgccggtacttgcggattcaaaggtacacgaagggggacaccttttgccgctcaaactgcagcaggaaatgctattcgaacagtatcggatcaaggcatgcaacgagcagaagtcatgataaaaggtcctggtctcggaagagatgcggcattaagagctattcgtagaagtggtatactattaaattttatacgagatgtactcctatgccacataatggatgtagatctcctaaaaaaagacgtgtgtaaaactaaaaagaaacattga

SEQ ID NO: 13080 - DNA, 285 bp, Glycine max
  Peptide Sequence Number=SeqID_129858
atggggttgaaccaagcacatgcttttaagaaaagggtttcatcaagtcaaggtcaaatatggaagaaagaacgtgctttacgacgcccttaccaaacgggtgccgaagctagagtgatgagtgaaatagaggaggtacaggaacagatgaaggctgacatggaggccatgaaagagaaaatgaccacaatgatggaagccatgatgagtatgagaaaaatggtgggggtcaaatgttcgcttctggcaagtgcattggatcgcacaagtagtataaaacggtaa

SEQ ID NO: 13081 - DNA, 334 bp, Glycine max
  Peptide Sequence Number=SeqID_129859
aatcctcaaagaagtgaaaagaggatcttcctccaccaccaccgttgctggtcatcgccgccaaggaacctctagagacccacccacaccagttcctccatctctttcatctcctcgatcaaccacattattttccttagatgatcagtgtcaaagtattcccaatgttgttgatcagtccttgttttattcgttgactaagctacccattcaaggtgttccttttgagggcactcttgttgacgattggaaatttgattattctagtcatgatgctcgcagaatgactggtcgtcagattgactgggcccatctagttcggtaccggatgtaa

SEQ ID NO: 13082 - DNA, 273 bp, Glycine max
  Peptide Sequence Number=SeqID_129860
atggctttagctatctcagttgggcagcctgatacttccactattaggcctaaaaggggtagaattaggttgagcttagctcatcagtgggctaagcgtgcatccaccgctaagtgcagcttcagtgtgcttagcgcaatagaagaatctggtagagcatcaatatcaaggctgcacgttaagctcgagatcagtacgctaagcgcaacagttatcttcagccaggctcagcgcacgactagcgctaagctcatctccacttactcgcgctaa

SEQ ID NO: 13083 - DNA, 531 bp, Glycine max
  Peptide Sequence Number=SeqID_129861
atgattgtgtatgagcaagtatgcaacgattcacttgaacagtacttaacaaggggaagtttccagtcattgacttcgaagcaaaggctgaaagtggcaattggtactgccagaggtttaaagtacctacatgggaataacataattcatggaaatataaaaccaagtaacattattctaacacatgacttcgaaccacggattggagattttgactttggaaaagtgaaacatggaccaaagaaatccagcaaagataatagtgtacggaattctggatatgcagcagctgagtatgttgagaatggaaaagtatcaaataagacagatgtgtactcctttggagtggttcttttagagctgatcagtggccgaagggctacagacaaattactaggtggaaaaagccttgttggttggaaagttatggcttcaaattctggaaacaactttactgatagggcacgtatatcaaccttctccaaaccacacaaggtggaagccttgtgcaatggctcatccttcttttaa

SEQ ID NO: 13084 - DNA, 267 bp, Glycine max
  Peptide Sequence Number=SeqID_129862
atgggggcatacgcaaaagatgagaaactgttgatacatttcttccaagaaagtcttattgggtacaattctgatatggctctggataggatgcaactacagaacatgtgcaaaaaggggaacgaatctttcaaagaatacgcccaaagcattgcagatttggtcttcatcggggaaaggatcgaagcgggtctaaaaagaggcaaattcgatcatcctgctttgatgaatgagaaaagtggggcaaatgaagaggatgagaattag

SEQ ID NO: 13085 - DNA, 231 bp, Glycine max
  Peptide Sequence Number=SeqID_129863
atgggggagacacatgaaattccccaccacaatctagccgacttcgagccttgcctcgaatatgccactgaagggcatgtagttggtggtatactcctacaaaacactttggagggccctcaatttcgcccccaaccacaacccttgcattccataacaggtaaaatccctcctattatggaaggaatgggaaaagttggatcatctagaggaaaggctcagggtcgttga

SEQ ID NO: 13086 - DNA, 633 bp, Glycine max
  Peptide Sequence Number=SeqID_129864
cacgtcctcgcctttagaggacaacacgccctcgccttcagaggactacatgttctccccttcaaagggctacacgtcctcaccttcagaggattgcatgtcctcgccttcataggactgcacatccttgccttcagaggactgcacatcctcgcctttagaggactgcacgtcctcgcctttagaggactacacgccctcaccttcaaagggctacacgccctcgccttcagaggactacacgtcctcgccttcagagggctacatgccctcgccttcaaagggctacacaccctcgccttcagagggctacacgtcctcgccttcagagggttgcacgcccttgccttcagaggactacacgtcctcgccttcagagggctccacatcagcgccttagaggactcaagggatcgcgcctacaaggcactcaatgggcccggagaagtccaacagggtcctagggtttccaactctgattacgagcctccgttagttctatggagtgctcgtcgcccccagcagggtcatcatgcccctattaacagggctttcatcgagaagtactgcacccccaggcacagggtgaggcatcacaatagcgggcatcagacgcaccgccaccacctctag

SEQ ID NO: 13087 - DNA, 686 bp, Glycine max
  Peptide Sequence Number=SeqID_129865
atgccaccgttgcttttgttgaggccacaaggtcaaaccaccaactgtattccaaggttggtggctaagaagatgaacttgggtggcaaagtggagagcttggcggttgagaaggacaggcttgccaaagtagttgctaatttagaggcccgacttaaggagtctgagtctaggctgggggaacaggcctatttctttgtgaaggaccttgacttaggtctcttcgatcccttcaaggatgtgaaggatggtgtcttgcttgatgagaaggagattgttgtggaagaagaggctgctgatgaaggtcttgtcacccatctgatggggctttcttctattttgtggggcttctcccctgatgttcctcctctgatggttatgaggagtaagtgtgagcggcacctgattgaaggtcttgtcatggtgggtcatttttacctacaaaagtactcctttgatggttgtgagaaatcaagggggtaccttgggttttgtagaagtatgtaccaagggcggaccttgggttttggtaccgttgcaacctacccttcggtgggagggcaacgcgaggctcacgggtgcatcttccaagggaggaaggcgcgtggagtcgccaccaatgtttattcgaggaaaacgtcggaaaaaccggaaaaggtgtggtctacgaactttaagcgtgaaag

SEQ ID NO: 13088 - DNA, 1328 bp, Glycine max
  Peptide Sequence Number=SeqID_129866
ccccgcaagctctgagccggcttgcggagggtcatgagtttgtcaagcccccaagtatgaatgagtgttgtcctgtgtcaggtgtggaaaccttgaccagtctaagagaattgcaagtcgacgtggcttgtcaagcccccgagcttggacaagtgttgttcgggcttgcattgaagacaaacgttacttttgtctactgcaacagacgtgtgcggtgcatgtgcaacactcttgcatacatgtcactcatggaatgggcacgtactggagtagtggttcatgcgtcattgttcattgtcttcttgcttccttgctttcttgctagcttttgtgctttctggctttcggtttccatttcttcttcctccaacttccaaaggtctaaggatactcaccaaggtgcgtccaataacgagtcatcctctactaagagggtgagggcctcgcgtcaaacaggtgggggtgcttctcgccctagaggagggtcatggctttccgctactgccggggagcctgtcccagtcacggtgaacctccccccttctgcttccgggggtgtgaggaaaggccgtggcggtggacatgtgagggcatctccctgcatgcgacgtagcctttgtgttaggttgccgttgtccatcccgaccattgctggctatgagtgggtgaagctggaaaaccctaaggactcctgtcctgggtgtcaatttacccttgaccacttttcagtgtgctctactggagcacttgaatgtggccccttcctaacttcacctaaacagttgggcgatggtgaccattttttcaaggtcttagttattgatgccatggatgatgacatgccactaatgcttaatagggatagggagccctgcttcccgttctactgggagtctaaccccactaggttcaagtcttatgacaaggatttgttgacctttgtggatagggccattttgtctgttccttcagtgagcgatcctctcgctgccttagatggtattatgggtgacttcacctggaggccactcatgaagcaggttggtcctgttgctattgctgttgaggtcacccttaatgctccttcctctgttttggcaaagaggaagatggatgatattgttgggtcatctggccacaagaagttgaaggcccttatgagtcttcacgcccaaagatgggctgcagggttgatgcccacagcgggttgcctttcgactgtgcaagatgtgcctctggctccactgaccgtcaagactcttgctactcctgctccttcacctcctcccgcagttgctattcaggaggttgcccatgctgctgatgaa

SEQ ID NO: 13089 - DNA, 741 bp, Glycine max
  Peptide Sequence Number=SeqID_129867
atggtcacttcctctcaacgcaccaacaccatagagcaacatgcttctactaacactatgaggagcataccattaccaacatcgatagtgtcttcaacaaaatcaaaccaaggcttggagttactctcaatccctgggcatgaaaaggaatgcaagaaaatgagaaacgtgggatttttagggcctttcctcccaaggataggaaaactttcttcaattggcttgctagggtatacgccaaagaatcccaacactagaagaacagatggagtcgcgtggacactcaaacctgcttctgtcattttccagcttcatccatcaacactgcgtccgcttaggcatgtggctaagtccctcgtcggcacctccattttcaccgtcaacaattccaacaacgagttcgttcttatctccgaccccgacggtgccaagtccattggattgctttgctttcgccaagaggacgccgaagcctttctcgctcaagttcgatcacgtagtagagagcttcgaagcaaggctaaagttgttccaattactctcgaccaggttgaaggcattgccttccgattcttacttgatcctgttcaaataaggaatgctttggagtcagagcttttggctgtgaagaagaggaataagcattactgccctgtgtatttctctaaggaggatattgagcaggaactgtccaaagtttccagggcatcaagagcacctggtgtttctcagcatataacg

SEQ ID NO: 13090 - DNA, 1287 bp, Glycine max
  Peptide Sequence Number=SeqID_129868
atggcaacatgcatagacgaaagagaagataaagctcccatgcacggggatatcttagaggccatattctcgcacgtgccactcatccacctcgtgtcagcttcccacgtgtcgcatgaatggaagcgtgcgatctccacctccctccgctacgtcaaccccgccaagccctggctcaccgtgcacatccagagcccccgtgccccacacgtgaccgccaccttcgcctttgacccacgctcccgagaatggtttgaaatccacgcgccgagtcccaaccacatcaccgcccttcgcgcgtcgcactccacgctcctctacatgctctctccccgcgaattcaccttctccctcgaccccctcagactcacctggcaccacgcgcgccccccacgtgtgtggcgcaccgaccccatcgtcgcgcgcgtgggaagccacatcatcctcgccggcggcgcgtgtgacttcgaggacgaacctctagcggtggaagcgtacgacacggagtcactcgcgtggctccgttgcgagcccatgccggagattctcaaaggctcaaccgcctccacgtggctcgccgtcgccgtctccggagacaagatgcacgtgacggagaaaaaatccggcgtgacgtactcgttcgactgcggcacaatgacgtggcagggaccgtacaatttacgtccgagtgagaacgttttctactgcgtaacgggaacgatacgcggtcgtttaatggtggcgggattagttggggacgcggagaacgtgaaggaggtgaagttgtgggaagtgaaaggggaattagggttagggttaaggtattggtgtgaggaaataggagcgattccgaaggagatggtggtgaggttagtaatgggtgaaggggattgttgttgttgttgttggggtgtggtggggtccattgaggtgcattgggttggggattatgtgtattttcagaaccggatggaaatggagatggtggtgtgtgaggttgtgaatggaaggtgtgagtggtggagcgtgaggaatgtggcggggaatgacgtgagtcgcatggggagaatggtgttctgtggtggacatgtggggcttgaggatttgaagagggcgattaaggataatttgaaaaatttaggaaatggaatggtgtttcaattcgagacagatcaagtctgtttgattttgtcctttcagaggtttcagacgacattgcatgctttctcaaacacggcagagaacaacaatgttgatgttagttactttcctaagttttcatattaa

SEQ ID NO: 13091 - DNA, 270 bp, Glycine max
  Peptide Sequence Number=SeqID_129869
atggagttccacaaaaaaacattcgaaggacaactcagggatgttgacaaagtcggggaatattgcttgaaaaagagagagctgaaaaacacatcagcctcagaagaaatagttcgccggaagaaggacaacgagttgaatggtacactagaaattggaaaaagaatgatagaaggaaggcaactagcaaaagggctcaccgaggacagtccatcctcagtgagagacggtttttccttattccctcaacctgactttgatgccatgtaa

SEQ ID NO: 13092 - DNA, 667 bp, Glycine max
  Peptide Sequence Number=SeqID_129870
atgaatagtgattgtgacttcaaggatatcgttccgaccaacttcgaacatcgtggattgaacatgctggtattggacgtgatgaggcgtagaggggacatgtgtggtgatgcgcgtgactggtgttggggtctgggttgggtggtggaaagtgaagagatggtggggtggcattggaaattactcaaaggagtaggaggggaagagacacccgttgaagtcgaagaatatgatatgtcatcgccaatgtctcggccaattgtatcaggcctcttcaccatatttgggaatgagtacttgaggagaccaaataacgaggacatcgaacgactactacaaatgggagcggcacgcgaattttcagtttttggaatcgctggttcaaataatgacattactatgttaaatggatctaatgtgtttgatgaagttttgtcaggacgtgcgcccgcagtgcaattcacaatgaataaaacccaatataatatgagatactatttagcggatgacatttatccagactttgccacgtttgtgaagaccatctcaatgccacaagtagaaaagcaaaaattatttgcacaacgacaagaatcgacaagaaaggatgtagaatgggtgtttggagtgctccaatctcgattcataattatacgtggtccggcag

SEQ ID NO: 13093 - DNA, 538 bp, Glycine max
  Peptide Sequence Number=SeqID_129871
gcaactcgaaccgaccagacattcaggtcgtggtctgaccagttgtgtcggtccgggttttaaaacacaatcattaccattccattgctattaccatcaccattccaccaccagtgccaccattgtcgacaccattattccacccccaccaccgccaccgacaccaccactatcgccactcccacccccgctacctctgccaacaccattatttcattgtagagaaagattggccctcaaagaggatgccgttcaacttggtcctgcattactcttctttggatgtaggaatcgacaaatggattttatttatgaggatgagctaaagaattttatggaacaaggtgctctgtcagagttgatagtcacattctcgagagagggacctgaaaaggagtatgttcaacacaagatgatggataaagctgcaaatctgtggaatttgatttctcagggaggttatctttatgtttgtggtgatgctaagggcatggcccgagatgttcatcggactcttcataccattgtccagcagcag

SEQ ID NO: 13094 - DNA, 1158 bp, Glycine max
  Peptide Sequence Number=SeqID_129872
atggtgttaaagcttttgttttgcacaggtgcaaagcgtcttgttccattgggactaggtgatgacgatcaatccattgaggatgattttgttgcttggaaggaatctctatggtctgagttggatcagttgctccgggatgaggatgatgtaaatactgtatctactccttataaggctgctattcctgaatatcgagtggttattcatgattccaccgtcacatcttgcaatgataatcacttaaatgtggcaaatggtaatgctgtgtttgatattcaccatccttgcagggttaatattgccgctcaaagagaacttcacaaacctgagtctgatcgttcttgcatacatttggagtttgacatatccgggactggcataatatatgaaactggtgaccatgtgggtgtttttgctgaaaacggcgatgaaactgttgaagaagctggaaagttgctgggtcaggatttagatttggtattttccattcacactaataatgaggatggtactcctctaggaagttctctgccacctccttttcctggcccttgcacactgcgctttgctttggcacattatgcagatctcttgaatcccccacgcaaggcttctttagtggctctggctgcacatacttcggaacccagtgaagcagatagattaacattcctctcatctcctcaggggaaggatgagtactccaaatggctggtgggaagtcagagaagtctccttgaggtaatggctgagtttccgtcagcaaaaccaccgcttggtgtgttttttgctgcagtagcccctcacttacaacctcgttattattctatttcatcctcgcctaggttttccccgcaaaaggtgcatgtaacttgtgccttggtatgtggtccaactcctactggaagaattcacaaaggagtatgttcaacctggatgaagaatgccattcccttagagaaaagccgtgactgtagttgggctcctatttttatcagaacatcaaacttcaagttaccagctgatcattccattcctattattatggttggtcctggtacaggcctggcacctttcaggggatttttacaggttgctagcttttgcataatattaaatgaagaggggaagttttggggtggaggtgtagaatag

SEQ ID NO: 13095 - DNA, 549 bp, Glycine max
  Peptide Sequence Number=SeqID_129873
atggcttcgaattccgagctggtgcgaaccgttgtggagtcagtgctgggcgtttcggtctccgattcggtgatggtgatcgcggccacttccgtcgccttggtgatcgggcttctcgttttcgtgtggaggaaatcttcggatcggagcaaggagcagaagccgctcgcggtgccgaagttgctggtgaaggaagaagaagaagacgaagtcgatgctggttcggggaagacccgagttgccattttcttcggaactcaaactggtaccgctgagggctttgccaaggtaaaagaagctcttaagaggatgaataatggtaaaatcgttagtcctaatggtatttctattaaagctttggcagaggagatcaaggctaggtatgaaaaagcagctgtcaaagttgctgacctggatgactatgcaatggatgatgatcaatatgaagagaagctgaagaaagagtcacttgcatttttcatgttggcaacatatggagatggagagccaactgacaatgctgcaagattctacaaatggtttactgag

SEQ ID NO: 13096 - DNA, 474 bp, Glycine max
  Peptide Sequence Number=SeqID_129874
atggttcgctattccaaccgctcctttttctccactgtagacacaaggcctgttattggcctgtccaacaccgccaatatctcaaaccaggaaaacttcacgcatttgatgttcaaaactgtgaacaaaactatagatgaagtggccattgctgccaagaaatacaacacaaagcaggcaaacatattcgggtttcaaaacctttattgtctagttcagtacacgccagacttgtcaacccaaggttgtagaagttgtctcagtgatgtcgtagggctccttccatggtgctgtgaaggaaaacaaggagggagaattttaaatcccagctataatgtcaggtacgaattgtaccttttctttcatgccaacaccactgcttcctccccaaccccaatgcctacaccatcagtctctgttcctccaactccaaccacttctaagtcgggaggtatgtattttttaaagaattaa

SEQ ID NO: 13097 - DNA, 258 bp, Glycine max
  Peptide Sequence Number=SeqID_129875
atgaggatcaaaaggtcttttaaggttgtaatggggccaaggacaaggcttgtagtgagcttcaaaacaaggaaagggaaacaagactcaaaagggctatcaaaggaattaagtcaaggtaagtccatttggctagaagcttataagaagaaaattgcctcaatcatttccaaatatgcatgtaaattaggaagcatcaacaagaatcaagccaaggctattgtgcaagcaatcaatgggggaaaacacaccaaatga

SEQ ID NO: 13098 - DNA, 312 bp, Glycine max
  Peptide Sequence Number=SeqID_129876
atgacaatctcagcattggtgtggaaacacattgcttgcataaggggagacaatgagtcaaaggcagtgacaatttgcacacgtggcataggtagtaacgaattttccgctaatgacttggtgttaagcattgttgaagcaaacatgctggttggaaaatctaacatgtcgaatttggcaaagccgattggtgaggaaaagagagttgagaatgttgttgtgaagaagttggtggaagagagtcaagggaaagaggattgtgtggatttggaagaaggtgacatgtacgaggttgtggtgaatggacactaa

SEQ ID NO: 13099 - DNA, 381 bp, Glycine max
  Peptide Sequence Number=SeqID_129877
atgtatgattttgtatttggaatttgggttgaaaagacagctagggtttcatggcataagaaaagatggtgccctttccattccaccctcgagttcatttggatcagcagtaacaattctagatttcgaaagggtcacttttctttaaactacatcaattcagagattgtagcggctgtttctctctctgggaatctctctatgccagcaattgaaattgctcatgagcatggatggaattgcataatagatggcagaattgtagtgtcctccaaagaagcagaattgtggtctatgatttatggtcttcgcatggctgaagagttaaagatagaaaggcttattgttgaggccttgagggagattgtcttcctgggataa

SEQ ID NO: 13100 - DNA, 1878 bp, Glycine max
  Peptide Sequence Number=SeqID_129878
atgtgcactggaattgaagtggatgaaattgtattagagatatttttggcaggttttcttcttgaccctgaaaaatgtggtatgctgagtttgccagacaaacaaagactagtccgtgagattgctcggcagtcaaaagatgcctcaagtatgcttcagtcatttacacgtagggaacttctagaaataatctgtgctgaattaggcaaagagaggaagtacacgggatataccaagagtcaaatgatagaacatcttctgaagataatttctaagaactccaactcgcacatcaatggaaatatgcccgctcaatctcctgccaaaagttgcattggaactaaaaggaaaaaaaaacctgcatctcaggatttacatcacgctcctctagggaatagtaaagaaaaaacagtgaaaacctttttgtgtcaaaatgttgcatgcaaagctacattgaatcccgaagattctttttgcaagagatgttcttgttgtatatgtcatcattatgatgataacaaggatcctagtttgtggttgacctgcagttctgatcttcccaatgaggagtcatgtggaatgtcctgtcatttgcaatgtgctttgagtaatcaaatgtctagcattttgaagggtagttgtggtattaagttggatggagccttctgttgtgtttcttgtggaaaaattaatgaactgatgaagacatggtggaagcaattattagttgccaaagaagcaagaagaacggatatactctctttgcgaatatccctggcccacagaattcttgtaggaacagaagtctacaaggaagtgcagaaaattgtagaaactgctctcaaattactggagaatgaagtgggatcacttgatcatgtatatgctagtatgactcgtggaattgtgagcaggctttcatgtggtgctgaggttcagagattgtgctcttctgctcttgaatgttttgattcaaagttttctggtcttttctctatttgtgtggaaaacaaagatgcaccaacatgttccattcattttgaagagtgtcttcctacttcagttgttattgtgctcgagtacaaagacaaacttttaaagaattttctaggctgcagactttggcaccgaatatcaacaatagactaccctgaacaacccaccttcattgtcttgaggcccgagaaaagattcaagttagaaaacctccatccttcaactgaatacttttgcaaggcttctctgttcagcagcacagggatcttgggtgctgcagaagctaaatgggtgacaccttgtgaaccctccaacccttcaaaagttatcagtggtggtgggaatcgctttagatggtcccctcaaagaccctcaggtacaggagtggacatgtgtacacaggaccgaataactgctgaaattcatcccacagaatctgccaactccgacatgaagttatcaactggagaacatcctgggaagaaacacatcattctgaacatcaggagcaggtttgaagagttcctctccaagcctcaaccagtagagcctttttcatataaaaatcttgctgcagtttcaccttccacgccttccaagtcctatgaaatgaggcaaattcctggtttgaattctaggaagcgctcgaaggagaacgattacgagtattccgtcagggtagtcaaatggttagagcatcaagggcacatagatgaaatcttcagagtaagatttctcacttggttcagcctgaaggctactcagcaggagagaagggtggttagtgcttttgttgatgcattgattgatgacccagcaagcttagcagaccagctcatacacactttcagcgacgagatatgttgcgagcaaaaatcttag

SEQ ID NO: 13101 - DNA, 3801 bp, Glycine max
  Peptide Sequence Number=SeqID_129879
gttgaggaagaagaaagacacggcacggcacggcgacggagtcggagaatagtggtggttcttcttcgcacgtgcgagcgtgcatcaccatcgtctgtggctgctgcagcgacttactttttcccgaggcagtttccggaaagaggcttggatgaatcttcgaagcagagattagatcaggaaaagagaaaaatagtcaactccatcaaatcaccggatacgaattttgcagccttcgaaagcgatgcgccgaaaaagcaaacaacaacgccacagagtcccacacctgatgtgaaaaacgacgtcgttttctcgtccactaagcagaatgcggtctccgatatattcaccggcggcgacaagttccgaaccaagcagaagcaaatcgccgccttctgcgactggttgatcgataaaaagaaggatcgcaaccgacctagtcaccatttcaaaccttatcctaacgaggaggaggaagaagaggaggatgaacgtgagcttctgcttcggccgccgccaccggatgcggcggcgcaggttgtgaaggatgccgtcgaccggagcttcgaccggcaggtttcgctgccgcggctgtccagcgggagcagctacgccggaagcttgttcacgctggacggcactgccacattctccagcgacgtcaccaaagaagaaacgtcgtcgtttcgtcaagtcttcaccgaagaagacgcaacacaaaaacagcaagaagaggaagagaaagagaagcgcaacacagcgcagaagtacagagaaagctactacctgcaactcgcgtttacgaagaggctatcttgcttggcaagcctcggctccgaaccggttctcactcttgacgctggcactgaaacctgggatgctgaatccgtttcgtatcgtctatgggtgagtgggtgtttgtcatacacggataagatatcggacggtttttacaacatattggggatgaatccttacctgtgggtgatgtgcaacgatgtggaggaagaagggaagcgtttaccgactctgatggcgcttaaggcggctgaacctagcgacacttccatagaggtggttcttttcgatcggcacgaggattctcggcttaaggagcttcaggataaagctcaagagttgtattctgcttcggagaacgcgttggtgctggtggagaagctcgggaaactcgttgccatatgcatggggggatcattcccggtggagcaaggagatctacacaagaggtggaagttggtgagtaagaggttgagaaactttcaccaatgtgttgtgcttcctgtaggtagcttatctagtggactctgtaggcatcgcgcaattctcttcaagagattggcggattacataggtttgccatgtcgaattgctcggggttgtaggtactgtgtttcagatcatagatcgtcttgccttgtcaagattaaagatgatagacagctctcaagggaatatgtagttgatctggttggggaaccaggaaatatccatgggccggattcctctattaatggagcatatgtgtcttcaataccttccccatttcaaatttctcatttgaaagaatcccaatcaccatatgtggatgttgcagcatgttctcaatctcttggtaacacttctttagatgcattaaaagatgccttggaaattttcttccctatcttgtggaacaagatcattcctattctgaagtttgacttagttgttactcaatctgtttcaggctgtgtacaggaagatcaacaagctgaagaaactgatctgcagaaaaataataatggctctatttatcctgcaatagatcaaactcgtggaggtgcagaaccacctctaattccttttggcttgaaagggaatcacaaggaatgtgcaatccttggtttattaaattttcctccagtatatgaaggtgtttctgaggatcttcacccagccactgaagcatcgttacatgaataccccaggctcagtaaagattcagttgtagtactagaagcttccaacaaagagatagagatcattgtaaaaggaagttctgggggtgctggtaatattccaagatacttgaatcttgaaccatcacttgcaatggattggcttgagataccatgggatgatttgcgaatcaaagagcgtgttggtgccggatcatttgggactgtgtatcgtgctgaatggcatggatcagatgttgctgtcaaagttttaacagttcaggatttccaagatgatcaattgaaagagtttctaagagaggttgcaataatgaaacgagtacgtcatccaaatgtggtgttgttcatgggtgcagttactaaacgtccccatctatctatagtaacagaatatttgcctaggggcagtttatttcgcctaatacataagccagcatctggtgagattctagatccaaggagaagattacggatggctttagatgtggctaaagggatcaattatctccactgtctaaagcctccaattgtgcactgggatctcaaaaccccaaatctgttagtggacagaaattggaccgtgaaggtctgtgattttggattgtccagatttaaggcaaatactttcttatcatcaaaatccgttgctggaacagttggatgtatggctgtcaattctttgatgacagtttggggtggggagaatgtgccttttcaggagtgttttaagggagcaattttgtgtccacctgagtggatggctccagaatttcttcgaggagaaccttcaaatgagaagtctgatgtttacagttttggggttatcctgtgggaacttgtgactctgcaacaaccatggaatggacttagtcatgcccaggtggttggagctgtcgctttccagaataggagactagctatccctccaaacatctccccagcattggcctccctcatggaatcttgttgggccgataaccctgctgatcgtccatcttttggtagcatagttgagtcgctaaagaagctactgaagtcaccagcggatgcaataaaaatggtgagagaccttacaattgcaatctcaaattctcagtttcatctcgatcaccttccagatccatcgcagagcccgattccagattgcgaaattccgatggataaaacggtgaaagacaactcagcgtggaacgacatcgttttgcagggggtcatggttctggtgatggtcctctcctacttcttcatgcacgacgtgcccaagaagctgtgggccaagctccgtctaagcaaccgcgccgacatccaagccaagcgccacttcgtccaaggggcccagctcctggcccgggcccgcgcctccaagtccaaggccctcgccaaggaggcccaggcccaggctcagcgcgccatcgccctcgacccgagcgacgccgcgccgcacctcctcaaggccctcgccttagacttcctgggcctccgctccgctgcgctggactcgctcgacgaggcgctctcccccgccgccgcgaagtccctctcggactcggagcgcggcgacgcgctcctcaagcgcgccgagttgagactcggcacgagccagcgcggccgagtcgactcggcactcgcggacttgaccgagtcggtgaggctcagcccgaataacgctaaggcatttttcgcgctgggggattgctacgagcggaagaagatgaacgatgatgctattagggcgtacgggacggctcttgaattggaaccccaattccatgctgcggaacaagccctaaacaggttggattcttcgcccatgaacaattga

SEQ ID NO: 13102 - DNA, 126 bp, Glycine max
  Peptide Sequence Number=SeqID_129880
atggtgatgcacgctcgcacgtgcgaagaagaaccaccactattctccgactccgtcgccgtgccgtgccaagaaagggttgccatgctagttgaaggagggatcatggaatgctgcaatggatga

SEQ ID NO: 13103 - DNA, 123 bp, Glycine max
  Peptide Sequence Number=SeqID_129881
atggaataccagcaagaactaagcaaggcactaaggcaaggccaactgaccaagcacttggaccagtacgtgaagaagtacgaaagcagactagaagatttaggaatcaggctgtgcatttga

SEQ ID NO: 13104 - DNA, 488 bp, Glycine max
  Peptide Sequence Number=SeqID_129882
atgctgagcgaggcgaagccagaggaaactctggtggaggcccgcagcgatactgacgtgcaaatcgttcgtctgacttgggtaggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccg

SEQ ID NO: 13105 - DNA, 237 bp, Glycine max
  Peptide Sequence Number=SeqID_129883
atgtcgcggaacttcacggattgcttaacgatgggtgtcaagtacctcgaagtgatcaagcgagggtcgcatcccaacaaacaaatggctcgccgcctctggatgacaaaagggcgcagaatgaccataatttgtctctgcgtgccatcggacacgattgtctccgaatggcgaaaaggtgtgcggaatgaccataatttgtctccacatgtcatcgggctcgctgcctctggatga

SEQ ID NO: 13106 - DNA, 255 bp, Glycine max
  Peptide Sequence Number=SeqID_129884
atggcagctgatccaactaagacccttatgaactacctcactcctactttggagatgttggagaataacccgtttagtggtgctacccatgaagaccctaaacaacacttggggaggatgagtttggatgctgcttgtgggggaaacctcaagttaaagttccctactgatgccatcaaaatcattgaagacatatgttctaatccctacaacaacttaaaggataaaagaattataaagggaggcgttgactag

SEQ ID NO: 13107 - DNA, 495 bp, Glycine max
  Peptide Sequence Number=SeqID_129885
atgaagaagaaaaaaaatcctaatcttgaaagtgtgtttgaagaattcatggcatatcatgctagctcaacaactaatcaaaattcaatgaaaaatcatgaaattcattttgaaatccaggttggtgagctggcagaagcagtaactcaatttatgtccagacaagaaaaatcctttgtagaggctgaagttcaagagaaaagccttgagaaagatgaggaacaagcacaacaacaatgggagaagtactcaacagtagaaaaccaacaagaaaatattctccaaagcaataaccttccccatcaactgattgacaagaaaggaaggcaaggagagcatgaggaaaccttaagtggcgttctttctttaataactaacacctttcttgaaatgatttggaatgtccttccagattatatgaagtttatggaatttctagctagaaggcgaaacttcaaggaagatgtgttctttgtgactttcaagccaccttga

SEQ ID NO: 13108 - DNA, 1657 bp, Glycine max
  Peptide Sequence Number=SeqID_129886
atgaccagtcccatatgggactatcaacgcaaagtattcgctttaaaatggccagtaattagtccgcatttgaattatccgctgatattaaacattgatagcggaacaaataatctaagaggccatgcaatgaaattaaatcagatcgctaaacatctggctctggccggtgttttaacttcgctgtcgctttccgccttcgctgccgcccagcagcaggacgccaccccggcaactcagcaggcaaataacgcgctgtacaacaaactgccgtttgccgataaaactgatttcgataacgcgcataaaggttttatcgccgcgctgccgcagaccatgattaaaggcgagcaaggcaacgttatctggaacccggcaaaatatgacttcgtcaaagaaggtgaaaaagccccggataccgttaacccgagcctgtggcgccagtcgcagctgattaatatcggtggcctgtttaaagtcaccgacggtgtttatcagatccgtaatctcgatctctccaacatgaccatcatcgaaggcgagaaagggatcaccgttatcgacccgctgctgagcgccgagccggcgaaagaagcgatggatctctactacgccaaccgcggtaaaaagccggttgtcgccgtcctgttcacccacagccatgttgaccactacggcggcatccgcggcgtggttgatgaagccgacgtgaaggctggcaaagtaaaaatctacgccccggccggattcatggaagaagcggtttccgagaacattatggccggtaccgcaatgagccgtcgcgccagctatatgtatggcaacctgttgaagcctgacgccaaaggccaggtcggcgccggtctcggcaccaccacctctgcgggtaccgtgacgctgctccagccgaccaactacatcactaaaaccggccagcaggaagtgattgatggcctgacctacgacttcatgatggcgccaggttccgaagcaccgtcggaaatgctgtggtatgtcaaagagaagaaaatgattgaagcggcagaggatgttacccataccctgcacaacacttactcgctacgcggcgcgaagatccgcgatccgctggcgtggtcaaaatatattaacgccgcgatcgaccgctggggcaacgatgctgaagtcattatcgctcagcaccactggccaacctggggtaatgacaacatcatcaagctgatgaaaggtcagcgcgacatgtatcgctacatcaacgaccagaccctgcgtatggccaacgaaggcctgacccgcgatgaaatcgccgctaacttcaagctaccggaatcgctggaaaaacagtggtcaagccgcggttattacggctccgtcagccacgatgtgaaagcgacgtacgtttactacctcggctggttcgatggcaacccggcgaccctcgacgagctgccgccgcaacaggctgcgaagaagttcgttgaatacatgggcggcgccgatgccatcatgcagaaagccaaagccgactatcagcaggggaactaccgctgggtggcgcaggtgaccagtaaaatcgtcttcgccgacccacagaataccgatgcgcgtaacctcgaagccgatgcgctggaacagttaggctaccaggcggaagccg

SEQ ID NO: 13109 - DNA, 603 bp, Glycine max
  Peptide Sequence Number=SeqID_129887
atgcagattggggggtaccttgctttattacagtgctggatctatgagcattttctgagtgtgcatcagtgcgtcaccgatgatgcgtatgaggagacgtcccctcgtgcctcccggtggctgacgatgaaggctcatatgaagggaattacaggagccccgtaccgggcacgttgtgatgctttgacggtcacagacgtgtgctggttgccttacagtgaccatcgaggggttagggggtttgagccgatttcatcattccagggtcagataagatggggtcctacggtggtcacagttcgaccggagagggtgctatgccaatttgggtacattcagagcatccctccgccgcctgttagcgcttcgttgtcatatgatgatatagatgacaggtggatgcatttctcggaccacgtagtagttgtgggtgacctttgtgtagtgcctgggcaggtatttgcagattacatggagtggtttttccagatatctcacccattcatgataccgacccagcaggtgaccagcccagacatgcacctgctccagaccatgaggactacatgcagccggacatcccacagttctagtggcatttga

SEQ ID NO: 13110 - DNA, 123 bp, Glycine max
  Peptide Sequence Number=SeqID_129888
atggcgactccactggggatcacactcctaagtggtgtctttccgagagtgagtttcggatgtggcacatgtgataaccccgctcaatggagggatcttgggagtattactatgttggcatga

SEQ ID NO: 13111 - DNA, 853 bp, Glycine max
  Peptide Sequence Number=SeqID_129889
aggattacatgtcctcgactttagagggctacacgtcctcgccttcagaggactacaggtcctcgccttcagagggctacacatcctcgccttaagagagctacacgtccttgccttaagagggttgcacgtcctcgccttaagagggctacacgtcctcaccttcagaggactaggactacacgtccgcgactttagagggctacacgtcctcgccttcagaggactgcatatcctcaccttcagaggactgcacgtcctcgccttcagaggactgtacgtcctcgccttcagagggcttcacgtcctcgcctttagaggactgcaggtcctcgccttcagagggttacaggtcctcgcttttagagggctgcatgtccttgccttcacagggttgcatgccctcgcctttagagggctgcatgtccttgccttcagagggttgcatgccctcgcctttagagggctgcatgccctcgcctttagaggcctgcacgccctcgccttcagagggctgcacaccctcgccttcaaagggctgcacgccctcgcctttagaggactgcacgtcctcacctttagagggctggccgccctcgcctttagagggctccacatccacgcatttagagaactcaagttcctgggccacccccctgatcttggaggagggccaactatgctagcacagccaaaggatgaggctattgcccagctactatgcataccagggcaagatttcgcccaggctgctgcatggagacgagtgtggatcatgcacaccaacatatggatgacgttgctacttcgcaacattctgcccagcgaccaccactctgatcccccctgctga

SEQ ID NO: 13112 - DNA, 192 bp, Glycine max
  Peptide Sequence Number=SeqID_129890
atgggctcaaaaatctaccctaaggttcatgagaaccctaaggccttctttatcaactctagcccaatcctcttggagcctcttgctcatggctctggtaattggtcctttcctaaggaggattgcatcagcaggccacttgatccaacaaaagacaacccgataggagacattcctatgggtgctttgtag

SEQ ID NO: 13113 - DNA, 240 bp, Glycine max
  Peptide Sequence Number=SeqID_129891
atgggctcaaaatctatcctaaggctcatgagaaccctaggcccttcccttggatctctagcccaatctacttggagtcttgtacccaatgcccttgcggagcgttgcctacgacctgtggtcgaccagcaggtgaccaagtccaacgccaaagataagcaaaagtactacgtccgtgaccgacaagtcatcacgcatccaactcaagacgttaaggaagtgctactaggaggcaacctt

SEQ ID NO: 13114 - DNA, 138 bp, Glycine max
  Peptide Sequence Number=SeqID_129892
atgggtgccaagcacctcacgaggaccaaagaatggtcgcacgtcatcgagcaaaggttcccggacgaaattagggcaatcatgaaacatagctccaaactcgaaggtggaggacacatgaacagcgctaggcaataa

SEQ ID NO: 13115 - DNA, 744 bp, Glycine max
  Peptide Sequence Number=SeqID_129893
atggcaagcactggttttttaaaaagtgtaagcaaaacacggctgaagtcttgtcccgcttgcgttgttaggcggctggaagatctgaccttatttgtccgcgcggcggcgttaggcagttttagcgaggcggcgcgggaggcggggcagcagccagcgcaggtcagcgcggcgatcaaacgcctggagacgacgctcaacattcgtctttttgcccgttcgacccgtagcctgcgcctgaccccggagggcgaaacctggctgccctacgccacccagatgcttgatacccttcaggccgggctacagaaaattcaggcgccgggggatgaagtccgcggcacgctgcaaatcgccgtgccatccgatcttggacgtaacctgctgctcaaggtgttttgcgcttttcgcgaacgtcacccggcgctgcgcctgcggctgcacttttccgatcatctgaccgacgtgtttaaagatccggtggatgtcgcttttcgctacggctaccacgaagacgcttcgtttatctcgctgcccgtcgcgccggaaaaccgtcgggtgttggtggcttcaccgcagtgggttgcccgccacggtcaaatcagtagtctggaggagttatcccggcacagcgcgctgttgtacgtattacgcggccgcccttttgaccgctggccgctgatttcaggtaatgaagtgcataccgtggagatgaacggcgcgattatgagcgatgatgcggag

SEQ ID NO: 13116 - DNA, 357 bp, Glycine max
  Peptide Sequence Number=SeqID_129894
atgattcaaaatgatcaaggcctacaagctccacatggagctacatcatgtggtttcaagttgaggctactacttcaccttcctctagtgaaagtgaagaaggaaaaggggaagaatctgatgatgaaatctaccctcgagaagaaggacaaccatgaatggttaaggaggagtgtaaggagacaacctccacattttctcctttgtaaaaagacacttgttagcattgccacacctctcgggattgagtttattcctcatgtgaaggagttgttggatgagggtttggttcgcaagagcttaaatccttgtgctttattggtgcctaaaataggaataatcaacatgaaaatatag

SEQ ID NO: 13117 - DNA, 525 bp, Glycine max
  Peptide Sequence Number=SeqID_129895
atgggagacatttcaaagatgaaagatatttataagaggtggactgagtatcttgacagcacgcgatcaagggtcaatcacccaccaccgatacacccttacaatcaatatgaagaagaaaaaactcctactcttgaaagtgtgtttgtggaattcacggcataccatgctacctctacagccaatcaaaactcaatgcaaaaccaggaaattcaggttggcaagagctactccatggaaaattatcagtgggagcaagagttacaaccctacaaccaatatgaagaagaaagaacttctaatctggataatttgttgatgaaagacaaggaagtcactgaatctactcaaagagcatttaaaagtctagaaattcaagttggtaagctagcagaagaagtgactaaatttgtggccagaagagaagaaaattttgtagaggttgaaactcatgaggaaagccttgaagaagagcatgattcaaaagaaaaagatgaagataaaagtgaggagaaatcacaataa

SEQ ID NO: 13118 - DNA, 234 bp, Glycine max
  Peptide Sequence Number=SeqID_129896
atgtcagtgaaaaaccacgtcgggtgcctaggagtacatgacaagacaaatcacacactaggagaccagtcagggtcacagtgttttgcgagaatgctccaaccatatgggatcaacattggcttaaaggaacactcaaatcggatgaccaaaaagggacataacattaactcgttgcccttaaagggacttagcattaactcgttgcccttaaagggacttatagtcgtgtga

SEQ ID NO: 13119 - DNA, 246 bp, Glycine max
  Peptide Sequence Number=SeqID_129897
atgttcaggaagttcttctattcaatccttttccttctccttgttgctggatatctcgttcgtacacatcttctctttgtttctcgagtctatagtgagttacagacagagttcgaaaaagaatctctttctagttgctctggaacaattaggagattctctagaagaaatacggagttttgcttttggtggcaacatgctatggggtggtggtcccacttatggggtcaaatcaatacgttctaa

SEQ ID NO: 13120 - DNA, 678 bp, Glycine max
  Peptide Sequence Number=SeqID_129898
atgtcttggcacttttggtatttggagttgtccttttttccaaatgtgaatgggctagtggacttagcagcgatcgatgccttccttgcttatcaccatagcaaggagagtccggtcattgttgtgttggctaatgcctgtgacactttcgaccgaagatgcgataagagtggcgcaaggattgtttgttgcacaccagctctttatgtgtggctagtctcgcacctctttcgtcatgaaagtagacccgtctgtcccctacaaggtcaccgcttgtgcaccgagaaagggaaggcaaactgggagcaactcttggctagtgtggtagggggatccattaattggttcccccgatggaaggaaagaagagttggggttttgtcttcatgtgaaggattcccaaatgttcccttgatgggaacaaggggttgtatcaattataatcccgtcctcgccataagacaacttggctaccccatgagaggagcaccatcggaggaaggcgtcacacctttcatcgcatggggtttcagtgaccccaatgctaggatacttcaaggattccgtaaggcatggggtgtagtgcaaaggaaagataaagagcttaggggaagcagtaatgggatcattggcggctatcataagtggctgaaggctcgagtgcaagagttggattag

SEQ ID NO: 13121 - DNA, 537 bp, Glycine max
  Peptide Sequence Number=SeqID_129899
atgttggtacctggaacccaacaatgtgtttgtccatcaattgaggtaacaccagcaatagcgtggagaaactaccaaaagtctaaggataagaaaagcactcaaaacagtatccctagggatctatttgagaaacataagagggatcattcacaaaaagttgaagcacctaagagtgagtttcagataaagttcaatctacatacaccttttcccaagcttctagttgtacatcctgtagatgttgacctctccctgacagactactttatgcttggtggattacatgcacaagtgtacattcaaaatcaagcaactgcctatccacagggaatgtgcatttcaaaggccaccgaaatcaaagttgtggcagataaggtgtgcccttgtctacctatttggcatgctgctaagaagaagagcttcaagctatgttactatgaagagatgccctcaaggaagatgaatgtagaagtgatgaacttttcaagaaactatagttccttgtttagtggaaaaagatttttcatgctctag

SEQ ID NO: 13122 - DNA, 480 bp, Glycine max
  Peptide Sequence Number=SeqID_129900
atgggtgttaagtactcgaagcggtcaagcgaaggttgcatgcccccgaacaaatggtccccagatgaaattagggttgcaggttgtgttatatgtagtggaggacatgattctggctgctgcattcccacagaagatacaacacatgaagtgaactacatggggaaccagccaagaccaaactttaatgcaggtgggccacaacaacaagggactagtctctatgacagaatgacaaagctggaagagactcttgctcagttcatgcaagtatccatgtccaatcaaaagagcacagagtcaacaatcaagaatctagaagtccaggtggaacaatgggcaaaacaactggcagaccgatcgtcacgtagctttggagccaacacagagaagaatcctaaggaggagtgcaaggctgttatgactagaagcaaagtggagcgcgctaagcgagccacagtgcagtggaagttgcgctaa

SEQ ID NO: 13123 - DNA, 207 bp, Glycine max
  Peptide Sequence Number=SeqID_129901
atggtctctattgaattgattactaggcagccagaatcatgtcctccactacatataacacaacctgcaacctgcaaaacagaagaggcaaccaggcccacttgggccttccagggtgttccaatagaaggcggtgccttctggtggaagcaacccaacttgcctgggcgagctaggcggcaaccacctccctcttttcccctataa

SEQ ID NO: 13124 - DNA, 780 bp, Glycine max
  Peptide Sequence Number=SeqID_129902
atggcccacaaattctgttttgaagcacttgatcaaagtttaagagatattatcacagataaatcaaagtcaaatcaaatatttggaggcaaagttatagtatttggtggagattttcgccaaatactatcagtcatcccaagaggaacgcgctcaaacattgtaaatgcagcaatcaattcatcctatctatgggattcatgtgaaatattgaccttgacaaaaaacatgcacttacacagaaatctagaatcagttgatgaacaagaaactgccacatttgctaaatggattcttgacattggagatggaattatagatgatgaaaatgatggttatgctacaattcaaattcctgctcatctacttattactcaatatgatgatccaatcagtgctatagtcaaatcaacattcccagacttagatcagcaccacaataatcctgaattctttaaatcgaaggcaatattggcttcaacaaatgaaacggtagaacaaatcaatgattacgtgctatccttcattccaggtgaccacatggaatatctaagctctgattccattgataaatcagaaactagtgagaattcgtatttccaatcaattactactgaattccttaattcattgaaaacgtccggtttgccaactcattctatcaaacttaaaattggaagtcctataatgttgttaagaaacctcgaccaaaatcaaggtctatgtaacgatactagattagtggtaacaaaagatggcaaaacatgtaattgcaactga

SEQ ID NO: 13125 - DNA, 1021 bp, Glycine max
  Peptide Sequence Number=SeqID_129903
ccagcaattgctatcttgcactttgtgggatgattattgcttgcagtttttggagttcttagatgattatgaaggatcttatcccacatcgatcaacaattctttcaaggcttcaaagttaattattaaccagcctgtgatggagattcaagaattcaatgaacggcttgcagagttgggcattgaagcccggtcaggttttaaatcccatggtgaagggagtacacaactttcaggttctatccaattatcatcaaaagaatcattctttggcaaggctgagggaaagactattgctgacattaacaccatctctgaagaaattgtttgtgtcactgttggcacaattactaggattgttctggacaatcattcatggtgttatacatcttgcattcagtgccataaaaaaagtgatgcagagatgacgccctttacatgtgcatgcggcaaatacaataaggaagttgtgcttaggtataggcttgaggtgatgatcaaccagggaaatgaaagcacaaaattcctgctttgggaccgtgaatgcagtgaattaattggtcaatcagctgatgcagttaataagcttaaaattgaagatggtgatgttgatttgaatgcttcacccctagcacttgataagttgctgggttatgaacttgctttcaagataaaggtgcaacccaagttcaggaattctgctgttttgaagtgttcagctgactcgagcttaataaatgctgtgatggatatgctagttgatgctgagacatcttcaaaaatgaatatctcggtttctgattccaatcattctgctcaacatgaatctcaatccctgtctgtgacagcagaccatgatccattgcttggactccccttgacgcctacaaagcggcagacatttcaagattgtgatgatgaagcagggacctctcaaatttcacctgcacagctttcatccaaaaaattaaaaaaaacatggcgcaatttagtgcatttggttgttttcaagttgtgttga

SEQ ID NO: 13126 - DNA, 207 bp, Glycine max
  Peptide Sequence Number=SeqID_129904
atggcatcatcaagtacactgaccacagatagattaaagatcctaagccatccccctcaagagatgcttagactctttaacctctctatttcccccactagggacatccgacaagggacatccgacaaggtcaatgcagcccccatgtacatacgcaacatgcaacgtatgaaacatggcatcatcaagtacactggccatggatag

SEQ ID NO: 13127 - DNA, 231 bp, Glycine max
  Peptide Sequence Number=SeqID_129905
atgttcggagtcaaatacccctatcaaaacataagggttgaaggtgttcctcttggtgtgggggttcaaaagcaagcaacggtggctcaaggtggccactggtggtcttgggtggtggaaaatgaggttttagggtttgggtggcattttggagaagagatctcgcttagcgagctcatctcactaagccagagtccactttttgcacttagcgtgagaattcatgcttag

SEQ ID NO: 13128 - DNA, 276 bp, Glycine max
  Peptide Sequence Number=SeqID_129906
atggttatcgacactgatgtatggaaggaagtagcaagactggacatgggtggagtccgcaaattcgaagaaataactgatgggtacaggaagatgcagaactacaggggaatgcgtcttgacccaacaaggaatttgaggaatcgcctaggagtaggtggtctgacagccgaagacaaaatgcttgtgtacccattgttaggacttttggcaagcgtaccaattttcattgtaggtttcacatctataaaagagttcgtttccacaggaacttga

SEQ ID NO: 13129 - DNA, 1367 bp, Glycine max
  Peptide Sequence Number=SeqID_129907
atggacggcctgctgttctggaaactcaccggcgccgaggcgctgtcgcagtcgtttgagctgaacgccgagctgctggccacggacgcgcgcatcgaccggcacgcgctgctggggcagccggtcacgttcacgctgccgacgcagagcctgctgtcgccgcgctacctcaacgggaaaatcacgcgggtggcggtgcgcagcgaggagctgagcgggacgcgctacgcggtgtaccagctgcgggtggagccggacctgtggccgatgcgccgggaccgcaacctgcggatattccagggtcagacggtgccgcagatagtgcagacgctgctgcaggagaacggggtgaacgtggagacgcggctgggcagcagctaccgggtgtgggagtactgcgtgcagtaccaggagagcagcttcgacttcatcagccggctgatggagctggaggggatttactactggttccgccacgaggcggagcgtcacgtgatggtgctgtgcgacggggcggaccagcacgaggcgttcgcggggtatgagacgataccgtaccacgtgacggcgtcgggggggagcgtgacggaggagggcatcagccagtggtcgctgtgcgagagcgtgacgccggggatgtacagcacggacgactacgacttccgcaagccgaacgcgtggatgctgcaggcgcggcagaacccggtgtcgccggtgccgggggcggtggacgtgtacgactggccgggccattttgtcgaccacagccacggggagttttacacgcgcatccgccaggaggtgtggcaggttgcgcaccacagcgtgagcggaacgggaacggcgacgggcatcgcgccggggtaccggttcggcatcgtgaacgcgccgcacttcagcgacaacggagagtacctggtgacgtcggcgcggtacgacttcgaggagaacgggtacgcgagcggcggcggcggggcgcggcacaacatcgcattcacggtgctgccgtcgtcggtgacgtaccgggcggagccggcgacggcgtggccgaagacgcacggtccgcagacggcgaaggtggtgggcccggcgggtgagtcaatctggacggaccgctacggccgggtgaaggtgaagttccactgggaccgcctggcgaagggcgacgacacgagctcgtgctgggtgcgggtgtcgagcgcgtgggcgggccagggcttcggcggggtgcagatcccgcgggtgaacgacgaggtggtggtggacttcatcaacggcgacccggaccggccgctgatcatcggtcgcgtgtacaacgaggcgagcatgccgccgtgggcgctgccggcggcggcgacgcagatggg

SEQ ID NO: 13130 - DNA, 373 bp, Glycine max
  Peptide Sequence Number=SeqID_129908
tggggagaatttgagttttgaccgagtagttgtgttttacattgcacagaggcagagagtaccaaggatgacattgagtgatttgagcggtgtcttccatttgactattagtgctgcagcggtcaaactggacgtaggtgactctaccgtgaagagtatctgccgcagaggaaaattgaaaagatggccccaaagaaaggtgcaaagccttgccaagaaggtcagagtactcgaaagagcattgaattcgccagatccaggggtgaagcgaagaactctagatgaaatccgaagacttcagcaagaaataattgagaattgtggtggaattaccccaaccggaataccgatgctccaattcgatgaagaatga

SEQ ID NO: 13131 - DNA, 450 bp, Glycine max
  Peptide Sequence Number=SeqID_129909
atgtctcttgcaactctttttgggaaacttcaagaacatgaaatgaaacttatgagacttaaccaacatgaagaaaatgacaaaaagaagaaaggaattgcacttaaagcctcatcttctattcttgaaaaaagtgacaaagaaggcttgaatgaacataacaatatagaagaagatgatgatttcagtctcttcataaaaagattcaataaatttctaagaaacaaaggaaatcgaaaaagatcaaacttcaatccaaagaagaaaggagaagattcctcctcagttccaaaatgttatgaatgcgatcaacctaaacacctaagagttgagtgtcctatcttcaaaagaagaatggataaatctgacaagaaaaccttcaaagataagaaaggaaagaaaacttatatcacttgggaagataataacatggattcatcaagtgattaa

SEQ ID NO: 13132 - DNA, 153 bp, Glycine max
  Peptide Sequence Number=SeqID_129910
atgaagatggtgaagataggctcgcttagcgcacgtgaagatggtgcacttagcgagttggctttcactcagcgcctctatacaactcatccttcttccagaatttccatgcgcttagtggatgatgcgcttagccagaagatgagtggctga

SEQ ID NO: 13133 - DNA, 432 bp, Glycine max
  Peptide Sequence Number=SeqID_129911
atgctttcgaaaactggccccgacgaacgcagagaaacgcgactctccctcacgttgccattttcttcttcttcattctccattgaagctccaagcaaagcttcaacctttggccatcatttctgccccaaatcgcgaaaggaggccattttcggggtcgtgaagacttatgagaaagcttggactgtgctagagacaaaaacaaatgaccaaagtgaaccaagagccatttctagggcaaaattgggtgttgaagagtcaaattttgattcgaattttgctgtcaaaataggtgcagcagaattttggcttgtgcagaaaaatgcttgtgtgtggttggctgtggaaagggtagtgcagaatgagttctggatgtttgctagtagatcccacggtcaaaatgtaggattaagtattagagacttccagtaa

SEQ ID NO: 13134 - DNA, 714 bp, Glycine max
  Peptide Sequence Number=SeqID_129912
ttacccagtcaaggtgcaccttttgagggcaccattgttgatgactggaaattcgattattctagtcatgatgctcgccgtatggtttgtaatgaccaggctgaaatgaccggtagattgttggtcggatcattgacctttgataatcgcatcatgaactatattattgttagaattttgcttccccggtcttcaaatttggctcaagcctctgaggaggacttgattttgatgtggtctttccttactggtcgtcagatcaactgggctcacttggttcgataccggatgcataaggcattacgggccaatgcacctcttccatatcctcaattggtcaccctttttctccttcattttcaaattcctcttgatgatgaaccttttgttcaagtcaagcgttcctttgctataggtcctggtgcagtcacttcatttggttaccgtacggatcgtaatggtcaatggctgaagaaagatgcacttcctccacaagatgagcacactcattctcctcctcctcagcgagatgattcagcccttatgactgaagttctttcagagttacagggtcttcgcacttatgttggtgaacgttttgattctttggataatcgctttgcaggaatggatatccatctcacacagcttgaagaagatgtgggatatattcgtcacagcttcgatcttccaccaccaccaccaccttcttag

SEQ ID NO: 13135 - DNA, 234 bp, Glycine max
  Peptide Sequence Number=SeqID_129913
atgggtgaagaatcatggtcattggtgcgcaaccatttgcataaagaactgataagctggtccgaagagtatatcaacctggttggtggcatagagagatttgaggaattaaagcattctctacttgttgacggattatctatggttaccatggataaatggatgaatattacggatatgggatatgtcattgcttcacaatacaacgtgatcattatttctctttcacgataa

SEQ ID NO: 13136 - DNA, 348 bp, Glycine max
  Peptide Sequence Number=SeqID_129914
atggctgattgtattgttgcaaagcatactcagagagcaatccaaaaggttgataacaaatggtcaggacagcatgaagcaattggtacctgttgtgttgaagttgagtcagaccgatttccactgatggacaaaagaatcatccaaagaatactctggatcatccaacatgcccaaaaaatctacttgctaagagcaatacacaacccagagaagtcaataatcctcacctccattgctagtgagatgcatagaagaaaggaactcaatgtgtatcagcttctgtcctttgacccaagtcatggtgtcagattactcattgcggtagctgcacttgaagatgcataa

SEQ ID NO: 13137 - DNA, 686 bp, Glycine max
  Peptide Sequence Number=SeqID_129915
atgatcaacgtctacggtacaattctcaattttcttctaggatcatcttagaccctaagtacctagacatagatttctttaatgatgagacatttgactgttatcaagtgtttcaaaactctggattagttgattttatgtccttaaaattgccttattatcttgaactagttagagtcttttacagtaatttaaaaattcaggatggtattattcgttctgaggtgcatggtatttctataatcattgatcaatctctgttcttttcattaactaaattacccagtcaaggtgaaccttttgagggcaccattgttgatgactggaagtttgactattctagtcatgatgctcgccgtatggtctataatgaccaggctgacatgaccggtgctggtgcagtaacttcatttggttaccgtaaggatcgtgatggacaattactgaagaaggacacactacctccacaagacgagcgtactccttctcctcctcctcctcaaagagatgattcctcagtgcttatgaatgaagttctttcagaattacggggcctccgcacatatgtaggagaacgctttgattccttggatagtcgctttgaaggaatggatacccatatcacgaggcttgaagaggatgtgacttatctttgtcggtgctttgatcttccaccaccttcctag

SEQ ID NO: 13138 - DNA, 297 bp, Glycine max
  Peptide Sequence Number=SeqID_129916
atgacatgcggagacaaattatggtcattccccacaccttttcaccatctagaggcgatcgtgtgcggtggcacacagagacaaattatggtcattctgcgccttgccacccaggctcgatcgatccgaagacacgcagagacaaattatggtcattctgcgccttgtgtcgaccaagaggaacgaattcgacagtatcaggatgatgtgccggtacagatcattttcaaaatttttgtaggttctgctggcaggaagattcaccgttcgaatggtgtttcgctcgaacgaaattag

SEQ ID NO: 13139 - DNA, 651 bp, Glycine max
  Peptide Sequence Number=SeqID_129917
atggtttcagtcacatggcaagtgctcattgttgcagttcttgctatagtggcctcaaaatatgatcagggctattatcaagcctctggtagagaaattatacagatcaatggaactactaaagctcttatgaattttacaactgagacatcacttggtggaattactatcagagctttcaacatggctaacagatttttcaaaacctaccttaatcttgttgacgcaagtgccacactgttctttcattccaatgctgctatcaaacgaatcaagcaattcattcacataccagcagagcctagtgcaattgtagaggataatagaccaccacattttttgccttccaagggtagaatagatctccaatctctagagctatggtttagtccactaatccaagatcaagtccaagattctccaccaagtgtgcttaggtgtcatgaggcatggctaaaagatttgagaacaaagctaagcatcattcctcaagaaccaactcttttcaagggcagtattcaaaagaacttggaccctctatgtctatactctgattatgaaatatggaaggctttagagaaatgtcagctgaaggcaacaattagtagtctaccaaatctcttggacagttgtggtgtcttaaatctgtga

SEQ ID NO: 13140 - DNA, 660 bp, Glycine max
  Peptide Sequence Number=SeqID_129918
atgtcctccacttcagaggactacatgtcctccacatcagaggactacacgttctcccctttagaggactacatgtccttgccttacgagggctacacggcttcaccttttgaggactacacgccctcaccttcagaggattacacgtcctcgcctttagaggactacacgtcctcaccttcggagtactgcacaggactacacgtcctcaccttcaaagggctacacgtcatcgccttaagagggctacacgtcctcgctttcagtgggctacaaggtctcgccttcgtagggctacacgcccccaccgtaaaaggactactcatcctcaccttcagaggactacacgtcctcaccttcagtggactgcacgccctcgccttaacaggattgcatgttctcacctacagaggactacacaacctcgccttccgagggctagacgcgctcgccttcagaggagtacacatcctccccttcagagggctacacgccctcgccttcgtagggttacacacccttaccttcaaaggagtacacatactcaacttcagaggactatacatcgtcgccatcagagggctacacgtcctccccttcaggggacaacatgacctcccctttagaggactgcacgccctcgccttaacaggactgcat

SEQ ID NO: 13141 - DNA, 177 bp, Glycine max
  Peptide Sequence Number=SeqID_129919
atgaggagacggatccttaatgcggagaataaaaactcaatcttgttgccatttgcatcagttggagaagaaaacaatgacttgctaggcctatcgtcgaagttgaggtacaagaggcacttggtgatgatgacagtgtggatctcagtaccaaagctttgggactacttccgatag

SEQ ID NO: 13142 - DNA, 258 bp, Glycine max
  Peptide Sequence Number=SeqID_129920
atggactgtgactatgatttggaccgcaacatcaacgttttcttaactatctgcatccacaattgggactgcatcagccatgatatctacaaatgtgacgaaactacaatgcaaccgttactggtaaaagacttgaacaaaagagaggctacatgtgttgtgcggcattcatggttacattcgtggtcaacatctcattgcaccctcctaggggctttgtgcaagttactgggtcatcagagaacacatttagtttga

SEQ ID NO: 13143 - DNA, 289 bp, Glycine max
  Peptide Sequence Number=SeqID_129921
gatcggctccgtcgtagatgctgtcgatgtcacggtcgtcgtcggaatacctcccgacggcgtcgatgtattaaacagtgatatcgaatccggagaaagttcagaacccgaactttcagagttaccagccgtaccgtcaaggtcgggccggaccattttgatgactctagtcttgggtacctcgtacgccactcatgaatggaattgtgacatcgtgatggcagaatggacgaaaaggatgagaaatataaacatgagagttgtggctattgataagatctgcattgtg

SEQ ID NO: 13144 - DNA, 1095 bp, Glycine max
  Peptide Sequence Number=SeqID_129922
atggcaagtagacaagtaagatgtaaccagtgtggatcactattaatggtttcagcagagactcgtgtcgttgagtgcacagtgtgccatggcatgacccagattcgaccctccattacaggtgcatggagtgaagtagtctacaactcctttcatcagtttggaggtcgtctcagaagctttgcaaataccataatgcctggttctggttcagttaacaatagcaatccgcggggttattatgggacacctcaaattgcgtattatcctccacctcctcagtcactaaggccatcatacaatgcatatggcccaaagcgggctgtgctatgtggaatttgctatcatgggaaggataaccagctaaacggcaccgtgaatgatgttaaaaacatgaatatctttctggttaaggagtgtgggtttcctagggaatccattctcattctcacagatgatatggaggagagaaacccacaaaaattcccgacgaaatataacattctgaaggccatgaggtggctaattgagggtagccagtcgggggattcattggtgttccagttctcaggacatggttgtcaggaactggatacgaatggggatttcgatgagcttgatgagcgtgacgaagcaatatgtccggttgattgggaaaagcagggaattatactcgatgatgatattaatgctgcaattgttaggccactaccatacggtgctaaacttcatgccattattgattcatgcaatagtggcactgtccttgatttagcttatgtgtggagccagagggacacatgggattatcaatatggaggtcctgataaagacacaagtggagggctagcaatttgcatttcaggttgtggcgattatcaatcgtccaaagaaatccctgtcttaagtggtggtggcggcggcaatgcggtcactggcgtttttacttatagtttcatctataccatgctaaatgaaccagctggactaagttatggtggcttgctcagttccatgcgttcaaccatccgtgggatgctaaataacccaaatgcttcgctgtttaatacagattttaccttggccccaagacag

SEQ ID NO: 13145 - DNA, 270 bp, Glycine max
  Peptide Sequence Number=SeqID_129923
atggaggttcacctattcaccattatcatttatttgagcatcactggacaaagtcagaggcgagatcttgaggtcgaggccatcgtcggtgtagaattgcaacatgttgcttcaggcgttgaaacctccatcgggttttcggttcgccgatgcttgcacaattctagagatgagttttttttcatagatctaaaaaggggaaagaggggtggtggtggtgggcctggtggcggtgtgagagagggaggaaacagtggcattggagggtga

SEQ ID NO: 13146 - DNA, 1152 bp, Glycine max
  Peptide Sequence Number=SeqID_129924
atggctagtagacaagaaagatgtaaccagtgtggaatactattaatggttccaccagaggttcatgtctttgagtgtgcagtgtgccatggcatcacccagattcgacctaccgcgggtccatggagtcaagcctacaactcctttcatcacttggcaggtcgttttagaggctttgtaaataccatgatgactagttcggttaacagcaatcccagttattatgggacaactcatgaatttggttattatcctcagcctcctcagtcactaaggccatcataccatgtatatggctcaaagagggctgtgctatgtggaatccgctaccatggaaagagttacagactaaaaggctccgtgaatgatgtaaaatgcatgaaatactttttgattaaggagtttgggtttcccagtgcctccattctcatgctcacagatgatagagaggagagaaaccagctaagaatcccaacgaaatataacattcaaatggccatgaggtggctgattgagggtagccaatcaggggattcattggtgttccacttctcaggacatggtacacaggaaatgaatatgtatggagatgagattgatgggtttgacgaagcaatatgtcctgttgattatgaagagcagggaaagatactcgatgatgagattaatgcagcaattgttaggccactaccacgtggtgctaaactccatgccattattgatgcatgctatagtgggactgttcttgatttagcctttgtgtgcaagatgaatagggaaggctattacacatgggaagatcaaagatgtcccagaactgataaaggtaccagaggagggctagcaatttgtatttcagcttgtgaggatggtcaaacctccatagatacctctgccttaagtggcaatgaagctaccggtgccttgacttatagtttcatccaaaccgtgcaaaatgaacctggactaagttacggtcgcttgctcagtgctatgcgttcaaccatccgtgggacgaaaacaggcatagtgcaactaaatggtccaattgcttcgttgttgaatagacttcttggcctcgacctcagacaggagccacaactatcgtcctccgagatgtttgacgtgtatacaaagcggtttgtactatga

SEQ ID NO: 13147 - DNA, 579 bp, Glycine max
  Peptide Sequence Number=SeqID_129925
atgtttcccaacgccgaagaatcaaagtcagaaaataaaattaccgtaacgaactcttccgagttccagcaagaaacccggttccgagttggcgactcggcaccgatggacgagtggggttctgcatcctctccgccgtggccggtggcgatcgagggcggcgagggcgacacggcgctggcgaagtcgcgggtgctgacgcgggaggaggtgctccggcggcggctgcggcgaacgaggcagctggggcggtgctaccgggcccactactgggccctgatggaggagatgaggtccaagtaccgagactactgctggagctacggcaagagcccattcaaggaggatcacaatgacaacagcgacaacaacaaccaccaaaacggcgtcgtttctggtggtggtgacgacatcgtgcagtgtcgttataacggatgcaagacgaaggccatggctttgacgaattactgtcacactcatatattgggcgattccaagcagaagctttaccggggatgcaaagccgttgccaaaaagtttgtgcttgttgaagtgaaactggaagatactgcgaagtga

SEQ ID NO: 13148 - DNA, 450 bp, Glycine max
  Peptide Sequence Number=SeqID_129926
atggagaacaacggtggtttgtggtggctaatggtggctgtgggtgatggagaaagtgcttgggacgttagaaatggctttggaagaaagaaagaagaagagatgggtgttacaccaagtgtagcgaaggagtacccaaaattggtaaacataaatactcaaggcagtatggtgcagaatgcaatgttccactctattatgagatggttatctaaggacattgtcgcaacgtgcccttcgcgggcgagcgagggcgaggctcacgggtgcgctttccaaaggaggaaagatgcgcagagtcgccaccaacgtttatttgtggaaaacgtcggaaaaaccgaaggaaaccggtcaaaaataaaaattctaagttcgggagttatatttacgcttgaggaaggtattagcacctctcacgtttgtctcgaaggacaacagtctattttttaa

SEQ ID NO: 13149 - DNA, 375 bp, Glycine max
  Peptide Sequence Number=SeqID_129927
atggccaataacaatgtacccgctcaaattcccatatgctggaaagtcattaatggtactgtcgcaacctacccttttgcgggcgagcgaggcgaggctcacggggctcttgctcctacgtaccctccatcgaagaggaaatcagacctacgcagttctttctttaagggtgaatcaagcgattctttttacttggaaagtggtcattttaaggcgttggaccttaaaaattatctattttacttggggaggagcttgccacccagctcgcccaggcgagccaggttgcttcctccagaagcaactgccttctggaggaatatcctggaaggcccaagtgggtctggttgctatttgcacccacatttttactaa

SEQ ID NO: 13150 - DNA, 438 bp, Glycine max
  Peptide Sequence Number=SeqID_129928
atggcaaatgaagtggacttcaagattgaattgaaagtgtcagctaattgctgcgaaggaagcaagaggaaagtcaagaaggctttaagaaacccagaagtgttaggaaacgttaatccacacattttgattaaaaagcttcaaaaggtcggaaagcacgccgaactgtggagctatgaggaatttgaatctgaagaaaaagaagaactattggcaaatgagaaagaaaaacagaatgtgtgggaacaagagaaacagcctcatccatgtgacattaaaattgataaaactaaggatgtcacaaggaagaaaaaagcctcaaaagcttgtgttgaagagcacatgccaagatttgagcctccaccattcttgagaccaacagagcgagtaggggactatttcagtgatgaaaacaccacgggatgccatgtcatgtga

SEQ ID NO: 13151 - DNA, 573 bp, Glycine max
  Peptide Sequence Number=SeqID_129929
atggttggaggcagagaaggatacagaaaaggagtagttgaagcaaaactaaaggtagccataaacggatttgggaggataggaagaaacttcttgagatgctggcacggtcgcaaagactctcctttagatgtcattgccatcaatgacactggaggtgtcaaacaagcctctcaccttctcaagtatgattccacccttggaatctttgatgctgatgtcaagcctgttggtgacataatctcaatagatggaaaggtcatcaaggttgtctctgaccacaaccccgtcaaccttccttggaaggacttggaaatcgacttggtgatcgaaggaactggagtatttgtggacagagacggtgcaggaaagcacattcaagcaggagcaaagagggctgctgcccttaacatagtgccaacctcaacaggagcagcaaaggctgtggtccttgtcctcccaactctcaagggcaaactcaatggcattgcactccgtgtgcctaccccaaacgtttcagtggtggaccttgttgttcaagtcacaaagaagagacctttgctgaagaagtga

SEQ ID NO: 13152 - DNA, 987 bp, Glycine max
  Peptide Sequence Number=SeqID_129930
atggtgatcgtggcaactgagaaagaatcgacaactcacaccaaaatccttgacatctatggcaaatacttggagcaaccatttattattggcaggaataaaaaagttgtctttggctttttgaaagacagaatctggaagtgcatcgaccattggtcagggaaacaactctcagaggctagtaaggaagttctgattaaatcatgtgctcaagcaatctcatcttattgcatgagtgtctacttacttccagcgtttcttgaggaagacattcagagaatgaagaactccttttggtgggattcgaaaactgcaacatcaagaggtatcaattggcttagttgggacaagttatctatgaaggaggagtttggaggcttgggctttcataatttacatggtttcaacctatccatgctaggaaaccaggggtggaaactcatcactcacccaaatgctacagttacaaaatttacaaagctaaatattttcctgaaggagctaagcagatttaggaggctgcgggtttctgacaaggttgaccaggcccaaaatacaaaggatctcatcttcaaagttctgcaaatcctaccatcacaacatcaacaaaaatttgcaatgatgctctggtgtatatggaaacaaagaaacgagaagttatgggaaaacttggacactaatcctaatatctcggtttctctaccaatgcaacttctgcacgagtggcaacacgcgcgcaagcattctaggacaccaacagtttcaaatattcagattccagcaacatggtgcaagccttctcttggattccttaaattcattgttgatgcagctttgtttaaagaccataaatgttttggggtaggaatctgcataagagatgacaagggtgcatttgtgaaagccataactcatctatctccaggatggccaaaacccagagaggctgaagcttggggtcatcttcaagccattacatgggcttaa

SEQ ID NO: 13153 - DNA, 708 bp, Glycine max
  Peptide Sequence Number=SeqID_129931
atggtggttctgagattcagcttcatcttgataaatacacaggtactggcttccaatcaaaagggtcctacttgtttggtcacttcagcatctggcacagtcactgctttctatttatcatccacaaactcagaacatgatgaaatagactttgagttcttgggaaacagaaccgggcaaccttatattttgcaaacaaatgtgttcaccggtggcaagggtgacagagaacaaagaatctacctctggtttgaccctacaagagaatatcacagatactcagtgctatggaacatgtaccagattgttttctatgtggatgactacccaataagggtgttcaagaacagcaatgacttgggagtgaagttcccatttaaccaaccaatgaagatatacaacagtttgtggaatgctgatgactgggccacaaggggtggtttggagaaaacagattggtccaaagcccccttcatagcctcctacaagggcttccacattgatggttgtgaggcctcagtgaatgccaagttctgtgacacacaaggcaagaggtggtgggatcaacctgagtttcgtgatcttgatgctgctcagtggcaaaaactctcctgggttcgccagaaatacaccatctacaactactgtgctgaccgcaaacgctaccctcaagtctctccagagtgtgctagagaccgtgatatttaa

SEQ ID NO: 13154 - DNA, 572 bp, Glycine max
  Peptide Sequence Number=SeqID_129932
gtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaatcgcgatgaccatttgtgcgaatcaacggttcctctcgtactag

SEQ ID NO: 13155 - DNA, 1020 bp, Glycine max
  Peptide Sequence Number=SeqID_129933
atgattaatggaaatggtactcagactgagtattggggcgaaagttcgggttcaacttcccatagcagtcagcaggatgtggaggatgacaggatgattgctcttgtgctgtctgaagagtatgccaaattagatggagcagttggccggcgccttaccaacttggaacctgttcgtcttaagcttttggtagaattggttcagggcatatctaatgctctcaaaggacatacgggcactgctgttcttatttacttcttcctttctctgcccgtgaactttctagagttggctcttagttttgtttctcatgtaccccggataaattcctttatccccactgtaagtgatgccagtatggatcaccagcgtctgcttcagaggttgaatgtctatggtttatgtgaggtcaaggtatctggagatggaaattgtcagttccgtgcactttctgatcagttgtataggtcacctgaacaccacaagcatgttcgcaaagagatagtgaaacagctcaaagatcaccgttccttatatgaatgctatgtaccaatgaagtacaaaaaataccacaagaaaatggctaaaactgcagaatggggggaccatgttaccttacaggcagctgcggataagttttctgcaaagatatgccttctaacatcattcagagacacttgcttcatcgaaattatgccactgtaccaagcaccacagcgtgaactgtggttgagcttttggtctgaggttcattacaattcattgtatgaaatccgaggtaaagggggaaaaaaatccataaaacggcctttcaactctgaggctttggcaagtagaactcttgacttccaattgagaattgaccacttttcagatttggaagatatcttaatagcccactactttctactttttgtttgtcagtttatctttgccactaccttcacaccatttcaaccacccccgttcacccgttggatcttttggcgatcagctccttgcatgatccaagatatctaa

SEQ ID NO: 13156 - DNA, 190 bp, Glycine max
  Peptide Sequence Number=SeqID_129934
ggaaaaagagggaggtgtttgccgcccagctcgcccaggagagctgggttgcttccaccagaaggcaccgccttctgttgaaacaccctggaagattgcgcaacaatgctttctttcgacttccgacttgtcgcggaacttcatggattgcctaatgatgggtgttaagtaccttgaagcagtcaagtga

SEQ ID NO: 13157 - DNA, 354 bp, Glycine max
  Peptide Sequence Number=SeqID_129935
atggaaaaaaaaggtaacgaccaaacatgcatagatattagaaaacattcaaggcatggtcattatagcttacctcgaacattcgtctgtcaaacaccaaacaacatcagtgtcgcaacgtgccctttggcgggcgagcgagggcgaggctcaccggtgcgctttcaaaaggaggaaagatgcgcggagtcgccaccaacgtttatttgtggaaaacgtcgggaaaaccgaaggaaaccggtcaaaatgaaaattctaagttcgggagttgtatttacgtttgaggaaggtcgacaaaagcggggctcttgctcctacgtaccctccatcgaagaggaaatcagacctacgtag

SEQ ID NO: 13158 - DNA, 228 bp, Glycine max
  Peptide Sequence Number=SeqID_129936
atggctacgagagattcttattggaaccaggttgcaagtgttttgaacattttggatgatgagctgatcaagaatgttggagactacattttaagattgttgattattttccttaataagctcaattggcaagcatcaaaatatgcctgcatcaagcaaactcttttattatttcttcagaagccatgtgtggcctcacaagtgacctttaagtacagccaccggtaa

SEQ ID NO: 13159 - DNA, 216 bp, Glycine max
  Peptide Sequence Number=SeqID_129937
atgattgatggccttggtgttgctggaatagaagctgcaatgcttggccagaataccttggtagagttgtgttcaacacaaatggcaggaactgattcacacataactatgattgatggcctgggtgttgctggatggggagttggtggaatagaagcacaagctgcaatgcttggccagacctgtgtggttttgactatcggagaagttatttag

SEQ ID NO: 13160 - DNA, 516 bp, Glycine max
  Peptide Sequence Number=SeqID_129938
atggatgaagaccctgtgagaatagttgaggaattaagaagaactccaaaatcacctgtttcttccaagtctcaaaaaggaaagaacactattcatgtagatgactatttcatgcctagaacaactcctaaagctcaacctagcttgaagagtgtcttgcaaaataagaaaattgtagaaaagtgtgacaaagccattgcaaaatggatgatagatgctatagtgccatttaatgcaattaactcgacatattatcaacctatgattgatgttattagtagcatgagtccggtgtataaatctccattttttttttatagaatttgtggtcctttgttatataaatggtttgatgaagggaggaagcttgttaaaatttaccaagaagtttggaaggaaactagatgtactatgatggctgatgggtggactgatcaccctaggagaactctcattaattttcttgtttattgtcctaaatggactattttcttaaggtctattgatgcttcctaa

SEQ ID NO: 13161 - DNA, 225 bp, Glycine max
  Peptide Sequence Number=SeqID_129939
atgtcatctgccgaagccccatcatctcaagaaacatccactccaaatactcctcagaatggtgctacaaaagagacaatgatgtgtatttattgtgataaaggagttaagggaggtggtattaataggtttaaggctcacttagctggacaaaaaggccaagtagaggcttgcaagaaagttattgttgatgtccaacaacaaatgaaacaactgcttgaatag

SEQ ID NO: 13162 - DNA, 606 bp, Glycine max
  Peptide Sequence Number=SeqID_129940
atgtccctctatgatagcgtttatcagaacatgtattttgctttcattaaattcactctgttggataaacaaggagctgtgggacccgtaaaaccagcagatagaccggatcatgaggatgctaccgtgttcagggtgtttaatcaagacttcccattatacataaagcatgaagatctgtctgaaattgcacacggtggtcaatgtctctgcatatctgttatacagttatggattctgcatctgactaatacaagtatgcgagcggagaattctgatgtgcatggattcctcgagccacagttcatccaaagatttgggcaatcacaatttgaatcaaaaagttacatgaaaaactggatgcataattcaaaacgtgatgtctacctaggagcctacctgaatgggccaaacaactatcttaaaggaataaataacagggctttgaaaggacttgatgatactccacaacctaaattcaaggctggtgctaggtggattgttgttaagtattttaatgatgttagaccattggaagcagagagattcaaggtgcttcgcatccagtgggcacaatattatctgaaacttagaaatcaaacttag

SEQ ID NO: 13163 - DNA, 327 bp, Glycine max
  Peptide Sequence Number=SeqID_129941
atggggtttgttgtgagttcatggtggggctcgttaggttttgcaacgatagtggcagtggagatcacaatcgttgggtttcatgaaggggttgcagttgagatcatagtgctgcagttaacagtgtggtgcacagagttgcatagttgtgccattgatggtgaaaacaaagaaccagtgtgggagctccaagatagacacgatgtagtggttgcgggtgaggacgtgggaggggatggaggaggcagtgatggcaaagacgacggcgtaacacctctggttcatgttgattttcccgtgccaacgatgccagatcctgcacagtga

SEQ ID NO: 13164 - DNA, 285 bp, Glycine max
  Peptide Sequence Number=SeqID_129942
attgcaagggaggtgttggatgtagctgctccgattattcaacctagtgtgacgactaatgagattgacagagttattcacttggcaactattgctgcagcttcaatgaggttctttaatggtgatttgccaccatggagatgcagcggaagacaaaagagaagaggtgagaggagacgtcatccactagggaataagccatggaagaaggagcttcaccaccaagatgagccttggataagaagcttggagaggatgcttcaatggaggaaaagaaagaggtag

SEQ ID NO: 13165 - DNA, 429 bp, Glycine max
  Peptide Sequence Number=SeqID_129943
atgtataaggccaaaaaggagatggttgggaggtttcaaagaaataagaagaaaatggagtcttacttggaggttgtagattcaatgttgaagaatttgagatgcataggaatacacaatttggcattttggaactcattgatatatacacatggagatcttgagttgctaggtaaattaaatgaaggcatgaggatatataaaaattttgaaggagattttgcaagacaagctgcaatacgtgaccgaaacatagtcatgtcagataaattaaatctggatgaagatgaggatgatgatgtgccacaaccactagataacactatggaagatgttaatccaaatgaaagcaatattggtgaagagcctcattcttttgatggagaaggattacttgaagttgactcaatattggctccttggatataa

SEQ ID NO: 13166 - DNA, 1473 bp, Glycine max
  Peptide Sequence Number=SeqID_129944
atgcttttggagtatgcacgaagtgaatcatatcttattctccgcgatagcccagtacaaaagatatggcatggctcactgtcgatcccagactcgtgcttcagtaacttgggcaccttgattgttggcggctgccaatttttatccgatgcagtgctacccttcaatttacttcctttattacctaaattggaagaattggaagttaaaaactgtgaatatgtgaaaaccatatttgatgtgaagtatataacccaagacagaaaaatgacaactatgggagcaaccagcatccccctcccttttccccttaagaaattgactttatcggagctgccaaatctggagaatgtttggaatgaacatcctcatagaattccaaggatgcaacttttacaagaagtatatgttgacaattgtaaacgccttgctagtgtgtttcccacatcggtagccaaagatcttctgaaacttgaaaatctagttgtgaaacactgtgaggggttgatggcagttgttgcagagcataatgcagatccaaaaggaacaaatctagagctaacgttccccagtgtgaagtcattgacgctatgggatttgccgaagttcaactataatggtatatattgcattcatgatgcaacaaaaataattgagcttacacccaacttacaacatctaacactcggtcaaaacgaactcaagatgattttgcatggagaaattcaggggaaccatttaaacaagttaaaagttctaactctgtgctttcatgttgagtccgatgtatttccacatggatttctacaaccggtgcctaatatagaggagcttgtggtgtgtgatggatccttcaaggagattttctgccttcaaagtcctaatgtggatgatactactctcctatcacaactgaaagtgttacgcttggagtcccttccagagctcgtttccattgggtcactaaatttggtaccatgcacaatgtctttctccaatctgacaaagttgaaagtaaaaagttgcaatagcctgctatgtttgttcacatcctcaacagccaaaaatttagctcaactccaaaatatggagatagaattttgtgaatcaattaaagagatagtgtctaaggagggggatgaatcacatgaggatgagataacatttccgcagctcaattgtttggtacttaaagacttaccagatctcagaagcttctacgaagggagtttaagtttcccatctttggagaaattgtcagtaatcaaatgccacgggatggaaactttatgtccgggtaccctaaaagcagacaagttgctaggagttcaattaaagagcgggtactcagatgtcatgccattggaaattgatctcaagtctaccatacggaaggcatttctagcagagataccttttcggatggaaagtgcatgttattcgttagcaatcatcacatacccaactttttga

SEQ ID NO: 13167 - DNA, 150 bp, Glycine max
  Peptide Sequence Number=SeqID_129945
atggacgcagcaggaaacaacaatagtgagagtgagagtgagagtgcatgtagcaacatcctgacagttcaaatgacaattagacgagtgaagataggcccaaaaaagaattgtgttaaagggaatgttgttaacattctcagtagataa

SEQ ID NO: 13168 - DNA, 1116 bp, Glycine max
  Peptide Sequence Number=SeqID_129946
atggacatatacggtcctgagaaccttcatcttccacaacggtacaccgaacaatcattgagcaagtttaccgttgagcaagtttaccacttatatgattgtgaggattatctcagaaagaatctctcggcgcttgatcctgagatgcaagatgctccggttgaatctgcacctttgacaatgtcagcagaagcatgttcaatggatccacttagttcagctaaaggaaatggaaaagaaggtattaataatatggaatcaattatgtgggatgaaccttcgaaaaaatttctcatttcagaaattgatcatattgaaagctttgtggaacagttgtctgtgagtttgaaacgaatttgcaaaaaattgaatgaaaatgagattgagtattctgaaaatccatgtatcccctctaagattgagatatcttccacgaacccagaccagaagaatccagattttgggttttgtgaatgtggtttaatgctagggaaattaaattttgttttgactcattctccagtatcattgctgtctctaattcttagtcagattcagcatgctctttactgggaggacaggagggaagcatccattgtgtcaaattttgtggacaaagagaaattgcttgggttaacaaatatgacttcaggaattgatattgaagtggttgttggttcaccttcatttggtatagtaccattgacaggtcagttgggacatggtaatggcaaagcagagtgtgttaaattggaccctcgggcgattgaaattccaaaaccaaataatgataaatatgcctcctcaggaaagatttcaattggttcctaccttcatctaaatgacataaatgcttgtatgatcaaaggtaaaggattttcagggacaaaacggtactttggcgatttagggacaactcagttgagatcagctggctccaatatagcttttgcagctgtagctgaaatatcagattctgttctgaaaggtgcagtgagtggctttcaacaaggaattctaaaattggctatggagccatcagttctgagaactgcattgatggaaggtggtccagatagaaaaatattgcttgatcgaagtccaggggttgatgag

SEQ ID NO: 13169 - DNA, 1360 bp, Glycine max
  Peptide Sequence Number=SeqID_129947
atggcacaccagaatgcaatcctaactgttgaaaacaaagatgttacattcatcaaaccttcaaagcccactcctaccaccattctttcactgtctagcattgacaatgctcccgataacgatttcttcatgcaaagccttcatgtataccgatgggaaaatcacaattcccctaatactccaaaacttggccctgcaaaattgatcaaagtggcactctcggaggctctcttttactattatcctcttgcaggaaagttagtaagacacgctgatggaaaattcagaatcaactgcaactccgaaggagttccattcatagaggctatttgtaactgcagcctctcatctattcattacctagattgcaacgacgtcgaaatcggaaaacattttgctatcgattttccttcggaagatgaatttggaaaccaataccctttggttttcaaggtgactaaattcctctgtgggggtttcacattagtgatgggcttgtcccacgctattttagacggaactgggcaatctcagttcttacgcgcagttgctgaacttgcaagtggaaaagctgagccctctgtgaagcccgtgtgggaaagagaaagactagtgggaacatatacaagtcaaccaatgcaaaatcccatggacaatgcttcttttgcagtttcaccatttctaccaaccacagattattcgcatgaatgctcgaaggtggacagtgagagcataacaagactcaagacgagtttgatgaaagaaagtgacaacaaagaaagtatgaagaaaaaagggttcacaacttttgaaaccctagctgcgtacatctggaggtcaagaaccagagccatgaaactgagttacgatagaaaaacattgctggtaatgacagtagggttgagaccacacttgctgaatcctttgcctgatggatattacggaaacaccatcatggatgcatttgttacgttaacagtgagggagctgaacgaactaccactattggaggttgtgaaactcatcagagagagcaaagaagttgcttttagcgatgactatatcagacactcaatcgacagtatgcatacgaagccaatggaatattattatgaaagaggtggaataacgtttataacggattggagacatttgggtttgttggaaaaggttgattttgggtggaaggagccagtgaatactatgccagtcccttcggacatgtatggattaataggtttgtgcaatatctttcttccaagtaatttggatccttcaatgattggaggagctagggtttacgcctccctgcctagtgctgccatgcccaagttcaaggaagagatgaaagctcttacca

SEQ ID NO: 13170 - DNA, 468 bp, Glycine max
  Peptide Sequence Number=SeqID_129948
atgcatctctcactatggaaacccatttctcaatgtgctgcactgatcatggacaagagcaggaggaaagaagaatccaatgttgaaatgaggagaaacccatcaatgcttcggaagctgcaagagaacaagctcagggaagcacttgaggaagcttctgaagatggctcactctccaaatctcaagacatagaccagcctgactctgctgccaaccaggatgatggccttgggagatcccgatcgctcgcccggctccatgcccagcgcgaattccttcgcgccacagcgcttgcggccgagcgaatcttcgagtccgaggaggaaattcccagcctccaggaagcatttgccaagttccttactatgtacccaaagtaccagtcctccgagaaggttgatcagttgaggtctgatgaatactcacatttgtcaccaaaggggatcagctttcaagttgctggctga

SEQ ID NO: 13171 - DNA, 240 bp, Glycine max
  Peptide Sequence Number=SeqID_129949
atgactatgacaacactaaatggtgatagtggtcgtgatatggtggtagcaatgacaaatgtgatattggtggtaatggtggcagtggcgacaacagcaacaacagtgataatggttgtgatgatggtggtaacgatgttgacaacaaaaagtttagatgttctgaagcgccttaagcatgtcaacaacaaggttcccaaaccctccatccaatactttgaaaacacttcaccaacctaa

SEQ ID NO: 13172 - DNA, 273 bp, Glycine max
  Peptide Sequence Number=SeqID_129950
atgcataaaagagttatcgcgacagcctccttatgctcgatgtcgagcttgaactcgaggagagttggaactcgatcttggattggtagtcatgatgacagtgatgtggccctcttaatagcgactttcctccttctaattgatcgacgagatgatgtgccacaaggtgtggcgcgcatggatctcgttattgtatgcaacggagacgacgttcctctgctccacgatgagttcttcgttgtcgacagcggcaagggaacacatcaacattaa

SEQ ID NO: 13173 - DNA, 2136 bp, Glycine max
  Peptide Sequence Number=SeqID_129951
atgcgccctctgttccgtttggctcaagtagcccggcgccactacaaggcgtcgtcgccaccaccaccgagcccaccgaaggccccaaagaagccgcagaagttcagcttcgacggcgcaacgtgggaggacccatacagctggatgtcgcagctgaacgacaaggtggcgatgcggcacatggacgtgtgcgtggagcaagaggagaagtacgccgaggccgtcatgtcggactccgataacctcctgaacaagctccactttgagatggcctctcgcatgcccttcgacctctccacccctcccctccgctggggcccctggctctactaccgccgcgccgaagaagccaaaccctaccccgtcctctgccgccggttggctagcttgtacgaagacttcatttcacataagtacccccccgcgggtttcgatttcactacgggaaagaccattgagcagaagctccttgattacaatcaagaagcccagagatttggaggttatgcttatgaggaactgtctgaggtttcgccgaatcatcagtttcttgcatatactatgtatgataaagaaaatgactacttcaaattatccgtgagaaatttgaattcgggttcgttgtgcagtaagcctcaggcagatcgagtttccaacttggcatgggccaaggatggacaggctctgctttacgttgtgacagataagaaaatgaggccttaccgtatctactacagtctgattggatcaactgatgaagatgttttgcttttggaagagtcagatgaaaatgctcccaaaggtggtcgatcagttgattgtcattatcttctttttagtccagtggatgatccttcaagtacaagaaaatgggaggaggtattagtcgatgacccaggtttgattattgaggatattgattttagtgataaatacttagcactcattgtaagggaaggtcgaaaagttcagctttgttcagttggactgccattgccctttgggaagggagcagttaaactgaggaagctggacctacagtacttgcccattccaagacatgtttgccaaattacgcctggaccaaactatgactttttctcatctgtcatgcgctttataatatcatcacctgtgatgccagatgctgtggttgattatgacctggccacaggtaagtggaacatcattcaacagcaaaatgtgcttcatgacaggacaagaatactgtatggtaaaaattctgcaagtattagtatggagtcctcaaattcaaaacactccaatcctgtgaatgttaactctgaagatgaccacttatggaatgacctgtctgagttttatgcctgtgaacaatatgaggtcccttcatttgatggagttttgattcctttgactattgtttttgcacgtaacaataagatagaagctaaaaaacctgggatattgcatggacatggagcttatggtgaattacttgacaaacggtggcgcagtgaactaaaaagcctcctggatcgaggttgggttgttgcctatgccgatgttagaggtggaggtggttttggtaagaaatggcataatgacggaagacgtacaaagaaacataattcaatcaatgattacatctcttgtgccaaattcctcattgaaaaagatattgtgcatgaaaacaaattggctggttggggatatagtgctggaggacttttggttgcttctgctattaatcgttctccagatttatttcgtgctgcagtcttgaaggttccctttttagatgcaaccaacactcttctgtatcccatcttgccacttatagctgctgactatgaagagtttggctaccctggtgaccttgatgattttcttgcaattcgagaatattctccatatgacaatatacgaaaggatgttctttatccagctgtattagtaacctcatctttcaatacacgatttggggtatgggaagcagcaaaatgggttgcacgagttcgtgatctctcagtttacgacccaaagcggccaatattgctgaacttgaccacagatttagtggaggaaaaccgttatttgcagtccaaggaatcagcattagaggccacatttctcattaagatgatggaatattag

SEQ ID NO: 13174 - DNA, 2379 bp, Glycine max
  Peptide Sequence Number=SeqID_129952
atgtcgccggcggtgccgatcgccgccggcaagattccggtggcggcggcggttgcgttatccgatgcgctgtctttgccggtggtgcaaccgctctcgaaggagctgaaagtgccgagctccgaacccgcggtatctcctacgtcggtgatcgccttcgaccggaccacggtgtcgccgacctccgcacgaagctcgagcgcgttgttactaagccactcgaattgcgagcaagcgagtttcgatttcaacgattcgagccaacgcgactacgcgtccacgttgagttccgattatccatcgtctcacaacatttctcctctaaaaacaaacgaaactgaacatgaacgcgaagctaaacgcacacctgtgttgggtttggagaaggaggagcaacaacacgaagcgaaagagagggttaagcgagaaaatgtaataaagaagacaaagaaaggttcatgttattgttgcttaaaggggaataggttaacggagaaagaaacatgtctggtttgtgacgctaagtactgcgcgaattgcgtgttgagagcgatgggttcgatgccggaaggccgcaaatgcgttggctgcatagggcttccgattgacgaggcgaagaggggcagtttagggaaatgctcgcggcttttgaagagattgctcaattatttggaggttagacaagtgatgaaggcggagaggttctgtgaagtgaaccagcttccgccggagtatgtttgcgtcaatgggaacgaacttacttttgaggaacttgtcacgttgcagagctgtgctaatcctcccaagaatttgaagcccgggaactattggtatgataaagtctctgggttttgggggaaggaaggaccgaagccttgtagaattattagtcctcatttgaatgttgggggtcccatcaaagcggattcaagcaatggaaacacacaggttttcattaatggaagggaaatcacaaaagtagaacttcggatgttgcaggctggaacgattcttgtatgtgctttagggtccctgccagttccttctaattcaaaatgttcaagttcgtgtggatttctatcctgcaatgtggttaccagaccagttcatggaatagttcataaactcctcttacttggttacaccgggtctggaacaagcactatttttaagcaggccaagattctttacaaaagcacccccttttcagaagatgaacgtgaaaatataaagttgaccattcagaccaatgtgtatgcttatcttggcatactctttgagggtcgtgaacgttttgaagaagaaagtctggggaatttaaagaaaagtcattcttctgtgcttgacactacaggaaccagtccaaaacttggcgacaagacaatttattccattggcacaagactgaaagcattctctgattggcttctgaaaactatggtttcgggcaagcttgatgctatctttccagccgctactcgtgaatatgctcctttgattgaggagttatgggacgatgcagccattaaggccgcctatgaaagaagaaatgaaatagaattgctacctagtgttgccagttatttcttagagcgggctgttgagatattgaggactgattatgaaccctcggatttagatatcctctatgctgaaggagttacttcatccaatgggatggcttctgctcctgaggaaactgtcgacactgccgatctacatgattctttagttaggtgggtgaaaatatttgcgcctattgtttcatgtgagaaattttctaggtatcaactaattacaatacatgctagagggctagcagaaaattgcaagtggctagaaatgtttgaggatgttgaattggccattttctgtgtttccttgagcaactacgatcagttttctgttgatggaaatggttgtcgcacaaacaagatgatatcgagcagaaagcttttcgaagccattgttattcatcctactttcgagcaaatggacttcctgttgatattaaacaaattagacgagtttgaggagaaaatcaaacgaattccgctgaccaagtgtgactggctatctgatttttgtccagttattagtcgacaccgctgtggcatcaacagcaacagcattaacaacagcccctccctttctcagctggcttcctattacataggagtgaagtttaagaggctttattcgtctcttacagggcgaaacttgtacgtgtccctggtgaaggggctggaacctgatagtgttgttgaagcacttcaatatgcaaaggagattttgaagtggaacgaagagagaccaaactttagcttaagtgataataactcgatgtatagcattgaggccagttcattctctcattga

SEQ ID NO: 13175 - DNA, 102 bp, Glycine max
  Peptide Sequence Number=SeqID_129953
atggaatggaatagtctgtcaacctttgctgcctctttcttcgacaggtcatgcttatctagtgcatgtccacgactgatggtgagaaggccaggttcttga

SEQ ID NO: 13176 - DNA, 273 bp, Glycine max
  Peptide Sequence Number=SeqID_129954
atgctcttcttcttcctccaacggttctgcttcttgagtttcctgcttcttcagttttcttcttcctcccgcgcagcttcttcattcttcttcttcttcgccgccatcgccgccattgttgccgtgtttaggaggaaggtgtgggtcttcgcgtttgtggtgtgggtcttcacgtttgtgcttcttcttcgcgtttctgcttcttcttcgagaaaacgctgtcgggaagttgttgggttgtttacggatcaagtgatctgtaaagcatattaa

SEQ ID NO: 13177 - DNA, 312 bp, Glycine max
  Peptide Sequence Number=SeqID_129955
atggatgatagatggggtgagctagatgcgggattcgatgaacaagttattactctacaaaatatggacacacaagatacattgcttccatctatatcaccaatagagccattattgggtagaggacatagaatcaaacaaccttttactcacttgcaagattacgtgacaaatactgccagaagattaaatccatctaattgttcaccctctccaaaggcagactcaggtgcactctatcccataactgattatgtgaattataaccatttttctcttgcacattgtgcttttcttgaatccatttcatag

SEQ ID NO: 13178 - DNA, 306 bp, Glycine max
  Peptide Sequence Number=SeqID_129956
atgattgataataattctgggtgtagtggcaataatagcccagtcgaagaggagaataaagcgtgcgaagttgcaattcatttcgatgatagagtggaaaaaacaagggaaagggaatcatgtgcgtgcagaaaaggccaaaaagaggtcattactgattacattttacagaagcactgtatagaagagaagcgaagcgaggagatagcgattgtgttttggggtccgagaaagagaaagaaacaaggggtctctccactttccaagtttccaagttttgtttccgctgttgaaagcgacccatga

SEQ ID NO: 13179 - DNA, 1122 bp, Glycine max
  Peptide Sequence Number=SeqID_129957
atggccttgttgaattctaatgacatgttggtccttctgattttgctcttgaatgtgagcttttacggaaatgttgatgctcagaaaaatggcttaggagcctctttcatctttggagattccttggtggatgcagggaacaataactacttgtcaactctttctaaggcaaacatccctcccaatggaattgatttcaaggcctctggaggaaaccccacaggccgctataccaatggaagaaccattggtgatttagtaggagaggaattgggacaaccaaactatgctgtaccatttttagctccaaatgcaacagggaaaatcatactcagtggagtgaattatgcttcaggagggggagggatactgaatgctactggaagaatatttgtgaatagggtaggaatggatgttcaaatagattacttcagcataacaagaaaacaaattgacaaactgctgggtgaatcaaaagccaaagagtatataatgaagaaatcaattttctccatcacggttggggccaatgactttctcaacaattaccttctcccagttctctctattggagcaagaatttctcaaagtccagattctttcattgatgacatgattactcatttcagggcccaacttacgagactttaccaaatggatgctcgaaagtttgttataggcaatgttgggccaataggctgcataccttaccagaagactattaatcagctgaacgaagacgagtgtgtggatttggctaacaagcttgcgcttcaatacaatgctcgattgaaggatttggttgctgagcttaacgacaacctccctggagccaccttcgtccttgccaatgtttatgatctagtgttggaactcataaaaaattttgataaatacggattcacaacggcaagtagagcttgctgcggaaatggagggcaattcgcagggataattccgtgtgggccaacatcaagtatgtgcagagataggtacaagcatgtgttctgggatccttatcacccaagtgaggctgcaaacctaatcctcgccaagcagctacttgacggagacaagagatacatatctcctgttaatcttaggcaactcagggatctatga

SEQ ID NO: 13180 - DNA, 705 bp, Glycine max
  Peptide Sequence Number=SeqID_129958
atgccgtcgtcgaattccggcgagagtcgccgagcgagcaagccgcagagctcgggcggagcggcgccgccgccgccggagcaggagaacctgccgtgcccgcgatgcgactccaccaacaccaagttctgctactacaacaactacaactactcccagccacgccacttctgcaagtcctgccgccgctactggacccacggcggcactctccgcgacattcccgtcggcggcggcagccgcaagaacgccaagcgctcccgcacccaccacgtcgccgccacatcatcctcctccacctcgtccaccatgacgtcagcacaggaacaccacgcacacactttattggcccccgtcgcctccacgcactacggagtacttgacggcgacgttaaacagactagcaacggcaacggtaacgtgtgcgggagcttcacttcgttgctgaacaacacccatggctccgggtttctcgccctgggtggctttgggcttggacacgggtatgacgacatgggttttggcattgggagatcgggctgggccttcccaggaatggtcgacggtggcaacattggcggcgccgtcgcgtcttctggcctaaacacgtggcagttagagagtggcgaaggagggttcgttagcggagattgcttcgcttggcctgggcttgcgatttcaacaccgggaaatggtctcaaatga

SEQ ID NO: 13181 - DNA, 1854 bp, Glycine max
  Peptide Sequence Number=SeqID_129959
tcaaacctggagtttattgccacaattgaggaagaagccatcatcaagtccaaagaaagaaacacaattagtactaagacaaaggaggagggtatcttcctaacatgggaggatttgcaggtcactgttccaaatggaaggaatggtaggaaaccgattcttaagggtctaacaggttatgccaagccagggcagctcttggcaataatgggtccttctggctgtggcaaatccacacttcttgatactttagcaggggtcaaatgggctctcaggagatcaaatgggaaggcatatgtgacacatgatgatgctgtgttgtcaacattaacagttggagaagcagtgtactattcagcacatctccaatttccagaatcaatgtccaacagagacaagaaagagaaagcagattttacaatcagacaaatgggactacaagatgccactgacacaaggattaaagggaagggttctaaaggccttagtgagggacagaagagaagactagccatttgcatcgagattcttacaagccccaaacttctccttcttgatgaaccaactagtggcctggacagtgcagcttcatactatgttatgagcagaattgcaagtctaaagataagagatggcatcaaaaggacaattgttgtatccatccatcagcctagtagtgaagtttttgagctatttgataatctttgtcttctgtgttcaggtgaaacagtttattttggccccacttctgctgcaaccgagttttttgctttaaatggctatccttgtccacctctccacaacccttctgatcatttcttgaggatcataaacaaggatttcaaactggatgatgaagagtgcttcaacaaaacattacccaaagaagaagcagttgatatccttgtagggttctataaatcttctgaaattagtaaccaagttcagaaagaagtagcaataataggtgaaagtgaacatggtttcatggagaggaacagaacacagactgcatttcttactcagtgtcacattcttgtgagaagatcttctttgcatctgtttcgtgatgtaagcaattattggttacgtctagctgtgtttgttctagcagctattagtcttggcactatattctttgacgttggttcaggtgaatcatctatccaggctagaggggccctggtctcttttgttgcttcagttctgactttcataacccttcttggtggattccctccatttgtggaacaaatgaaggtatttcaacgagagagattgaatgggcactatggtgtcgctgcttttgtaattagccacacattatctcctattccatatatggtactaatgtcactgattcctggagtgatcacttactacctttctggacttcacacgggacttgaacgttgcctatacttttcttgtgtgctacttgcatgcatattgtgggttgagagcctcatgatggtggtttcaagtatcttcccaaatccaaacacaggcatcacagtctctggtggaatcatgggaatcatgatcttaactggtggattctttcgcctgccaaatgatcttcccaaaccattttggaagtaccctatgtactatgtttccttccacaaatatgccttccaaggattgttcaagaatgagtttattggcttgaatttggctagtgatcaagatggaggtgcctacataagtgataaagaaatactgacgaagatatggcaagtggaaatgggtcactcaaagtgggttgatcttgctatcttggtggggataattgttttgtatagacttatgttcttggcgatcattaagagcaaggagaagatgaaggcttga

SEQ ID NO: 13182 - DNA, 426 bp, Glycine max
  Peptide Sequence Number=SeqID_129960
atggatatgcatcttggatccttcatttctagtcagattacactcatggcccagcacaactcctcgaggctcggcgttcctgtcctaatcactgctttatgtaaagcccggggggtccactctgatttcttgaccctggagagcctgagtcctgccattaatttggcatatattaagaagaactattggaatcttgatgatccaatagtcacattcagaggacccaggaaggccagaggtaagagatctgaggccccttccacaacaccaccagcaccagcaccatcaccagcagcagcagaggaggagaccactccagctcagagcccacagccatctccactatctgcacctgctcctaaggagattcagccttcagcactggatcttaatgaagaccaaccacaggaggagcaggacgtttaa

SEQ ID NO: 13183 - DNA, 864 bp, Glycine max
  Peptide Sequence Number=SeqID_129961
atgatttctattcccgatactttgctggcaagaatcatcaaaacaaaatattgtcctttgggagatttcatgggttcctcgctagggcataacccatcatacacatggcagagcttattttcctctaagatagtattgaagaaaggcagtaagtggagaattggtgatggttctaatatcaatctttggactgatccatggttacaaagagagaataattgctacccttcgtctcctactgttgtagggttggaaaatttgagggtaattgacatcatccaacatgaaactaaaggctgtaatatggatcttgtgaacaatattttcaatgaggaggatgctgatatagtaagtaaaactccccttcttccacaaattctcgaagacaaacttatatgggcaagcactatcgatggctcttattcagtgaagagtgcatatcttctcattatggagaaaattctgaagctggaccacttggcatcaaagtttgagttgcagctgttatggaataaaaaacgtcctccaagagtgaaaatgatgatttggagagcttgtagaagttgtcttcccacacgagcaaacttaagaacacttggagtagagtgtcccataacatccactatttctgtttggagctacattggtctggatcaaaaagtcctccagctggtagaccagctggatcctcaaaaccggggtcgtgtttcaatggtgatgtggagtttgtgtcggagaacaaatgataaacacgaacaattcactgatgttagcgcttgcattagagatagtaagggttgttttttcttgttcaaatcagagtggaagcatccttgcttgaaggtaatcgagggagaagcttga

SEQ ID NO: 13184 - DNA, 168 bp, Glycine max
  Peptide Sequence Number=SeqID_129962
atgggtgttaaacattttgaggtggtcaaacaaaggtcgcatgccgacaaacaatggtccccggacgaaattaggcttgcacatcatcctgttatccaggatccaataatgttcccacttcaaggaccttcttctcaagtcttctttcctccatcacatgaactttaa

SEQ ID NO: 13185 - DNA, 1866 bp, Glycine max
  Peptide Sequence Number=SeqID_129963
atgcaaaggaggaaaggagtagaacaacacgtagcacccatggttcaacccatctctaacaaaaaggtaaaaatgaggaggataaatgaatgttcaattttttgtgatttaataaaagggagattaggttccaacacaaggcaaactggggagattctgatcaacgggaagaaacaagcactggcatatggaacctcagcatatgtaacacaagatgataccttactcacaaccttaacggttggagaagcagtacactattcagctcaactccaattacctgacaccatgcccaaagaagagaagaaagagagagcagatttcacaatcagagaaatgggtcttcaagatgccattaacaccagaattggagggtggggtgttaagggaatcagtgggggtcagaagaggagagtgagcatttgcattgagattctaactcgaccagggcttctgtttcttgatgaaccaactagtggacttgatagtgctgcttcctattatgtcatgaaaagaattgccacccttgataagaaagatgatgttcacagaactgttgttgcctcaattcatcaacctagtagtgaagtttttcaactttttgacaacctttgtcttttgtcttctggtagaactgtttactttggacccgcttctgctgcaaaagagtttttcgcttcaaatggctttccttgtcctcctctcatgaatccatctgatcatttacttaaaaccataaacaaagattttgatcaggacactgagttgaatttaggaggaacagtaacaatacccaccgaagaagcaattcgtatccttgtagattcatacaagtcatctgaaatgaaccatgaagttcagaaagaagtggcagtactaactgaaaagaacaccagttcaacaaacaagaagagaagacatgctggcttccttaaccagtgctttgctctaaccaaaagatcgtccattaacatgtatcgtgatctaggctattactggttacgccttgccatttatattgcattggctataagtttagccactattttctatgatctgggtactagttatcgctcaattcaggatagaggttcatttcttatgtttgtgtcttcattcatgactttcatgaccattggcggattcccttcctttgtggaggatatgaaggtgtttgaacgtgaaagactaaatggacattatagtgtcactgcatttgtgattgggaacaccttttcagcaatcccatacttgttgttggtttcaatcattcctggggctatagcctattacctacctggtcttcagaaagactttgagcactttgtgtacttcatttgcgttctctttgcttgcctgatgctagtagagagccttatgatgatagttgcaagcattgtccccaactttctaatgggtatcataaccggggctggaattcaaggaatcatgattataggtggtggattctttaggttaccaaatgatcttcctaggccattttggaaataccctatgttctatgttgcattccatagatatgcctaccaaggattgttcaaaaatgagtttgaaggactaagattcgctacaaataacgttggtggtggctacattagtggtgaagagattctaagagatatgtggcaagtgaacatgagttactcaaagtggtttgatcttggaatcttgctagggatgattattctgtatcgtgttctctttttgattaacatcaaaactactgagaagctgaagccaatcattgtatcattcatgtcatcatcaaggtcttcacctaagccaacaatacagatcatgcagaatcccaatgcaactcctttacaagaagttcaagtcatataa

SEQ ID NO: 13186 - DNA, 783 bp, Glycine max
  Peptide Sequence Number=SeqID_129964
atggcgtgcagcatattcgattttcgcccaaaatttgctctcatgcgcgtgtcgaagaagccccgacaagataatggaaaaccagatcacaccatccatctatccgtcatagtaccgtttgaattgaagaccaacccagttgaagcatttttttccaaactgagtcagcaaagcgtctggcttctttgcttcataaatcataccctcactgtaccgcgtgtcgtgcttcacccaagctctcgccgtggcctcattggacctcgcgacgtcgccgtcaccctaggtcgtgccgaattgatcaaatacaagcagcagaacgaatcgatatgcttacccaggtttctggattttggtttgctctgtcaaatggacaaaaggcatcagcttgctatgctggcttcaattattcatatagtaaatggtgactgggcatcccttgtccgtgctctggttgatatggatgttgtgaggccagggacaaatatcagactttttaccctcgaactggaacaagccttgggagaagtagaatttaaagaaggaattcctgatgtgaagtttagcagggttctgggaaagatttggactgtagcactcaagcatcatttccccatgccaccgtatattacacttgtcttgcgatccctagcttcattggaaggtttggctatagctgcagatacaaatttcaatacttttgaagctgcatatccttatgttgttcggaaacttctcacagacaactcagctgcaacaaggaatatattgcattgggtattataa

SEQ ID NO: 13187 - DNA, 423 bp, Glycine max
  Peptide Sequence Number=SeqID_129965
atggatggtgtgatctggttttccattatctggagtttatgcatagaaataatgtggtcgatcttcaaagatgcagaattgaatgcagacatggtgtgggacatggtgaaaaggaaagaaactcaaactttcactggtccggttaaggttgcaccttgtaacttaggattcatagaatattgctatgctctgttgctttactcgggttatctgcttgcttgtggggcttctatggaggctggatctttgagcttcaatgagcgccatccactagggaataagccatggaagaaagagcttcaccaccaagatgagccttggataagaagcttggagaggatgcttcaatggaggaaaagaaagagggagagaaagagaaagggggagcacgaaattgaaggaagaaaaagggagagaagttga

SEQ ID NO: 13188 - DNA, 333 bp, Glycine max
  Peptide Sequence Number=SeqID_129966
atgcctagtggaagtagggatcctctcgttgttgggggagtaattggggatgtattggatccttttgaatattctattcctatgagggttacctacaataacagagatgtcagcaatggatgtgaattcaaaccctcacaagttgtcaaccaaccaagggtaaatatcggtggtgatgacctcaggaacttctatactttgattgcggttgatcccgatgcacctagcccaagtgaccccaatttgagagaatacctccattggttggtgactgatatcccagcaacaacaggggctagtttcgtctattactggcttggtctgaacaagtaa

SEQ ID NO: 13189 - DNA, 228 bp, Glycine max
  Peptide Sequence Number=SeqID_129967
atggggattcatcgtttggtgtttgtgttatttcgtcaactgggtagggagaccgtgtatgcaccaggatggcgccagaatttcaacactaaagaatttgctgaactttacaaccttggattgccagttgctgctgtctatttcaacattcagagggaatctggttctggtggaaggaggaaagaaaaaattctctgggaatcacatactatcaagaacaacacataa

SEQ ID NO: 13190 - DNA, 510 bp, Glycine max
  Peptide Sequence Number=SeqID_129968
aggcaccctttggatccggagaagtccaacaaagccctgggattttcggccttgatcacgggcctctgccagttctacggagtacttgtcacccccagcaaggtaatccagccaccaatcacccaagctttcatcgagaaatattgcacccctaggcaggcacagggggacacacagcaggctgcggacgcaccaacacctcagcagcccgatccggttagaccactaagcgtggagcagtatctacggcatgtggttcgccagcaggcggccaaccaccgtggggaggtgcagttgcatgagtgcttctaccgtttcagcctcagccagcagaggcaggactccactccttttgtcgcgtggcctggagattggcccactgaggagggaaccggacccgcaagatccccgggcaaagcggaggaagcccacatggatgaggatatgactaacctgcttggttacctgggagagggtggagccacacgaccaaggtcaccgcacttgtga

SEQ ID NO: 13191 - DNA, 219 bp, Glycine max
  Peptide Sequence Number=SeqID_129969
atggagaccgaagtaaggaacgacggaaggttatgtttcggccaattgctacacgccgcagtgccagtcttgttcggaaactccgttaacggcgaagtacgcgacgccgtgtcttgtgcggtttcaatgaataaaaatactcctcatttctacatagcaattccaggaaccaaaggggatcacccaactgaggtcacaatgcatagaagatttttctag

SEQ ID NO: 13192 - DNA, 219 bp, Glycine max
  Peptide Sequence Number=SeqID_129970
atgggacacaggtgcaagttattttcaagctgtcatagaacaattcaccttgaggacaagagaaaggacggaagtagggaattaaagtcccacataggtggggtgggaagtgtggcaacatataacaacccgctgaatatgtgggagtgtgtggaaatcagcaaaaagagaaggaagggaaacagaaaagagatgaagaaatggaaaaggaagttctaa

SEQ ID NO: 13193 - DNA, 378 bp, Glycine max
  Peptide Sequence Number=SeqID_129971
atgatgatacacagatgtgctgcagagcatggttttaaattgcggcccccaaccgcaattgcggccgtaaagttaaggtattttgacactccgcaatcgcattgtggctgcatcagccgcattttcccgcaatgtaaagcggagggtgtggaatcaaaatactctctcaacgtttcaaaccaattgggactccgttctttaacaaacctgcaacaacgtcacaaaataaggtcatttcagttgaggaaaccaagaaacaaaaacaaaaacaattacaaaggatggaaaccgaagcaaggaatgacggaagagtatgtttcggccaattgctcgacggagtaccagtcttgtttggaaactccattaacggcgaagtaa

SEQ ID NO: 13194 - DNA, 222 bp, Glycine max
  Peptide Sequence Number=SeqID_129972
atgtcgtgctttgagtatgaaagtgagaagagtggattagatggaggctttttgacttttcctcagattggtgtggacaaaggatcacacggaaagaagattgatttttctgagcaggtgttgagggagagagtagggagaaaagaagcactaaataatattcactggtgtattgtgttgtattacaatatgaggctattcttcataaaacctaaccaataa

SEQ ID NO: 13195 - DNA, 165 bp, Glycine max
  Peptide Sequence Number=SeqID_129973
atggtgtcctccttgtctactctcacccctccccaaaatggaaaccaccatggagggcgtgtggttggatgtcatgtaggagaggtcatgaacagggtggtggtgaacgttctcaacaatagtgtcgaggcggaggagagtgcagaccaagggactcagggataa

SEQ ID NO: 13196 - DNA, 390 bp, Glycine max
  Peptide Sequence Number=SeqID_129974
atgaagcgttctgaccacctacgaagacaagctgtttacctcttattagcttgttctttcagtctgatctgtaaaagaggagaaattgcaaaccactgtaataattcaactctgtgctccagttttaccactaacccagattcagagcatgattacttctgcagaaaaaagggatcactagaacttttcaagtggattctaggacatcttccaactgcaatctctatcaaccatgaaaagtacatgcagatgtgtatgaacttcatatcatctttccttcagctatatctccgtgagatacattatgatcaccaagtgcttcttgattacctcatttcaaaagatactggaataagctgtgctaaatatcttctaaggtattcattgtaa

SEQ ID NO: 13197 - DNA, 1404 bp, Glycine max
  Peptide Sequence Number=SeqID_129975
atgaagactccatctcatagcaacacaaacatacctgcacgagaggacagaggcccaaaaggcacaccagcaaaccatcacacttccagaactacgtgtaacaggcatctagcaaaattccagaatatattccatactcggtgttacgtgacgacagcatcgcgcagtagcagaaagataccgccaggcgccaatccaattctctcagtttcgccggtgaaatgtctccggccggtgaactcaggtggctctgccgcctcctccacgactctctccgcccctacacagtctgtttcattcttcacacctccaactctttttttttttttaaataattatcaattcattccattaaccaaacacgcttttcacgtgcctcaggaaccacgcgccttcgtttccacctccaaggagaaggagaaggaaattctaatagcttcttctcaggtcgtgacaaaaattcagcttcggattcgcgaattcgattctcgtgcagaggcgaaacgtgcttccgatgaagagcgatcgtgctgttcgagcccgcattcttccgttgatcaatgtctgcgaaaaatcgtcactgagatgatggttttgctcactgtcaagagtgaatttgttcaacacgtggttgtcaacgctcttgtcttagtttcaaagtttttgtacacaatggggaacaattgggatgggttcattcatttgttgtgctgttcgttggaaatggcgattgctaggatgatttcgtgttcgtctgagcctccttctggagctgaaaatagtgaatttgattgttttgatgttgagtttctgatgcaatacgggcttaagaattttgattggtctactgtggctggtgttgttcgagtattgcgtgttatatgtaaacatttgaaggaggaggattatgatgatggacttatcaaagtgtactatgactctgtcaattcttgtcttctgaagatgccgtgggatttgttagatgagtattggagtagtgagtttggtagaatgaaggacaactctactatcaatcaattgcacttaaaaaatttcagtgttatggatcctgtgatgaattttcttgggacttttctgcagttactatgctctttggtttaccggaatgattcagtggaaactggttgtgattctgttgataaacatccactttttctcacagtcgtgaatcttatacctagattagcaaagtggtgtctaagcgagcaagaaaataatgctgagatgcacgccattcattacttgaaacacaagttgctgaagggagtttgtgcaccaatatctgccataaaaggtcctagccatcaatcgtttggatatgtaaaatacaggatttccaattctagcaggaaaaggggggaatggagactcaatttcaagtga

SEQ ID NO: 13198 - DNA, 912 bp, Glycine max
  Peptide Sequence Number=SeqID_129976
atgaacaattcagggaattgcatagataagaagcattatgttctggtgcatggggcatgccatggagcttggagttggtacaaactcaagccacgcttggaatctgcaggccacaaggtcacatcactcgaccttgccgcttctggcatcaacatgaagaaaattgacgatgttcatactttctcacaatattctcaacctttgttgcacctaatggccacaattcccaaaaatgagaaggtagttctagttggtcacagccttggggggcttaacattgcacttgccatggacaaattcccaaaaaaggtagcagttggtgttttcttagctgcttttgctccagacaccgaataccgcccatcttatgtcgtggaaaatgtatgcttcttagtcttgaggttacctgggaaattttatgaagatcttcaaaaagttcaagaagtagtggatgtgaagggtatatatatcatcaggaaaaacctaagtttcttacttttgcaatacattgagaggatcccaccgtcagaatggttcgacactgaatttgctcccagtggaaataaaacatcaatattgttgggtcccgagattttggccaagaaattataccagctttcccccattgaggatcttgaattggccaagactctagtcaggccatcgtcactcttcgttgaagacttgtctcagcaaaagaacttctccaaagagagatatgggtcagttccacgtgcctatattgtttgcactgaggaccttacaattccaatcgaatatcagctctggatgatccaaaatgccgggatcaatgacgttctaaagatcaaaggcgcagatcatatggctatgaatagcaggcctcgagaactatttgaatctctccagaaaatagctgcaaaatatgcataa

SEQ ID NO: 13199 - DNA, 1293 bp, Glycine max
  Peptide Sequence Number=SeqID_129977
atgagttcggaaaattgtttaggcaggaagcattatgtgctggtgcatggggcatgccatggagcatggtgttggtataagttgaagccacggttggaatctgaaggccacaaggtcacagtgctcaaccatgcagcttctggcatcaacatgaagaaaattgaggatgttggcactttctcagagtacactgagcctttgctgcagctattggacacaattccctcaaatgagaaggtagttctagttggtcacagccttggggggatgagcatagcaattgcaatggaaaaatttcaagaaaaggtagcagttggtgttttcttagctgcttttgctccagacgttgaacaccgcccatcttacgtcttggaaaaggaccttgaattggccatgactttggccaggccaccatcatttttcatcgaacatttgtctaaggaaaagaacttctccaaacaaagatatgggtcagttccacgtgtttatactgtttgtcctgaagaccttggaattccattgaattaccaacactggatgatccaaaatgctgggttcaatgacggtgtggagatcaacggcgcagatcataagccgatgctgaagccacgcttggaatctgaaggccacaaggtcacagtgctcgaccttgcagcttctggcatcaacatgaagagaattgcagatgttgacactttctcgcagtactctgagcctttgttgcagctaatgaccaaaattccctcaaatgagaaggtggttctagttggtcacagttttggagggatgaacatagcccttgctatggagaaatttccagaaaaggttgcagttggtgttttcttaacagcttttgctccagacaccgaacatcgcccatcttacgtcttggaacagaacacgtcgtctgaagacttggacaacgaatttgccccaagtggaaacaagacatcaatgctctttggtcctgagtacttgtccaagaagcaataccagctctctcccgttgaggacctagaattggccaagacattggtaaggccatcatcactcttcattgaagatttgtctaagcaaaagaacttctccaaacatggatatgggtcagttccacgtgcctatattgtttgcactgaggaccttgcaattccattggaatatcagctatggatgatccaaaatgctgggatcaatgacgttctaaagatcaaaggtgcagatcatgcagctatgtttagcaagcctagagaactattcaattctctccagaagatagctacaaaatatgactag

SEQ ID NO: 13200 - DNA, 375 bp, Glycine max
  Peptide Sequence Number=SeqID_129978
atggacaaatacccaaaaaaggtagcagttggtgttttcttagctgcttttgctccagacactgaacaccaaccatcttatgtcttggaaaaggaccttgaattggccaagactttagtaagaccatcgtcactcgtcgttgaagacttgtctaagcagaagaacttctccaaagagggatatgggtcagttccacgagcgtatattgtttgcactaaggacattgcaattccattggaatatcagcttttgatgataaaaaatactgggttcaacgacgttctaaagatcaaaggcgcagatcatatgcctatgaatagcaagcctcgagaactattcgattctctcgaaaagatagctactaaatatgcataa

SEQ ID NO: 13201 - DNA, 729 bp, Glycine max
  Peptide Sequence Number=SeqID_129979
atggaggataagttcagggctcagaatcaactgtttgcattatgcttgcatttgatatgcaactcatggaagttatttgtggaatttccattatttggagaatttttggatcaatcatcttgcaagagaagaaaaattgtaggggatggtctacactttctagcagatggaatgcctacgtcaattgacaacagtggaagtatcatattgcatatcaagaattataaggaagacaggggtggcttcaagtactacaatattaagccattcaagaaagccggagaatgtttactatctttgaacaattctgtatataatcttcatcaaaagaagttgtttccgtataatcctaaagtgcttctgaaacggtattggtggcacggatggacaggaaatagagaaattttgtgctggttcatagttatcggacttagtgcccacagctgtcaacattgtgctactggtgtccatctagtgacagtcttggttcacttcaaatccgtcgattattctatgggtttggggttacatgccatttctggagaatctggtgagccatatcatggatccagggtgcatgaatggttcctaccagtcttcaatcttgaatttgtaaaggtaatccaagcaattatcgcattgaaggatgtctttcttgcggatacctgcctttctcttggtacttggagcttgcattcatgctcctacaaaaaagcatgtaatgagtag

SEQ ID NO: 13202 - DNA, 963 bp, Glycine max
  Peptide Sequence Number=SeqID_129980
tacaatgagaggaccccgtcgtctgcatggttggacacagaatttgctccaagtggaaacaaaacatcaatgttctttggtcccaacttcttgtccaacaagctataccagctctcccccattgaggaccttgaattggccaagactttagtaaggccatcatcactcttcgttgaagacttgtctacgcagaagaacttctccaaagagggatatgggtcagttccacgtgcatatattgtttgcactgaggacattgcaattccaatggaatatcagctctggatgatccaaaatgccgggattaatgacgttctaaagatcaaaggcgcagatcatatggctatgaatagcaagcctcgagaactatttgaatctctcgagaaaataccacggttggaatctgaaggccacaaggtcacagtgctcaaccatgcagcttctggcatcaacatgaagaaaattgaggatgttgacactttctcagagtacactgagcctttgctgcagctattggacacaattccctcaaatgagaaggtagttctagttggtcacagccttggggggatgagcatagcaattgcaatggaaaaatttccagaaaaggtagcagttggtgttttcttagctgcttttgctccagacgttgaacaccgcccatcttacgtcttggaaaaggaccttgaattggccatgactttggcaaggccatcatcatatttcatcgaagatttgtctaaggaaaagaacttctccaaacaaagatatgggtcagttccacgtgtttatattgtttgtcctgaagaccttggaattccattgaattaccaacactggatgatccaaaatgctgggttcaatgacgttgcggagatcaacggcgcagatcatatgccaatgttttgcaagccgcaagaattatgtgattctctccagcagatagctgctaaataccaatga

SEQ ID NO: 13203 - DNA, 1413 bp, Glycine max
  Peptide Sequence Number=SeqID_129981
atggcatgccttcatgatgaatctgtctcatctgctcctacacttgcttatgaaactaaaccccagcaaagtgtcatagaccttgaagccactacactagaaatggaagcttttagaggtccaagaaagatgaatagaggagaaggtgaaggtgtggctcagaaagaagagatcggtatctgcttaacatggaaggatgtatgggtgacagcttccaataaaaaaaatggaagcaaatcaattcttcaaaggctaactggttatgccaagccagggcaactcttggcaataatgggtccctcaggctgtggcaaatcaacactacttgatactttagcagggagattaggttcaaacacaaggcaggccggggagattctgatcaatggtcacaaacaagcactgtcttatggaacctcagcatatgtcacacaagatgatacattactcaccaccttaacggttagagaagcagtgcactattcagctcaactccaattgcctgataccatgtccacagaagagaagaaagagagagcagatttcacaatcagagaaatgggtctgcaagatgccattaacacaagaattggagggtggggttgtaaaggcattagtggaggtcagaagaagagagtgagcatctgcatcgagatcctaacacgccctaaacttctgtttcttgatgaaccaactagtggacttgatagtgcagcttcctattatgtcatgaaaagaattgttgcccttgctcaaaatgaccacattcagagaaccgttattgcgtcaatccaccagcctagcagtgaagttttccaactcttcaataacctttgtcttctctcttcgggtaaaacagtttactttggacctgcttctgctgcaagtgagttttttgcttcaagtggttttccttgttcttctcttatgaatccatctgatcatttactgaaaactatcaacaaggattttgataaggacatcgaggtgggtttagcaggaactagaaacatacctacagaagaagtaatccacatccttgtgaactcatacaaatcatctgaaaggaaccaagaagttcacaatgaagtagctgtactatctaagaaggacatcggttcattagatattaagagagggaatgcaggcttccttaatcaatgcttagttcttaccaaaagatcgttcattaatatgcatcgtgatcttggctattattggttacgtttcgtcatatatgttgcattggccataactttagccagtgttttctatgatttgggcaaaagttatgactcaattaaggatcgaggttcacttgttgcatttataaatggattcattactttcatgaccattggtggatttccttcctttgtggaagtcatgaagaattttagaggacaagattaa

SEQ ID NO: 13204 - DNA, 291 bp, Glycine max
  Peptide Sequence Number=SeqID_129982
atgaagatgatttgtgggtatgatattctagcaaagacacgattatttgtgaatgtttgggctattggtagggatcccaatcattgggagaacccttttgagtttaggccaaagaggtttatgagagatgggcagaatgaattgaataagatgagctgtacaggttcactgagcgcaccgcttcatctcactaagcgcaccgctttagtccatccgctaagtgagataagcgcgctaagccgaaattcacttatgagcgctaagcggtttagaattgcgctaagcgcatga

SEQ ID NO: 13205 - DNA, 429 bp, Glycine max
  Peptide Sequence Number=SeqID_129983
atggagtacctattgaacagtataacacaagaagaagataccatgagcatgatcatttcagggaattgcatagataagaagcattatgttctggtgcatggggcatgccatggagcttggagttggtacaaactcaagccacgcttggaatctgcaggccacaagatcacatcactcgaccttgcagcttctggcatcaacatgaagaaaattgatgatgttcatactttctcacaatactctgaccctttgttgcggctaatggccacaattcccaaaaatgagaaggtagttctagttggtcacagccttggggggcttaacattgcacttgccatggacaaattcccaaaaaaggtaacagttggtgttttcttagctgcttttgctccagacactgaacaccaaccatcttatgtcttggaaaag

SEQ ID NO: 13206 - DNA, 642 bp, Glycine max
  Peptide Sequence Number=SeqID_129984
atgatagttgcgagcgctgttcccaactttctaatgggcatcataactggttctggaattcaaggaatcatgcttttactttgtggcttctttaaattgccaaatcatattcctaagccagtttggaaatacccattacactatgttgcctttcatacgtatgccaaccaaggaatgttcaagaacgagtatgaaggactaagatttgcttccaatgaagctggaggaggttacgtaagtggtgaagaggttttaagaaatacatggcaagttgacatgagttactcaaagtgggttgatcttgcaatcttaatagggatgattgttgtgtatagagttttacttttggttatcatcaaggttaaagagaagatgaagcccgttgttgtatcaatatcgtgcatgtcatcttctcccaagaaaacaatacagtcttctctttcttcttcatctttcttgcttcttcatcgcccaactagttccaacgacaacaccaccatctttttcatcgttaccttttttgctcatgctttacacactttgcggtggccccaacttcatcaaacacaacaactccaacagttttatagtatgtgctgccttcatcacggtggcttcatagcaactccaagcaaaatttaa

SEQ ID NO: 13207 - DNA, 2124 bp, Glycine max
  Peptide Sequence Number=SeqID_129985
atgcatgggagattaggttcaaacacaaggcaaaccggggagattctgatcaatggtcacaaacaagcactgtcttatggaacctcagcatatgtcacacaagatgatacattactcaccaccttaacagttagagaagctgtgcactattcagctcaactccaattaccagacaccatgtccaaagaagagaagaaagagagagcagatttcacaatcagagaaatgggtcttcaagacgccattaacacaagaattggagggtggggttgtaaaggaatcagtgggggtcaggagagaagagttagcatctgcatcgaaatcctaacacgcccaaaacttctgtttcttgatgaaccaactagtggacttgatagtgcagcttcctattatgtcatgagaagaattgctaccttggctcagaatgatcacattcagaggactgttattgtatcaatccaccagcctagtagtgaagtttttcaactcttcaatagcctttgtcttttgtctttgggtaaaacagtttactttggacctgcttctgctgcaacagagtttttcgcttcaaatggttttccttgtcctcctctcatgaatccatctgatcatttactgaaaaccataaacaaggattttgatcaggatattgaagtgggtttagcaggaactaaaagcatgcctacagaagaagtaatccacatccttttgaactcatacaaatcatctgaaaggaaccaagaagttcagaatgaagtagctgtactatctaagaaggacaccagttcattggatatgaagagagggaatgcaggcttcctaaatcaatgtttagttcttaccaaaagatcgttcattaacatgtatcgtgatctaggctattattggttacgccttgtcatatatattgcattggccataactttagccactgttttctatgatttgggcacaagttatgactcaattaaggatcgaggttcacttgttgcattcataaatggattcattactttcatgaccattggtggattcccttcctttgtggaagtcatgaaggtatatcaacgagaaagacaaaatgggcattatggtgtgactgcatttgtcattgggaacactttgtcatctatcccatacttgttattggttacattcattcccggggctatatcttattaccttcccggtcttcagaagggatgcgaacactttctgtatttcatttgtgttttattttctagtctcatgttagtggagagccttatgatgatagttgcgagcgttgttcccaactatctaatgggcatcataactggttctggaattcaaggaatcatgcttttactctgtgggttctttaaattgccaaatcatattcctaagccagtttggaaatacccattacactatgttgcctttcatacgtatgccaaccaaggaatgttcaagaacgagtatgaaggactaagatttgcttccaatgaagttggaggaggttacataagtggtgaagagaacttatattgcctttccatctctccttccgttcgcgacgccaaagttgtcaccgaccccaacaccgcccgctccaagggttacggcttcgttaagttttctgatgaaaatgaacggaaccgcgccatgactgaaatgaacggcgtttattgctccaccaggcccatgcgtattagtgctgctacgcccaagaaaaccaccggtgcttatggtgcacccgccgcgcctgtgcccaaacctgtgtatccggttccggcctatacttcgcctgttgttcaagttcaaccaccggactatgatgtcaataatactaccatttttgttggtaatttggatcttaatgtgtcagaggaggagctgaagcaaaactctctgcaatttggggaaattgtttctgtcaaaattcagcctggcaagggatttggttttgttcaatttgggaccagctttttgttaatggcattggcacggcagaacaattatgtcaggcctttgttgactgaagaaaatttgcttgatataaaaaatggaaggcatgttttgcaggaaatgactatagacacatttattcctaatgacactaagattcttcatgatgggatatga

SEQ ID NO: 13208 - DNA, 348 bp, Glycine max
  Peptide Sequence Number=SeqID_129986
actacaaacgaggccagaggaagtggtggggctggaggaggaggaggaggaaggggtggggaagcagaggaggaccttaaattggccaagactttggcaagaccagcgtcactcttcatcgaagacttgtctaaacaaaagaacttctccaaagagggatatgggtcagttccacgtgcgtatattgtttgcactgaggaccttacaattccattggaatatcagctctggatgatccaaaatgctgggttcaatgacgttctagagattaaaggctcagtcagatcatatggctatgctttgcaagctacaagaactattcgattccctccagcagatagtgactaa

SEQ ID NO: 13209 - DNA, 144 bp, Glycine max
  Peptide Sequence Number=SeqID_129987
atgtggtgtactacccccaacaggatcttgaaggggttggattcgttggaaggagggtacaagagccgcaaccctttctcttggatcaaagaagctgaaactgtttgggaaaacgttgttccttattttgtttgggcttcttga

SEQ ID NO: 13210 - DNA, 1194 bp, Glycine max
  Peptide Sequence Number=SeqID_129988
atggcacctgtgacatacatagattctagtgttgttcaggctttgaaagacttgtatcaggagtacaaattacgggacattcagattgcaatatccaatccaagtccagaagttctgcttaccttgtctagatcgggtctggtggagttgataggcaaagaatggtactttgtgagagtacatgatgttgttcaagtttgcttgcaacatgttcaaagcttgaaaggagcatctaacagtccacaagcaccattctcttcagtagagaacaaaccaagtttgtttgcacgattatcaaaagagagagtggagaagctttcaattaccgacttggagtctggggcagggaaggacatagaaagtgcttattgggaattggttgtgaaggacatacaggatacttgcaaacttctggagccaatttacaatgaaacagatggggaagatggacatgtatctcttgcagtttccccaaagctagcaaatgacaccaatgggacaattgaggcagcaaaatggcttcataatatggttggaagtccgtgtgtttacatgaaaattcctgccactgatgaatccatctcttccatgaaggaggtcatttctctggggataagtgtaaatgccacttcttgtggcatgactgatctctctaaggtttcaagtgtaacaacattctacatcagtagagtggatgttacacttgacaagaaacttgagcaaattggtactactgaggctcttgatctcaaaggaaagggtgtggttgctcaagcagtcttagcataccaactttaccagaaaaaattttctggtccaagatgggaacgcttggagaatagaggtgccaagaagcagaggttgatgtgggcttcaacaaatgtgaaaaatccatcttaccctgacacgttttatgttaattctgttattggacgagatacaatttcaaccttttcagtacaagctcttcaagcattcatggaccatggtattctttcaagaacgcttgatgcaaaagtatcagaggctcaagacatttacaatgcaattgagaagttggggattgattggagttctgttggattagaattggaacatgaggtgctggattctttcacaaaaagctttgacaatgtgcttgaatgcatgcaaaagaaggctatgaacatatattcatttcaaaagcacgtttaa

SEQ ID NO: 13211 - DNA, 1273 bp, Glycine max
  Peptide Sequence Number=SeqID_129989
atggcttccaacaatgttccattactagcacctcctgtattcataggaaagaacgacgaaatgtgggttgtgaagatgagaaggcagttgaaagcttttgatctttggaaagcaatggaaacaactgaaccaccagctttggaagagaatccaactgttgctcagatcaaatttcacagtaagcaagttgccaaaagagcaaaggctcttaccatcttgcactcagttgtggatgatgatgttctcaaccttaagagggagtttgaagccttaaagatgaatgaggctaaaaacataaaagatttcatgaccagactgatgaagccgaaagatttgaacctaatgtctaatgaaaaagctagtgagtttgaacaatggaaccattctatgaaggagatgaccaccattgaagacaacaatacatggcagctggttgacaaactggaagacaaaaattctattggagttaaatgggtctatacgctgaatcttaatgggtccattgattatgtagagacgttttctccggttacaaaaatgaacactattcgcattcttgtagctttggcagctgaaatgaagtggaaaatttggcatttagatgtcaaatctgcattcttgaataggaacttgactgaagaaatttataaacaagctcctagagcttggtacaacaacattgatgcttactttagcagtcaaggttttaggagtgaaaatgatgcaactctttatgtgaaaaggttgttggatggtggctctttaattgtctctgtgtatgttgatgattttctaatgagtagcaataatcaacaagaagtgcaacaactgatatatgcttatgaaattttgaagaagtttagaatgaaaagttgcaaatttgtccctactccttcagtgcagaatctgaaactatccaaagatgatggagctgaaaagatgggcgattctctttatagaaatgtgattggaagtttgctttatctcacttcatctagaccagatcttacgtatgcagccagcttactctcaacatttatgaaaagtctaagtgtgttacattttgtagtagcaaagagagcacttaagtacttgaaactcaatttagaatctggtttaaacccgatgaaaatggaagacattgtaactcaatctactgctgaagctgaatatgcagcagcagctgcagcaacaaaccaagccatttggttgaagaaaattatgtttgatttgggagtggagaagatggacgctactgagatttattgtgaca

SEQ ID NO: 13212 - DNA, 474 bp, Glycine max
  Peptide Sequence Number=SeqID_129990
atgagttcaaaaaatagtatagataggaagccgaagcactatgttctggtgcatggggcttgctatggagcttggctttggtataagctcaagccacgcttggaatctgcagggcacaaggtcacagtgctcgaccttgcagcttctggaaccaacatgaagaaaattgaagatgttgacactttctcacagtacactgagcctttgttgcagctaatggccacaattcccccaaataagaaggtagttctagttggtcacagtcttggggggctcaacatagcacttgcaatggaaaagttcccagaaaaggttgcagttggtgttttcgtaacagctataattccagacattgaacacaagccatcctatgtcttggaaaagcctcccaagctccggcctccggtgacatttcctccatcaatagtggctccaaccggcggtggtttgcttcaccaggccggtggggcttag

SEQ ID NO: 13213 - DNA, 456 bp, Glycine max
  Peptide Sequence Number=SeqID_129991
atggctgagaaaacccaagtttatgaacgaactctggaggaaacaccaacatgggctgttgcggttgtgtgttttgtgctgctcgctgtttcaatcgtcatagaacatattattcatggtattggaaagtggttcaaaaagaaacacaaaaatgctctttttgaagccttggaaaaggtgaaaggagagcttttgctgctaggattcctatccttgctcctaactgtgttgcaagatgaaatttctaagatatgcgtatcaaaaaatgttgcatccacttggcatccatgtgccaacccaaaggccccaaaaacatctcaatccgaggatgaatctgaagactttcagatcaattctaggaaactcctacaattttatgacctcgtaccaaggcgtgttcttgctacaaaaggatacgacaagtgcgatgaaaaggcaagtagagcatcttcataa

SEQ ID NO: 13214 - DNA, 846 bp, Glycine max
  Peptide Sequence Number=SeqID_129992
atgcaacgtttcagcaacacggtgataggattcttgaactttttcacgctcttggcatcaatacccatcataggtgcgggtctatggatggcaaggagcaccacaacatgtgaaaatttcttccaaaccccacttttggtgataggctttgttgtgcttgtgatttcgctagcgggtttcataggggcatgttttcatgtggcatgggcattgtgggtgtacttggtgatcatggtgttcattatagctgccctcttagggtttgccgtttttggctttgttgtgacggaacagggtgggggagtggaagtgcctggtagggcttacaaagagtatcgtctcgaccgttattcgccatggctgaggaataggattaaggatcctcagtactggagcaccattaggagctgcattttggggtctaacacttgtgcaaagcttgccttttggacccctcttgattatgtgcagagggacatgtctcccatacagaatatgcatgtgttcaactgtgtctgtcagtctggatgttgtaagccacccacagggtgcagttacaacgaggaaacagtggtagtgacacaagatccggactgctaccgttggaacaacgcccccactctgctttgctacgattgcgactcttgcaaggctggtgtgctcgaaaacattagaaggggctggcacaacatctctgttcttaacgttgtcgttcttgtgttcctcataggcatatattccattgccttttgtgctttcaggaatgccagaagagctcaaactgattatcctcatggagtaaaccgcatgaccaaagttaaacccagatgggattactattggtga

SEQ ID NO: 13215 - DNA, 588 bp, Glycine max
  Peptide Sequence Number=SeqID_129993
atgggactgaggattcaagacagaggggaagtattcaagggtgcacctgtggttgagccaggagatgacctgttctggttcaaccgtccacgcttccttctcttcatcattcatcttgttctctttcagaatgcctttcaattagcacattttgcatggagtacaatggcttcaaccatgaaacccaccattttcaatgatagagtagcagcagcattgaagaaatggcaccatacttccaaaaagcatgtcaaacaccgcaagcattcagagggtaacaatgccacaccattctcaagcagatcatcaaccccaacatttggcatgtctcctattcacctgctgcacagacaccttgctggaagaagtgagagtgcacaaacttctccaaggatatccaactatgaaaatgaacaatgtgatgtggatggtgaagcttccacaagctaccatccaggaacagatgatacccaaatgcaagttctggggcctcattcaacaacagaattgcgtattagcactaaacatgacatcaattttagttcatcagaattttcttttgagaagcgaaacaccagaggagattag

SEQ ID NO: 13216 - DNA, 366 bp, Glycine max
  Peptide Sequence Number=SeqID_129994
atgagtggagacactgattcagtagttcctgtaaccgcgtcttggtattcaattcgtgccttgaacctatctaccatcatcaattggatcctttcgtttatgtatgaagaggttggtggctggagtcaagtttatgaagggcttacattggttacagtaagaggggcagggcacgaggttccacttcataaaccccgccaaggttttactctttttaagtcattcttggagaacaagaacatgccattgccaattgatagcaagcttagtggcccaactcaatcactgaacaagaacattcgattggctaggcccatacgcaagatcactatgccatcatcggtgcagggcttctttacttattag

SEQ ID NO: 13217 - DNA, 360 bp, Glycine max
  Peptide Sequence Number=SeqID_129995
atgggacaatgttttagtgggggagtttgggtgctccttgagagtaccctagcgacgaatttgttggacagtgaattctccaagagtggaaacaaaaccatagttgtttttggtcccaaattcttgtccaataaactcaatcaagcctccaccattgagggatatgggtcagttcctcttgcttttatcgtttccactgaggaccaggaaattccattgaatttccagcattggatgattcaaaatgctggaatcaatgtcgaagttctagagatcaaaggcgcagatcatatgcttatgattagcaagccacaagaactatgtgattctctcctccaaatagctactaaatatgcatga

SEQ ID NO: 13218 - DNA, 201 bp, Glycine max
  Peptide Sequence Number=SeqID_129996
atggaagcttttagatgtccaagaaagatcaatagagaagaaggtatctgcttgacatggaaggatgtgtgggtggctgcttctaatagaaagagtggaagcatatcaattcttaagggtctaactggttatgccaagtcagggcagctcttggccatcatgggtccctctggctgtggcaaatccacactacgtacttga

SEQ ID NO: 13219 - DNA, 492 bp, Glycine max
  Peptide Sequence Number=SeqID_129997
gttactcaaatgaagcaggagcatcacaagaggcaagcaagcctcatagctgaacacaacgaacagctaaagcgtacccaactgcaagctgaaaatgaatacagagagaaaacaatgtttatgaggaatgatcatgaagctcagatcaaagcattgaggtgtgaacttgaagatgagtgtcggaagctggaagaggagttgcatcttcaaaaatccaaagaagacaggcaaagggctttgttgcaattgcagtggaaagtgatgagtgacaagcccaaagaggaccaagaagtgaattcaaaacatgttgacttgtgtttcaatctatttgtctgtgactgtcttcaaatggatgccatatttgctaattttcatgttgggatacctttgagcatcaaaggaggaggccatcctcatccttcaaacattggtgatttgtttttagaagggtctcttaatccatatgcagaggatccctatgcatttgattag

SEQ ID NO: 13220 - DNA, 1074 bp, Glycine max
  Peptide Sequence Number=SeqID_129998
gaccctgagaaaggattagccggagggctaagtacagaagaagcaattcatgttcttgctaaatcatatgattcatctaagatttgtcaccaagttcaaaaggaaatagcccaaacaaagaaaagggactcggacacaatggatgagaaatgccatgctgactttttcacccaatgtctcattcttacaagaagatctttcgtgaacatgtatcgcgaagtaggttattactggttacgcctacttatctatggtgccttggctttaagtcttggtaccatgttctttgacattggttcaagcagtgaatcaattcaggccagaggttcattgcttgtgtttgttgttacattcctgaccttcataactgttggagggttcccttcttttgtggaggaaatgaaggtgtttgaaagagaaagactcaatgggcattatggtgtcactgcatttaccatcggcaacacattatcctctgttccatttttgctgttgatgtcattgatcccaggagcactggtttattacctagttggacttcaccaaggacacgaacattttgtgtactttatatttatgcttttcacttcagtcttcttggtcgagggtctcatgatgattgttgcgagcatggttcccaatttcttgatgggtataatcgttggttctggaattctgggcataatgatgttagatggtggattctataggcttccaagtgacattcctaagcccttttggagataccctttgcactacatttccttccacaagtatgcctaccaaggattgttcaagaatgagtttcaaggtctaacattccctagcaatcaagttggagcacacatgacaattcatggtgaacatattctgagacacatatggcaaatggaagtgaattattcaaagtgggtggatgttggtatcttggtaggaatggcagtactatatcgaattctatttttggttatcatcaagagctttgagaaggtgaagcctatttcctcagcattaaattgtccccaaacaaactttgggttaaccaaagtgacaaggagcagtgagattgattag

SEQ ID NO: 13221 - DNA, 942 bp, Glycine max
  Peptide Sequence Number=SeqID_129999
atgggtctgcaagatgccattaacaccagaattggagggcggggttctaaaggcgctagtggggtgcagcttcctaccagaagaattgctactttggctcagaatgatcacattcagaggactgttattgcttctatccaccagcttagtagtgaagtttttcaactcttaaataacctttgtcttttgtcttcgggtaaaacagtttactttggacctgcttctgctgcaaatgagagagggcatgctggcttctttaatcaatgcttagttcttactgaaagatccttcgcgaacatgtaccgtgatctaggctattattggttacaatttgccatatttgttgcattggccatagctttggccactattttctgtgatttgggtacaagttacggctcagttcaggatccaggttctcttattgcatttataaatggattcttaactttcatgaccattggtggattcccttcctttgtggaagtcatgaaggtatttcaacgagaaaggcaaaatgggcattatgtggatagtcttatgatgatagttgcgagcgttgttcccaactttctaatgggcatcatgaccggtgctggaattcaaggaatcatgcttttactagatgggttctttaaattgccacgaatgttcaagaacgagtttgaaggactaagatttgcttccaatgaagttggaggaggttacataagtggtgaagatattttaagaaatacatggcaagttgacacgagttactcaaagtgggttgatcttgcaatcttgatagggatgattgttgtgtatcgagttttgtttttggttatcatcaagattaaagagaagatgaagcccgttgttgtatcactatcgtgtatgtcagcgtcttccaagcgaacaatacaggtcatggaaaaccccaacgccactcctttacattga

SEQ ID NO: 13222 - DNA, 486 bp, Glycine max
  Peptide Sequence Number=SeqID_130000
atgggggttgtgatacaatttctgtgcagctatgtgaccttgcctctatatgctctagtcacacagatgggttcaaccatgaagcccaccatcttcaatcagagagtggcatcagcactgaagaactggcacaacactgccaagaagcatgtcaaaaacagtaagcacaccactccattctcaagcaggccatcaacccctcaatatggtatgtctccaattcatctgctacacagacaccttgctggaagaagtgagagtgcacaaacctctccaagaacatccaactatgaaaatgaacagtgggatgttgaaggctcaccttccccaagccaccatgcagtagctgctgaagaaacccagatgcaagtttttgagccaggctcaagctcagcaccagaattgcctattagctctcaacttgatatcagagttagttcatcagagttttcctttgagaagagacacactgctgaaagtgattag

SEQ ID NO: 13223 - DNA, 927 bp, Glycine max
  Peptide Sequence Number=SeqID_130001
atgagctgtcttcttcaacctaatgctagtgattgtgaaccaaacaatagctctaaaattctgccacccctttcagaatttgagacctcatttgaggtagaaaagatcaaatcagtagaaactggtaaagatggcgaggaagatcaagaggagggtgttttcttgacgtgggaggatttgtgggtgacagtttcaaatggaaaaaatggaaggaagccaatacttcagggtctaaaaggctatgccaaaccagggaaactattggcaataatgggtccttctggttgtggcaagtcaacacttcttgatgctttagcaggaagattaggttcaaagacaaagcaaacagggaagatcttaatcaatggaaggaaacaagcactagcttatggagcatctgcatatgtaacagaagatgatactattttgacaactctaacagtcaaagaagctgtatactactcagcttaccttcaattgccagattccatgtccaagtcagaaaaacaggagagagctgatttcacaataagagaaatgggtctgcatgatgccattaacaccagaattggagggtggggttctaaaggcgctagtggcgggcaaaagaggagagttagcatttgcattgagatcttaacacatccaaggcttctcttccttgatgaaccaactagtggacttgatagcgcagcttcttatcatgttatgagtagaatatccaacttgaacaaaaaggatggcattcaaaggactattattgcatcaatccatcagccaagtaatgaaatttttcaacttttccacaacctttgccttctgtcttctgggaaaacagtttactttggacctacttctgctgcaaataagtttttctcatcaaatggttttccctgcccaagtcttcatagtccttcagatcacttc

SEQ ID NO: 13224 - DNA, 333 bp, Glycine max
  Peptide Sequence Number=SeqID_130002
atggaagtgctgaagaagttgtttgtggcggatctttttaccaataacaaactgtttcgcaactattccgatcaaggcttcactaacatggatgaaatgatgtgttggacgctgtttgtggatgactatgccctactacatgtgttggagcacgccaaacttcatgatccaggaagcatgaatgttaaagttgagcaattaattcttgtgatacaggatgtggttttgttagagaatcagctttcgttcctgttgctgaagttgctatggagagacaccgacgagtggatgttgatccgaaccatggaagaatttcttagctgtcatcattga

SEQ ID NO: 13225 - DNA, 1410 bp, Glycine max
  Peptide Sequence Number=SeqID_130003
atgtgtgaagaatgtggaggaggccatcaaacatcaaaatgcaccaaggtaccaaccgaggagggagacaacaaaccacaacaaagaccaaatttatgggatcacaccgcaaagttggaagaagccttgaccaaactcattgaagtggtcatcaccaactacaaaaacactgaagtcgcaattaaaagcatggagactcaaatagggccattggccaaacaattgcaaaactcttcaattggcttttccgtagccatcaaggagaacccaaaggtgaagaagaagaagatgagcaagctaagcatccataagcaagaagactgtgagaggatggccaaattcgagaaatacatggaaatgctacaagggaagaaggaggaaccacctattgaaaaactcacatgggacgtgctacatcaaccttatcaacggacagctcatttggagcaccatgtactcgttgttcaaggaggtggcgaggctgcaatggctcgcccaggcgagctcggttgcttccaccagaaggcaccaccttcttttggaaccttcaggaaagccgaaaatgttgtgaaactttacggattacgcaacaatgcttgtttcgtgggttctgaagggagcaaacaagatgacgaaggtaaaacctgcaaagattttcaaaataatcagcatcggacgaccaacatcatcccgatattaccggacatgttcgccttggttgacgaaggtgtggataaccacgaggtgcggataaccataaggtatctccacatgtcatcggacttgccatctctggatgacaaaggtgcagatgacgatgtgcggataaccataaggtatttccgcatgtcatcggacttgccgtctctggatgacaaaggtgcaaatgatgacgtgcagataaccataaggtatcttcgcgtgtcatcggacttaccatctctggatgacaaaggtgcagatgaagattctcggccggaagatgctgacatctctaggaaaggtgcatatgacaatgtgcagataaccataaggtatctccgtatttcatcggacatgctgtctcaggatgacaaaggtgcagatgacgacctgaaaaaaggtgcggataacaataaggtatctccgcatgttatcagacttgtcgtctctgatgacaaaagtgcagatgatgatatgacgacgttagtcactgcatgctaccagacccttgagtcacaattgcagaagtctcagcctgaagattctgacatctccagaaaaggtgcagatgaccacattggtgtctgcttgtcaatcggacttggggatggggtggttgacaaaagcggggcttttgctcctacatatcctcaatttgagatgaggaactcagactacgtagttgttgcttttgtgagactaaaatag

SEQ ID NO: 13226 - DNA, 192 bp, Glycine max
  Peptide Sequence Number=SeqID_130004
gactccggtgcatttgggaagaagaagaagacccacgctgcattcattactcagtgcctgatccttataagaagagcttcactgcaaacctatcgtgagacgaacaactatcgggctcgtttaattgtctttatcgtgatatctttaagcgtgggctctatcttttatcacccggatttgcgatcgattatg

SEQ ID NO: 13227 - DNA, 384 bp, Glycine max
  Peptide Sequence Number=SeqID_130005
atggggtgtgccaaaatttcactaattatgattagcaaatgcttactacaccccaaagcatctagtgtgataaccgaaaggcatcccaagaagcttgggatgaggtttgtagaacacgaatggatcatggctagagtgccaccagcagtaaacatgggtcagatgaaagaagaagcggaagatgaagctcaccaagagcccgtgtaccaatggggtccttctgagtctcttatgattcagaagatggatgccatgtttcaccaccatcaagagcactcagccgatgttcacagtaccttagaaaacatcaccactaggctagagagcatagggactaggctaacccttagtaacctctttaacccgaatgaggatgaagcgtag

SEQ ID NO: 13228 - DNA, 736 bp, Glycine max
  Peptide Sequence Number=SeqID_130006
atggttcatgaattttccaagcttggtgcttatttttccttctcaggatttcttatgtcactaaaagcaagtaaagcaaagaaaatgctgaagatggtccctcctgataggattttgttggagacagatgcacctgatgcactaccaatgtcaaacatagattctctttattttgttgaaggagatacttctctcaccgaagagcttcttgcccaaacaacaacttcatcaacttctggttcttccctcggtaattcatcccatgtcttggcagatgcttcgatgttgccaaaggaaacactcaatcatcccgcaaacattcataatgtacttgattatgttgcatctatgctagaaattacgaaagaagagcttgctgaattaagttaccagaatgcagtccggttattatcctatgaaggtggagaagagagtaccagtgctcttaggttggtcgctagcaaagcattgaaggtaagcacctatggaacgattcatgacttccgtctgactggatttccaagtgatacgttgtggagaactcagagaagaatgccattgaggtgggcaatctcaacgaagaaccttgaggccactcttgtcgtagtgaatgtagttggtaacgctatgagggtgcccattttgagtgaggacaacaccaatagccactctaaatgcatctattttgatctcaaagggcaattcaaagttaggcaacatgagcactggagtagtc

SEQ ID NO: 13229 - DNA, 367 bp, Glycine max
  Peptide Sequence Number=SeqID_130007
ggccctggggtttccagttctggttacgggcctctgtcagtcctacagggtgcctgtccccccagcaaggaatcgcacccacaaagacacccagtggacccagagaagtccaacagggccctggggtttccagctctggttacgggcctctgtagtcctacagggtgcccgttccccccggcaaggtcacgtcatcatgacatagcaaggtcatcaggcccccctactaatcgagctttcatcaagaagtactgcgtccccaggcaggcgcagggcgaaacaccacagcagcctggggatggccggcagcaggcaacagacgcaccgccatcacctctagagttcacctcagatcatccaaaaaaag

SEQ ID NO: 13230 - DNA, 969 bp, Glycine max
  Peptide Sequence Number=SeqID_130008
atgaacgatcttatgaccaaatccttcaccagctacgtggacctgaagaaggctgcaatgaaagaagatgttgatttggaagctggtgttgttgtttcttctgctactcctcgcaacgtggaacttacctcttccacaacacacttggacaccgacatgggtctcttcctcgaagaggctgagaaggtgaaggctgagatggggtccctccgtgacatcctcggccgcctccagcaggccaacgaggagagcaagtccttgcacaagcccgaggccctcaaggtgctccgggcccggatcaatgcggacattgtcgctgtgctcaagaaggcccgggcgatccgggcccagctagaggagatggaccgcgccaatgctgccaacaggcgcctctccggcctcaaggaggggacgcccgcgatctaccggacccggattgcagtcaccaatgggctcaggaagaagctgaaagagctcatgatggagtttcaggggctgaggcagaggatgatgagtgagtacaaggatactgtggggagaaggtacttcacagtgactggggagcacccagatgaggaagtgattgagaagatcatcgccaacgggaacgaggaagaggttctggggaaggccatacaggaacacgggagagggaaggttctggaaacagtggttgagattcaggacaggcatgatgctgccaaggaggtggagaagagtctactggagctgcaccaggtgtttcttgacatggctgtgatggtggaggcacagggtgagaagatggatgacattgagcatcacgtgctgcatgcttctcactatgtcaaggatgggaccaagaatctccagagtgcaaaggagtaccagaagaagagcaggaagtggatgtgcattgggatcattctgttgctcattcttattctgtttattgttattcctgttgtcaccagtttaagcagttcttga

SEQ ID NO: 13231 - DNA, 219 bp, Glycine max
  Peptide Sequence Number=SeqID_130009
atggcctttgtggataactgggcggtgggtaaggaggagacccacatcgatcctttcactggcaaagaccaaatccgcaaagctttgaaggtgccacttgagctgccaggttctccacctttgggcgtattctttgaaagattcgtgccccctttttgcacactttttgtagttgcatcctatccggagccatatcagaattgtactgacgctgcctaa

SEQ ID NO: 13232 - DNA, 332 bp, Glycine max
  Peptide Sequence Number=SeqID_130010
atggcatgtattgctgacaagataaaaaccatcgatggatctaaagaaactttgaaacttgctgtaaggataaccgatctctggtttgttgggacaccgggcaggtctgaacaagctgagaagatcattgttgactctgacggtgatcagatccacgtggtctgtaagcaagaccagttaaaggcatggaaaatggatttgaaggaagatatcattgctggccaattacagtttgacctattagtagacatcattggtgttgttgacgaggttgtctttcgtcatatttcacccagaagtaagagagttgtttttaagcttatgaatttgag

SEQ ID NO: 13233 - DNA, 204 bp, Glycine max
  Peptide Sequence Number=SeqID_130011
atgagctcaccttcgcatctcaatgcccagccgctggtctggggacacggaccgcggacttttgaagtattcctcgaaccaacctgtccgttttccgttcgcgccttcaacaagcttgatgaattgctggatgaagtgggtgccgagaacgtcacgattaaaattcgcctgcagtcccagccgtggcatctgtttccggggtga

SEQ ID NO: 13234 - DNA, 372 bp, Glycine max
  Peptide Sequence Number=SeqID_130012
atgacaaattggtttgcaatcgaaaccacaaccacattaggggctctcgaggaaattctcgacaccaaaataagcggaagtgattcgaatagagaagtaaatattgttcccctgacgagagacctcgatgatgttgagccaaaggagcaagattttgacggtgacacctttgagattataaagcctgcccttggagatgacacccgtgatggtggatttgtacttgagcatgtaggactctatgtcgaagcttcacgcttcttggaaatacgctgtgaactcgctgttgtctctgttaagcgaataccctatggctcccttgggaagaagacccaccgggaacctatactccatcagaacatcataggctga

SEQ ID NO: 13235 - DNA, 531 bp, Glycine max
  Peptide Sequence Number=SeqID_130013
atgaaaagagtggccaacatcacactcatggcagatacatatggatttcgtgctcccacttaccaaagaggaaaatatgaagcattgaagcttaagaaacttcaagatcagcatggggaatccttgagttggaccgattacttatcattgccattttctcaaacaaacatcaaagaatatgacatctggctagcagcagagaatgagatgtttttaaacccttcaaagggagaatggatgacaacaatgccagaacaactgaatatggaaatggttgacaattttttggttgctcgactcactcatatcaccctcaagagagaggcttgggttacctctagtgcccttattcctgttgttgctggagttgtcattgcaagtgggagatatgtcaatgttgcatcatgttccttgtgccactctagatctggagtagtggtggatagattaggtggtggtgggcgagccaggctttcacttatttggattcattatgtgcctaagattgcaagctttgcttcaaataaatag

SEQ ID NO: 13236 - DNA, 255 bp, Glycine max
  Peptide Sequence Number=SeqID_130014
atgtccaagacaataatgttacctcctttctctatcatcttctcttctccgacttatattcataaggagacatgctttcggtgtcggtctttgaaggagattaagaattacgagaaatatggaagtcctcctcgacgtcacaaagtgaaaacacaagccaaagaagaaagcaatgacaaaaccaaaaatgaaacagaatattggttaaagtttactgacaactacaagctcatgagtaggactgaaagtgattaa

SEQ ID NO: 13237 - DNA, 147 bp, Glycine max
  Peptide Sequence Number=SeqID_130015
atgtcggcaagggcggtcagggaaaagtggtggcgggaaaggtggtcatcagcggcgaggcaagcattggagacaacgagaatggagagggaggagcggtctgagaaatccacggtgaaggatgtgacggaggcagggagggagtga

SEQ ID NO: 13238 - DNA, 585 bp, Glycine max
  Peptide Sequence Number=SeqID_130016
atgggtggagagcaaataggggaagtaagggatcactcctctctcttcagtgctatcaaaaccagatttgttgggtactcggtcgacagaaatagctggataagtattaggcccattacaagatgggaaagtcataaattagctaagatgcatggtaattgtctgcaagaaagtccaaagtctaacaagatttgtataaataaaaatgagattcttgagaataccatcctagggcagacagcaagaccaaataccctgaagaatctaaggaagagggacgttgcaagaagaagaccgttgagctcttggaatatggaaatgcaggagatactttgggtgaaggcgcatgagccgccactactttgggtggttcaatttgatgatgaggtggaagacatgtccacgctgatggaggaggacagacgttgttcgttgatctcggcgagtttccaacatgttgggcaatttttcactctgagggctagagcgattcaaggtggcggtaacgctgctgcattaagtggcaaagatagtttagatttggtagtaattaaaagaaaactaaaggacaattttatcatttaa

SEQ ID NO: 13239 - DNA, 708 bp, Glycine max
  Peptide Sequence Number=SeqID_130017
atggatattataaatatctctttcaaatatgagagactttgtaatttctggtatggatgcgaaagtttggatcaccaactgaaagtgtgtcacatgcaagatgaaagctatgatgaggaagatgttgataatctcccatttggatgtggcgacacgactaaaaaagtgggaagcagaataaaagaagagtatagggcaaggttgtcacaaagaacagaatcgatggaatatggtgagattgaagaggaatcactagagccacacaagtcgaaggaatcaccctacgaaatgttgtgcaacaacaagaactccgtagagaacattgtcaccgatatgctctccattaaaaaagattgtaaacccaagaaactccttcgagatctcgagctaaatggattcgctgaacagaacaacgacagtggaggaccaacagttagccgaatggcgcatgcactatggcccccacttcgaatcgcttctagtttccctcaagggaatgtaattgccgtatttggggaaatgagagtgaaactatttagcatcgtatttgatagcatttctcagagtccagagttgacgctcattcatttgttgccgaaatttggtcactcggttttggatgtttgcttcctcaaggatgtagcgacaattcagtttacatttgggatatttctaactctaatatggttcttaaggttcaatctccag

SEQ ID NO: 13240 - DNA, 1050 bp, Glycine max
  Peptide Sequence Number=SeqID_130018
atggttgcaaatggagggaagcatgctactaagatgaacatagtactaagaatgccaatagagaatggatttaacgttattaataagaccattttcctctcctacagcaataatctggataatcggatagtccataatacttactactttagaatttatgagatttctcaaaactcttgctttgcaggaatggtgggtttatctcttggagaaacacatttcatccaaggtggcattgctcaagatcttcgttgtgatggtagaaagagattgacatatcgaccaatctctgttgaaactggagtgattccccagaccaatggttcagcaagagtcagaatgggtgccacagatgtcattgccagcgttaaggctgaacttggaaagccaagcttgttgcaacctgacaaaggaaaagtctctatatatgttgattgcagttcaacagcagagccagcttttgagggtagagggggtgatgagttggcagcagaactgtcaaatgctcttcaacgctgtctcttgggtggtaaaagtggagcaggtgctggaattgatctctcatcgcttattgttgtcgaaggaaaaatttgttgggatctttacatagatgggcttgttgttagttcagatggaaatttgttggatgctctaggcgctgccattaaggctgctttgagcaatacaggtattccaagagtccaagttgctgctggaacatcaaatgatgagcatccagaagttgacgtaagcgatgaggagtttctgcagtttgacacatcaagagtccctgtcatagttacactgactaaggttgggaggcactatattgtagatgcaacatcagaagaggaatcacaaatgagctctgctgtttctatttctgttaataggcaagggcacatctgcggcataaccaaacgtggaggtgtagggctggatccaagcatcattcttgatatgatatctgtggctaagcatgtaagcgagcaattaataaacaaattggattcagaaatagcttctgctgaagctgaagaggagtcatga

SEQ ID NO: 13241 - DNA, 960 bp, Glycine max
  Peptide Sequence Number=SeqID_130019
atggttcccttgcttaactttttgcaatcaacaggttcatatcttatgctcaatgtgtacccttattatgattacatgcaatccaatggtgtagtccctctagactacgctttgttccggcccttgcctccgaataaggaagctattgattccaacaccctcctgcattatactaatgtctttgatgcaattgttgatgctgcttattttgctatgtcatatttgaagtttaccaacatccctattttagtcacagagtcaggatggccctccaaaggcgactcatctgagccggatgcaaccgttgacaatgctaacacttacaatagtaacttgatcaggcatgtccttaacaatagtgggactcccaagcaacctggaattgcagttagcacttatatttatgagctttataatgaagacttgaaatcaggtccagtgtctgagaataattgggggctgttttatgctagtggagctcaagtgtataccttacacttgactaattctggtactgtatttgcaaatgatacaacaaaccaaactttttgtgttgccaagagtaatgccgattcaaagatgcttcaggcagcactcgattgggcttgtggaccggggaaggtggattgttcgcctttgctgcagggtcaatcgtgttacgaaccaaatagtgtagcttcacatgctacatatgctatcaattcatattatcagcagatggctaaatctgcggggacctgtgatttcaaaggagttgcctctatcaccactacaaacccaagtcacggttcctgtatattttcaggaagtggtggtaaaaatgttaccagcgtaaatggcacagcattggctccatcaacaaattccacaaattcagggtgcttgtcccaatattacaatggtggattttttacaagcactgtgattcttactttaattttgagtgtagttgtcttgtaa

SEQ ID NO: 13242 - DNA, 821 bp, Glycine max
  Peptide Sequence Number=SeqID_130020
atgcttcaggttcaggaagctaagaacaagcttgatgttcctaaagatgcagaggaaaaattgtgtgatgaaaccaaggggcataaactagatattactagtgatagagatgtccaaattttggatgatacaaagtcaaacagaagaagtggtacttctactatgggcgatgaagcaataaaattatctggttcaaataggagaccacattctgaaataactaagaactccaaaagaggaaatgcgaaagccaatatggaaactgataatttagactctgttcaggaaccaaaatcagaaacgcagttgaatactgtaccaaggaagaggggccgaaacaaaacctgggaaatcagccaatccagaaaggcttgcaattgcagctctccttatccatcttctgaaaaacctacttctagaaaggataagttgcatagaatgcctaaaactgttagtgaaactctagtttgtatgcagaaaagtgagaacatagcaaaagctgtccaatccagaaggactcaaaatattggcactgattttctagctaatgatacaagcaaagttcatgaagctttagcttctaagcctaaagctgatgagaatacaaatgctgcttctgtaaataataactatcctgatgcaggtgctatctcaattcgagccacttcgagtcaatatacttcttcactctcttgtcgggacgtgaagcggctaggttcgagttgggttggtcaagctaggtgcaaaggaagaacaatgaagaacaaggctagggttcgagtggggttagcagtcaaggtgcaaaggaagaaggaagaaag

SEQ ID NO: 13243 - DNA, 213 bp, Glycine max
  Peptide Sequence Number=SeqID_130021
atgactcttagcttgaaatctacttatattcataaggagacacactttcggtgtcggtctttggaggagattaagaattacaagaaatatggaagtcctcctcggtgtcacaaagtgaaaatacaagacaaagaagaaagcaatgacaaaacccgaagtgaaacaaaatttactgacaactacaagctcatgaataggactgagagtgattaa

SEQ ID NO: 13244 - DNA, 165 bp, Glycine max
  Peptide Sequence Number=SeqID_130022
atgtttgattcagtgttgtgtttcaggaaacaagcccttgagcaagaacagggccaaaatctcattggaatgggaggtacaagacaggctaaaaaatcaaaatggaaacacataacaaagcttgccgtaagagtaggccagaacacatatattgaacaagtctaa

SEQ ID NO: 13245 - DNA, 501 bp, Glycine max
  Peptide Sequence Number=SeqID_130023
atggtactgaggaagccaaggatatctccacaaaccgtgtggagtcataaggttggactgcacggtgagaacatgaagttctattcccctggcatcactgaaggatggtttgcaaatggtcttccaacagataaaatattcatgtggtacaagactacattcagaactcccataggaactgatccagttgtgctagatttgaaaggttcgggaaagggtcaagcttgggtaaatggtaacaacattggtaggtattggacaagctatcttgcaggtaccatgtcccagactcatttcttcgtaatggtgaggataacacattggttttgtttgaagaacccctttgaagttaaaattgccagtgtaactattgcaaaagcatgtgcaaaagcctatgaaggacatgcattggaattagcttgcaaggagaaccaagtcatatctgaaattaaatttgctagctttggtgtgcctaagctatgtcttggcaagcagaaatga

SEQ ID NO: 13246 - DNA, 546 bp, Glycine max
  Peptide Sequence Number=SeqID_130024
atggagaataagagcatttatggcccatggcttttggtgaaaaagaattttcgcaagaaaccaatggtgggaggcagtacaagagttggtgcaatttctattcctagaaaagtggatccagaatctaaaggagccactaagtctaaggagttatggggtatgtttaaagagctaacttctgatattaatagtccttgggctcttctaggtgaattcaattctactcttcatgttcatgaaatgtgtggtggagttgtgaacccttccttgagagggattcttggttttcagggagtattgaatggctgcgaacttattgatgcaggttttcaaggctaccctttcactaggaaaagaggaaacttggagcaaaggctggacaaaatgttaattaacctgcagtggaggcttctttttcaagatgctattgttttgcatttatcgcctttcaaatctgatcatagacctctcttggtgaaattttgtgctaattattcgaaaaatagtcataggagaggccttttcactttttggcctcttggataa

SEQ ID NO: 13247 - DNA, 300 bp, Glycine max
  Peptide Sequence Number=SeqID_130025
atgaacctggttggtcgacgaatcagtgaagagggaggaagcctcgttcaggaaggtagaagacgtttgagaaaaatgattgtctctgaggtactggtggaccatgagggccacaagagcagggctgattttgtccattcggaacgactctgccgtgttgggttcgattgtcttcgacgacgttttggaatctccagcaacgaaaaagagaagaaggagtgtgatgatagatcaatgagagtagctcactttagaaaagaatcgtgtgatgctttcacactttcattcataatactatag

SEQ ID NO: 13248 - DNA, 780 bp, Glycine max
  Peptide Sequence Number=SeqID_130026
atgactaagggaataactccaagagattattctctgttgctcaagcccagccctttatcttctcttggtttactccattctctccagcatggtaacagtaggattagagttcctgtgactattagaattcaaccagagaggttttgtcatcgtgcgccaaccgtcacgaatgaagtgccgcaaaatgctgattttcctcagcactattcgagaaaagagaagaaaccttttccagtgcccattgtagaactgcgacgagcagctagggagaggatgaagaagatgaaagatgagccgagaaaatcaatgtcagcacctaagaatgggttgctggtgaagagccttgtattgactgcgtataatgtgtataacactaggatcactttgatcaacaatctgaagaagctgctcaaagtagtgcctgtgcatgctttagtggttgagctttgcattcaagctggtgttgaaattccagagtttcccaccaaaaggagaagaaagcctatcatccgtattgggaggaaggaattcatcgatgctgatgaaagtgacttaccagataaaatctcagagggccctttaaaaccgttaccagctgaaacacctgattcagaaatagtagctccattagacaatgaagtagtccctcttgctgtggaaactatcctagcatgggaacggacgaggaaaggtgcgaagagactaatgaggctgtacaatgtgagtgtttgtggatattgccctgaaattcatgtcggttcccaggatcacaaagcttaa

SEQ ID NO: 13249 - DNA, 265 bp, Glycine max
  Peptide Sequence Number=SeqID_130027
atgagtttcggagttagccttagtaatgaatccaatattaaaaagctgagcaaccatcttcaaaacatcatgtcccacaattctaaaataagaggagtgctgctaggtgcacctagcatttttgctagcgcatttgttccccctgtgagcgttgtcgtcgtcttcttcgtcggcatttcgttgtgcgaccgcgctgccatgggtgttgactatcccagccaagttgacggtggttctgctgcctccgcgcgtcggcattgtcgag

SEQ ID NO: 13250 - DNA, 396 bp, Glycine max
  Peptide Sequence Number=SeqID_130028
atgaaacagtttatgaggaagacattcttaccaccatcttacaaaagatatgcttatgacaggttacaaagcctcacacaaggtagcaagaacattgatgggtatcataaagagatgacaatgactatgaggagagccaatgtacaagagcctaaaactgccatggcaaggttcctacgtgggcttaatagagacattcaatgcattgtgaagttccaacactatgagagcttagagagtatggtgcatcaagctaagaaagtgaaaagacaacttaaaaggaagcattcctacaagaagacttatcattatgactcttttagtggtaaagacaagtccaagaaggaaggatcttccccatctaggcaacaaggttcaaagagaatgcactggtag

SEQ ID NO: 13251 - DNA, 543 bp, Glycine max
  Peptide Sequence Number=SeqID_130029
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatatgtttgatcaagattccattactgactatttcaatcgcgttcaaatgcttgttaatggtatgaagacctgcaaagaagagctgattgatcaacaacttgttgacaaggtgctaagaaccttgacacctcggtttgatcatgttgtagtggtaattgaagaatcaaaggatcttgattcaatgaaggtggaggagttgcagaactctcttgaagcacatgagtag

SEQ ID NO: 13252 - DNA, 516 bp, Glycine max
  Peptide Sequence Number=SeqID_130030
atgatggactacattgccatcaaaataacaacttgcccaagcaactttactgctcagaattacccatgccatgttatgaaactcttaccagaggatcatagagactatccctgcctattcaatgatgaatacgaaagttgggatgtacagggtaatacacagtatcaatatagcctcatgagggcacaaattcagggttaccaatggttcttctcagaatcagataaacatgagtttgatctaataaaagaaactcatgacacaaagcttttcctgcccttatacaatgggaagtttttcattcctttcccggttgatcacaacaacaaactagttcaattcttccagaaagagaaaaaagataaggagatttacgaagccaacggatgtcatggacaacaaacccctcctttcccatccaccgatctctcaatgaaagactcatccgacatcttctgttatgggaatatccaagacaaagaagatgttactgtcacaaaatcaaccaagaattaa

SEQ ID NO: 13253 - DNA, 324 bp, Glycine max
  Peptide Sequence Number=SeqID_130031
atgacgatggttttggagttattgaaagatgcatttgaaaatgcaaagattcctacttcattttatgaggcaaagaaggtgatctacaagcttggtcttaattataccaagatagatgtttgcccaaagagttgcatgttgtattgggaagaagatgaaaatttgcagatttgcaaacattgcagaaaatctagatggaaagcaaaagaacctagaaatgttcgccttggccttgcaagtgatggcttcagcacatgccgaaccatgaataataagcatactatatggtcggtgcttctaattccatacaatcgacctccttag

SEQ ID NO: 13254 - DNA, 147 bp, Glycine max
  Peptide Sequence Number=SeqID_130032
atgagacaggctcttaacacattccttccttggccgatacatcttgtcaagcgtttatcagaacagggagttgtgggacttgcgaaacctgcagataggccggatgatgaggtcgttgtgggatgctaccttgtttggcctgtttaa

SEQ ID NO: 13255 - DNA, 765 bp, Glycine max
  Peptide Sequence Number=SeqID_130033
atgcctaatcacgcctctgatacctattatattgatattgaacagatccagatcggtctgtatatccaccttgacctcggatggatggaccatcctttctctgtcagcaactttaaaatcacggacgaatcccagatcgagaccatcaggtccctggggctgcaacaattgcgttatgacccgcggcgtagttccagtacaccgttaagaagcagtcgtggcggcggcaattacaatgtggtggatttccctttcaaaaaagatttttcatcgagactgggaatcattgatgacaccccggcattaagcccggcccagaaaaaacagctcgccctcaaacatgccattacggaaagcgagcagaaattcctgcaaaccagtgccgaggtgagaaacctgcagaagctctcggtagaacatccggaccaggcgtttggactggcctccaacctggtgcaggacctggtcaccagtacactgactgaaggtgatatcgccattcatgccatgaatggccatcgcattggcgaccagtattaccagcacgaactgaatatcctggtattgtccatgttgctggccaagaacctgaacatcagtgatgaggatgccgtcattctaggcatggcggcgatcttgcatgacatcggcaaacgccagatcagcgacaagatcttactgaaaaaagagccactgacggcacgtgaaacagccatctaccagacccatgtcattctgggcatgaatatgctgaaagatgtgccg

SEQ ID NO: 13256 - DNA, 261 bp, Glycine max
  Peptide Sequence Number=SeqID_130034
atgggtgccaaatacctcgaagtggtcgaacgagggtcgcatcccaacaacggatggtccccggacgaaattaggacgcagaatgaccataatttgtctctgcgtgttgttggacacaatcgagcctgggcggcgagacacagaataaccataatttgtctctgcgtgccactggacacgatcgcctctgcatggcgaaaaggtgcacggaatgagcataatttgtcttcgcctacctctcgacttattgtcctcgaatga

SEQ ID NO: 13257 - DNA, 177 bp, Glycine max
  Peptide Sequence Number=SeqID_130035
atggcgagtttgctctgcgaaagccacgtggcctggaaaccgccagtggtgatggcaattcaggcgcaggtgcaagtcgccagttcctctggcgagtttggtcacaggtttccagtttcactttttagagggaggcacgtggttgtagcttttccagaaggcacgtttttcaggtaa

SEQ ID NO: 13258 - DNA, 720 bp, Glycine max
  Peptide Sequence Number=SeqID_130036
atgaggccacatcaagaagagacggagcttgtagacttaggtgctggcagtgaaaggaaggaagtgaaagtaggcataggtatgaccccccccccccccatccgtgaggaattcgtggccctgccgagggactaccatgacgcctttgcttggttgtaccaagatatgcctagtttaagtcacgacatcgtgaaacataggttgcctttgaactccggttattctctggtgaagcaaaagctaaggagaatgaaacccaggatgttgctgaagatcaaggaggaggtgaaaaagcagttcgacgccggtttcttggcggtggctcgataccctgagtgggtggccaacattgtgccggtccctaagaaagatgggaaggtacggatgtgtgtggactatcgggacctgaatcgggcaagtcccaaagataagtttcctgtgccacacatcaatgtccacgtggacaacacaaccaattttgctttgtttttcttcatggacggtttctcaggctacaatcaaataaagatggtgccagaagatatggaaaagaccacgttcgttaccctgtggggaacgttctgctataaggtgatgtcctttgggctcaagaacactggggctttgttccacgacatgatgcaccgagaaatcgaaatctacgtagacaacatgattgccaagttcaaaactgaggaggaatacctcgtcaacttgtag

SEQ ID NO: 13259 - DNA, 234 bp, Glycine max
  Peptide Sequence Number=SeqID_130037
atgactagccagcaagcggctaatcacagaggacagagtcaggacctcagtcctttcccttggcctacccccgagcagtttgaggccacggtggcctggcctggggacaagactgatttcaagacacaggcaggacctacaggagctctggggatgacgaaggagctcaggaggataacaacatggctaacgtgttggacttcgtcacttgataaggctgagttgcacgactga

SEQ ID NO: 13260 - DNA, 342 bp, Glycine max
  Peptide Sequence Number=SeqID_130038
atggctccaaagaaactctcgaccaagaggtctaggaaggatgccactggagagggttccagtgtggccccacaagcagatatggattttgatagacaccggttctggagtacggaacaccagcaatggtttgaggccatcaaaggctggtcattcctcagagagaggcgagtccagctaagggacaaggagtatgtggagttccaagaggagatagcccgaagacaatgggctcagctcgtatcacccatggctaagtttgatcctgagatagtcatagcctacagacgaaggagccaaagacatgcgctcctgggtgaggggccagtggattccctttga

SEQ ID NO: 13261 - DNA, 438 bp, Glycine max
  Peptide Sequence Number=SeqID_130039
atgatacctcctctagaggcggcggtggcgcatctactgcagctgctgctggtattcctttggctgctggggtgcctgacccgacaccttcctgggcacacagtacttctcaatgaaagtcctgttaataggaggttgaatgagcttggtgggggtgacctccattccatagaactgacagaggcctgtgatgagagcaagaaacccttcgggtccactgggtatctcagaggcgtaatccctgcaaactgggggaggttcgagttatggttgctggggaaaatgttgctaagcagcaacgtcatccatatctgtgtgatggtggtcatgctggtgcgcatgatccgcactcgaagtcggaggcctgactcctcctttgggagaactcacagcgctggccttcctccaaaaccagcaaatgccccagaaactgattga

SEQ ID NO: 13262 - DNA, 312 bp, Glycine max
  Peptide Sequence Number=SeqID_130040
atggtgtggcgtctcctctcaagtcttcttcttctccattctgctgccattaatcttcaagaagcaaaggactctattgatgaagaagatctatggcctacaagctccacatggagctacatcagtgagggatcccaaggtgtgttcaaagattgtaaaggaattacaaggatagtggaaaatctcaagtggtttacttggacatggacacgagaagtggttgaactagtcattttggcaagagctctagaggccaaaaatcagcagaaagttctagaaggagaaattgtggaaattgaagataaaagctag

SEQ ID NO: 13263 - DNA, 358 bp, Glycine max
  Peptide Sequence Number=SeqID_130041
gtctccaaggttaacagcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtagtgctggcggggagtaactatgactctcttaaggtagccaaatgcctcgtcatctaa

SEQ ID NO: 13264 - DNA, 720 bp, Glycine max
  Peptide Sequence Number=SeqID_130042
ggacctgctggggtcttctacagacagttcgctttcactttggtaattgcgatccttatttcagctgtaaatgcattaacattaagtcctgctttatgtgctcttttcttaaaagatccacaggatggagagcatgtaaacactcctccgggaagttcattggacagaacccaacgtgcaacaaaacaaattgataaaattgtaaacggagaaaaagcaaccaaccacttatgggtagcggacggggtaaactttatcagtaatgcgaatgcttctccttactctgccggatttatcaaattaaaagatattgacaaaagaggtgatgtaaaagatcctgatcagattgctgccgggttaacgggaaaagtgagccaggtaaaagatgccagcgcattcttctttaacttccctacaatccaaggtttcggtaacttgggagctaatacccaggcgttcattggtgagctgatgaaacgtaaagaaattgcatttgccttcaccacttatgctgcaggaaatccacaatacactatagaagtggatgcggataaagcaaaccagctgggagtatctgttacggatctgatgcagaccatgcagatttatttcggtagtagcttcgtttcggatttcaacagattcgggagaaatggttcctaccaaaacattagtaaccttgaaaaggactttcgggccggaaaccgtaacaagaaataa

SEQ ID NO: 13265 - DNA, 452 bp, Glycine max
  Peptide Sequence Number=SeqID_130043
atggttgaccaagaggagacacaggaacagatgaaagccgacatgtcggctttgaaagaacaaatggcttccatgatggaggccatacccaactgggtggcttacccttatggattaccacctaattacacgcctccaatcatgcatgatgacgcgggtcatgtctcttcccccatccttgaaggggagactcctcgacagcccgacgaggtccataaagatcatcgagagctttggtactatccgttcacggacatgatgattctttgcttgataccggatgtcgtcatccccccaaaattcaaggtgcctgatttcgacaagtataaagggacgacttgtcctaagaaccatctcaagatgtattgtcgcaagatgggggcgcactctagggatgaaaatttgttaatgcactttttccaagatagcttggctggagccgcgattatttg

SEQ ID NO: 13266 - DNA, 707 bp, Glycine max
  Peptide Sequence Number=SeqID_130044
acgtcagcagagcgttcggaaccgtacaggcggtgagaggggcgacgctccgggcggaagcgggccgcgtcaccgggctcgtcggtccgaacggtgccggcaagacgacgctgctgctcatgctcgcctcactcctcgcgcccgacaccgggacgatcagcatcgggggtgtcgaccccgccgtggaccccctggccgcccgccgtcttctgggatggatgccggatgctctgggcgcctggccgtcgctgaccgcccgcgagacgatcgtcacgacggctcgcctctacggcatcgagcggaccgcagcggcagccaggtccgaacacctgctcgcgctcgtcgggctcgccaccctcgccgactctccggcaaaggtgctctcgcgcggccagaagcagaagctgggcctcgcgcgggcgctcgtgcacgaccccgccgtgctgctcctcgacgagccggcgtccggtctcgaccccgaggcgcgggtgcaactgcgcgtcttgctgcggcagttcgcagccgaggggcggaccgtgctgatctcgagccacatcctctccgagctggaggaggtcgtcgacgacgccgtgttcctcgtggcgggagccgtggtcgatgccgctcccgccgaggcgacggtgcgaacctggcgggtgcgtctggccggagcgtcggccgaccgtatgaacgcggacacctggcag

SEQ ID NO: 13267 - DNA, 196 bp, Glycine max
  Peptide Sequence Number=SeqID_130045
tcttagtaagagggggagggttaaagatttacctagtgtgagatatcacattgttcgaggaaccctagatgctgtcggagtaaaggatcctcaacaagggcgttctagtgccttggataagaagcttagagaggaagcttcaatggagggagagaatgagagagagagagagagtggcatggaaattgaaggataa

SEQ ID NO: 13268 - DNA, 282 bp, Glycine max
  Peptide Sequence Number=SeqID_130046
atggaaaaaaatcccgccgtgaaagtggcacgaaccgggatatcctctaggaaagataaaggcattagccaatcccaggaacggagcaaggggctgggagtaactactattactactaagggaccaaaaaacctttctcgtctgtcatggagaaccttcccgggctctagctctaccatagacttagatagacttagaataagcgggactagaggacaaagcatcgagaagaaaagccttcagagccaagacctactcctaaatcagcagaactacggatga

SEQ ID NO: 13269 - DNA, 108 bp, Glycine max
  Peptide Sequence Number=SeqID_130047
atggcagtatatgaagctaatgaaggagggaagatgccattgacatggggtcagaccagaaatatgccaattactcatagggtatggaaaagaaacgaaatatgttag

SEQ ID NO: 13270 - DNA, 333 bp, Glycine max
  Peptide Sequence Number=SeqID_130048
atggctttttatggaatcgcgggtgctgcttttgatatcttcaataaaaaagggaaaaaggtacgttttgttccttggggatttcctggaaaaaatcgtcgtattattctcgaaatacctatgaacgagcttcactccatcagaataataacagaagttaaagaagagggtatttttactcgtaccagtacttttgagagtatcgtttatctggaaaccatagaacaggggtttattcccttgactcgtattgaagataatttgaatgggacacaaattgcacataaagctggcgaattatctgtatttttgggtgtaccacttttttactga

SEQ ID NO: 13271 - DNA, 849 bp, Glycine max
  Peptide Sequence Number=SeqID_130049
ttaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacagcggataacaatttcacacaggaaacagctatgaccatgattacgaattcgagctcggtacccggtgtttgggagaccctcgaaggcaatgagaggtgccgattccgtggcacagttcgactcactgctacttcgctagtacatccgaagcaacccgcatgcacacttcaacagcctgtggagtggatactacctacacctactccatctcgactagttgagtctgttcaattgataaaggtgtcatcctctgaagaggatcttgaagaggacccagaggagttatctcctgaacctgctatggatgcccctgacttaccagaggatgatgaggacccgctccctgatgttgattctctagaggatattatgccagcatctgaggtagactctacagaggagagtggccctggagggacaacgaatagtgatgactcttcatcatag

SEQ ID NO: 13272 - DNA, 530 bp, Glycine max
  Peptide Sequence Number=SeqID_130050
gcgaggctcacgggtgcgtcttccaaaggaggaaaatgcgcagagtcgccaccaacgtttatttgtggaaaacgtcggaaaaatcgaaggaaaccggtcatgaagaatattccagattcgggagttgtatttacgtttgaggaaggtattagcacctctcacgtcgacaaaagcggggctcttgctcctacgtaccctccatcgaagaggaaatcagacctacttgaagaccgaagaccgtcgaagaacgcacgacgaacgacgaacgatgaagaacggttgaaaatcttcgcgaaatcacccacggaaacgttacggaaacgggaggagcttgccaaccagctcgcccaggcgagccgggttgcttccttcagaagcaaccgccttctggaggaacatcctgctacgggaccttatgggtcaccatgtcatggaacttcacgtattgtgcaacaaagggtgccaagtacctcgaagcggtcaaacaaaggttgcatgccatcaaacaatggtccccggatgaaattagg

SEQ ID NO: 13273 - DNA, 238 bp, Glycine max
  Peptide Sequence Number=SeqID_130051
atgggtgccaagcacctcacgaggaccaaagaatggtcgcacgtcatcgagcaaaggtccccggacgaaattagggtgaccataaaatctccacatgcaaatgacttgttgttcccaaaatttcacaaattgcctaatgatgggtgccaagcacctcacaaggaccaaagaatggtccgcttgtcatcaagcaaagggtccccgaaatcagtgtatgacactaatttcgttcctctcg

SEQ ID NO: 13274 - DNA, 452 bp, Glycine max
  Peptide Sequence Number=SeqID_130052
atgaaaagaggagaacgaggacagctgactaccgctaaaagtcagactacgagtacactttgtatgattgaaaactgccgctgcgtactacccggtgcttgcagcgagctccggctcgaaaacaacaagcaagggattgagctttcgaaagccctttccccttactctaacaaagctaacgcgctttacttaaccaaggctttctctgataggggctcgttagccgttgtttgggtcgagctcaaacctcctctgattccgataaatcggtcaagcggggggctaccctcgactcacctctctatctataaaaacccctccccggaggagagcagaagctccaggatgagaatgaatccaggacatactcatcctgatccaccgtggaattttcggaatctacaaaaacattctaggagagggctcgtaatgatcttctcaaagatcacaag

SEQ ID NO: 13275 - DNA, 354 bp, Glycine max
  Peptide Sequence Number=SeqID_130053
tccggacgcacccgcgacatggtctatttcgccatactcaagaacgattggcccgccgccaaagcgcgcctgctggcgcgcctgcggcgcgggccctgaacgtcgcggcgctcgctctttgtggtttcatcatggccggcactcaagttcccgcgactcgaggccgttaacgcagtaccgcgggacgggttctgcccctccccgcccttctcaagtcaggtatggatcgttctcccctctccccgcccgcgtcgctcgggcacaatcgccgcaacatcttcatctacaccaaaaagcaacggggcaaccaattggtcgagtcgccggtcatcggcatgctgtcggacgtctcgg

SEQ ID NO: 13276 - DNA, 357 bp, Glycine max
  Peptide Sequence Number=SeqID_130054
atggccaccacaccccccgttttgttgaaaaatgggattccggggcttccgggacacccctgggttgcttctagaggaagcaacccagctcgcctgggcgagctaaggtcgcctgggcgagctgggcggcaacctcctccccttttttcctataaaaaggctgaagggggctgttctaaggatccctcagccccctggctatgtatttcagctgttttgggtgaaaaaaattgtttccgtgaagaaaatccaagccgaggtgcttccgtaacgcttccgagatgtttccgtaagcaaatccgtgaaggttttcgtccgttcttcatcgttcttcatccgttcttcgttcttcaacgg

SEQ ID NO: 13277 - DNA, 219 bp, Glycine max
  Peptide Sequence Number=SeqID_130055
atgcacgaaacacaatgtggaccactacgggtacatagaatgaatcgaaaagcttggttcgagcaaaataggggaggtggttgccgcccagctcgcccaggcgagctcagctcgcccaggcgagcagggttgcttcctccagaagcaaccgccttctggaggaatattccagagggcccaagtgggcctgggtgctatttgcacccccatttttactaa

SEQ ID NO: 13278 - DNA, 348 bp, Glycine max
  Peptide Sequence Number=SeqID_130056
atggtaaacaaagacgagtgggtgcgagcggcgatggcggacgacaccgtcgtggtggagcttctgctatgcctcaagcaaggtaccgtttcgcacaaatctcaccagcagcttatacctttctcctggggtgtgaaacagtcgcgctcaagatcaaggcttagagctgttgtctctcgcagcgacaccgttgtttcaactacatgcagccccaccacgcccctctcttggagcgctggcactgacaattacgaagactccagccgccgccaccaccaccaccaccaccacgccgccatatctaaggtttcctccctctctctatgttgtttgtggagggtttggtaa

SEQ ID NO: 13279 - DNA, 651 bp, Glycine max
  Peptide Sequence Number=SeqID_130057
atggtcattgaccaatcccttttccatgacttaaaccaattgtccagtgacggtgtaccatttgaaggtacactaaatgacgattggaaatttgatttctctgcacatgatgcccgccagttggtttgcaccaaccatgcggatatgaccggacgcctccttgccggttcattggcttttgaaagccgcatccttcattatcttattgtgcggattttacttccacgatcttccaaccttgcccaggtttctaaggaagatcttgttatcatgtgggcctttcatactgggtgtcaacttgactgggcacatttagtcagatatcgcatgcataaggcattgcgattaaatgctcctttgccatatccacaccttgttactctcttttttcgccattttcaaattcctcttgattctgaaccttatgttccaatcaagagatcctttttaattggtgctgctgttattgcttctcttggttaccgcaaaaagcatgatggctcttgggtcaaaaaggctgctcaacccgctgatgatgaaggcaacctaccaactgaagatagttcctctcttcagaaaatattctcaattgtcacatcttttcatttggttcttgaatggctatcaaaggcctatatatatgtgacttga

SEQ ID NO: 13280 - DNA, 474 bp, Glycine max
  Peptide Sequence Number=SeqID_130058
atgaggccgaagtgtaacgcgattgccgcacaagggttaataaaagtgaggctgggagcgacaaaattcgcaccttttgaaaaggtggagtctgatggcaagaactgtcattgctcagaatttgtggtcgccattaatggcgaccctacaaggtatttgcactatttgcacagggcagttgcacgatttacacatgacggcgcattgatacggaccgttgtaatcagggaagcctctcagtatgagccgggccttaaaatatcgatcgccccagccgctcccgccggtgaccagacggcaatactcatctcaccgggaatcactgcgacaatcccgccaccgacgccggatttagccggcatgcctacgcgccaggcaaactcaccggcgccgtcgtacatgccgctggtcatcatcagtgcgttcacctgccgcgcctggcgtgcagagatcaccgcccactcatcatccagc

SEQ ID NO: 13281 - DNA, 1259 bp, Glycine max
  Peptide Sequence Number=SeqID_130059
atgacgttttcctatcactttcgccagcgcctgaccgcctgcgtcgccattgtggcggtgctgctgctgttcgtcgcgccgattgtgtcgaaaacgctgctggagcggcaaacgcgcattgaccccgtggcgtcgcacagcccttcatctgccatgccaatgcaccatcacgatatgccgatggagatggcgatgccgggcatgatgcatcacaacatggacgacggcgaatttgcctgtggctattgtgatttgctggtgcatgttccgatgatgatgtgggtgtttatcccgttcatctggctgatgctggtgatctcgcgcgccccaccgctgccgccgctggtggcaccccggccgcgccgcttcagcggaaggaagacggctttgtctgctgttcactctgcagcaccgcgcggcgcggtgcttaatctgctacgccgcttacacttttacattggcctgtttgtcgcgccgttcatcttcgtggcggcgctcagcggcacgctgtatgtgctgacgccgcagctggaaaatctgatctacgccgatgcgctcaccgcgcagccgcagggcaatgcgcaatcgctctcggcgcagatcgccgcggcacgcgcctatgcgggagaaaatcagcacatttatgcggttcgccccgcgcccgccgcgcgcgataccacgcgcgtacagttcagcgatgccacactcggtccgtcgcagtcgcgcgcggtgtttatcgatccctacagcctcaaagtaaccggcgacatgacggtgtacggcaccagtggcgtgttgccgctgcgcaccacgctcgatctgctgcacagcagcctgttactcggtgactttggtcgcaactacagcgaactggcggcgagctggctgtgggtggccgcgctcggcggcgtgctgctgtggctgggcacgcgaccaaaacgccggctgaaaaccgtgcgaaaggggtttgccttcacccggcactggcacatcacgctggggctgacgctgatgctcgggctgctgttcttctccgttaccggcctcacctggtcacaatgggcaggtggcaatatcgataagatgcgcaccgagcttaactggctgacgccacaggtgaatacggcgctcagcggtgatgcgcccgccgcgccggccgcgccggccgatcctcacgccgatcaccgcagtatgccggacatggacatgaccagcatgccgatgtcgtcgatggcgaaaccggcggcgcagccagcgaa

SEQ ID NO: 13282 - DNA, 477 bp, Glycine max
  Peptide Sequence Number=SeqID_130060
atgtttccccttacaaagattcaagggactaaccgcctaagaattctttgtcttaacacattggagtgtacatcctttgtggtacaagtagagggtacatccacttggttgttcaaagagaacaagggagggtacatcccttgtggatcttttcttgtaaaggattttacaaggttattggaaatctcaagaaccggtggttgcttggggactggacgtaggcacgagttatggccgaaccatgggctaagcgctcatccacagctaagcgcagcttcagcgcgcttagcgcaacagaagaatctagtagagcatcaatatgatggatgcacactaagcgtgagatcagtgcgccaagcacaacagttgtcttcagccaggctcagcgcaagactggcactaagctcaaatccatttactcgtgctaagcgcgagggtggtgctaagtgcaatgtcgcaaattcagagcctatttaa

SEQ ID NO: 13283 - DNA, 273 bp, Glycine max
  Peptide Sequence Number=SeqID_130061
atgtcgagcttcacgatatactacgggacacaatcggacatccgagtaaaaagttattgtcggtttgaatttcttacgagcttccgtttcaattacgagcgtctcgatatactacgggacacaatcagacatccgagagcttatgttttcaatttcgagcatctcgatatattacgggacttaatcagacatccgagatataagttattgtcctttgaatttgctttcgagcgtctcgatatattagagcactcaatcggacatctgagttaa

SEQ ID NO: 13284 - DNA, 567 bp, Glycine max
  Peptide Sequence Number=SeqID_130062
atgcaaaccgccagccctattggcgggtttgctgtggctgtgacacgtggcgaagacgccaccaccactggcgggggactagctagtcaaatcggcgagttgcaggctagggcagtcagcttttcaggctttttcagatggcagccttttcaggtggcaggggcgggtacaggatacatcatgaattcggttataaaagtgttgtatttaaatggaagagtatatgaagagaatgatggtgtaatatttgaaggcagtaaaaaagcgattcagattaaacgtggaattagtttcaatgctttgaagaaaaaattggagaaaagatttttagtgtctggaaaatatgttgcgttgcaaatttgtgatgacgaagatgttgaaaccatgcttgaaagttttcaacaacaagatcaaatgttagttccggaattgtacatagaaaaggatgtggatggtggttctatgtttcattctgcaaattctcttacatcatgtggaaataatttatctaataatggggcgcaaccgccaagaaatgtgagcatctacatggtgatgacgatgatg

SEQ ID NO: 13285 - DNA, 307 bp, Glycine max
  Peptide Sequence Number=SeqID_130063
gtatcagctcgccaaggcgagctggttgcttaaggctgaaggtgcaaccagctcgtctaatgatcctttgcatgggattggaggtcttatgacaaggtccaagactaagaggataaagcaatcattgcaaggcctgattctaatgatcaaagagaaagaaaaccaatgtgaattaagggttgctcctaattgggtcactttcctgcaaattgatgaagattctttgaagccaacttcaagaatcactaagaagcatccatgggttgagttgatcaattttggtggactattaacattggttgattag

SEQ ID NO: 13286 - DNA, 168 bp, Glycine max
  Peptide Sequence Number=SeqID_130064
atgattccaatgccgaatcgcctatggcgcattttaagaagtgatgcaatccttcgtaggaaaggaccattcactagagccataagcaagaggctccaagaggattgggctagagctgctgaagaaggccctagggatctcacgaacctcacgggctccatattgtag

SEQ ID NO: 13287 - DNA, 1136 bp, Glycine max
  Peptide Sequence Number=SeqID_130065
tatattttggtccagcctctgatgcaaatcagttttttgcttcaaatggtttcccttgcccgactctccacaatccttctgatcactacctaaggatcataaacaaagattttgaacaggatgctgaacaaggctttggaaagggagtaatttcagaaaaagcaattgataaccttgtaaagtcttacaagtcgtctcaaattagaaaacaagttaaaaaggaagtgaataaaataggtgaaagtgattctgatgcaataaggaagcagaggattcatgctgcatttcccactcaatgccttgttcttataagaagagcttccttgcagctgtttcgtgacataagcaattactggttacggttaattgtctttattgtaatagctataagcattggctctatcttctatgacataggcacaagtaatggatctattcaggggagaggttcgctgttcatattttttgtttcagttctgactttcatgacccttgttggtggattttctccacttttggaagaaatcaaggtatttgaacgagagagattgaatgggcactatggtgtcacggcatttctcataggcaacatattctctgctgttccttacatgctattgatatctcttattcctggaggaatagcatactacctttgtggaatgcacaaaggaccagaacgcttcttctacttcacttctttgttatttgccatagtgatgtgggttgagagccttatgttggttgttgggagtatctgccccaactatgtaataggtatgttccttgctggtggagttgaagggctcatgattttaactggtggattctatagactgccaaatgatcttcccaaaccactatggaagtaccctttatactatgtttccttcctcaaatatgccttccaaggatccttcaagaatgactttgaaggcttaacattttctgtagaccaagatggaggagtcaccagaaccgtgagtggtagagaagtactaagtgacacatggcatctggaaatgggttactctaagtgggttgatcttgctatcatgtttggaatgattcttctgtatcgagttttgttcttggtcatcactaagtgcaaggagaagctgaagccttttcactag

SEQ ID NO: 13288 - DNA, 318 bp, Glycine max
  Peptide Sequence Number=SeqID_130066
atgattctcacaaacaacattaaggaagttatccccaagaccaaaaatgctaaagagtttataggattaatgaaagagtactcccaaatagttgataagtttcttactgagacattattgaatatgttgaccaccatgaagcttgatgactcacgtactatgcacgagcatgtgattaagatgacaaacattgcagcaaggcttaagaccttgggaatgattgtaaatgagaacttcctagtacagtttattcttgactcattatcgtctgagcatggtccgtttcaaatgaactataatatcattaaagacaaatga

SEQ ID NO: 13289 - DNA, 441 bp, Glycine max
  Peptide Sequence Number=SeqID_130067
atgactacctttccttctgcacaacctgaggttttgcaaactaacccacaagttttgaccacatttgaaggtgatgccatcaagttaacagaaatcaatggaagtgttcaaagagagaaggacataacagtgacatgggagaatttgtgggtcactgtttcaagtgggaagaaaaaaaagccaattctgcaggatcttacaggttatgctcggccaggaaggattctggccataatgggcccttcaggatgtggaaaatctacacttcttgatgctttagcaggaagattgagcacaaacataaagcatacagggaagattctaatcaatggccagaaacaagcactggcctatggaacatcagtaagagacaattcccaaaagctacaagaccataaaagaaaaagtagcaatatttttgtaggaaaaataattgtttaa

SEQ ID NO: 13290 - DNA, 216 bp, Glycine max
  Peptide Sequence Number=SeqID_130068
atggcagctagccttggaaaggagttaaagagcaaaatgcttttatctttagtaattaatttggttactattctaagtcttcatgcaaagtcattctcattcgtgaattccagttcctctgatagtgatgaagaagtaaagattgttgtgaaagtgatgaagcagggtgttttgttatgcagaacgtgggcacagttaattgtaccagcaagataa

SEQ ID NO: 13291 - DNA, 804 bp, Glycine max
  Peptide Sequence Number=SeqID_130069
atgggaatgatgatgttttactcactgacacccaagacaaacaagctcagtaagcttgcttatgatatgctcgatgattgcaagatatgcaatatgcagcacccatttcatacaactttctcaacctcattaatcttggtgggggtagaaaaaccatttttgaaaaatttagatgccattatccttgagatgttaagggctgatattaaggatacaaaagtagaaaaaatttattggaaaatgggaaagatcaatgacgctgttcctttttttggaaaaggattcaacaaaatttaccccctcatcatggttatatacacttcactaatagcaagcaatattttcaaccgggtcatcaagtattgtgggaattggaaaatattcaagttcagtgatgaagcagaagatatggatggatttgacctgtccggagtaataatcttgcggagagaatgttctcttctccaacaagggcacaaagttggcgaacttgtttttcctttggcaaggagtttcagcgtgagtacggatgttgagtccaccagcaaggccatggaaagagtttcttcctccttgacaagtgatgttaatgattctccgaacacaagtgcagctccatcatctgtattagcctcaaaatgggaatcaatgatgcatggatttaaaattttgagatctaacattgactccaagggattcctcccactttctaatgctcaggggtcaactctaaactcaaaatcttcatctgaatcccttgatgatatatttgagagattgaaacgtcctccatcagaaatatag

SEQ ID NO: 13292 - DNA, 471 bp, Glycine max
  Peptide Sequence Number=SeqID_130070
atggcttgctctaatacatttggactggttaccggtgcatttctacttggatttggtttgagtgaaattccaaatggcatttggttgaattcagattggaacactgagcaaaaagttctttcacataaagttgcaaaaatggctgtcaaattagatgatgctcatcatgatttttcaaatgctattgttatcacacaggcaacatcaaagcaaatgtccaagcgggattctttgagaccctacatgaatataattgacaaaatgttgcttcagatagtaaagtcttgtaagtgtatatacatgcagttgaaagaagacccctccttcaaaccacagggtggaacactaggagaaagtggcatggattatgatacagatgataaatctatggcagcactaagacgtcgtcttacgaaagctcgtgaacaatactatcgatatagaagatacacactaatttgcttggtatag

SEQ ID NO: 13293 - DNA, 261 bp, Glycine max
  Peptide Sequence Number=SeqID_130071
atgcagttggggagcaatactagttcagattgggaatggcacttcaattggaggagacctttatttgacagtgagattataatggctgatgatttccttggggagatagcgtcgcaacaaatccatccagttagagcagactcttgggtttggaaacccgagccaagtggacattactcatcaaaaagcgcgtatgatctgttatggggagagttaatggggaacaacaggatgctgtttttgaggaactatggaaattga

SEQ ID NO: 13294 - DNA, 1134 bp, Glycine max
  Peptide Sequence Number=SeqID_130072
atggcttcttctctcagtctctccactccccctctctgtcaccctagggtatgtaaacatttcaaattgtacaatgggttgcataagttctcattcaatggacatgggtcggattttgccgttgtccgacacaactctaaagtccccaatgctgctggtagaattagagctacattgacctctggaggaggaggagacctaggatcttatctgaagagctctggttttgtgaccaatcatttcagaactggggcacagcttgatgtcatagcatttggaacactgagagcagacacagcagtgccagcaggcagtggtttttctgatgatgaagatgaccatgatttcgatagtccaacggaaggttttgcttccataccggaggccattgaagacattaggaatggaaagatggtagtggttgtagatgatgaggacagggaaaatgaaggagacttgataatggcggcgcagttggcaacacctgaggctatggcttttattgtgaagcatggaactgggatagtttgtataagcatgaaggaggaagatttagagagattggatcttcctttgatggtgaacagtcagtataatgatgagaaacttcgcacagcgttcactgtgacagtggatgctaaacatggtactaccacaggggtgtcagctcatgatagggcaacaacagtcttggcccttgcatccaaagattcacaaccaagtgacttcaaccgcccaggccatattttcccactaaaatacagggagggtggtgtgctgaagagagctggacatacagaagcttcagttgatcttgccatacttgctggtttgaatcctgtggcagttctgtgtgagattgtcgatgatgatggttccatggctagattacctaagcttcgccagtttgcagagcgagaaaatttaaaaattgtatctattgctgacttaataaggtacagaaggaagagagataaactagtagagcgtgctggtgatgcactaataccaacaatgtgggggccatttgtagctaactgctataggtcacttttagatgggattgagcacattgcaatggttaaggaaacaaaatatgagaatggaaagcatactgatatggtagaaacatga

SEQ ID NO: 13295 - DNA, 351 bp, Glycine max
  Peptide Sequence Number=SeqID_130073
atgggggatgtgagggagattttcatctccaaacacaggaacaaaggtggcaggcgttatggctttgtaaggtttaaggtggtgtccgatgagcgcagcttagaaaggaagctcgataacatcattgttggaggcctcaaaatgtacattaatgttccaaaatataggagaaaaaaggagaggtatatggagcgcagcgtcaaacacagcacccaagcagtcggcgctagcaatgaaaggaagttacctggacaaacggcagtgcagcataggacagatcctaagtcatacgcgaaagtggtctcaacagtcaatatggatgccggacaacggcggaacccactgcctaca

SEQ ID NO: 13296 - DNA, 1038 bp, Glycine max
  Peptide Sequence Number=SeqID_130074
atggtgctgcatcacagaaagcttttattgtttccaccaccaccaccaccactctgtagaagtgcctgtcctgagaaatttaatgaccctctacccccacctaactccccagatgattatttgacccaaagtcccaccaaaaacatcaaaatctccaaatacttgatcataagtttctccattgtagcaaccgctttcattgtcctcagcttctacgccatctacgccaaatttttctctcctcggaacaggtcaatacgaagaacactatcacgcccagaaacagaacaagatttcttggacgaggaagaacaacaacaacatggtcctgtcgttgaccaccccatctggtacatccgcaccaccggtctccaacaagcagtcattaccgccatcaccgtctgcaaatacagaaaagatgaaggcttgattgaaggcaccgattgttccgtttgcctgagcgagtttcaagaagacgaaagtctcaggcttttgccaaagtgtaaccacgcttttcatttaccttgcattgacacgtggctcagatcacacaccaattgccccatgtgccgtgctcccatcgtcactgaccccacaagggttccttccatggaccctactgcgtttgaagcaagttcttttgtggaggaggttttggaaaatagtgtggaagatgctcaaagcagtagtgatgatttggtgaggaatgaggaagaggaaagagtgcaagaaggtgaagtgtgtgaaaatgagaacttggctgtgactgtgcagccgagaagatcggtgtctttggattcttcttctgctgctaagatcagtcttgctcttgcaactgttgtgtcaggggattctcatgggaatcattcaaagagggttgttgggaatgtgaatgggaatttgtcaactaaaggtggttcttcttcttcttcttcgtctagttcggtgaagaggtcacgatcattcaatgccaaacacttgctatcatggtatagccgtagtcagagaaagccaaatgctcctttgagaagcttctga

SEQ ID NO: 13297 - DNA, 528 bp, Glycine max
  Peptide Sequence Number=SeqID_130075
atggcttcaaccgcttctgaggttagccaacaagtacaatccaataacagaacaagtttcacaagtgtgaaagcactaactaaatcaccagaactcacttccctcccaccctcatacacaaccaccaattcagatgatgaaatagtggcagacccagatgaagatgatccaattcccatcattgactattctctcttagttactggcacacttgatcaacgtgccaagaccatccatgacttgcgcaaggcttgtgaggagtggaggttcttcatgctcatcaaccactttgtgtcaaagaccatcttggagaagatggttgatgaaatttttgctttcttcaatcttagagaggaggagaagcaagagtatgttggtaaggatgtgatggaccctgtaaggtatggcaccagctccaatgtttcgatggacaaagtcttgttctggagggattttcttaaaatcgtggtgcactcggaatttcactcacttgacaaaccacctgggttcaggaatttaagttggtga

SEQ ID NO: 13298 - DNA, 237 bp, Glycine max
  Peptide Sequence Number=SeqID_130076
atgtatccaaatttcataaacatccaacgacataatatcgaaattctcaacggtgagaatgctcgtaattgggttgctaatgtggtgctcaaattgcacgatgatccaacggtgaacgagtccgagatcgttgtttttctgagacaggttagatggcctgcgggaaagagagagggttttgggagaagagagaagaaacaacattgtgaggcagaggaggctgaggagtcagtctga

SEQ ID NO: 13299 - DNA, 294 bp, Glycine max
  Peptide Sequence Number=SeqID_130077
atgagtaggaatgtaaaagatattggtgttggacatatagagatgatgtgctcgaagaggagagacattagagaagaagatgccaataaaaggaatagaaggcttagtgtcttggtaagttgttttgtcatcaatgcctttggtgtcaacctcaacctcaacctcatagcacaaaatgacgtcgttctagtcgaagtggggatgaatgaaatgcagcaagaaacaagggagtcgaagcagcctgagtcagtaaatgaaatgcgtgttgttggggggatgggaagaaaaaagtga

SEQ ID NO: 13300 - DNA, 525 bp, Glycine max
  Peptide Sequence Number=SeqID_130078
atgagtaggagggcgcggcggtcgctgcaaaacccagggcgcgagcccgggcggagcggtcgtcggtgcagatcttggtgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaaccaaagcattgcgatggtccctgcggatgtggacgcaatgtgatttctgcccagtgctctga

SEQ ID NO: 13301 - DNA, 276 bp, Glycine max
  Peptide Sequence Number=SeqID_130079
cagcctgtggagtggatactacctacacctactccatatcgactagttgagccggttcatgtgatagaggtgtcatcctctgaagagcatcttgaagaggacccagaggagttacctcctgaacctgctatggacgcccttgacttacctgaggatgatgaagacccactccctgatgtcgattctctagaggatattatgtcagcatctgaggcagactctacagaggagagtggccctggaggggcagcaaatagtgacgactcttcatcatag

SEQ ID NO: 13302 - DNA, 297 bp, Glycine max
  Peptide Sequence Number=SeqID_130080
atgaggggagcaccgtcggtggagagcctcacacctttcgtaacacggggtttcagtgaccccaacgcaaggatgcttcaaggagtccacaaggcatgggaaaaggtgcaaagaaaagacagagaacttaggggaagtggcaacgggatcattggcgactatcgtaagtggctgagagccaacacacaaggtctggattggctcctgaagctgagagccgctaaggaggaggaggctgaagccccagaagaaagtgaagaggtgcaagccctcaaagtggagcttgagaaagcctaa

SEQ ID NO: 13303 - DNA, 348 bp, Glycine max
  Peptide Sequence Number=SeqID_130081
atggttaatcacaagggtgaacaaaccaaatttttgatctgggatcgtgaatgtgcacagttaattggtcagttagcggatgatgtcaacaggctcaaaatagaagatggggatgttgatttaaatgcctctcctcaagcactagataggctattgggttgtttccttgcattcaaagtgaaggtgcaaccaaggttcaggaattctgttgttcttaaatattcagatgaatcagacttgatcaatgctatgctagatatgattcccgatagtgagcaatctttgtctattaccgctgaacatgatcggtcaatgcttggctcaagtgagcctacaaagtttgaatct

SEQ ID NO: 13304 - DNA, 243 bp, Glycine max
  Peptide Sequence Number=SeqID_130082
atgcagaatttctttcaactagcatttttcacatggacttcgatccgattcgacatcagatcatgctttcatcaagaaactgagaatattatcataagggatgttcctccaaggactactgttgtcgggaacccagcaaagctggtaggagggaagaacagctctgttaagttggataagatttctatcttcaccatggaccatacttcacatattgctgacttttatgattattgtgtttag

SEQ ID NO: 13305 - DNA, 192 bp, Glycine max
  Peptide Sequence Number=SeqID_130083
atgtcggacacgggtcgaccactaccaaagtttggtgaatgggatgtgaatgatccagcttcagctgaaggttacacggtgattttcaacaaagctagaaatgagaaaaagacaggtggcaaacctgactcacctgcaaaggttaataatcctcgtacaagacctccgttagatccaagcaaaacacaaagt

SEQ ID NO: 13306 - DNA, 300 bp, Glycine max
  Peptide Sequence Number=SeqID_130084
atgtcttcaagagtagtgttccgtggaccagaaaagattagctataagaaaataacaaagatagcgtctgcttgggttttggggatctgtgttcttattgttctgtttgatgttcaggatgctgtttctcttgcccgcacggaagaggagcctgaggcagccgcacgaaagttaacagaagcagcattttctcgtgggagtgcagataacattacatgcattgtggtgcgattccaccatgagaaagcagaagtagctaatcctgataaagcagaatcaactagtactcagcatgagtag

SEQ ID NO: 13307 - DNA, 207 bp, Glycine max
  Peptide Sequence Number=SeqID_130085
atgcagcaacaccaccgtcaacacccacgaagaagaagacgaacgaagcacgcgattggaaggtcacaaagaagaccagcgaaggtcacgaagaagacgcagctaagctttttcgagaggagaagaaggattggaaggtcacgaagaagcaggaatggcgaggaagaagtagaagaagcagaaatggcgaagaagcaaaaatggtag

SEQ ID NO: 13308 - DNA, 251 bp, Glycine max
  Peptide Sequence Number=SeqID_130086
ggatttccggtccgctgtatcccttgttacggtctttcaaagaaatgaacatggatttgaggcttttagtcctcacgggcaggatcaccttgggctaccttctggagtgaagacaaaacatgaatggcagaaaccagtcaaggtacttaaggatgaacgcaagcggggatggggtcacgaccgaccgatcgctgctcttctctgtgcgaaacaaacagggaatgtcgctgcaaggcagctccgtatccttt

SEQ ID NO: 13309 - DNA, 433 bp, Glycine max
  Peptide Sequence Number=SeqID_130087
atggggacaaatcaaaccggcaagaggttttaccaagtcaaggttaaaggcctagatacccccagcatcaaggaattagggcggttgatggaacctctccaaatgcaagctttccgcaagaattacggaaagatcttaaagttgtccatagcagaaatatccatagaagccattgcatcactcacccaatactacgaccagcctttgagatgcttcacgttcggagacttccaattaaaatgcaactgtggtcaaggattcagcaagaggtttggaccgcataaaacagactcggaacggcatagcgggcctaccacggaggtacctagaagacaaggcgaggggtatggccaatcgaggagattgggtccccaatcgacgcttttccttgcataccaccatagcaaggaaagtccggtggtagctgtcttgg

SEQ ID NO: 13310 - DNA, 250 bp, Glycine max
  Peptide Sequence Number=SeqID_130088
atggctccgaaaaagcttttcgcgaagagatctaggagggacgccgcagctgaagggtccagtgccgctcccgaacgcgtccagctcatggacaatgagtacaccgactttcaggaagagatagctcgccgacgttggacgtcgctggtcactcccatggctatgtttgacccagatatagtcctagaattttatgccaatgcttggcccacagaagagggagtgcgggacatgcgatcatgggtgaggg

SEQ ID NO: 13311 - DNA, 289 bp, Glycine max
  Peptide Sequence Number=SeqID_130089
atggcagtgacaatgatggtggtattggtggtggcaacgacaaaggtggtattggtggttgcggtgacaatgacattgatggtggtgctgatggtgatgtcgatttcatctagttatggcactgacaatgatggtggaattggtggcattgaaaaatgtgggtcacgatgttttccgagaatgctccaaccatatggtatcagtataggtttaaaggaacactcaaacccagtgacccccaaggcctacactccgaagagtccgtcagggcctctccctcctgattcag

SEQ ID NO: 13312 - DNA, 1137 bp, Glycine max
  Peptide Sequence Number=SeqID_130090
atgaaggtggagctccatggtgcggatggttatggtggccctttgtttattggaacttgttgctttcatagaagagacgctttatgtgggaagaagttcaattgtcaatacaaaaatgagtggaatgatgagaatgagaaagaggtggttaaagcaaacttgcatgaactagaagtggaatcgaaggcactagcaagctgctcctatgaggaaaatactctatggggaaaagagattggtgcaatatatggatgtcttgtggaggacgtgataacagggttgtggatacattcgcaaggatggaaatcaatatactacaacccaccaaggaaggctttttttggtattgctccaactaacttgcttcacacactagttcaacaaaagaggtggggtgaaggtgacttccaaattttgttcactgagtacagtcctacatggtatggtgaaggaaagatcaatttaggcctactaatgggatattggcgctttaactattcggcaaccacttgtttgccaatactatattactccttcatcccttcactttatctccttaaagccattcccttgtttccaaagatgtctagcccatggttcatacctttcgcatatgtaatactcggggagagttcttctactttgattgagggtttgatttctggaggcacaatcaagggttggtggaatgacttaaggatgtggttgtacataagaacaagttcttacctttttgctttaatagacattgtctggaaattctttggacgttcatattcatcctttgctgtcacaactaagattgtagaagatgatgatgtttcccaacgttacaagaacgaggtcatggagtttggaacctcttctccatttttcactgtactagcaacacttgcattactccatttgttttgcttactagccactataaaagagttagtcctttgcaaagttgctttgactggtgagaaaatggcattgcaagttctattgtgtgggtttttggttctcatcaatttcccaatataccaaggccttttcttaaggaaggacaagggcagattgccaagctctcatactattaaatctactacactggctttaagtgcatgcatcttcttcaaaatatggaattaa

SEQ ID NO: 13313 - DNA, 918 bp, Glycine max
  Peptide Sequence Number=SeqID_130091
atggagagtggtgaagactattccctgtttgagactaggaaagacaaaggaaggcacattcgaaggatctatgcaatctctttgtttgtggccatatgcttcatctgggcttacagattgagccacatacccgcatatggcaaatgggcttggcttggtttgtttgctgcagaactctggtccggtttctattggctctttggtcaagccctccgctggaacatgctgttcagaaaaaccttcatcaatagactctctgaaagatatgagaatagcttgccgagagtggacatgtttgtgttcacggcagacccaatcattgagccacccatgatggtgattaatacagtgttatctgtgatggcttatgactatccagcagagaagctcagtgtgtatctctcggatgatgcaggctcagacataactttttatgctcttttagaggcttctacctttgccaagcattgggtgccattctgcaagagatttaaggtggaaccgaggtcacctgctgcttattttaatacccttgtatcaacaaactcacacgaccataaccatgccaaagacttagatgccatcaagaaactatacgtagatatgaaaagacgaatagaagatgcagtcaagttgggtggagtacccagcgaagcaagatcaaagcataatgggttttctcaatgggattcgtattattctcgacatgatcacgatacaatccttcagatactacttcatgaaaggaacccgcacaattcgaaggatgtagatgggtttgttttgccaactctggtgtatatggctcgtgagaagagacctcaatatcatcacaactacaaagctggagctataaattcattggtagtgtatataattaaaacccgcctctattttttattaaagaatttaggatga

SEQ ID NO: 13314 - DNA, 835 bp, Glycine max
  Peptide Sequence Number=SeqID_130092
gggttggaaatcgatttattacaacccagaaaggaaggcttttgtgggcatagctccaacaaccttggatgtagcatgtcttcaacatatgaggtggtcagaaggcatgttccaagttttcttctccaagtattgccctttcatttatgggcatgggaagatacactttggtgtacaaatgggatattgcaattaccttttatgggctcctatgtctctgcctactctctgttatgtctttgtttctcctatttgcctacttcgtggcattccactgttcccacagctttcaagcatatgggtccttccatttgcatatgcatttctcgctacatatggctttagcttgtgtgagtatttgatttgtgggtccacggcaaagggttggtggaacttgcaaagaattaaattcatccataggaccacctcgtatctctttggtttcattgacaccatgaaaaagcaattaggactgtcacagacaaaatttgtcatcacggataaagtggttactaaggatgtccaaaagaggtatgagcaagaggtcattgaatttggaggctcttcaatcatgttaaccatattagctacagtggcattgctaaatctttttggtctcctttggggaatgaagaggattatgatggatttggaattcagctctagccaattgatgatgcagattacactgagttcattggtggtaatgatcagtttaccagtgtatgaggcacttttcattcgtagtgataaaggttgcataccatcttcagttatgctcaagtccattgtcttggcttcattagcctgtttcctagcacctttcatttgctaa

SEQ ID NO: 13315 - DNA, 321 bp, Glycine max
  Peptide Sequence Number=SeqID_130093
atgggggagacacatgaaattccccaccacaacctagctgacttcgagccttggctcggatatgccactgaagggcaagcagttggtggtataccctttgaaaacactttggagagccctcagtttcgcccacaaccacaaccattgcattttgcggtgggaagagcccctcctgctatggctgaaaagggaaaggtggatcatctaaaggaaaggctcaaggccattgaaggaggtgaagattatgcctttgctaacctagaagagttgttcctaatacccaaacatggtcattcccaagttcaaggtgctggactttga

SEQ ID NO: 13316 - DNA, 983 bp, Glycine max
  Peptide Sequence Number=SeqID_130094
atgatgagaaggcgttcccttgtgactgcatcaccaaaacaagggtccgtcttctttgttggccacgacaacaacccaacaattcatcctcacactcacacccttctgactccatcaccaaaacaagtcacagaaaaccataatcactccaaaaccttcaaacccagttccaatcacaacagggtcaacaccttgcacactggttccaccgtacaacatgttgaagcggatgaggccgttgaactggatgtgttgtggacgaagatgcaggaagaagccaaactcgatgtcactgtggaaccctttttgtctgattactacaacacttccattctctctcacaactcactgcaaaccgcgttggccaatcaccttgccatgaaactcagcaactcaagcctcccaagcagcatactttctgatctttttgtgacggttttggagactgataaatccatcatggatgctgtgaagagtgatctgagagtggtgaaggagctagaccctgcttgcataagccacgtgcactgcttcttgaacttcaaaggctttctggcgtgccaggctcacagggtggctcacaagctatggcttcagggaaggaagattcttgctgtgacgattcagaaccgggtttcccaggttttcgcggtggatgttcatccgggggctaggattggaagtgggattttgctggatcatgcgactggtattgtggtgggagagactgctgtgatagggaacaatgtgccaattctgcatggtgtcactttgggagggactggtaaggtttctggggacaggcacccaaagattggtgatggggtgctgattggtgctggaacttgtatcttggggaatattaaggttggtgatggggccaagattggtgctggttctgtggttattaaggatgttcctccaaggactactgttgtcgggaacccagcaaagctggtaggagggaagaacagctctgttaa

SEQ ID NO: 13317 - DNA, 498 bp, Glycine max
  Peptide Sequence Number=SeqID_130095
tgtgttcaggtgcaaggtgacactgatagtgatcatgctagaaacttcattacgtgggaagacttcatggtggatgaacaaggtataacatccaatgttggtggtcgaattattgtggtcgatcaaagtggtaagggagattcaacaactgttcaaggggctgtagatatggttccccaaaacaacacagaaagggtcaagatatacatttatcctggaatttatagagaaagagtgcatgtgcccaaaagcaagccgtttatttcatttataggtaaacctaatataacaatgaatgagagagaggcaaatataacggcgaatgcacaaaatataacggagatagcgaatgccatacctattatcactaatagcactaaggcatcagacaaaggcaacgatggccaagaaatgggcactgttagtacagcaactgtatgggtagaatctgatttcttctgcgcaactgctcttacaattgaggtaattgaggactaa

SEQ ID NO: 13318 - DNA, 603 bp, Glycine max
  Peptide Sequence Number=SeqID_130096
atgtgtatatttgtttttcagaatttggtggataaagatgcagataaacgtcaagcagtagcattgcgtgtagacggtgataaagctgtattttatcgagttaggcttgtgggggagcaggacactctcttggataacacaggaatccattatttctaccgaagttacattcaaggatccgttgattttatatgtggcaacgcaaaatcattgttccatgagtgtgtactagactctgtagccgagttttggggagcaattgcagctcatcacagggattcagcagatgaagatacagggttttcatttgttaattgcacaatcaaaggaagtgggagtgtttttcttgggagagcttgggggaagtatgcagcaacaacatattccttctgtgacatggatcatgttattcttcccttgggatggagcgattggggtgatccatctagacaagggactgcgatgtttggggagtatgaatgttcaggaaaaggatcaaacagaactgagagggtggaatggtcaaaagctttaagcagtgaggaagctatgcctttcctgagcagagactacatatatggagatggatggcttagactataa

SEQ ID NO: 13319 - DNA, 816 bp, Glycine max
  Peptide Sequence Number=SeqID_130097
atgtgggatatagcatgtttgttgccaccacctttggaggatgttgaagaagatcattgccgacaaattaacattgtatgcacttcttggggggtcgggcatgctgattcttttgcatgtgacacctcagtgcctgctaaagcagtagagctttatttggatgcaagaaggctaattgaagaacaagttaggagttatactgaaccatacacagacaagctccttcctgatctgcttcctcaggagcaacatgtgtttacacttgttcttgatctcaatgagacattgattcactatatttggacgcgagatacaggttggcagacttttaaaagacctggagttgatgccttcttggaacatttagctcagttctacgaaatagtggtgtacacagatgagcaaaatatgtttgtagaccctgttatagaaaggctggataccaagcattgcattagatacaggctatcgaggccagctactaagtatcaggatgggaaacacttcagagacctctcaaaactaaacagaaatccaggaaaagttctttatttaagtggccatgctttggaaagttgcctacaacccgagaactgtctccctattaaggcttggcagcagcaagatatagatgacacagctcttttggattttataccatttcttgagtttgttgcccgtagtagtccacctgatataagaccagtgctagcctcttaccaaggatgtgatattccaagtgagttcatcaggcgttccaaggagcatcaaaggagaatgcaagaacaaaaaaatcgtggtcgcttctggaaatga

SEQ ID NO: 13320 - DNA, 750 bp, Glycine max
  Peptide Sequence Number=SeqID_130098
atgactcacaacctaaaacctctttactatctagttaagcttactcaattattcgtttcagtatccgtgtgttccttcatcttctcaccttcttccttgcttgttttcctatattacttcaaattctatctctctgcattccctttccaactttatacacacaacatagacaagaactccatgtttctactttgcaatggtatccttgtttttgttggtataactaaatctctctccaggtctagttgttgtgatgattataggccttctgcgtatattaaagatgatggttcacaatctcggttttgggttattgaagccaacgagctaatgtcggagatagtggaaactgaggaacaaactagtgagcctgatgaacagaacactgcagttgagcaagtaatagaaatagaaaactgtgctgaagaagaagtacaagaaaacattgagaagatcgttttggtagatgaaggacaagaaaaaggaagtagcttggttttgaaagaagaggagaaggaggagctagatgaagaaactgaactattggatgtaggtgatgaagaggaagataaagggtcagaaactgattacattctgattgaagaaagcatagaagaggaggaagaagatgtagaagaagaaagctgtatgttgagcacagaggagttgaacaaaaagtttgaagatttcattagaaagatgaaggaagatctaagaattgaagctcaacggcaattagtcatggtttga

SEQ ID NO: 13321 - DNA, 1036 bp, Glycine max
  Peptide Sequence Number=SeqID_130099
agttgtgttcttgtttgttgtttcgattttcgtgatttgggctcaggtggtggatttagcagaaggtggtgctgttcgaaattacattagttgggaagatttgcaggtgaatgaacaaaggttggccgtgaagtcgtcccataaccaggttcgagttataactgttaaccagaatggtgggggacattccaaaactgttcaaggtgctgtgaatatggttcctgataataacagacaaagggtcaaaattttcatttttccaggaatttacagagaaaaagtgcgtgtgcctgtgaccaagccttatgtatcatttatagggaaaagaaatcgaacagcaagtcctataattacttggaacagtaaatcatctgacaaaggcccaaatggcacagcattgggcacctatgcttcagcaacagtgggagtggactcagattatttctgtgcaactgggatcacttttgagaactcagtgattgcatcggctggtggaaaagggatgcaaggagtggcactgagggtaagcagtccaaaagcaatgttctatcgagtgaggattaagggaacacaggacactctcttggacagcacaggaaatcattacttcttaaagtgtcgcatcataggaaaagttgattttatctgtggcagcgcaaaatcactctatgagaagtgtcgtcttcagtcaatagctgagaactatggagcaatagcagcacatcatagggattcaccaacagacgacacagagcatgggggaactactcaagaattatatactccaaatgtaatatggatggcattattaatcctcaagggtggtcagactggaatcattcacataggaagaatgcagaatatgtctaagcatatatggtacttcaggactgcagtgtttgctgagtatcaatgcaagggaagaggagcagatagaagacatagggtgccttggtcaaaatcattcagctatccggaagcaagtcctttcctttacaagagcttcatagatggagaccagtggctcagactgtag

SEQ ID NO: 13322 - DNA, 1218 bp, Glycine max
  Peptide Sequence Number=SeqID_130100
atggatgcattttctgccttttctttaaatgaaggcacacaattgaggagatccatatggctcgtatcagttgtaagtgatgatccaaacgatttcattttgcatttgtggtggtcctatattgcagatccttgttttctaaattcctctgctgtgggtaaaggagcctatatggccaacaacggtgtaaaggagcccttgctgtgggtatcacttgatgcgactcaaaagactgaacagcagctaaacaagagaagcctcctccgttttagaagtgctcctcacgcagaaattgttcctactgagacaaatggcaatgaatcaattccccatagtgcgtccatattccagaatttacatccaagctttaaaagagtggctatctaccttgcagtctatttaggtgttggtgctttaatcttctaccttgtccggaaccagattaaggggcagaaaacagatggaattcttgatgctttgtactttacaattgtgacaatgacaactgttggatatggagaccttgtgccaaatagccaccttacaaaactacttgcatgtgcttttgttttctctgggatggcattgattggactaattgtaagcaaagcagcagactacttagttgagaaacaggaaattttgctagttaaagccatgcgcatgcaccaaaaagttggttcaactgaaattttaagggaggttgagaccaataaaacaagatacaaattatttctagtctttttccttcttttgattctcatcatcgcggggacaatttttttggtcacagttgagaaattggatgttattgatgcattctactgtgtttgttctacaattacaaccctgggttatggggatcaaagtttctcaactcaagcaggaagaatatttgctgtgttttggatattgacaggtactattactttagctcagcttttcctctacattgctgagctaaacactgaaatcagacaaaaggaacttgtcaagtgggtacttacaaggaaagtgaccaattcagatttggaggctgcagatcttgatgtggatgggactgtgagggctgcggaattcgttatttataagctcaaagagatggggaagattagtcaagaagatatatcacttgtgatgcaggagtttgaacagcttgatgttgatgattctggcacactatcaacttctgatataactcttgctcagtcatcttag

SEQ ID NO: 13323 - DNA, 450 bp, Glycine max
  Peptide Sequence Number=SeqID_130101
atgtttggagcaaagtttgtggcagttgtagttgtaaccctttggttatcaaagtccaattttaattttgaagcttatggggatgcagtaggtgatgtgatcccaaccccaacttcttgtgagaactgtcaggttactccaccaccttctggttatccttcttatgaagctccaccaccaccatcacagccacctcctccatcttctggctactctatatatggtgctccaccaccaccatcaccacacaagtcaggccaatctaagtgtcctcctgctgcaggtgttcagtgttgtacccctcctgcaccttacacttatggttatggttatggacctccaaatccttacacctatgtgccttatggggaaggtcaaggccctgcttctatggttctgccaattctagtccccctcatcatgcttttttcctctatttttctagtctga

SEQ ID NO: 13324 - DNA, 786 bp, Glycine max
  Peptide Sequence Number=SeqID_130102
atggtgaaagtaactaagcaacaaatctgtcacaatctgtgttgttattttgccagtttcttaccaatcattctagttcttgtccttctattttcaatttcctttttcttttcagtttctgaatcctttccttcccttcttacactactgattgctcttctatctaccttgtttcttgtcacactggcaaagaaaaaagggtccctacatgaaaatcttgtccaagataaccagcagaatttggagttacagccttcattgggagatgttactgtccaacaaaatgaaacttctgagaggcaagctgaagcacactcagagtcctcatttccattagattgtgaaagcagcaatatcatggatacaagttttgaactcagtgctcggaagtatgagcaacaagctgatccacagtcagattcttcacttccatcagatagtgaaagcactgctagctcaaccatggatgaagaaagtattgagattcatcgcaatagaaatcaaaatcttgatatatctgatagcttggtctttgattatgatgttgatggggaggaggatggcttgattgaaatcaagcttccaaacaaccactttccagagttcttgccagaatccattttcaagcagcaaggtctcacagagctcttggcagaaattaatgagatgaatgaggatgaaaatttaattgagattgatatttccaagggatccacaaagcatcaagatttgagattggagaaggagttggtttgcagagtagatcattgggttcttagtgattaa

SEQ ID NO: 13325 - DNA, 633 bp, Glycine max
  Peptide Sequence Number=SeqID_130103
gcaaaatgcggtgtttggatcaagttacctacagcattagttaattttgttgaaactgcagttaaggagggtttccgttaccaccatgctgaaccaaactatctaatgctagtttattggattattcctgaaacaagctgcacaaaccctcccaatgcatcccaccgtgtaagggtcggtggtcttgtcctaaatgataagaaagaggtgcttgtagtccaggaaaaaagaggtatattccatgaaattggcctgtggaagatacctactgggatagttgaagcgggtgaggagcttttagccgcagctgttagagaagtaaaagaagagacgggaattgatacagaatttgtggagttggcattcaggcacgcagataattcactatttaggaaatcagaactatttttcctttgcatgttacgtcctctttctactgatgacatcaaaaagcaagatttggaaattgatcgatgctgccaagacaaagggatgtattcagaagcaatagatgtgaatcaagacatagcaactacaggggtgtctacagcaaagaagggtgcaaatcaagcagaaaaggaggtgcaagcagcagtcaataccaaaagaaagatctcgaatcctgaggaatga

SEQ ID NO: 13326 - DNA, 651 bp, Glycine max
  Peptide Sequence Number=SeqID_130104
atggccgcgcttctggcggctggcgctgcccctggccgcaccgggcctggcgtcggctacggcactggcgtgggtgcgggcgatgggcgaattcggcattgtgatgattttcgcctggtttccccacggaatgccggcgcagctgtacaacaatctgcaaaacgacggcgtggatgcggtgtatgtgctgttgtggctgttactgctgtttaccctgccggtgccgctgctgtgcgcgctggcttcccggcgcgcgctttccggcaacacggcgcggcattagaggctggcgcgctgctcactctcacgcatcgccagccggaccgtctccagcagcggttcaatctccagcggccgggtgaaaaaggcaaaggcgccctgagcaaacaagcgccggcaggcctccagcgtgtcgtgcccggtcatgatgatcaccggcagcagcggatggcgtgcgccctgccgggccagccagctcaggccgctactctctggctgtcgcacatcaagcagcagacagccgcatacggcttgctgaccggcggcggcggtttcgaacgatgccaggtcggcaaagtcggcgacttcgtagtccacggttcgcagcagaaatcccagcgactcacgcacggatacatcatcatccactaa

SEQ ID NO: 13327 - DNA, 617 bp, Glycine max
  Peptide Sequence Number=SeqID_130105
atgttgcctacgacacacacagctcacgtagtagcctccctgtttcttgaattggtcgtgaaaatccatggagtgcctcagagcttggtctccgatagggatccactcttcgtcagcaagttctggcaagaacttttccaccatagtggcacgcagttgaagatgagttcagcctatcaccctcatagtgatgaccaaacagaggttttaaatcgtgccattgagcaatatttgaggagtttcgttcatcatcaactgtcaagctggggcaggtttctggcatgggcagagtactctcataatacatcatggaatgcagccacaggcgctacaccttacgaggtgacattcggccgtaaaccgttcaactttctggcatacattgccagcacctctaacctcaaggcagttgatacctttatgaccaacagagatgaagtttttcaattcattcgcaagaaacttttgaaggcacaggctacgatgaaggatcacgctgacacccaccgtcgtgaggtgacttacaatcctggggattgggtgttgctgaaattgagaccacattgccaatccactgccaagggctctcaagctttttcgggcaagctagctaaaag

SEQ ID NO: 13328 - DNA, 183 bp, Glycine max
  Peptide Sequence Number=SeqID_130106
atggcagacaaaatatgcttctgctcgtttccccattctattggagtgaaggggaaagtgtctgatcctttcaatcaagcgatagaggcagaggctttacttcaatcgcctacgctaggacggagctgctgtttagtgacgattgcccgaggggagttccatcatgaagctgggtacaaataa

SEQ ID NO: 13329 - DNA, 216 bp, Glycine max
  Peptide Sequence Number=SeqID_130107
atggaagtaactagcttgcaaaagttggggcagaagatggatcaaatcgacgctgacatggaagccatgaaagagcaaatgaccataatgatggaagccatgatgagtatgagaaggatgatggaggtcaatgcagctacaattgttgccgcaagtaccgccacagaggtggaccttgtaatgacccacctcgtcgctacgatatcaccactctaa

SEQ ID NO: 13330 - DNA, 237 bp, Glycine max
  Peptide Sequence Number=SeqID_130108
atgaatgttcaccaggagagctcaactcgcccaggcaagctgtgttgcttccaccagaaggcaccgccttctgttggaacaccctggaaggtccaagtgggcctgtttacggattatgcaaccatcccctctttgacttctggaatgttacggaactttacggattgcgcaacaatgcttcctttcgacttccggcatgtcgcgaaacttcatggattgcctaacgatgggtgttaa

SEQ ID NO: 13331 - DNA, 183 bp, Glycine max
  Peptide Sequence Number=SeqID_130109
atgaatctttcaaaggatatgctcaaagatttagtgtttgctggcaaaaggattgaagtgggtctgagaagagggaaatttgattatgcttctactgtgagttctagtaatagaagaccagggatgagtggagggaataataatgaggaagaaacccatgttgtgactatcgttcctacatga

SEQ ID NO: 13332 - DNA, 273 bp, Glycine max
  Peptide Sequence Number=SeqID_130110
atgttgagtcttatgaaaaataaaggcgaggaaattaagtcctatagaaacataaatgtgaggaagttgagtcctatgaaagataaaggtgaggatgttgagtcctatggaaacataaagaggatgttgagtcctatgaaaaataaaggcgaggtcattgagtcctatggaaacataaaggtgaggacattgagtcctatgaaagataaaggcgagaacattgagtcctatggaaacataaaggcaagaacgttaagtcccatgaaagcataa

SEQ ID NO: 13333 - DNA, 366 bp, Glycine max
  Peptide Sequence Number=SeqID_130111
atgaagggaacttactaccctgatttggtaaagattttctacgctactgctcatattgatggtgatacttcatttttgtgtgctaaggggagcaatcatgcacaattgacaaaggaggatcttcttctcatatgtttaatgcaaaagaagatgaagcttaattgggtcaacatcattgttgacaacgtgttgaggactaagaggattggttccttcaagtgtccttatgcaatgatcatctccaagatacttgactactttggtttggatacccaagatgaggtatttgactttatggaggaagagtttgcagtaaagacaaaggtgctgaagcaaatggcctacatcaaagctgatgaagaatga

SEQ ID NO: 13334 - DNA, 618 bp, Glycine max
  Peptide Sequence Number=SeqID_130112
atgcatggcccacagaggaaggggttagggataagcgctcctgggtgcgaggccaatggatcccctttgatgaagatgccattaattagttcttggcacattcgttggtcctggaagaggggcaacattgcgaattcagtgagaggaggagccagacctcgagggatcacacctcccagacacccagtggacccagagaagtccaacagggcactggggtttttggccttgatcataggtctctgccagttctatggggtgtcggttactcccacaaagcttattcagcctcccattaatagggccttcatagaaaagtattgcatgccaaggcaggcacaacagcagggtcaggcacagcagcagccagccgcagatgcaccgctgccacctctacggcaaccaccatctctggagtccatctctgctcacatgcggaggatagagctccagatgcacgcatatatgcagcatgtgatcgaccagcaggcagccaatcataggggtcagatacaactgaatgagagcttttaccagtacaccctgcatcagcagtgccaagaccccagtccttacccatggcctactcccgagcatttcggggccatggttgcatga

SEQ ID NO: 13335 - DNA, 459 bp, Glycine max
  Peptide Sequence Number=SeqID_130113
atgtcccctcgcttctatctgtggcacgaagggcttctgaagatccacctctacgcatattcatgcaaactttcctcgagaatgaatacagggatatcaacaactggccaaggagaaaatgccttcaagccatcacccctctacttcacttttttgttcgtaagatcctcctcatcctcaagatcacgtatcttgacaagcttggctattaaaggacatagccatcaacaatttatccatataggagaaatctcccgttatgtctccttcaatgtgtgcctttatgacccgctccctcatcccttgaagttgaacattatcccgcaccagcacttgaacacgcgagccccacgcgctgctgcacgtcatgaaccagttctacggcggcaccttcgcctcttcctgggcgtgcagtggatcaaccaccagataagacaaatcggtgccgaaggattttga

SEQ ID NO: 13336 - DNA, 342 bp, Glycine max
  Peptide Sequence Number=SeqID_130114
atggaagttgtgctcccatttgaggtagaggttccttctttgagaattctagccaaatcagggttgttagccgccatgagccatggacgactgtatcaaagccgggtgaagaatgcttttgacaagaaggtgtgcctgtgcaagttcagcgagggagatcttgtcttaaagaaagtatcacaagctcaaaaggactatagagggaagtgggctccgaattatgaaggaccttttgttgtgaagaaggctttttcgggagaagcatttttgcttgcaagcatggatgatgaagaatttccttcacctataaacttcaatatcgtcaagcgatattacgcctaa

SEQ ID NO: 13337 - DNA, 252 bp, Glycine max
  Peptide Sequence Number=SeqID_130115
atgggtgcctctgaagaagaaggtgcactcgatgagaatggtgagacttgggaagcagaaggcttgtatgtgtgtgatgggaatgttttgcctagtgcagttggtgtcaaccccatggtaaccattcagtctacatcttactgtattgctactagggtgggcacgacggaggtcagggaaaggcaatgtgcgggtgggcacgatgaagtcaatggaaaggagatcgagtgggatgagttcacaacgcgctag

SEQ ID NO: 13338 - DNA, 291 bp, Glycine max
  Peptide Sequence Number=SeqID_130116
atggctatatcaaggaaacaaagcatagtgcgtttgttccgtgcccctattttaggaacctattgggagggactaaaggtttgctatttagtgacatctcccaaagtagggactaccagtgacaacatatcatcaaagagaaaaactctagatgaggcttctctttcgtcaagcgagtcggagacccagcatgaccacagatcaacctccacttcctatgtttccatggacccgggtataaggcccaataattcccctatgtgcaaaggtgtaagtgccatgtgtgcatag

SEQ ID NO: 13339 - DNA, 1056 bp, Glycine max
  Peptide Sequence Number=SeqID_130117
atgaagaagaagaagaaagtgaaatccatggccatgaacgacgtggctccaagaatcaacaagaaaatgaacgaagtggcggttgtgtgtactgcatgtggaggggtacatgagggtacttatgtcaaaggtagtgtaaatagcaagagcctaaagttcctagcaatgttgggccaccttattgaagagaccctttcaatgttgggtgaagtatttaagtattcctttcatttcattcatcgtcttattgggcacgcccccatcctcggcttctccttcctggagcactctcactccgtcacccaacacatccaggtcatggatgttccactgccacgggataaattggctttagatttgattaataatgagccctcccctgcaaacacgagcaacagcaagatatatgtaattctggtggcaactggaagctttaatccacctactttcatgcatttacgcatgtttgagcttgcaagagatgcattgaattcagatggctactgcgtaattggaggttacttgtctcctgtgaatgatgcatacaagaaaaagggcctaatatctgctgaacatcgaatacaattatgtcatttagcctgcaaaagttcagattttataatggttgatccatgggaggcaagtcagagcacatatcaacgcactttaactgttctctccagagtccacaattcagtttgtgagacagggttggtatctcaagaatccctcaaggtcatgcttctttgtggttctgatctccttcattcttttagcattcctggattctggattcctgaccaggttaaaactatatgcaaagattatggagtagtctgcattcccagggaaggacaagatgttgagaagactatatttaaagatgacattctgaatgagaataaggataatatcaaagttgtgaatgaacttgttccaaatcaaatcagctcaaccagagtaagggattgcattgcaagaggactatctataaaataccttaccgcggatgaagtgattgattatatcagagagcaacaattatacttgaactaa

SEQ ID NO: 13340 - DNA, 1005 bp, Glycine max
  Peptide Sequence Number=SeqID_130118
atggaagattgggagtttcattacaaagagttgaagtctgctacaagagagtttcaccctagtaggattgttgggcatggatctttcggaacagtgtataaggctttctttatatcttctggaaccatcgctgctgtgaaaaggtcaagacattctcacgaagggaagactgagtttctggctgaactcaacaccattgctggtttgaggcacaagaatttggttcagcttcaaggttggtgcgttgagaagggggagttgctgcttgtgtatgacttcatgcccaatggaagcttggacaagatgctttacaaggaacctgaaagggggaagcttttgagttggtctcacaggcaaaacattgcactagggttggcttctgtgctggtttaccttcaccaagagtgtgagcagagagtgattcacagggatattaaggctgggaacatattgctagatggaaatttcaaccctaggttaggggattttggattggcaaagcttatggatcatgataagagccctgtttccactttaactgctggaacaatggggtaccttgcacctgagtatcttcagtatggaaaagccactgataagactgatgttttcagctatggggtggttgtgcttgaggtggcttgtgggaggaggccaattgaaagagaagggtctaagatgttgaatctgattgattgggtttggggccttcactctgaaggaaaagtgattgaggcagctgataaaaggttgaatggggagtttgaggaggaggagatgaggaaattgttgattttggggttgagttgtgctaatcctgatagtgctgagagaccctccatgaggagagtgctgcaaattctaaacaatgaggctgcaccacttgctgtgccaaaagtgaaaccaacactcaccttttcttctgacctacctctgcctctcactattgaggacattgtttcagaggctgatcaagagtctatgtgcgagatcaaaattgactga

SEQ ID NO: 13341 - DNA, 198 bp, Glycine max
  Peptide Sequence Number=SeqID_130119
atggtggttgatgaggtggcaggagtaaatgcagaaataatggtggttgataaggtggcaagagtaaatgcagaaataatggtggttaatgaggtggcaggagtggtaggagtaaatgcagaaataatggtggttgatgaggtgaagacgaagagatgtaatggattacacacaaaagacatgcaagtaatcgattaa

SEQ ID NO: 13342 - DNA, 228 bp, Glycine max
  Peptide Sequence Number=SeqID_130120
atgacccccctttcaagtaaaaaagaatcacttgattcgccccttttgcgagaactacgtaggtctgatttccttttcgatggaggatgcaaagactttgactttgatgttttgatgatgccatatgatcatgatgttttgatgccatgtgaacatgtgcttctcaagttaagatcaagacaaaagtccaagagattcaagaaacatcatcaagaagatctccagtga

SEQ ID NO: 13343 - DNA, 376 bp, Glycine max
  Peptide Sequence Number=SeqID_130121
cttggtcgtgtcgaagaagaaactaagcgtcttgcaaccattcgtgaggcgaagctcacgggtgcgtcttccatgggaggaaaatgcgcggagtcgccaccaacgtttattgaaaggaaaatgttagaaaaaccaaaggaaaccgatcatgaagaatattccagattcgggagttatctttacgtcgacaaaagcagggcgcttgctcctacataccctccatcgaaaaggaaatcagacctacgtagttctcgcaaaaggggcgaatcaagtgattcttttttacttgaaaggggggtcgacaaaagcggggcttttgctcctacgtatcctccatcgaagaggaaatcagacctacgtagttctcgcgaatgcg

SEQ ID NO: 13344 - DNA, 722 bp, Glycine max
  Peptide Sequence Number=SeqID_130122
gtggctttgttcgtgctcgtgtgcttagcacaattatggaccgcttagcgtacattagtgaattttggcttagcgcatgcctttctcgcttagcggatggactgaagcgtgttgcgcttagcggatgctcgctaagccagcagattggcttagcgagaagccacataaaatctaaatgctccatctttctaaagaaaaaacaaggaggagaaaacaaggtgaatgttcataataataagaagaaggcttacattgcatgggaagaaaatgcttccagcacttcgagtgattcaacaaataaagaggaatatctctatcttatggcaattggtgaagttgaaagctttgtaggttcttcggattctaaaattgaacttgatgaaaactatgataagcttttacatgccttcaatgagatgcatgaagaggctaaaaaattatctcaagccaacaactatctcaagggaaagagatatggaattccaaatgggagatatagatgggttccgaaaagaacaacaaaggttactgatggaagcttgcttgtgggggcttctatggaggctggatctttgagcttcaatgaggaagaaggagcttcaccaccaagaattgccttggataaaaagcttgaagaggatgctttaatggacgaaaagaaagagagaaggggggagcacgaaattgaaggaataaaagagggagataagtggaactttgaa

SEQ ID NO: 13345 - DNA, 651 bp, Glycine max
  Peptide Sequence Number=SeqID_130123
atggtggtgccctcactctgtctcccatgtgtcatgtcaccgtcatgtaacgccattgtgatacagttcactcatctctccctcatgcttcgtctccctcacaactcgtctccttcacgaaccctcctttgtcagtttcactctcgctgtactgaaaccattatcgctgacggtgtcttactcatgcctttttcgatagtggttgttcatgattctagttgtttggttgttttcgacaatgttttggttggattcgacagtgttttcgacattgtgttggttgttcatggttctgaggaaatgttcaacactgttcatgttattgaccagccttatggtgaagttagtaggtcattcgttgtaagatggaaggatgaactagagcctacttggcatttgctacactctagtggcaacatgcactttgtcacatatagccaagatctggtgagctcaactctacttgttggatggacagaactcagagagttctatgggctcactggaaatcatcagttcctaactcagccacttaaagtcctactgactgagtacaaagtgacttgcaacagatgtgctgagtaccatgtactcattgatgaaagctacaagattcacccatctgaagttggaagggactacagagtgtag

SEQ ID NO: 13346 - DNA, 366 bp, Glycine max
  Peptide Sequence Number=SeqID_130124
atgagaccaaggccaattgcatggtcagagttagagaaatggagagaggaagaaaagaaccttcttccgtggaatccagcggaagaaccttcttccgttgacactcgcagaagaagttctttcgcggttttcaacgaaagaaggttcttccgcagttcttgtgcagtttgcctcacgaaagaagttcttccgcgggattccacgaaagaaggttcttccgcagttgacattataactgcggaagaagttcttctgcgcaagaaggttcttccgtggaatcccgcggaagaacttcttccgagagtgtcaccggaagaagtttgttttacagaacaaaaacgctcaagggcatttttgggattttga

SEQ ID NO: 13347 - DNA, 312 bp, Glycine max
  Peptide Sequence Number=SeqID_130125
atggctcgcatggttgatgccgcaactatctgtgttataagtgaagaatctaggaggcctagcataggaaatgaagaagcatggcttgttgttacctttggcagtgctgggaatgaatatgttggtgttgtgagttctatggggaagcttcaatggcttcgaggaaaaaggagtttgtttggctttgcaaagttcagactgaacatatatacagtccagagtgcaaagttctcactcaaacatgctcttctgatgctcttggatactgctaagaagagaatgcaacaaatgaagcaacactataacaattga

SEQ ID NO: 13348 - DNA, 123 bp, Glycine max
  Peptide Sequence Number=SeqID_130126
atgactctgcctatgatgaagatcagacgagttgttaatggctacaagtctactatctatgatcgtgtggaaaacgtaggcgtgaaagtgatgacaggaagtcaggaaacgtttagccagtaa

SEQ ID NO: 13349 - DNA, 834 bp, Glycine max
  Peptide Sequence Number=SeqID_130127
atgagggacagtgacggggttattgtaaacacgtgtgacccaattgaagggagggttatcaaagcgttgagcgagggtttgtgtttgccagaagggatgactagcccgcacgtgttctgcatagggccagtgatttctgccacgtgcggggagaaggacctgaacgggtgtctgagttggctcgactcgcagccgagtcagagcgtcgtgttgctgagtttcggaagcctcggaaggttttctagggctcaggtgaaggagatggctgttgggttggagaagagtgaacaaaggtttttgtgggttttgcggagcgagttggtcggggttgactcggtggaaccgagtttggacgagttgttgccggaggggtttgtggagagaacgaaggggagggggatggtggtgaggaactgggccccacaggtgaggatactgagtcatgactcggtgggtgggttcgtgactcactgcgggtggaactcggtgttggaagcggtgtgtgaaggggtgccaatggtggcgtggccactctacgcggagcagaggctgaatagggtgataatggtgcaggacatgaaggtggctttggcggtgaatgaggacaaagatgggttcgtgagtgggaccgagttgcgggaccgagttagggaactcatggactcgatgaagggaaaagagattagacagagggtttttgagatgaaaataggtgcaaagaaagcgaaagcagaagaagggtcttcacttgttgcgttccaaagactagttagttatcccctcccaaaagctgagtatagaattatggagtccttcgtggactactcatgttga

SEQ ID NO: 13350 - DNA, 480 bp, Glycine max
  Peptide Sequence Number=SeqID_130128
atgtcgtcatcatgttggcggtggaaagtagcattaaagtggaaagaaagtaagagagtagaaaaatcccaggattttgagcgaagactgcaaaatctcccagggaaagggaatcctatccagtttccctcccatatcatcaaatggcacgacaataacaaaagaacacgacggtggggcggcctgcaattgatggagggcacgatctcaattagggcacgaggcattgtcaggactaactcagtgagtgcctatgagagaaatcaccaagtgtcgcaacctacccttcggcgggagggcgaggcaaaatcaaaaaggagtcttccaagaaaggaaaatgcatgggagtcgccaccaacgtttattctagggaaaacgttagaaaaaccaaaaaggggtctgcggattttcaaaatgagggttcgggagttgtatacgcatagggaaggtttattgttattgcgaacaaaagttgtttaa

SEQ ID NO: 13351 - DNA, 285 bp, Glycine max
  Peptide Sequence Number=SeqID_130129
atgactgggagttggagaaaggttgcaagagatgaagcgccggaatgttttggagagggaggtgatgacgtgggggaggtggtggttgctggagcgggagagttcgagggagaggatgtggggtgggagaatggtggggatttgagtgggagggaggtggtggaaggtgatggagggtgtcgcggcggtgacggcagcgatatattgggaggtggagtcacaacccttgggtgtcgaaggggtgttggagggtggagtgaggatgagtattgtgatggaaagtga

SEQ ID NO: 13352 - DNA, 414 bp, Glycine max
  Peptide Sequence Number=SeqID_130130
atggaggtgaaataccgttttgaaactgagtatgattgcaacatggcaagaactgtttgggacaaaatgcgcaaggatagatattttgactttttggctaaagcaagacttaaggaaaaagcaacaacaaaaaaggaaaaagaaaagtctattgttgcaacaactaataaggctttgaagcttgattgcaaggtgcacactagaagctcaagaaactttgagcaacacttgaaatctatggaagttcgtgaaaacaacaagggtaaagtccacgacatcggtcatagcttagaaattgtcattagtggctcctatggttcatctgttagaattaatgtcttatgtgagagacatgctcaagaagaaatgaaggaaacattgaaggacaagatgagtgtggcattgaaggaatag

SEQ ID NO: 13353 - DNA, 156 bp, Glycine max
  Peptide Sequence Number=SeqID_130131
atggctagcaacccctccaaagctcagaagaaggctaagtcgtccaagaggaagcaagaagagtgctctcagttatctagccctgctctatcaagttccaaggaaacagtacatttgtcaatgctaaagttcctaacagcacacaccaatggatga

SEQ ID NO: 13354 - DNA, 216 bp, Glycine max
  Peptide Sequence Number=SeqID_130132
atggaaaaacaagcatttgagaccatggcagcttgcccaagcgatctgatgcttagtcctgaagaaactagctcgcccaggcgagctggttccttcagtcctaagcaatttgagggcccagatgagctagaggctagcctgggcgagccagggtccaaaaaaatgcttgaaatgatcccttttgcccctccccttgtgtatttttcgcatccttga

SEQ ID NO: 13355 - DNA, 309 bp, Glycine max
  Peptide Sequence Number=SeqID_130133
atgatgaagatgacaattctggccccgaataaaaggcacatgtttgggctttggagttgtgttttatgtctttcaatatgtgctaggttttgtagcgcggccaaattagatgaggtaacacgggagaggttctatgggaacatgcccaatggcttgttgccagaatccaacaacaccttggacaagatgttcaatcgtgttcttgagaaggagttcttctacaatgaccaaactgaaggggtggtgtggatgatgcctttctcacatgtcaggggaaggtggtgtctatctttctttaaccacatgtga

SEQ ID NO: 13356 - DNA, 237 bp, Glycine max
  Peptide Sequence Number=SeqID_130134
atgaccaagcctcaagacaatccattagtgttgtggcttaatggaggtcttgggtgttcttctgtgggatatggagcaacacaagacattggcaggggccttaaattcaataacttttcatggaacaaagaaacatttgagttggatatcagcatcacaaagaagcttcttgaaggagagcgaggcaaaataatccacgagagaggcatacttgtatgtggcttttcctttgtttag

SEQ ID NO: 13357 - DNA, 177 bp, Glycine max
  Peptide Sequence Number=SeqID_130135
atggatgacaaagtggtggaattacgtgaattaagtgtaaagggtgtcacaatatacttgggtgttatgctaggtcggcctactcggacactccagttgggtagctgtgaaaaaattatggctttaattgttgaaggagttcttgacttggaactactaatggaagggggtaaatga

SEQ ID NO: 13358 - DNA, 195 bp, Glycine max
  Peptide Sequence Number=SeqID_130136
atgggtttggtggacagtggtcctcagactttggatccattcatgtatgggccctatgtgcttaattttctgaaacttgaatgtcataaactaaggaacagagaagaaaattgtttaaaatcatatgaaacccatttgacgtccttcaacacgtggttaggggctccttttccgggtttcacgtgtatgaaataa

SEQ ID NO: 13359 - DNA, 222 bp, Glycine max
  Peptide Sequence Number=SeqID_130137
atggctaatggagaggaatttttcaaggatgagcaaaatgtaggcataatcgttgctcttggtggtggtggaggctcatcctacatgggggcaacttcaggaatcaaggcagttgaatcatggggaaatgaggaaatggaatggagagggttgaaggttcaccatgaacgggaccaaggccacagacaattttcacagaggagtaaaaaatgggagaattga

SEQ ID NO: 13360 - DNA, 441 bp, Glycine max
  Peptide Sequence Number=SeqID_130138
atggcaatgctcaaatattcaataatgtgtcctgttcgtgagatcaatgttcattggaatcctcttgcctcaaactccgtcaagcttaatactgatggaagatctctttggaaccccaacattgatggctttggtggtcttcttcgtgactccttaggacaatggatttcatgctactctggttcttgtggaattgctacttgtctcttcactgagctcatcgttttataccatggtgttaaccttgcatggaataaaggtattagaagtcttgcttgcgaatcagattctaaagtctctcttgagcttatcaaggggatacgtagaaatgcactcgccagtcaggggagcaatcatcgttgtccatcacgcaggggaggtgcttgccagtgcggagggcctgggtcatgccttacaccgttgattgaatattgtggtcag

SEQ ID NO: 13361 - DNA, 756 bp, Glycine max
  Peptide Sequence Number=SeqID_130139
atgacggtaaagaacccatctcaatcctcaacctcaaacagtgaaacctcatcctcaccctcacccattaactacagagataaggtgaaatgcaaggctggtagagccttatatgttgttgctgtgatggacagtagcaatttcaccttgaaggctactttgaagggtgctaagattttgattagaacactttttgatagatcttttggggagaaggataatgagttcaaatccaaatccctggcctcttttgggaagattgtgcattggatcaacatgcattctgtgttggctcatgctagcacattccaggaagaaaatgaccatgatatattagtcactattgccactaaacccatcaagtctacctctagtgtgccttatgggatgctgatgactctagtcttcaagcattttggagtgcccttggaagatgaagacaaagatgaagatttactgacctggggagagaagaatgtgtcagttctaaggatgctaagatctctgaagaaagggtgtctaaagaccattttgagggaggaagctagagctcaaaatgaagacatccacccttttgagggtgtgggggctgttgatgcttcaaacattgtgagttctacacaagctcaagaggaacctaatgtggaaatcattgttgatgtactagccaagttagggactactgattctaccttagagaaagaagagactgaaaaggaagaagaaaagaaagaaaagccttttgagaaggcataa

SEQ ID NO: 13362 - DNA, 555 bp, Glycine max
  Peptide Sequence Number=SeqID_130140
atggaggaagaactaagtctattcacaaagaacaaggtctggaaccatgaacacactcttaagaatcaattagtgattggaaccaagtgggtcttcaagaacaagcttaatgacaaaggagaggccaccataatacttatggcctatgttgcacacaaagatattaagttataccagatgaatgccaagagtgcttttctaaatcaattcattaatgaagaagtatatatgaagcaaccacctgatttcaaagataaagagaaacctcaacatgtatacaagcttttcaaggcattaaagtctgggaaaggagatctgttgattgtacaaatatatgtagatgacataatctttggtgctaccatagaaatgatgtgcaagggtttttctaagctaaagaaagagaaatatacaaagcacattctaaagaggtttcgaatggatgaagctagacatatggctactcctatgcatccatccattgtcattgacaaagagatttcaatcttgcccaaaggctactgtgatgttgattttgttggtgataaagtataa

SEQ ID NO: 13363 - DNA, 465 bp, Glycine max
  Peptide Sequence Number=SeqID_130141
atggaagggcccaccttagggtggtttcagtggatgatgcgaaattatcaactcatcacctggcctagctttctacaagccattgagactcgatttgcccattcaccatataaagaccctactggtcttttatgcaaactcacacggaagggttccgtgaaagattaccttcatcaattcgaagctttagccaatagaattgttggattgtcgccctcctttcttatgagttgtttcatctccggtctcgacccggagattctccaggaggtccaggctatgcaacccttcctcttgtgcatgtcgccgggcttgtgcgccttcaggagcaaaagaagaagaagagcacaaaaggtcaaaaagggtaattacagaatccacaaatcctatgtgccattaggggctgtctccatgttagcgcaatgtccaaattcctccaaggcatataatgccaaaatatgttag

SEQ ID NO: 13364 - DNA, 678 bp, Glycine max
  Peptide Sequence Number=SeqID_130142
atgaactgtgaagtgtgccagctcaaggaactggaactggagcattttgagatacgcgaggtcttgcgatgcatattgcacacgatcgtctttcaccgtgccttgggtctcgtgcgccctaaagacgttgacttggagctatttgacgtcacttatgtgcaatgtggagaggcagagcttgaaaagaaaatagatgagaagattgagcagtttgtttgttgggtggagaagcacccaaacaagaagagtcagatatgtttatctttctatgaggtgaagaacaaacaggcgtcttggttcagtaacaagattgaacgtttgtattgggagcagtggtatattaatctgaatgtggcccagcatccgaaggcacattctagcaagtatcatcattccaaagttgttgatcctggaggtgcattgattgctctgttcgtcaaactaaatctcttttcatgtttcactcctactgtgaatttacctgttttcctgtgtttcttacaagtagagggagcattggaggatagaaatgctcgaagtgcagcactggaggcatcgcttcgtgaggttttatttcagataattaaatttgttaatgagaagaaggatcatgttccacctataccaaatcttgagggtgctgtttcatttccctatgaaattacaatccctaggtga

SEQ ID NO: 13365 - DNA, 501 bp, Glycine max
  Peptide Sequence Number=SeqID_130143
atgatgacaaaggtgatgacaaaaaattcaaagatcaatcaaagaacaactcaactgattaagatagaatcaagaacaattcaagagttcaagatagaatcaagaagaattcaaaactcaagaggaaagttaagagtcaagaatcaagattcaaggttcaagatctcaagaatcaagatcaagattcaagactcaagattcaagaatcaagagaagggtgcggtgaaggtgaaggtatcggtgttgagcattgcggtggtcgttggcggcatacgagtttcctatggaagcaatgttttccaagattattttgttgatgccaaagactcaagtcaagaatcaagagtcaagcaagtttcaagaatcaaagagtcattcaatcaaagcaagtttcaagaatcaaagagtcgttcaatcaaaacaagtttcaagaatcaaagagtcgttcaatcaagattcaaggttaaagtgaagattcaagagaagactcaattaagataa

SEQ ID NO: 13366 - DNA, 681 bp, Glycine max
  Peptide Sequence Number=SeqID_130144
atggcgagccaagagaaatggggcccgtttgcagatattttagctttgctgatttttggggttgtcctcttcccgaacgtcgacggtttggtaaacttacccgccattgatgctttcctcgcatatcaccatagcaaggaaagtccagtggtggctatcttggcagatttgtttgacacctttgaccggaggtgtgagaaaaacagtgcacggattgtctgttgtttacccgctctctgtgtgtggttgatttcacacctattccaacaagacacgagacacccgtgtccgctgcaaagctatcgctcatgcgccgaaaaaggaagagtcgattgggaccaacatttggctgggatagggggcagcgcgatcaattggtttcctcgttggaaggaaggcaatgaaggagttcttttctcgtgtggggactaccctaatattccattgatggggactagggggtgtattaattataatcccgtactcgccataagacaactagggtaccccatgaggggagcgccaaccgaagaaagtctttcgcctttccttgtgaggaatctaggcgcacaaagtctcgaggcgatacaaagagtccacaaggcgtggagaagtccgttgaggaaagacaaggagcttaggggcattcgtaatggcgtcatcggaggttatcatggatga

SEQ ID NO: 13367 - DNA, 1148 bp, Glycine max
  Peptide Sequence Number=SeqID_130145
gcttcataaaatttgcgtgcgcgcacgttctcgcccatcacttccagccacagatagccttcctgcttatcgcgcgcggcgtggataatgctttcgaacatgcgccggccatagtttttaccggtttcctgcggattgaggtagagcttattcagctgggcaccgctcatgccggagtccggtaccggcgtattccaggtcactttggcaaagccgatgggtttgttggtttcggcaatcagccagctttcgttgggggctaccaggctgctgcgcagttcggccaggccgtactctttgtcgatgaattcatccagctcggcttcggagacccacatatgtttgaagtgggcgctgtaggtcatgcgccccagctgatgcagcagttcggcatcatcaggctgcgcgttgcgtatggtgaattccatgccagtcttccttcagtttttatgttttatcctgcgttacggcagagtgggggtgtcagcgggcatcctgcccgtacaggtgacccgtcattatgcgcgaatcaaaccgggtgtcatcccttttgcgtggctgatggtcttattgctgaggtgcagcgcatgcccgatctcagtcatgcggcgcggacccgccagccagcgcagcagcgtgaactcgcgctcggtcagcacatcggcgttgccgtgcggtgcggcgacggtggcaacgttttccggcgtcagcaccgcactgaccagcgtcgccagcgggcattttttactcaggatcagcgctttcttcaggtagcgggcgacgtaattcagcacggcttcatcgctgatgtcggtgagaatcaccagctcgacgcccggtgttttgagctgcatcagcagcaggctacgcagcgtctcttccaggtttttattggcaaaatgcagttcgctgatcaccacgttacgcccgcgtccggtggggatcgggtcatccggcgaggtgagcgtcaggcagcttatcatctgcccggaaaagtagaggcgcagaccttccgtaatccagcggtcgctatccatagtgaagatgttcagcattgtttcctcctgtgctcgcggttaatccatttgaacggaaaccgcgctgagccgatatcagacggcctgcgtcaggttgtaggaaaaggctga

SEQ ID NO: 13368 - DNA, 357 bp, Glycine max
  Peptide Sequence Number=SeqID_130146
gttcatattatccaaagaggggttattccacaattagttgacatgcttaagttttcatatcgtcatggggaaatgtcggtttttgcacttgggagtttggcaccggaatcacataatcaagctattattgctcataacggaggtatagagcctttgctcactatgcttgactcaaacaaggctgcactccaacatcgagctgttttatctctctatggtcttgctgataatgagctttcggattttatcgaggctggtggttttcaaaaactgaaggatggacatttcaaatatcaatctactaaacagtgtatagaaaccacattaaaaagattagaggagaagatgcaagggcaa

SEQ ID NO: 13369 - DNA, 1437 bp, Glycine max
  Peptide Sequence Number=SeqID_130147
atgcaaaggagcatagccatgcacatgattgaacacatctatatcaacggccagtttgtcactcctgacggcgatgaatggctggatattatcaaacctgccgacggcagcgtaatcggtaaagcgcgtctggccgatgcgcaggatgctgaacgcgcaattgcggcagccgcggcggcgtttcccgccctggccgcgaccacggtggcgcagcgcatcaccctgctggaacagatgtaccatgcggttaaccgcgccgaaagcgagctgcgcgcggcgatccttgaggagtacggcgcgcccaccgcacgctccgagtggatgagccgctatccggctgacgtgattctgcaggtaattgaagagctgaaacgctatccgtttgtacaacaggcaggccgtgcgcaggtgcagatgctgccgctcggcgttgccggcctgatcacgccatggaacagcaacgcgggctttatctgccacaaactggcaaccgcgattgccgcaggctgtaccgccgtgatcaaacccagcgagttcagcctgctgcagacccaggtgatcaccagggcgctacacaccgccggtttgcctgcgggggtgtttaatatcgtcaccggacgcggtgccagcgtcggtgaagccctgagccgcagtccgcaggtggcgaaaatctccttcaccggctcgaccgccaccggcaaagcgattttgcgtagcgccgccgacacttttaaacgcgtcacgctggagctgggcggtaaatcaccgacgctgattttgccggatgccgatgccgcgcaggcggccgggctggcggttcaggctggctttatcaacagcggccaggcctgtattgccggcacgcgtattctggtgccggagcagcgcaaggccgagttcgaacaggcgctgacggcggcggtcgctgcggaggtctccggcgatccggctgacgcgcgcaccaccatcggaccgatggtcaacgagaaacagtggcagcgcgtgcagcactatattgcgcttggtgaacaacagggcgcgcgcctgctgaccggcggcagcggccgcccggacgggctgcaccacggctggtatatccgcccgacgctgttcagcgatgtcaccaatgaaatgccgctggcgcgcgaagagatttttggcccggtgctgagcatcctgacctaccgcgatgaagccgaagccatcgccatggccaacgacagcgattacggcctgtcggcactggtgatcggcaccgatgaacagcatgcacgccaggtgggagagcagctgatcgccggccgcgtgatgatcaacacgctggcacacgaaccgcgcgcgccgttcggcggcttccgccactccggcatcggccgggaaatgggtcaggcgggtatcagcgcgtttctggaaccacgggcgctgattgctggttaa

SEQ ID NO: 13370 - DNA, 255 bp, Glycine max
  Peptide Sequence Number=SeqID_130148
atggtgttgaaagcaaaatataatgagcatccatgggaatcaatatggtggaaagacataaagaaaatttgtggaggattgagcgataacaaatggtttgatgagggtgtgacttggaaggggtcacaaatcttggaggattcatggtggtggcagttggaaaattcaggaatatacacaacaaaatccactaatgcgtacttggtggactcggtggaggaatcacaaatttcacctttgtttaaggtactgtga

SEQ ID NO: 13371 - DNA, 198 bp, Glycine max
  Peptide Sequence Number=SeqID_130149
atgtggtggcatgctagcatgttgctcgcacttttcgggggtggggatgggtatagagttgaagagcacaatgagtgtctcatgttgggatggcacactaagcccttgattgccacctccgtgtcaactcactgcaaaactggtgatggctgctcactaagtcgactcgctgattccttaatcaactttcttacatag

SEQ ID NO: 13372 - DNA, 582 bp, Glycine max
  Peptide Sequence Number=SeqID_130150
atgcagggtgctactatcagctttagattacaattagcaaatcatatagtcatagtttctcaaattgttagcaaacttggaagtcctgacttggctctacaataccttgaaaagtgcttgtattatgtgaacataggcagcaatgattacaagaacaattacttccatccccagctctacccaacaagctgcatttatagccttgagcaagaaaatggtttgtgtattgacaatgcattacacaaccttggagtgagaaagtatgtgttggctgggttgggccgtataggatgcactccaactgtgatgcattctcatgggacaaatggatcttgtgttgaagagcaaaatgctgctatatctgattataataacaagcttaaagctctagtggatcaattcaatgacagattaatgaattcaactagaaaagattatggacaaccaggaaacttcccagaagaagaggtgcagataatggcatacttagcggaaggagtgtttcctgctagatcccgacactcgaccaaccatgagcgaagtcgtttagattctttcgagtatttccccaggaaaatgtag

SEQ ID NO: 13373 - DNA, 165 bp, Glycine max
  Peptide Sequence Number=SeqID_130151
atgaaggaggtggaaggcatgaaaggagttgttgaagaggatgggaaagaagattctgtcgaggagagcaatgactctaggctcactggagaaacagtaggggaagtgaaggcagtagcagacatgcatcaaaggaaagtagagatggccaagcaagcactctga

SEQ ID NO: 13374 - DNA, 415 bp, Glycine max
  Peptide Sequence Number=SeqID_130152
atgggtattaaacattttgaagtggtcaaacagaggtcgcatgctgacaaacaatggtccccggacgaaattaggggtgtctccgcatgctacccgacttctcacagttcggggtggcagaattgtgtgtgggcgcagataacccttgggtgtctctacctgccacctgacgcacaggatcagcagatgttgtctttgtacggacaatcacttgggtatattcacctgccacctgacgcatgggtcaggatcagcagatgttgtctttgtacgaataatcactggggtatatccgcctgccgcctgactcaagggtcaggatcaacagatgttgtgagaccaaaagaggtgcagataaccgtaaggcgtctccgcatgctaccggactcacgggtcacgctagcaggatggggtg

SEQ ID NO: 13375 - DNA, 489 bp, Glycine max
  Peptide Sequence Number=SeqID_130153
atggatgttgctagcatcaatccgggtgagcagttggtggttaagagtcaaattttagcccgtggacgaggtttgggaactttcaaaagcggccttaagggaggagtgcacattgttaagattgaccaggttgaagacatagttgataataaattggtgcttccaatcgttacttcacatttacttttttttattgaccctgtttgtagaactgctaaagtggccaccaaagtttacttgtgtgaaaaactgtcactagtaaatgagatgtacattgctataacactggatcgtacgagtgttggtccacttctctctgtgtctgttgttaaggataatatcttggaggctgtcaaagttttaattggacggtgcctacgtaagcaccgtcttagaaagctagcttttaaggacggtgcttacgtaggcaccatcttagaaagcttgtgcctacgtaagcaccgacttcgaaagttggctattttctaa

SEQ ID NO: 13376 - DNA, 1128 bp, Glycine max
  Peptide Sequence Number=SeqID_130154
atgcattcctatggagcggtgaaggcgctggtggtagccctggagaaagagacaatgatggcaaaggaggcaaaggagaacgcagtcttcttgaaaggagggggattgcgcgggaagaagaatgcggtgactgtgcagtacttgctgtgttcggcggtgaaggagaataaggtgaaggcggtgagtgcaggggttatgaggacgctagtggagcttatggtggacttggggtcgagtatggaggacttggggttgagtatagtgtacttggtgagcgtggtggtggcggtggcagtggtggaggggatttatgatttcaagggagcactccaccaccgagcaacaccaccttctaatccagtggagcttcaacgcatgaacgctgagaacaagaagctaaaagagatgctcagccatgtcactggtaactacaccgtcttgcagatgcatcttgtgacattaatgcaacaaaaccagcagcgaacagaaaccatggaaaatgggggaaaggttgaggataaaaaccatggtgttggtggaggaaaggtaccaaggaaattccttgatataggtcccagtgacagagcaaaagtagatgatcaagtatttgattcttcttttgatgaaagaacacgatcgagcatgcctcagaacaataacgtgaagctggaacaagagatggagcaagaaataacgatgaaagtgaacccttccaatcctatggatcaatccactgcagaagccactatgagaaaagctcccacgattagtgatgggtgccaatggagaaaatatggacaaaaaatggctaaggggaatccatgccctcaagcatactacagatgcattatggcagttggttgcccatttcgcaaacaaacatcaagtttgccagttgctctatggactcaagcaataaaggttggagtttggaggacccgtgcaaaggatcacatgggaaatgttgtaaggtttgctatggtggtgcttcacaagttccagtttgatgcaatcctccctaggaaaggaccagttaccagagccatgagcaagaggctccaagaggattgggccagagctgataaagaaggccttagggttctcatgaaccttagggtagatttttga

SEQ ID NO: 13377 - DNA, 162 bp, Glycine max
  Peptide Sequence Number=SeqID_130155
atgattggagcattctcgcaaaacactgtgaccctgactggtctccctatgatattacctagtgagagtgacttgacttactattgtgtgatgaataggtggatgactatgaagaacctcatgctagaggacacgggaacaccacgctctgataggatgtga

SEQ ID NO: 13378 - DNA, 267 bp, Glycine max
  Peptide Sequence Number=SeqID_130156
atgtttcggtctttccgacgttttcctcaaataaacgttggtggcgactccgcgcgccttcctcccttggaagacgcacccgtgagcctcgcgtcgccctctcgccgaagggtgatggctccgaagaagctctccacaaagaggtccagaaaggacacatctggggaaggctccagtgccgcccaggattttgatagtcaccgatttcggagtgtttcgaggccatcaaaggatggtcgttcctcagggagaggcgggtccagttga

SEQ ID NO: 13379 - DNA, 372 bp, Glycine max
  Peptide Sequence Number=SeqID_130157
atggatcgttcaaccgcagttaggaaagagaagcagatgggaaataataagctcgacttaaaggagaggaagaataagaagagcaagctagacgtacagggactattcattaggctaggttttggaatggatttgttgccaggaagaaagcctgaccttggcaagagaacggctgaagatagtgggttcctctctctagcaagtcactctgactttcttttggttgaactcagcaccagagtggctaaccaacgatccaatgcgcttaagtggataaataggatcccttgttggaagagaaaaagcagagaatcttcccagagtgccctattacagattacagacaggcgatcaagggaggaactaaactag

SEQ ID NO: 13380 - DNA, 786 bp, Glycine max
  Peptide Sequence Number=SeqID_130158
atgtcttcatctccatgctttgctagtgatgcaatcctccctaggatggggccagtccctagagccatgagcaagaggctccaagaggattgggctagagctgctgaagaaggccctagggttctcatgaacctcagggaaggcaaaatcaacaacacacgcatgatgttcgacaaaatgcctgaatgggacattggtctgtggaccacaatgataactgggtacttaaagtatggcatgatcagggaggccacaaagctatttgatagacgggatgccaagaaaaatgtggtcacttggacaaccatggttaatgggtacatcaagtttaatcaagttaaggaagctggtaggttgttttatgagatgccactgagggatatcagcacaatcgtcacgacattggtgcaatgtgggagtattgaggacgaatggaggattttttatcagatgaatgaaagggatgtggtttcttggactaccatggttgcgggtttgtcgaaaaatgggagggttgaggatggtcgagcattctttgattggatgactgtttggaatgtggtttcttggaacgcgatgataatggatcatgcgcagaataggaggttggatgaggctctagagttgtttcagagaattcttgagagggacatgcattcgtggaataccatgatcactacttggactgcaaggatgacggagtatgtgcaacatgggctaagtgaagaagcattgaatgtatttaacaaaatgttggctaccgattgggttaaaacccaacactag

SEQ ID NO: 13381 - DNA, 177 bp, Glycine max
  Peptide Sequence Number=SeqID_130159
atggcacataaaaagaacaaaacagctaagaatccaggtattaacaatgaagatgatgtcaagaagaatgaatgggtccttgaatgggatcataaagagaagttgatattgcataggaagtgttttcatactttcacatctttcactaatcaggtgaaatctttccttaatctgtga

SEQ ID NO: 13382 - DNA, 147 bp, Glycine max
  Peptide Sequence Number=SeqID_130160
atggcgaagaacaaagtgcacaacaaggatggagccgcgaaggaacctacctcgggcattagcgaaatgggtcttaagcactttgttgttgcgtcatatgcacctgccgccccatttgttgtgtctaatgtccaaaatcaagggtga

SEQ ID NO: 13383 - DNA, 255 bp, Glycine max
  Peptide Sequence Number=SeqID_130161
atgacatcctattctaatatgtacaaagataattggacccaaccttggcccatgggcttagaaatctaccctgaggttcatgagaaccctagggccttcttcagcaactctagcccaatcctcttggagcctcttgctcatggctctagtgactggtcccttcctagggaggattgcatcatcacgaaaaagagactttcatgcgagggatatttctctcaccaaatatattatttcatagatcccagcggttaa

SEQ ID NO: 13384 - DNA, 198 bp, Glycine max
  Peptide Sequence Number=SeqID_130162
atgagtaggccgcctaatttcaaaggaagagagggctttttgcttgaatctggaatggcgggactgattgacgtcacttccttacatcaacaggaaagtgctaagaccagaaaaacaaaggcattcgatgcatctctagggctcgaactccgggaacacagaggttacaggactaagccactactcagacaagattga

SEQ ID NO: 13385 - DNA, 474 bp, Glycine max
  Peptide Sequence Number=SeqID_130163
atggatccgcctcctcccaagaagttgaataagtcagccatgtcttcatcttcttgggctttgtcctcgactccgggggcccctgcgagtcctgcccctgctcaatggcctagccgaagcggcctgccgaggtggcggcggtgcgtctgctgcctgcggctggggttctctgtcctgtacttgtcggggagtacaatacttctcaacgaaggccctagtgataggaggtcagatgaccttgctgggtataacgggcactccgtagaactggcagaggcccgtgatcaaagccggaaaccccaaggccctgttggacttctccgggtccaaggggggaaggttagagttgtggtcgctagggaggatgttgttgagcagcagcgtcatccacatctgggtcagggtggtcatgctggtgcgcatgatccgcacccgcctccatgtggcagtccgggcaaaatcatgccctggtga

SEQ ID NO: 13386 - DNA, 714 bp, Glycine max
  Peptide Sequence Number=SeqID_130164
atgacgctgtctgtaattcacccaaaaagtaacatgataaaggtcttgcaagagcataataaaagcttgggtgatgacaatgcttctgaaacattgagattgttagctattgggccaaagctaaatgtcctcacatggaaaggatgtgatatgaaaaaaatttccttctacacaaagtcacaggcaaataagagtagagtgcaaaatagcaggattaatggaaataccgatgtgcgacatgatgaaataggatttgctttggtagaccttgataaggttgcttacaaggatgagcctttcatcatggcagaacaagcaaaaagcttgactactagacagttggatgagcccaaggtagtggttcatgtcaatcatgccactaagagagtttcaaggctacatgaagagaagttccaccaatatttaggcatggtagttggatataagattcatactttgtatcccaattggaaagttgttccaaaagctctgaagaatctgatttgggatgacattgtgggaagctttgtaccccatggtcatcaggatatactgactactaccattaggcgacctaagcactcaagtcatgttcatgttgtgggagttggtgtgaccattagccaatactttggacatgcatcacatggctccaatagttctacatccatcaccccacaacagttggttgagataatagagcccctaaaataa

SEQ ID NO: 13387 - DNA, 243 bp, Glycine max
  Peptide Sequence Number=SeqID_130165
atgaggaaaagcccagggcatgctcaacgtgaagtcaacatgaaaagggttatttattgggaaatggtgcacttatggacgcccattacaatactgttgccaatgcatcctccagacatcaaactctccgatgaagatgactcatcccttggcaagttacataagtatgaaggtagagattgtgaaccatcctcaaaattggagctcattgtttcatgggaagcaattgatcgaaactcttga

SEQ ID NO: 13388 - DNA, 792 bp, Glycine max
  Peptide Sequence Number=SeqID_130166
atggcatttatattcatcacaccaagtatgttcaacatgagtgatacaaaagagatgaagactcttatgcatcccactacacatcttggaccggatgaggaatcaatgaaggtggacgggactcagtacagagcaatgattggctctctactctaccttactatgtccaggcctgatataatgttcaatccgataaggaccttctggcaatatgctgagttcgtcaacaagaagaccataacctccaaggttttgggagtaaaggttgtattgtcatgcgacacccttgctaaggctgggagaagaactacgactcctacatcaccagagctttctaccttgagaatgcagacaagcatctactacgcagccctcatcaacaagcttctatgggatcaaggagtatatcatgtgttcaacaagacaggttcaatagtcgttaaacaacaaaagtttagcaaaagtaacctgaaggcaatgaaggtggccttagaacaaaccttgaaggaggctccagaagtggatgtggacaccatcaacaagcgtaaacagaagagattggccaagtccattgctaatgaagaccttagtctggagagctttggcattacaaggataatcaagaagatcatgtcccaaagggatgaagaagaagaagagatattggtaaaggagcactggaccaaaaaaaggcatgagtatgtcgtgtctactcctacttgtccaccaacagtgaacctagttgcacaacagttgaaagaactaagtgagattgatgatgatgaagagtag

SEQ ID NO: 13389 - DNA, 243 bp, Glycine max
  Peptide Sequence Number=SeqID_130167
atggccatttacctcttggaagattctagcccttggcagcatagagtgtatgctgatccaatagacaattcttccaaaggatgtcaaagatttacacttgaattgtcaacaggaactcctaacaagtctgctaggagttgttctgagatcagaatctcagttcccttcagtgtagcctttagtgtgaagttgttgctatctacctcagtagcaacaaagaaagttcttactagccgtgggtag

SEQ ID NO: 13390 - DNA, 588 bp, Glycine max
  Peptide Sequence Number=SeqID_130168
atggtgaaagctcaaaagatagcccatgtgactaagatccatgaggctcaacagaagaggaaagttgatgttgttgttgttgctgagattggtgcaaaaaaagctgctgagaaagaaacagccgccactgttcaagctgaagcatttgctaaagctatggacgacactgttgtgcatggggtcctcattgaccttacaaacactggtgtcatggatgagattggtgaaatgtcaaatgcagctatggctgatgaagttgaacccctcatttcggatcttgcgtccaagcagacatcaaattcaaatgaagccacttctcaagataaggatgaccatgatgctgtaattgtctcttcaacaagttctagtcctacccctctcaattatgcacaacatgccatcgtcactcgtgaccaaaatgttcaacaagctcagctatcaatgcttggagtcgttgctgcacctgcactagtatctcaatcggtctctcttgaacctccaccacaacctttggcttcgataccacaaccaccttcatcttctcaaccacctttcgaacctctgccaccacctctttctcaagactga

SEQ ID NO: 13391 - DNA, 363 bp, Glycine max
  Peptide Sequence Number=SeqID_130169
atgtgcatctgttctttgttcatccattccccaatgagtcacaacaagggctaccaaggccaatccaaagattgggcagtttccttcactggaaacaaggaaaatctagcctcttcttcaacagaagatgaatccactgatgactttcctctcatgccactctgtaagtttgtaccaactccacaaccatgtccagctctctctccattagaccttgataggttcaaaagggcagctccaagggagaaattaacagatgaacaattttttcccctagcctttatttatggtaatcctacacttatcatcctcttctctgaagccattttctctgaagccgtgtatgctaaagcacccacctag

SEQ ID NO: 13392 - DNA, 606 bp, Glycine max
  Peptide Sequence Number=SeqID_130170
atgtcctcgccttcagaggactacacgtcctcgacttcaaagggctacactcccacgcctttagagggctacacgtcctctccttcaaagggctataggtccttgccttcagacggttacacgccctcgcctccagagggctgcacgtcctcgcctttagaggactgcatgtcctcgccttcagagggctttacgtccttgacttcagagggctacatgccctcgcctttagagggatgcacgtcctcgccttcaaaaggctacacgccttcaccttcagagggctacagttcttcgccttcgcacgattacatgccctcgccttcagagggctacacgccctcgcctttagagggctccacactcgcgcctttagagaacttaaggatcgcgcccttaagacactcagtggacccggagaagtccaacagggtcctgggggtttccaactttgattatgactctctggccttcatcgagaagtactgtgcccccaggcgggcgcagggcaaggcaccacaacagcctggggatggccggcagcgggcaacagacgcaccaccaccacctccagagtccacctcatctcatctacaaaggttgtag

SEQ ID NO: 13393 - DNA, 432 bp, Glycine max
  Peptide Sequence Number=SeqID_130171
atgccgttctcgttctctcactctcgcaatctcacttactcacgaaagagtttagaaacgatggatgaacatcaacagaactggaaggaaatgactaacacaatgatgaagattaacaaaaaagtaaaggaaatgttcaatattattcatgttattgatcagacttgtggtgaggtcagtaggtcatttattgtaagatggaaggatgaactagaacctatttggcatctgctacactctagtggcaacatgcactctgtcacatataactcaaatctggtgagcccagctctacttgctggatggacagaacttagagagttcgatgggctcactggaaatcatcaagtgaccttgatctactatagacaaagtgttttccttctcatcattttcaaaagcacctctgaaccaagagcttactctaaatga

SEQ ID NO: 13394 - DNA, 936 bp, Glycine max
  Peptide Sequence Number=SeqID_130172
atggaagatgcacctttaggttcatccgagaggcctttttgcaccctcgccggagggcaggctgtgacaccattgacaatgagtcaagcgtccctgttgttggcatcgtcgctgccatggcatggctattactatgcaagttatagcccctcatctaatcattcttcttttttctcttcctccccaaaagcccaaaaacctaaaaaggagtaccctcccaaaatccttcctggttactcctgggtttatggcgaagtcaaaacctacgcaagtagttttcgtacttatgaatcaatcacgtacttcctagaaggtgccaaatttttccatgatgatcgtctggatgtgatgatcataagtcttgtcttgccaacaaggattgacacactaggaccttttccaagggccccaggacaggtcaaatatctagtggtagccattggctacttcaccaaatgggttatagcagaaacacttgccaccataactactgaaaatattgagaactttgtgtttaggaaaataatttgcaggattgaggagaagagtaaaagaggccaaatgaacctgtgtagcataactgccacacatcctatgggcatatcgaacaacccctattctgccaaaggagaaaccccattcaagatgacatataagactaaagcggtcattcatgtggaaataggagaaccaaccttcaggattgtaaatttgaatctaaaccagaatgaagggaaccccataaccgagcatgacctcatcaaacaaagaagagagagggtgacttggtcctatggaaagctagtgttggaggaaaaaaataaccatcaaggaaagaagcttatgttttggaaatgttctctggagaaagaattcctcgcacttggaacacctccaacctgcggaaatacttcagctagaataggaaaatggtaa

SEQ ID NO: 13395 - DNA, 198 bp, Glycine max
  Peptide Sequence Number=SeqID_130173
atgaagcgttataaaagcttttgggaaggaccatccagggctaatgtcaagatagctaagatagaacttgaaattgttgccttaaagggtcaagttgctcaagttgatgctctaaaggcacaagttgctgaagttgatgtactaaagcaacaactagttttccttatgcaaactattaagggaaaccaagtaaagtaa

SEQ ID NO: 13396 - DNA, 435 bp, Glycine max
  Peptide Sequence Number=SeqID_130174
atggatcttgttcttaccgaattcggcaaaatcttctcacagtgttgttcctctatgagctcctatacgacagtggtggaatgtacctgcgaagatattttgacactcaagttagcattgagagggattctaggtggtctgggtagaggtagaatgctttttccgaaagttcatcctattggagaaagttccaatgatgaacattctcatcatcacgatggttctaacgttgccatttgtcataccctaatttcgtccagggacgatcatttgcaaacatttggattcttgccagccgaattgagctgcttaacaccaattgtcgtgcaatccataagatttttctacgtttcggaaggaaatgtgcaaaatactcaaaaggagggtaaaagggcacttttggggcatttttcagcccctgagccacctagataa

SEQ ID NO: 13397 - DNA, 342 bp, Glycine max
  Peptide Sequence Number=SeqID_130175
atggctggagtagacgaggtgcaagagcagatgaaggtcgacatggaggccatgaaagaacagatggccagaatgatggaggccatgatgagcatgaagaagataatagaggtcaatacggctacagttgccactgtcagcactgtttatagggtggacccgactcccccatctggcctcaacctaataaatcgtctaacctcagatatgggcgaccctcattttgtgctagtccaaaacaagtatgttttcccgccatatggtttgcctccaaactatactccacccaatgataatgtcaataactccactcttatactcattgagaaccaacaaccttaa

SEQ ID NO: 13398 - DNA, 1062 bp, Glycine max
  Peptide Sequence Number=SeqID_130176
atggaaccaacttcatcagtgagcagccgtctggcaaaaacagcctgctctactatttctgcagcagaaaaaacaagagaggctggagaggttgcaacggtggttcttgtgggggagaaattcagaccagcagaagattgcctgggtaaagtgggagacagtctgtctcccaaaggagaaaggtggtttgggtgtgcggggtttggcaaaattcagcagtgccttacttggaaaatggcagtggaacctcttccaccatcagggggaattgtgggcgaaagtattggattccaaatatggaagttggagaatgggataaaatggaaaataggatgtgggtcaaaggtcaaattttgggaagatggttggttggctggagggatcccgttgaatgagaaatatccacacctgtacagcactacagcttatctcaacaacaacagcattttgtccagcagttggggtggggtatacacagtgggcagctcttacaaagtgctcaataggcacttctcaggggaaaataattacgaggtgtttaaggaattatggaagctcaaacttccaagtaaagtgtcccactttgattggaggttgatactggataggctaccaacaaaggttaatttgaggaggaggaatgtggatttgaatgacgtctcttgcacattcggtacatcttgtgaggaggatgtgtctcatctgttttacagctgtgataagatttggcctctatggtgggaagcattgtcatggttaaacatagctgttgcttccccaaaatcgcctagagaacacttccttcagcattctcacggatatctcaagggaattagagttcagcgatggcaaacgattgttttctcaaatgaaagattcaacggccaaaagcagatggatgatgcaatatttttctgttggatatggctcaagaatatggaaaatggatttggtatcccttttcactcatgggctaccaatataagggtcggggttgtctactttaatctagacctatggatgcttaattcttgcaatacagcttgtattaggactccatag

SEQ ID NO: 13399 - DNA, 1657 bp, Glycine max
  Peptide Sequence Number=SeqID_130177
atggagtcttggagctatgttgctgaggagaaagggtatgtctccagtgaggcactatcacctcccaacacacttgagagaagcaaaggttcctgttttggttgggaactgaaaaccccatgtagtttttccaatgacatgttgggtttgggccagcaaaacgttgaggatcaaggttttggggagttgggttttccaggaatgttggggaagcagttgtgcggtgatgatcctaatcctattggtgctgttcagagcagaaaggtggatgatgttgttgttgactgcagaatcactagtcctagtcctgttgtggctgccccaaatggattttcttcaagggaggacttcaattccaagctttcaaacgctctggtggactctaatggtggaaattcactcattgatttgaagctgggttggtttgctgaccatggagatgccatggttccaacattttccaagggagcccccattttgtcttcttccgagttgtcgacgccaccaaagagggtgagagcttcgggggcgcattctcagactgcttactgcctagtctatggctgtaacaaggatctgagtggttgcaaagactaccacaagaggcacaaagtttgtgaggttcactccaagacttccaaagttatagtgaatggcattgaacaaaggttttgtcagcaatgtagtagatttgaccctctcaaaggcttacctcctttttcacacaaaatggaaaacaaccttgaaataagaggctgtatggttatggtatatagcgctgctgtaatgtttagcttactatccaggtttcatttgctggctgaatttgatgatggccacaatgagcgtcgaagaaagccacaagtgggtattcactctggaaaagctgggaggttgcttcagccatatgctgatagcagattccaggagaccatgctaacatcgtcttttatctgccaagagatactccccagtggagtcttgtcttctgagaaatatggagcaagtgacatgtggagacctatcaaagctgaagacagcaccggttttacttttaggcccctttcttctattcctattaccaatggacatcctcagtcacgatctttatttccttcgtatagtggaaaacaacttccatttcttcatgaaaatggtgctacatctgccacaggaaacatcttctctgaaaacaataaccaatataatcctccttccctcggtggccaaagttccgggtcacaatcactattccaggacagctccttaggaagggaggacttcaatgttttcgacacagaatcagctgttcaaggactatcaggaatttctgactctggctgtgctctctctcttctgtcatctcaatcccagaactcttcgggccaatcatcagggattcccattgctcacccgatggttattccaagcagccacagccattacaacatgagtcgggtttctgaaaagatgataggaataagttcacaggcttcaagtggagtgtcagataggtttccacctgaattcaatcctgtagatggaagtcatcttagtcccatattgatatcagataataatgaaatcatcaattttgaaatggcaaatgggatcttccaagggtcggatttcgtgaccgtgaaagatcgcctttcct

SEQ ID NO: 13400 - DNA, 192 bp, Glycine max
  Peptide Sequence Number=SeqID_130178
atggtaactaattggaatcccacaatccttgccaacacttccctcaagctagtgaatggatatctatcgttcttagcttgtaagatctcaaaaccataccatgggaagtcccttcgtgactgttatcaatggtggatagtcgagtggaaggccaagtttacgtcatataaagaaccccattgtgccttctag

SEQ ID NO: 13401 - DNA, 546 bp, Glycine max
  Peptide Sequence Number=SeqID_130179
atggcggtaggagcagtctcaaactccactctttttctaccttcctctcttctatcttcttctaaacctaatcccttaactatcccattctccttctatctcaccaaaacgtcaccgttttccatttctgttctcactcgccaacgccgcttcctttccgtttcttctttaaccgctgaccaccacaacctctctgatttcggagatggtgacagcgttgcaatttcaaacgaaggtttgaagatgcttctcaaagggatgacttatccagaacttgaaaaatgggttcaatcacatggatacaggcctgggcaggctatgatgttatggaagcgaatgtatggaaacaacatttgggcccatcatattgatgagttggaaggtttgaataaagatttcaagaaaatgttgaatgaaaatgccgagttcaaagcgcttactcagaaagaaattcgcacagcatctgatggaacaagaaaggatattgcagattttattcacattggaagatgggctggtcatagaaacagttgtcataccttgtga

SEQ ID NO: 13402 - DNA, 150 bp, Glycine max
  Peptide Sequence Number=SeqID_130180
atgtcagaacccccacgtgatatgaatccagaaacacggtggggaacagctcaagccagaggactgaatggaggcaaaaacacaatccagataaatgaatgggagaaaaagccattcagcattcaggagcttggaaaaggaaaacattaa

SEQ ID NO: 13403 - DNA, 315 bp, Glycine max
  Peptide Sequence Number=SeqID_130181
atgggggagaaacaagagcatgcatttactgcactcaaaggaaaattgactcatgtacctattcttgtattacctaattttaccaaatcttttgaaattgaatgtgatgcatccaatgtggggataagggctgttttaatgcaagaaggacatctcattgcttattttagtgaaaaattgaatgagggtgttcttaattattctacatatgacaaagagttttatgcattgaagtccaagtctaaagtcaagcctcatggactttattcttctttgcttattcctgattgtccttggataggttttcaaagatga

SEQ ID NO: 13404 - DNA, 354 bp, Glycine max
  Peptide Sequence Number=SeqID_130182
atgactgcacccttttctgcttatgctgaagatggtggcagatatagcttgcatggtaggaaggatgcttttcaggcaattcaattagatggctctaggtccaggaagggtctgcccattgttctggatgttgatgacgatgatggcggcgacaacaacgacgaatacgacgacgatgaagctcatattgtggagaaaacagaaaacaaatttcctgaatacctgaaagaagctaagatctattttccatcaagagatgatccagagtgcgttgaaatttgtttcacagacacaaattgccttgccccggaaggctatttaacatcaactattatgaacttctacattcagtaa

SEQ ID NO: 13405 - DNA, 1194 bp, Glycine max
  Peptide Sequence Number=SeqID_130183
atgtcttcgtcatcgggaagcacagcagcagcaacgccgattctgaaggaggaggtggacatagtgattcccacgatacgtaacctggacttcttggggatgtggaggcccttcttcgagggttatcatttgataatagtgcaggacggtgatccttcgaaggttatcaaggttcctgaagggtttgattatgaactctacaaccgcaacgacatcaaccgcgttcttggccccagggcacactgcatctccttcaaggactctgcttgccgctgcttcggcttcttgttgtctaagaaaaagtacatcttcaccatcgacgatgactgcttcgtgagcaccacactctgtctttttattggcaaatttactgttagatttctttgttacatatatgaaatttatggtcatggagcagggtttatatcccaggttgcaaaagatccatccggaaaagaaattaatgccctggagcagcaccttaagaaccttctgagtccatcaaccccatttttcttcaacaccctctatgatccatacagagagggtacagattttgtccgaggatacccttttagtctgcgtgaaggtgtccctacagctgcttctcatggcctctggctcaacattcctgattatgatgccccaactcagcttgtcaagcctctagagagaaacaataggtatgtggatgcagttatgactatcccaaaggggactctctttcccatgtgtggtatgaatttggcattcaaccgggaattgattggtcctgcaatgtactttggactcatgggtgagggtcaacctattggacgctatgatgacatgtgggcaggctggtgcgtcaaggtgataagtgatcacctaggattgggggtgaagacaggattgccttacatctggcacagcaaagctagcaacccatttgtgaacctcaagaaggagtacaaaggaatttactggcaagaagagctgatcccatttttccaatctgtttcttttccaaaggaatgcacaactgctcagaaatgctacattgaactctccaagcaagtgaaggcaaaacttggcaaggttgatgagtatttcaacaagcttgcagatgctatggtcacatggattgaagcttgggatgaactaaacctatctggggtaaaatctgaagcattgtccaatggtccggcaaagtaa

SEQ ID NO: 13406 - DNA, 1134 bp, Glycine max
  Peptide Sequence Number=SeqID_130184
atgacacgtaaggtgaactccattatggacgtcactgctcaaaaggagacttggaaagtgtgtgtgtgtgtgattaatatgagggttattcaaagggctgcaaggattaacattgaaatgatcttgatggatgagaatgctgataagattgttgctcaaattaaaaatgttgatcctggtaagtggaatgatgttgttaaagtgggggcttatgcggtgtccattcaaaattcaatgtatggttctaggctgtttatcaatgaagatttagaggacatcgaagattataaaaatggattagacccgagtcagctaagcgttgtgacttgcagtcaaaggttgggtcaagtctcttattcttcccaacctacttcagaggatagatttctttataatgctcaagttaaatcattgagtgaactttgtgagttgaaaaaggaatgtgtttgtgttactgttgccacaataaccaagttcttagttgacaatggttggatatatgagagttgtccaaaatgtaacaagaaagtggaatgtgagaaatttccatacacctgtcaatgttgtggaaatgaaagtgcaacaactgtggccaggtttcggttggaagtgagagttggccaaccaaatgaaactgctaactttactttatgggatcgtgagtgcaatgtactcattaaagaaagtgcaagtaagattaaacaacaaatgattgatgaggaaggtgaatttgatccaatggacatttcggaggctattgataggatacttggcaaaaaattagcttttagatttaaggctataccgaacaatacccggtattctatgtcacaaacctcaaaggatgaatatctaattatgttattattgaagagacttcctacatgtgagcttgttggagatgatatagtctacactataagttatggtaacatttgttgtatttatatactgccacaacaacaatccttatcagttagtggagattttgattctgaatcatctaagtcagtaactcctgcaaagagaggatttatgatctctaaatctcagctgaaatcagtaccatttgaagacctgtcatcaattcagttatcctattccaagttatccaagcatatcaagtctgagtaa

SEQ ID NO: 13407 - DNA, 138 bp, Glycine max
  Peptide Sequence Number=SeqID_130185
atgccactcatccaattccttaacaatgtagggcacaatgaggagaagcttaagatgtcatggtcaacaaaggttaatctagttggtaaaaatcaaactggtatctcacgaggatgcgggtttgaatgccgctactaa

SEQ ID NO: 13408 - DNA, 825 bp, Glycine max
  Peptide Sequence Number=SeqID_130186
atgttgggagaagaggataactttctatcagtagaagtcaatatggtcatccttataccaagtgaattttgggcttatgcaaagcaatcaaataaactagatggtgatgtgtttgttgaagacgtagaatgtgcatcgttgattatagacccaaatcaacaagggaaagcaatgatattcgaaaagcctatagaagaaatggggagacatttgaagccattgtatatcagagcccacatcaacgacaaaacattaagtcgagtgattgtagacggtggagttgtgttaaatgtgataccaattaatactatgaagaaaattggcaaaggagtggaagatttaacaaccaacatgaaaatgataaaatttacttgtggtggaacttatgcttggcgtgtgttagtagttgatattacagttgggaccaaaaccaaaaaaatagtgttgtttgtggtggacgctaaaccagcgtataccttgctattgggacgtgattggatccataggaatcaagtagaaaaggtccatgctaataaaagaccatttaaagttgagccttggtgggcatgctgcccaaataatgcactagcgggtcaactgattcgaaggaagattcctccatttgaagctcaagatctgctgatagaagtaaatctcgacactagtaaggaacctcgaatgacaaaagtgaatggtttgttaaatgaggaacaaaggaagaaattagtggaacatataaaaaatatcaagattctttcgcataggaacttaaactgggttttaaatcttccaaacaatcaccaaggaggtttaacccatagttga

SEQ ID NO: 13409 - DNA, 375 bp, Glycine max
  Peptide Sequence Number=SeqID_130187
atggtggtcgtgtgtcagtgtgtgtcacctttgtggggtcgtgcaggtgcgggttcgtcgctgctgcgtgcggggtcgtcgccgctggtcgttgctgggtgcggggtggtgcgtgtgggtcgtgttgttgtgttatgtgttgtgcgtcctcccgccgcgcttttgcacttcaatttcggaatgaagagtgatgaagaaagtctaaatggagttggaaactgtggtgggtacgaagaggaaggtggaggaatcagacttgaacaagttggagtatttggatatggttataaaagaaagcatgaggccccatccaatgcaattgtgagagacccaagtgcttgggatgaggcagaacagttttggccaaagatttga

SEQ ID NO: 13410 - DNA, 258 bp, Glycine max
  Peptide Sequence Number=SeqID_130188
atggtggaaaagcgtggtggaaatttgaaaaaatgccaccgaatagaggtggcatggcgggttgggatggtggctgacccgacccaaccttacccgaaattgaagtgcaaaagcgcggcgggaggacgcacaacacataacacaacaacacgacccacacgcaccaccccgcacccagcaacgaccagcggcgacgaccccgcacgcagcagcgacgaacccgcacctgcacgaccccacaaaggtgacacacactga

SEQ ID NO: 13411 - DNA, 231 bp, Glycine max
  Peptide Sequence Number=SeqID_130189
atgttgttaccggtgctggggttggcgtggctaaggcggggttacggggttgaggagggtgttgcacacaatgttacgaggagaggtgaacatctttgttttgtacactctctgcagaacctttctacgagcgacgttctcactttctcactctgtttgtgcgatcaagggacattgctcgattttggtgtggtcaagggcaccatgcgtgagaacgaaatcctctggtga

SEQ ID NO: 13412 - DNA, 2440 bp, Glycine max
  Peptide Sequence Number=SeqID_130190
atggaagacgcacccgtgagccctcgcgtcgccctcccgccgaaggtttatgattattttggaactgcatggtttaaattaccaaatgctgatgtagcaaagttactaaatgaggactgccatgatgttattttgtcaactgagcatgctgatccaagattgtatccaccccaggtgatgttgcttattggaaaacatctattgtttttaatagatagagaaagtgctgaaggaagatgtgttcaagatgctgttaattatctgaatggatacatggtgcatcaaatatgtcatgacaagcaagtgctaaggatgtctcatgccaaggagttcttaactgtggcgcaagagttaggtgcaaagataattgcacaaagatcatcaattgaaaatgctaagatgattattgcacagcctgctccatcggtagtgttaattgaatggattaaaaagcaaaaggaagacccaaagatatcaagtgacttggtggctgcatctttagcttcttttggactactgaataatgaaatccttgattgttcctttggagctcaacacgcaaatgattcacttcatcatactaatgaatcctcttcacataagaatgctgaagatgcagaaacagatgacgttgtaccagattatgagaatgaactattagattgtgttgatgataccgctgaagacattagcataggtgacccttctcaaatatgtccatattgccaagctgctatgtgctatcaagaaaagacgaggaaaaatagaaagcaagctaatcccaaatatagtctttgttgcagcatgggaaagatacaacttccttttctcaagaatcctccaatgcttttgcaacaacttctatgtgatgatgaatcacgcaaaagcagaaattaccaacaatatatcagggcttatagtatgatgtttgcatttagctctcttggggccaagatagatacaaatgggaagaaggatgaaaggatttataatttgcccacagttttagaggtggctgcagttattgttggtgatgcaagtcaacctataaatcgagacataatacttgaaaagcaaagaggaagattacaaagaatcaatgaacttcatccagatattgacacaatcgaattccaaaaaagaggtttgccacatgctcgtatcttgttgtttttggatgctgggagcaagtatccatctcctgtagatattgatcgtatcatatcagctgagataccatattctattgaacaaccacaactctatgagtgtgtcaagaaacatatgatgcatggtccatgtggtcatacaaacaagcagtcaccatgcatgaaagatggaaagtgttctagatatttcccgaaaaatggaaagctgaaattgttgttgaccaagacggctgtcatgtttataaaaggcataatgatggctcacctcaacatagaatggtgcaatcaatcaatatccatcaattatttattcaagtacattaataaaggttatgatcacataaccacagctcttatgcctgtcgaaaatgaagatggaaaaactgaacaaactattcacaagagatcacctattgttgaaaggttgtactttcatttgcctggtgagaattcagtcatatttgaagatggtgatgacattgatgccttgttgtccaagccaaccattaaagagtccataggctatacaattggaagacttaattgggtgcctccaagtactggagaattctattatcttaggatgatgttggttgtggttaaaggaccaacaacttatgaacaaattcgtacagtcaatggtcaattgtattctacatttagagaagcttgctttgctatgggtttcttggttgatgatgaggaatatattgaggctttaagagaagcataccattggggttctagccaattccttagaagattctttgtaacaatgttgttaacaaacaacattgagagaccaaatcatgtatggtctaaaacatgggagtgcctaattaatggtatccttcatcaacaaagaaggataagagacatacctggcgctggtggaatgtttttcctctatgggtatagaggtactgggaagacctttatgtggaagacattagcttttgcattatgttcaaaaagtgatattgtgttaactattgcgtcaagtgggatagccttattgttattaccaaatggcaaaactgcacattcaaaattttctattcctgtgtctacattacaaaactcaacgtgtaatatccaccaaggtataaaacaggctgaactcttaaaggaaaccaaattgattatatgggatgaggctcctatggctcataggtattgttttgaggcattagataagacattgaatgacatcatgtgtatgtgtaattctgacaatgttccatttggtggaaaaattgttgtatttagag

SEQ ID NO: 13413 - DNA, 591 bp, Glycine max
  Peptide Sequence Number=SeqID_130191
atgactgagacttcaacggtaatggtagctttagtaggggcgtttgcggcaatgacagggaagctcctccatagtgttttggttgctaatgaagtggttgaggaagcaaagaggattgtgtgggatgatgagagaagtgataaaaaaaagaagctatttgagagctatgttgtgggggagaagaaaattcaagttgatttacttcaatatgtggatgacacaatcttcatgggggaggccacgggctattgggtgggagaggaggtcttggagaggtattcacacatgttgaattgcaaggagcttttgcatgaagagactcttatttggagtgaagtgctagtctgtaaatatagaggtcagagagggcttagtagtgcggtagtttctagaaattcctccatttggcggagacacttgtctttggtgcgtggaggtacaaatgttgggagatggtttgatgctttggtgggaaggaaagtgggtaatgataggggtggaggtggaggttttgatgggaaagagagttatttgaatgggaaaattggtcatggaggatttatgaggaggttgagagtgttcagtgagtaa

SEQ ID NO: 13414 - DNA, 306 bp, Glycine max
  Peptide Sequence Number=SeqID_130192
atgaagtcaatagcacaaactgtacacatccaagagaagacacctagttttgagtttgagtgcgtggtccaatcaggaacaatatatccacttcctacaattgctatccaatcaggaacagactccagtttgagtgcatggtcactggtaatcacagtcttacctgaagaaaggggatggattaggagattcaggagttttctggaacttttaattgctgaagagataatgactgtttcagtctactttattacctatgtggactgcaaaaacaaagctgtaggactgcatgaatcactaaattga

SEQ ID NO: 13415 - DNA, 708 bp, Glycine max
  Peptide Sequence Number=SeqID_130193
accattgcaacggtctatatgttccttgctgggaaggttgaagagactcctcgtccactaaaggatgttattcttgtttcttatgagatcattcacaagaaggatcctgctgctgcacagaggataaaacagaaggtttgcaatcaaatgttggaattgtatgagcaaaatagacttgcaccagcacagggaagtgaagtagaaggaagtgctggaggaacaagagctgcttcaaaggctccttctgcaaatgaggagcaggcctcaaagcaaatatcatctcaagccccccagcacgaatctgtagacagaattgcgataccacaaacaggaactgagaaccaaagcaacgatgggagtgctttgaggactgaacgtgaccaagacagaattgttgggactaagcagggttcagaagtaggaaggagagatgaatctgcattaaacaattctggcagcaatgttggccaaaatctggagcgtcgggaagttccactaggtcattcacccaatgaagcaatcaagattgacaaggataagttaaaggcactagcagctatgggagataacaaaaaggaacaacgaggcaaaatggcattaaagaaacatgtaatggatgaggatgatctcattgagaaggagttggaagatggaattgaattagcagtcgaggatgataaaatacagattggatttggagtaatataa

SEQ ID NO: 13416 - DNA, 210 bp, Glycine max
  Peptide Sequence Number=SeqID_130194
atgtgcaaaaaatgtgacatattggttgaggcaagaggagagggggtttcagttgctgccattgaaggattaggtcacaaagatgaagaagaaccacttggtttcaatagggctggagggaaggttgttgatatggttgtgatgcacgaatcaaccggcccttgtcaaatgttacatgcatacaattccaaggtacggtcattcatttga

SEQ ID NO: 13417 - DNA, 535 bp, Glycine max
  Peptide Sequence Number=SeqID_130195
atggcggaagctacacgatcgagggtttcagcagacagattagaagacgccattgccaagctattagcctcacagttagcaatgaacgccaaaatcgacgatcttctgcaacgaataactcacattgaaactactcatcagcaaccgcaagcttcaccatcatcctcagcaggacaaactccaatagcaacgggttccacacatcgtctgaaactcgatgtcccgaggttcgatggctcggatcctacgggttggacgtttaaaataactcaattctttgagtatcacaacacgtcggatcacgagaggatgacaatcgcgtcgttctacatggagggagctgcgttggcgtggttccaatggatgcaccgcaacgctcaactatcctcatggtcagcattcttacacgcgttacatacgcgattcgcttcatcaacctacgaagatcccatgggattgctatgcaagttgcaacagcgatcctcagtgaactcttacttgacggagttcgagtcgctagctaatcaaatcgtag

SEQ ID NO: 13418 - DNA, 198 bp, Glycine max
  Peptide Sequence Number=SeqID_130196
atgatattagaggacaagttgaaggcttgtcaaaggtcgaagagaagcttgaccgaacagttgagtagggcggaagagaacatgtggacaatcattgaccagagtcaagagcttccaaggctgttagccaaagccaaggcaatggcggacgtgtactcaactcccgaggaagttcatgggcttttcgattattgttag

SEQ ID NO: 13419 - DNA, 204 bp, Glycine max
  Peptide Sequence Number=SeqID_130197
atgcacggagtctccaccaatgtttatttgaggaaaatgtcggaaaaaccagaaaggtgtggtctacgaactttaggtgtgaaaggtttgggagttgtatttacgcacgaggaaggcattgaaccattaaacgatctttcgattcttttgaaaggagagaaaacattaaggcattggaccattaatgatctcttgattttttga

SEQ ID NO: 13420 - DNA, 300 bp, Glycine max
  Peptide Sequence Number=SeqID_130198
atggaagtgagggacaaagttaagctcctttcatatagggacctagatgacctagtccaactttacataagggtagagcaacgaagcgtacttcaaaatcttagggctttcactcttatccaaagaaagatcaaagtcaatgcccttaaaaagaggcacatcccctcctactatgaaagggagcttatggacaagcttcaaaggcttcgacaagggagtatgagtgttgaagagtataggcaacaaatagaaacttttatggaggttggatctttgagcttctataaggtccttcaatga

SEQ ID NO: 13421 - DNA, 324 bp, Glycine max
  Peptide Sequence Number=SeqID_130199
atgctggatgcttctcctgaggatgttgttgaccatggtagctgtggtgactttcttatgtcatggatgactgttgtgaactcgtcatatttttactcatctatccctcaatactatgataaggaattagaagaaatgttaacatctagtagattggctacagagaatttgaattcaaagttggaagaggttcacctacagttaaaagttaaagaagatgaaattatgcatcacttaaccaatcaagagaaaatggagaaagaaaagaatgatcttcaattgtgcaatgtagggcttgcagaaaagcttgacatgtcactttag

SEQ ID NO: 13422 - DNA, 288 bp, Glycine max
  Peptide Sequence Number=SeqID_130200
atggtagatgctggagacggtaaccctcctcttgggggagactatatgttactaattgattcaattacaactcaaatggaaacgatgatgagggagcacacagaggagttatatgggagaattgaacaattagaaaatcaagagaataacgggagaattgaacaattagaaaatcaagagaataacgatgatgatggacgtagaaggaggaggagaagagataatgatgatggtgatgctagagaggacaacattgaaggagtgaagctgaacatactccctttgtaa

SEQ ID NO: 13423 - DNA, 327 bp, Glycine max
  Peptide Sequence Number=SeqID_130201
atgagtaattcttcttcaaattatgttccatctagtgatgaagaggagcataaaaaggaaaaaggaccacaaagagatttgttcatggtgcgaaggttgttgggcagccaagcaaaggacttggatgaaagccaaagggaaaataattttcacacaaggtgcctcatccatggaaagctggcaagttgcatcactgtcaacgaccaaggtgtgaaccatagctggcaagctgcgccacgccgcgacgtcgaagggttcattaaagaggaggaggagggcatttgctattttgatcacgcagatgatacttctcatataatgctctag

SEQ ID NO: 13424 - DNA, 810 bp, Glycine max
  Peptide Sequence Number=SeqID_130202
atgtctggtttgtttggttccttttcaatgatttcttcaacaggagaaacaagaggaattctgcgtcaacaaagcagtgcatttgtaagttccaatcctccaaagcttaggaggaatgcctctgcttcatctgatataagtagcacttcttcccaatgtggtccaacatttccagctcctttaaagcgcacaagtagcttgtgttttgatgaaaagctctttgtgcagtcactttacaagcttttggtttttatcacagaaactagttccatcattttatacatcagggatgttgagaagctcgttctccaatcaccaaggttatataatttactacaaaaaatgataaagaaactatcaggttcagtgttgatccttggttcccagatattagattcagaagatgattgcaaagaagttgatgaaaggttctctgcactattcccctacaacattgagatcaaagctcctgaagatgaaactcatcttggcagttggaaaggccaactggaaaaggacatgaaagatattcagttccaagataatagaaaccacattgctgaagtacttgcagcaaatgacattgattgtgatgacttgaactcaatctgccatggagacactatcttactcagtaattatattgaagaaattgtagtatctgcattatcttaccatttgatgaataccaaggatccggaataccgaaatggaaagctagttatatcagccaatagtttgtcccatggattgagtctgttccaggaaggcaagagtagtgggaatctgaagactaatgaatctaacaag

SEQ ID NO: 13425 - DNA, 3402 bp, Glycine max
  Peptide Sequence Number=SeqID_130203
atgataccagatgcaggaagcaacctcgaagttccgccggagccacctgaactggtccttgagtcaaccccggctcaactcagtctacatgcgttatcaggacactcagcccctgaaacgctgcgtatgaaaggcattatcaaagatttccatgtaaatattttaattgatggaggaagtactcataatttcctccatcatcaagtagtcacagcattgaagctttccacacaagacatagttcctctacgggtcacagtagggaacggtgatgaaatccgatgccaacaacgatgtgaaggggttacggtgcagatccagcgacattcattcaccatagattttcatattctccctcttggtggggcggacgtggtactgggggtccagtggttgaagacactcggtccaatactcacggactacacttcactcaacatgaaattcatcatggaaggcaagttagtagaattaaagggagatcgtgagaaggacatcgaacaagtaacaccctcacagcttcgtcgattactccacatgaatcctgctagttcactatttcacatacgtttagaaaatcaaacaccaacccaagccacgacccatattattcctgaaatcgcagccctaatcaccaaatattcttcattgtttcaacctccaaccactttaccaccatcacgaaccacggatcacaccataactctactcccaaacacaaccccggttaacgtaaaaccctatagatacccctactttcagaaacaagaaatagaagaacaggtgaatgccatgttagaaaaggggttcattcgaccaagctcaagtcctttctcatctccggtgttattagtaaagaaaaaggatggaggatggcgcttttgtgtggattatagagcactgaatgcagttactgtgagggatcgtttcccaatacccacggtcgatgaactattagacgagcttggcggagcacggtggttttcaaagcttgacttgatgcatggctatcatcagatcttgatgagggagacagacattagtaaaacagcattcaggacacatcaagggcattacgaatttagagtaatgccctttggtctttgtaacgcaccatcatcattccaatcaacaatgaacgagctgttccggccacacctgcgaaagtatatcattgtttttttcgatgatatattaatctatagcaggaccatttcagatcatcttctccacttggagagtgcctttcgaattctagttgcaggtcagttctccttaaaattttccaaatgtatgtttgctcaagagaagttggaatatctgggacatatagtggcgggtgagggagttcgaccggtgccggaaaaacttcagaccattcaagaatggccagtaccaaggaccccaaaggcactacgagggtttttgggcctcgccggattttatcggcgattcataaagggttactcgaccctcgcagcaccccttactaagcttctgtgccatacacaatttcagtggaccaccgcagccgcgaacgcgtttcagaagctcaaagaagcattaatggcagctcttgtcttggcattacctaactttcaaatcccattcattgtggagactgacgcgtcgggatcggggatgggagttgtgcttgtacaagagggacatcctatttccttctttagtaagcaattctgctccaaattgatgaatgcgtctacctacgtccgtgaacttgctgctataaccgccgccgtcaagaagtggcggcagtatttgttgggtcacaagttcatcatagtcacaaatcatagaagcttacgagagcttatgaaccaaacggtgcagacgccggagcaacaccgctatttagcgcgcttactaggatacgactttacaatccaatatagatcaggacgcaccaacatcgtggcagatgccttgtcacgaattcatgaagaatcaccttcatctgcctcactttctctaatctcaatgcctcaatttgactttcttgaagacctgcgtcaggacatagcaactaacccagctttcatggagttatttcgcaaaattcgcaataatcctgaagctcatcccgactacacaatcactaatggtctcatcttacacaaggggcggatttggattccatcagattcttcctttactaagttgttgcttgaggaatttcacaaaaccccaacgggaggtcatatgggggtccaaaaaacgctgcatcgtttacatgagaactttacatgggattccatgagaacggatacgcgtgccttcatcgcagggtgcttaacgtgccaatacaccaaatatgataacaagaaatcagcgggattactgaacccattacctataccggtacagccatgggacgatctgtccatggattttatcgtgggtcttcccacttacaaggggcatacatgtatcttcgtcgttgtcgataggttctcaaaaggcttgcgtttaggaatgttacccactcaacacaatgcaagaacagtagcaaaccttttcatggatatcgtaggacgcttacacgggatgccacgaagcattgtatcggatcgtgatcccttgttcatcagtcgattctggaaagagcttttttctctcagtgggacaaagctccgcctcagttccgcctatcacccacaatccgatggccaaactgaggttgctaaccgcataatcgaacagtatctaagagcgtttgttcatcaaaatccttctcggtgggggcattatttgctttgggccgaatggtcctataatacctcttgtcactccgccaccggggtcacgccgtttgaagtgactttcggcaagaaaccacccaatttccctcactacataacgggaaccgccaaggttgacgctgtcgatgatatgcttagtcagagggagaaagtatttgctttacttcgtcggaagctcactaaggctcaggcacgaatgaaagaggtggcagataaacgtcgtcgtgaactggagtttgcggtgggagactgggtgttagtaaagttaagaccacggcgccagatttccgtgactgaaaccacttattcaaagctcaccaaaatgtattatggtcctttccagatcacggctaggatgggcaaggtagcttaccagttacagcttcccccacattcgcgcatacacaatgtttttcacgtttcactactcaaaccttatgtaccgggagaatcatcacatgtctcgacggaacttccaccggcagccgtcgacaacgatcccgttgtggcaccattagccattatcgcatcaaagctcattccggcggaaagcggacctacacgtatggtcttggtgcagtggaaagacctaccactcgaggaagcatcctgggaggaatga

SEQ ID NO: 13426 - DNA, 234 bp, Glycine max
  Peptide Sequence Number=SeqID_130204
atgagttttctattatggaaaaatgaaagaactcaagctttgttgacaagtgctgcatatgttcatttaaaaagtcttcacttttccaagcacaccaggaacctcccaccagcaagcagggctattttgctatctggtccagcagaaccttaccagcaaatgcttgccaaagctttagcacattactttgaatcaaagttgctgttattagatattactgacttttctgtgaag

SEQ ID NO: 13427 - DNA, 333 bp, Glycine max
  Peptide Sequence Number=SeqID_130205
atggcacttttgcaacaaaaactaagcttctcatgtctactaatactttgcttagccactgtggtttcttcacacagcaggccttatacaactccaagtgtcacacgcttgactgattcttttcctcgtgtgcaagttgatagtgctttttctaagacctttggtgccaaaaatattcagtttcttagtaatggatccacggccacattggctcttgacaaaatcacaggctctggcttggtatcacaaagcagatactcctatggattcttcagtgctgcaatcaaattaccttctggtttgtcacctggagttgttgttgcattttattag

SEQ ID NO: 13428 - DNA, 153 bp, Glycine max
  Peptide Sequence Number=SeqID_130206
atgacgaagaccatacatcacatcaccacatacacttttcctgcagctggcatgcagaggaatctgatgcgacagaaaaataacacagggcacattagatgcacgttgcttttgtttgtaaccagcaagaggcccgtgcccatgcacgactga

SEQ ID NO: 13429 - DNA, 669 bp, Glycine max
  Peptide Sequence Number=SeqID_130207
atgcttggttcccgtcctacttctatccctatggattactctacacgcttaagtgcttccatgggaaccccactatcagaaacttctgcttcttcatatagacgcttgattagacgactcatatatcttacgaacacacgaccagacattgctcatgttgttcaacaactcaaccaatatatggctaatcccacttccacgcactcacaagctacttttcgggtcttacgttacctcaaaggaactcctgcgactccgattgggcaagatgtcgcgacacatgacgctccatcaccggcttctcagtctatctggtctgccatccagatagcctcaaaccctgttttccacgaacgaactaaacacattgaaatcgactgtcatatcgtgcaagacaaagttaacaaaggattgctcaagcttcttcccgtttcgtcttcaatgcagcttgtcaacatcttcacgaagcctctttctcatgctctttctcaaggtttatattccaagctgggaatgatgaacatccattcccagcttgcgggggctcttagcagaagcttatgtctcatcaacacaatcgtttcccttgagcacatatcagaagcgagggctggcggcacccaccgggcagaatatggctctgataccatattaaattttatagtgtag

SEQ ID NO: 13430 - DNA, 273 bp, Glycine max
  Peptide Sequence Number=SeqID_130208
atggaacagaagcacgttctgttgtcagcattgagtgttggggttgggttgggtgtggggcttgggttgagctcaggccagaaatggattggcgggaaccgtgactctgatgagctttccgtggagctgattgtgcaggagctcaagaatctggtggttgaaggaaggagcagcaacgttacatttgaggactttccttattatttaagtattttgataaagttgggtgtcaaaggtgttttagacatggatccctctcagtctgacttgtaa

SEQ ID NO: 13431 - DNA, 309 bp, Glycine max
  Peptide Sequence Number=SeqID_130209
atgtcatcaagtcaatcaatatcgatcaatacacaagcgttatgcaacatatacactaagactcaatcctatatgcaatgtggtaccatgtcagtgaaaaaccatgtcaggcacttaggattcatctcatcgcccttaaagggtcttagtattaactcgtcgcccttaaagggtcttagcattaactcgtcgcccttaaagggtcttagcattaactcgtcgcccttaaagggacttagcattaactcatcgcccttaaagggacttagcattaacttgtcgcccttaaaggttcttatagtcgtgtga

SEQ ID NO: 13432 - DNA, 579 bp, Glycine max
  Peptide Sequence Number=SeqID_130210
atgcctctgcaaaatatcattgaggtggaagtcttcgattgttggggcattgaatttgttggtcttcttccctcatcttatggtaatgaatacatattgttggtcgttgattatgtttccaaatgggtagaggttgttgctactccaaaaaatgatgcaaagactgttgtcaagtttctaaaaaaggacatattttcacgctttggggtaccaaaagtcttgatcagtgacagcagctcacatttctgcaatgtccaacttcagaagggaattaaagaagatattggagaagattgtggcgtctacaaggaaggattaggccgccaaaggaagttgcaactgttggagctagaagagatgaggcttaatgcatatgacaagaagttgtacaagcagaagtccaaatggtctagacctctcactatcaaagaggtaaagccctatggagcagtggaattgatggatcctcagttagatcatctagagagaagttgggtggtgaatggtcagagattgaaactgtatcatggtggcaacattgagaggttaaccatcatcctacatctgcaagacccctag

SEQ ID NO: 13433 - DNA, 360 bp, Glycine max
  Peptide Sequence Number=SeqID_130211
atgtttttcggcgaaagcattgcatgtggtggcgataagggtgaattgtgtccgcttaagggtgtaatgaataggaagttgatgaaaaaggatttgatgttggaaggagaaggagttcaagaagttcatcttggcaatgtttatggtggcaccgtggatcaggacaacgatagtatttgggtggcaaaggttaatggtggtggtgctcacgatgtggtggtttcggtggttcttgggattgtggtagttggctgcacgctggttgtgggtgataatggtgtgtgcggcgtggtgataagttggggtggtgcatgtcaggtggtgacgaaggtggcattggcagtgcagagcagaaaatga

SEQ ID NO: 13434 - DNA, 1575 bp, Glycine max
  Peptide Sequence Number=SeqID_130212
atgttgggtgccacactaggcctagtgattctgtttacttcatcttcaggcatggaatttgttaacggtaaacagcagccaaagagcacatttacatgcttgaagttggttgccttaattgctctatacctcgtcttaatttctccagcagaatcatttgatccgttggatccaaccgggaacgtgacaataagatgggatataatgtcctggacatcagatggttatttggccactgtgacattgtttaacttccaactataccgcaatattatgaatcctgggtggacactagggtggacatgggcaaagaaggaaataatctgggccatgatgggagctcaagccacagaacaaggagattgtgcaaagttcaagttgaagattcctcatagctgcaagaggaaccctcaagtggttgacttgctacctggagctccttttaacacgcagttcacaaactgctgcaagggtggtgtgcttacatcttgggggcagaacccttcaggtgcagtctcagcatttcagataggtgttggcctctctggcacctctaacaagacagtcaaattgcccaaaaacttcaaattgctaggaccaggaccaggatactcatgtggcccagccaagattgttccatccactgccatcctcacagaagatcgtaggcgaaaaatgcaagcactgatgtcctggaatgtgacatgcacgtactcacagtttcttgcctccaagaatccaagctgttgtgtttctttgtcatctttctacagtgacaaagtcacaggttgcccaccttgtgcttgtggttgtcaaaataacgatacttgtgtcacgaaagattcaaagatcctgcaacagaatgtcacgtcacctcaccaaaaatcagacatcacactcacaccaaaaccattattacaatgcacacaccacctgtgtcatgtcagggtgcactggcatttgaaagacaactataaggactattggcgtgtcaagattgccatcatcaacttcaactatcggttgaatttcaccgattggtctcttgttgtgcagcaccctaatctcaataatgtcacccaagtctacagctttgaatacatgccacttcttccctatgaatccacaaatgacacaggcatgttctatggtttgaaatattacaatgatctgttgatggaagctgggcctaaagggaatgtgcagtctgaggtgctcatgaagaaggacaagaacacatttactctcaagcagggatgggcatttcctaggagggtctacttcaatggtgatgaatgtatgctgccacctcctgattcatatcctatgctgccaaactctgcccataaactaccaacaactattacattgatggcagcctatgtgaagaataaagaaggagacagtgttaggaatttccacatcgtctgtcttagttcttggggtgcagcttatatatctgttggaaaacttcacttagtgccaattggttttaagatgaaatctaacatggcatctgtggaggggggtattagaaagtcccacatcgcctgtctcagttcttggggtgcctaa

SEQ ID NO: 13435 - DNA, 903 bp, Glycine max
  Peptide Sequence Number=SeqID_130213
atggcatccaaaaagaagcgtgcatcatcctctcaaccccaagagccttatgatacctcaatatttgtctcagaaatagcttgggagcggtatgagacaaatatagatgtagccttggttaaggagttttactccaacttgtatgaccctgaagacctctcccccaagcaatgcaaagtaagggggaagacgatcaagttcgatgctgctacactgaacacatttttggagactccagtggtgctagagcctggcgagcgatacccagcctattcccgttactgctatacctacccaaatcatcaggtcattgcagccaaattatgcttgccagggcgggggtttgttttaaatgctgagagagccccttggaagcttctgaggaaggacctaaccactttagctcaaacttggagtgtcctttcctactccaaccttgctcccacctctcatgcctctgatcttaatatggacagagcaaggttggtttatggtctggtcatgaagatggatatggatttgggctccatgatctcaggacaaatctctcagaaccctgatgacccatcgattacttttctagggttccgcaaggccaaggccaaagctccatcagatgcaccaatccctccacctctagcaccagcaccaactctagcaggattatctggcccaggtggcttggctcggagtccaaccttcctttcttgggggggtgaagctcctgaggcccaggatgcacaggctcaggatgctgaggacactccagagacccaggatccagcacaagaggttgaagaggacacaggtgcagcgaaggcaggcatggacactaattatgtagtagatgtcaccgcaacacaggggacttgggacccatggcccacaccagcacaagattga

SEQ ID NO: 13436 - DNA, 189 bp, Glycine max
  Peptide Sequence Number=SeqID_130214
atggaaacaatgagacagccaatacctgtagaagagaaagtggagaaagaaaacagtaacaggagcaagactgctgcaaaggcaccacgagggacaacagatccaatggcaggtaacatgctcaagttcaagatctgcaccaaaaaaggagagagagcaaacagaggtttaggcctctcagctctctag

SEQ ID NO: 13437 - DNA, 423 bp, Glycine max
  Peptide Sequence Number=SeqID_130215
atggtgtgtgaaaacaaatatgcgaacgtgttggttcctcctacaggcctaaccagacagcattacagttacaacataccgaaaaaccaagttaccgcactccgtgtccagatatatgataaattagccctgtccaatcaattcccaactgaggatttagccttccattgtgaggaagctcctttttacaagtttaaagaagagaaattgaaaaagtacaaagtggtggggatgtctcctccacctctaaaaacctcacaatctctcaaaaactccttcaaagctcttcaagatgcctcatttggtctgcttagtcgcctctgggtccgcatactccaaaaactcccttctaattttgtgttttcaggttttatatggaaatcctattggtggcctctcgcggagcgccaatctcgcgcttag

SEQ ID NO: 13438 - DNA, 375 bp, Glycine max
  Peptide Sequence Number=SeqID_130216
atggtggtggtggggacttgtggcgccaatgtgatggctgctagtctaaggaggtcgcatgcaaaagtacctgggtggggggtggttgcgacattggtgggttccgtggtgttgggtgcagtcaatgtcaagggttgtcttgagcagatgacagcctgggcttgtggtgcacacaaaagaggtaggtggaggtgttgtttggtggggagtgatggcgacgcaataggggttgatggtggcagttgtgctgtttggttgcaagcttggaaggaaggaggtgatgactatggtattttgatttttgagagtggttgtttgtgtttgggaaatgagaaaggtttagggaagaaggtgaaaattagggttcatatataa

SEQ ID NO: 13439 - DNA, 312 bp, Glycine max
  Peptide Sequence Number=SeqID_130217
atgtggactagaatagtggtgccattttggaggtggtgcggctgcccttggggatggggtcgggaatgcctttcggggattgttggcgaaagcagttttgaagagctggttgaaattggagtacaggtttgggtcgtcggagacaacatcggatgtttcatcgcagaagaggttaagtttgggtgtgtgggtgttgagccattcgttgaaaggtttgagctttgggattataattggggttcgggtggtattggtgtcaacaattgtggtggagattgggattctgggcggtgggggaaggattttgggtga

SEQ ID NO: 13440 - DNA, 273 bp, Glycine max
  Peptide Sequence Number=SeqID_130218
atgaagaaaaccattgctttgaaggataaagatgatgctgaaaagaagaacatttatgtcaagactatagcttcagatgttacaaaaaatgaagaagagaagaatgatgatttcatgcaaaatcttcctcatgttgattttgaagccagtggcaaatccacaccttctcttcatatccccatttcaactgcacccatttcacaagttcctcctcaaccttcagcaacaatgactccctcttattcgactattcctgatacttttgatgaatag

SEQ ID NO: 13441 - DNA, 201 bp, Glycine max
  Peptide Sequence Number=SeqID_130219
atgatgtataggtgttgtagcgcactagtgaccttagatttggcaaaggaagccaactctatttgcctaagtaaaggttttgatggaagcgaagctgaaggtcatgaacaatgtcttcccgaggcgtgtgagaacattgccctaaaggatttatctgcgatatcccacacaaatcccctaagatacaataggaagctctaa

SEQ ID NO: 13442 - DNA, 216 bp, Glycine max
  Peptide Sequence Number=SeqID_130220
atggtggagaagggatggaaaaagggaatagaaaatgatagaagaaagaattccctatatgagagttctcaggctttggttgctggagtggacttgagtttgcgtactcgacgcttagcacaagtgtctgtatttgcgattagtgcaccattttctcgcttagtgcgggtgcctattttcgcactgagcgcaccctacacgctgagcgcgtcttag

SEQ ID NO: 13443 - DNA, 255 bp, Glycine max
  Peptide Sequence Number=SeqID_130221
atgtatttactcttttttagctttcgaagaagttacgaaaactcacggattgcgaaaaaaacacctcctttcgatttccgtcacattacggaattttcacggatcgtgtttggagtacctaaagcaattgttagtgatcaaggaacccatttttgcaacaggacagatatgaggtatatatttgtttctgttcattacatggatcgaaatgaggacttaaagttcgataactttgacatcaaaattgaaatttag

SEQ ID NO: 13444 - DNA, 372 bp, Glycine max
  Peptide Sequence Number=SeqID_130222
atggcaaagaccaaggataataataatagagtacatgcaaagagagagatagaggcctatgcaactgccaccgccttccggttccggggccaaccttgcccatgccaacaacaacaacaacaacaacaacaacaacaaggagcagcgtccccagcaccgccgcaaggacctcacgctgccgctgccgtagtgatacaccaacttggcggtgccacttcctctgctgccatcaacaaggcctgcggcggcagagagcggcgaagcgagccaacaagcggtgcagcagctgtgttcccctccatggacgttgcggcactcacaagtgggtgttctcctccctctgcaagtgtagccgctgtgatcttctactaa

SEQ ID NO: 13445 - DNA, 672 bp, Glycine max
  Peptide Sequence Number=SeqID_130223
atggcacgtgttgctgataaaataaaattgatagatggatcaagggaagctcttaagctttctgtaaggattactgatctttggttcattgggattctcggaaagactgaacaagccgaaatggtggttgttgattctgatggagacgaaatccatgttgtttgcaagcaggatctgctgaagtctcgcaaggctgatttgaaagaaaatttgagttatgtgatgcataattttaaagttatcaagaatgatgagaaattcagagtttgtgatcatgaatataaattatgttttactggagttaatgttgttaggcaatgtgatatgaaacagttaccttttaggaaattcagatttgttgttttttccagtgtcattgctggtcattttaaaattggactcttggttgatgaaaggtcgatcgttattctcttgactcatgctaggattaaggaagcacatggatcatatccggcatcggtcaataattctttcaaggcatctaaactcatgatcaatgacctcgtgctggaaatccaagaatttagagagagtcttttagatttagggatcgaggttagatcaattttgacgcctattggacaagggagttcacaggtttcagggtcatctcaattatcatcaaaagatgtgtttctgtcaaagaccaaa

SEQ ID NO: 13446 - DNA, 348 bp, Glycine max
  Peptide Sequence Number=SeqID_130224
atggcccacaccaagaaaactgggcaaatgacgtctgaggcagcaaaggaaattgttgacaagattgatgtactgactgctgccattgggcaaccaaaacaccctggtcatgtgcatgctgttggagtcggtgtcacgatcaagcaatactttagactggctccaaggacctcccgcacatcttcctccatggctcccgaagacctggagcaccagatgcagtcccagtttcagtctcagatgcaatcacaaggacttgaactgcctcctgagcccgaggttggtccttcagctgctcgtgtcagcacaaaggagacttgtgttgatccatcagggaacgatccttag

SEQ ID NO: 13447 - DNA, 384 bp, Glycine max
  Peptide Sequence Number=SeqID_130225
atggcacctccagactctattcctacagtagagcagtttaatgagatggtagtctggactgggacccaatcttctcttcataaggaagacaaaggtcccacagcccaggtacctcagcatatggaggatgagtcatctgaggccaccatcccaaagccatttgatataggagaagaggtagaagagacacaggtgagacaggtagctactaccattcctgagcgatcccttgaggctacttcagagcctttttcaccagtggtaaatttaccctcacctcagcctggagttgaaccctccactcctcttctacagatgctagaggacccaactacaccagtcctagctgtggacacttctccttccactactctagtgctttag

SEQ ID NO: 13448 - DNA, 507 bp, Glycine max
  Peptide Sequence Number=SeqID_130226
atgagtcatgtatatcatggaggtagatcacttgggagaaaaagtaaagttaggttcaatgtaagaaaagaaaaagagtctctcgagtgtctcttgatgagaaaacattgctacaagcacatagatatatgcttttcaatagcgaaaatgttgactcctttaaaaaagaatgcattgatcatattaagagacaaaatcattgactatcaccatatgaaactgacaaaattcacagtcaaacattttctaattggtttcatgaacaggttgcatgcttggaagagcaagaaaacaagtaacaggaacaaaagaagtcgccctgagtatgaagatctacattgtataggtaccaagaatctttcaaggtttattcatgagttattctatagaacaaagaatatgattgagacttcattgcttatattaggagaaaagataaaggaatgcaaccctcacgagctaaaatttatattgatactcggacttgatgagacagaagcattgtga

SEQ ID NO: 13449 - DNA, 441 bp, Glycine max
  Peptide Sequence Number=SeqID_130227
atgaaggctgacatggaggccatgaaagaccaaatggccgccatgatggaggccatgttgagcataaagaaaataatggaaagcaatgcagctacagttgccactacgagtatcgccactgaggtagacccgactcacccatcaagcctcaatcaagtaaatccttcaatcttggatatggtaggccagagaggagaagcattgggaaaatgtcaaaactccactcccatactcattgagagccaacaacctcaatctgatcatgtgcatgtctctcaacccatgggggagacacatgaattaccccaccacaatctagtcgacttcgagcctcgcctcagatacgccattgaggggcaagaagttggtggtggtgtacccctgccaaacactttggagggccctcaatttcgcccacaaccacaacccttgcattttact

SEQ ID NO: 13450 - DNA, 591 bp, Glycine max
  Peptide Sequence Number=SeqID_130228
atggagttcatccgctttggtgtcgtcagacccaccaccatcggtgccatagtcgatcttctggcacttcctctcattgaaaatctcggtcttcttgcgcttcctcaaatctttgaggacaccgaatcactctcttatttcacctctgttttcaaactccaaaacattaaaacccccaaatggccaaaccctcaacacaattggttagtgttgcaaaagcgaagccatttggcggtgtcgagctccttgtccttgaccttggcgatgaacgtgacggaaggggataagccgaggtcggagaggaggatgcggtggctggggaactccgcacggatccagtggatggcagtcaagcagaggctggagaaggacacctggggcttgctgttttcggggaggtgggcggcagcaatggtaagcggagccgacaagggtgcggagtgttgctgtatgagtgcagggcgtggaggcggagttggcatggacgacggagttcacatgagcgtatgtgtgaggagtgtcttagcaaaggaagaagatggaggtgtgggtgagtggtgttggctggtttccaacacagtaatgcgttga

SEQ ID NO: 13451 - DNA, 351 bp, Glycine max
  Peptide Sequence Number=SeqID_130229
atgggagcaataaaatgcagaaacaacacagcaaacaacaagggcatggcaagagaatacagaaacagagaagggagaaggaccaaggctaaaaagggaaattcgcaaaccatattacctcaaggacttcgtaagaaacgggacgggttcggggacagattcggggcgggtattgagaatcccatccccgaccccgaacccgaacccgaatttggctatcggggaaaacccgacgccgatccccaccccgaccccggtcaactcgaattttcctcgtcaaaatcgggacgggtccggggcgggccccgttgccatgcctactcgaatgctaggtatccctgtggttcttaa

SEQ ID NO: 13452 - DNA, 735 bp, Glycine max
  Peptide Sequence Number=SeqID_130230
atgttgtctcagaagcaaggagaggacgcaatagtcacaaacctcaaccagacagagcatgaaggtggcagcacaagcacaagggaagaaaaggagcaagaccattccatctgtgcttcaaatcaagttgctcaagtgctcttgacactaccatactcgttcgctcaacttggcatggtatcaggcatcttgcttcagatcttctatggccttattggaagctggactgcttatctagtcagtgtcctctacatagagtatcgcaccaggaaggaaaaggaaaacgtcagcttcaaaaaccatgttattcagtggttcgaggtccttaatgggttacttggtcgatattggaaagcagtggggctagccttcaattgtaccttcctcctatttggatctgtgatacagcttatagcatgtgcaagtaacatctactacataaacggacatggacatacatttttggagcatgctgtgcaaccatggtgttcataccttccttccacaattaccaaatctgcacacacaagaacacaacacagggggactgcaattagacaaggaggagacaagcactacccacaaagctcaaaggaaaacaagcaggaagatttcgtaaccaattctgctcctatgcaccgagctggtgggttctcatcggatagggaggatatcttgtctgccaggatcttcattctgttatcaattctgttattgcaccttaggacctgctga

SEQ ID NO: 13453 - DNA, 594 bp, Glycine max
  Peptide Sequence Number=SeqID_130231
atgcggagatacccgagtggttatccgtttaaactttcttttgctatctctaagactcaaagcctgatagcacgcagagaccaacatcgtcttcttcaccctttgtcaatcgcgaccaacaagcccgttgacacgcggagatttacgtcatcttccgcgcagacaatttctgtcatactgacactggagtcacgtgacatgcggagatacccgagtgagacaaattttgcgccctttatcattcaggaacaacaagctgagtgggtaaacgcgcaaagacagattctgcgccctttatcattcgggaacaagctgagtgggttccgctggcagggaggttcattggccgaatggtgtttcgctcgaacgaaattagtgtcttatctttacttcccttttatctccaataaaagacaagtaaagaggggcaactgtcataccctaatttcgtccggggagcatccgttgttaggatgcgaccctcatttgaccacttcgaggtacttgacacccatcgttaggcaattcgtgaagttctgtgatatgccagaagtcaaaagaaagaattgtagcacaatccgtgaagttccgtga

SEQ ID NO: 13454 - DNA, 171 bp, Glycine max
  Peptide Sequence Number=SeqID_130232
atgtgggctcagcgcgcatccactgctaagcgcagcttcagcgcgcttagtgtgacaagggaatctggaagaacacaagaatcaaggctcagtgcaagcccaaatccacttactagcgctaagtgtgagggtggcgctaagtgcgacgtcgcaatttcagagcctatttaa

SEQ ID NO: 13455 - DNA, 520 bp, Glycine max
  Peptide Sequence Number=SeqID_130233
ggttgatgtgttattggagtgccatgtcacttgtcacatgtattttgtgggacctggactgtacataagccccccaatctctgagccagcttgtgggcaaaagaggttgtctaatgtcaatggaggttatctagtgtcgagggcagtagccttgacaagtagaaggggtcacgagtttatcgagcccctaagcgtggacaagtgttgttcgatgtcgagggtggtaaccttgacagatccaaggtttgcaggtggtcgtacaactgccctagttaatgaggaccttggacaccatgaaattggcgaccacaatggagataatcatggggtcttcctcgtggatagggttgatgcccttgaagtctttatcaatggaaatgttgatgtcgatgtcctagatgacatggaggttcatgctcgtgtctttgctggtgatgcctttgtctccctctatcttatgctcgatccctccttctgtcgacatgttgattcctgtgctagtcctcatgttgtcctctag

SEQ ID NO: 13456 - DNA, 447 bp, Glycine max
  Peptide Sequence Number=SeqID_130234
atgccatggggaggaattcagaaggctgaccatgatcaactggaggctcgtgtgagtcgcccccaaggcgacgagcactttactcacacaatgcatgaacgtactcaagggaaatcataccccaaacacaccatcagcacccaagatgatcccagtctctcacacgtacaccgccatgaagaacggatgatttgtcgacatccctttgtcgactgcatcatggaagttgacatacccttaggttggaaaccgctcaacctagagaggtatgatggaaccatcgattcggatgaacatctagattcattcctcacccaggcgaatctttacaccaacaacgatgcagtcctatgttgcgttttcccaatgtccctcaaaggggcagtactaacatggtacgatggactccctccaaggtccaccaacaactttgacacctttgtctag

SEQ ID NO: 13457 - DNA, 270 bp, Glycine max
  Peptide Sequence Number=SeqID_130235
atggacaccccagtctcttgccgtgtccagtgtccgacacgacaccgacaccgacaccgacacgacaccgaggcccgtgtccgggttgaatttgatgtatttgacaggtggtcacgtgttcatgtccgtgtcatgttacctggagctgagattggggatggtgggacaaaagggggaggaggagaaaatggaggagacccaggacaaggatgcccgatgactgggccacataggtccaagttgttgttaaaactgcaagggaattgctag

SEQ ID NO: 13458 - DNA, 501 bp, Glycine max
  Peptide Sequence Number=SeqID_130236
atggcacaattcactgtactggaaaagtttacagatatatttattggatggccgccaatgtatggattgatgaagctggtgctctttgtctacttgtggtatcccaaaactaaagtccaatctttgtttttgctacaacaactttacaattattttatatgttcttggaaacctcaagataaaagaagcactattgtttcaactttcctctgtttgattgtagaaggaaatagtgccactggtgcaattgctggagtagttgtaggtgttgctttgttatttgttgctcctgcaattgtgtttgcttggtggcgtcaaaggaaaccacaggagtttttctttgatgtgcccgatgagctatcccatccaattcaattgaatactcggaagaggatcctgaagtacaccttgggcagcttaagaggttttcattatgagaactgcaagttgcaacagatactttcggcaataagaacattcttgaaggggaggatttggtaa

SEQ ID NO: 13459 - DNA, 123 bp, Glycine max
  Peptide Sequence Number=SeqID_130237
atggcgcttcaagctgaaaaacttttattacttgtgcagccctacgcttgttatttcatccacatcagaatcattgttcaatctctcatcaacaacacccataatatatcaatggagaagtga

SEQ ID NO: 13460 - DNA, 642 bp, Glycine max
  Peptide Sequence Number=SeqID_130238
atggtttcaaagttgtttgtagtggaaagacaattctttgaggacaaagaaaactctaagacagggagtattgataggtctgttataaaattaaggtctaatgtggaaggaaggcccaaacacctacaatatgtgaaagcatgtgtctcaatctgccctctgacgggggcgcgatccgagactcgatgggtgcgtcttccaaggaaggaaaatgcacggagttgtcaccaacgtttattcgaagaaaacgtcggaaaaaccaaaatggaaaaggtcgaaggtctgcgtattttgaaaatgagggttcaagagttttttatgcatggggaaggtattagcaccccacgtgtccgccacaaggaatcaatcacggatgcgattcggaagcgtttcagccttgttttctcttcattcttcttcctttctcttctttcttcttcctttctcttctttctggacctctggacctcacggaactcaggggccctttacttcagccttcctacgcctatttatagcaaaatgaggggaagaggttgcacagcagctcgcccaggcgagctggttgcttcagcattaagccttctagtgggcccaagggctgaaaaatgccccaaaagtgacccttttgccgctctttaa

SEQ ID NO: 13461 - DNA, 549 bp, Glycine max
  Peptide Sequence Number=SeqID_130239
atgaccttaacaccccctcgtgataagggcatagtgattgactctccaagaaaaagatgttctataaacttggagatgctagaaaagaaaaggaagaagttggaatatgaggttcttactcttttctttgacaaggagttgaaggagaaatttgacagaagctgggctgggaaaaaatggtttataggagatacattgatctccttgagatcaaatctctttaacattctccattttatcaagaataaaagactttatgatgattggttcaaggacaaagggctcagaaagaaaaagattgattcagggagttttgatgataacaaagatgatgacaaaaagctcaaaagtcaagatcacttcatgataacaaagatgatgacattcaagattgagttcaagattgagtcaagaacacttcaaggatcaaaagaaaatttgatttcaagaatcaagaatcaagattcaggattcaagaataatcaagatcaagatccaagactcaaagattcaagaatcaagagaagacttaatcaagataagtattaa

SEQ ID NO: 13462 - DNA, 351 bp, Glycine max
  Peptide Sequence Number=SeqID_130240
atggtaaagtatcttgtgaagttgcaaaccaaatttcgagaagatccatcgcttcacgaaggctgggaagcatttctaccgaggcagctacatgtagttttctctagaagcttcaggtgttacagagtcttgtctcttccttaccctaccctacatgtcactaacttcaaaagcccaacaacaaaaagtgacaaccaaccaatgaagcttaccttgacaccaacaacgataatagcaatgacctggctgcgagtgggagtgagaaagaagagtcccgacatggagaggaaaacctatgcgagcgacaccagagctgcgccagagacaaagatgtgctacagacgtgactga

SEQ ID NO: 13463 - DNA, 219 bp, Glycine max
  Peptide Sequence Number=SeqID_130241
atggtggatgatgcgaattcagttgtgctagaaggagaagccttgggattgcttcaagctctaaatttggcaattgaattggatatgtctcatgtagtctttgaaactgaatgcaagggattggtggacaaggtttatagctcaactcatgctacagaagctggttccattattaatgcatggctgcaatcgtatttgtccattgttccaaacttttga

SEQ ID NO: 13464 - DNA, 258 bp, Glycine max
  Peptide Sequence Number=SeqID_130242
atgaccatgattttcaagtcattcactatctttggaagacaattcctctttgtctaccttttttatcatcaacacatgatcaaggctaccaagcctatcaagtctacctttaatgttccttatgagatgctaatgaccttgatttttagaaattttggagtttctatggaggatgaacctagagatgatgaggttttttcttggggtgacaagaatgttgatgatttgaggttgaaccctcaagcaaggatatgttga

SEQ ID NO: 13465 - DNA, 1455 bp, Glycine max
  Peptide Sequence Number=SeqID_130243
atggggcatttgggtcagaatattttgaattatgaacttgaaaatggagtcaatatgtgttgtgatgaagactgttctaagaatgagatcaatacaactcttattcagtatgctgtgaaagacctattgacgggtcttggggaagacatcaacagggaaggcattataaagacacctcttcgtgttgccaaggcactttgtgatggaaccagaggtgactatcccttccttcacattttgcttactgataactactgtataaaggatcttaaaggatttctttcaagcaccaatcttgacaagaagggtcttattatcccaggttatagtcaaagtgcgaaggaaattgtggaaggtgcactattccctgaagctggcgtagacaacacaaaagttggtcatgcaggtggagtaggtgggcttgtgattgtgagagaccttgaattttattcctattgtgagtcttgcatgctaccattttattttaagtgtcatgtgggttatgtcccttctggccaaagagttttgggtttaagcaagctctctcgtgtgaccaatgtgtttgcaaaacgactccaagagcctcagcgtcttgcagatgaggtgtgttttgctttgcatcaaggaatagaaccagcaggtgttgctgtcgttcttcaatgcacacacatcaacattccagacacagtttttgacacaaatcacaaagggttggtggagacactagtttcttcagggtctggtgtttttgaaaacaaagatgcagacatgtggggtgatgtttttggtcttcttaagtttagaggaattgataaggataaagtacatgttaagggatcattagaccaatattggtgcccttctttgtcatccaagattggagaaatcaaccctattatggtcactgcagtatcttcaattctcaagtctttaggtgaggatccaacaagaaaggagttagtagggactccaagtagatatgtgaaatggctgatgaacttccaatattgcagtgacattgatgggaagctgaagctgaatggttccccttggagtggggaggtaaactttgatgagaaagaggtacactcagagctaaacttgcccttttggtcacaatgtgagcatcatctacttccatttcatggtgttgttcacataggatatttcatttccaaagggtgtcaccccattgaaaaatctcttttacagtcaatagtgcttttttatggttttaagcttcaagttcaggagaggctcaccaagcagatagcagaaactatttctccactgataggtggaaatgtgatagtagtagtggaagcaagtcacacatgtatggtttctagggggattgagaagtttggaagcaacacagctaccattgctgtattgggacgcttttcaattgaccttgctgcaaaaaccgcgtttttggagagtattccaaaatga

SEQ ID NO: 13466 - DNA, 243 bp, Glycine max
  Peptide Sequence Number=SeqID_130244
atgtcagtgacaaacctcgtcgagcgcctaggagtacatgacaagacaaaccacacactagcaagtcaagtcactctcactagttttaactcatcgccctttaagggtcttagcattaactcgtcgcccttaaagggacttagcattaactcgtcgcccttaaagggtcttagcattaactcatcgcccttaaagggacttagcattaactcgtcgcccttaaaggatcttatagtcgtgtga

SEQ ID NO: 13467 - DNA, 537 bp, Glycine max
  Peptide Sequence Number=SeqID_130245
atgcctgactacttgggcatcgccaatctagatagcattcctttccaatccctctcaatggatcaaaaccaatccttgattgcaaattttgatgagaaagaagtcaaagaagtcaagaaggctatttgggagtgcaagggatcaaaggcactgagacctgatgatcatttgaaagcttttggtccggcgcataaagtggcgacaaaggtggttgatgaggccaggagagagaggaaaaaacacattctctttaaagtggataacgaaaaagcttatgacttagtgagttgggagtttctctggtacatgctacagaggctagggttctgtgaaaaatgggtctcatggatcaaaggggaggccaagttacgaggtgaatttaaaggttttgagatgggtgaggacaaagtggtggttgatctagttttccaattggtgccggagattaggaaaatagcatgggtgagtggtaagggaatcgctagttactggtttcgagggaccagctcctccaagaagaagatagaggaaagatga

SEQ ID NO: 13468 - DNA, 411 bp, Glycine max
  Peptide Sequence Number=SeqID_130246
atgccagcccttagggatgaaggcattggcatagagggagagcccgctctggagggcctagagctcgcggatgcagaaggcggcggagagcgcgacgtcggtggggaacaatcgggggagcgcggcaagaaggaggcagagagttgggagagcgaggcggagacagagaggcatttatcctcgatggcagagtctctcacaaaccctccctcacaaaacccccctcaggccgtcgtcattgccattgctggtaaaaccccaaaccctttctccctttcttcctcatcgctcattacccctcagcccgtcgtctcctcctcaccataccccaaaacctcgagttcatgtgactgccgcaaacctgcaactacgctactccacgagtttgtgtttgtcacttcctcgatttag

SEQ ID NO: 13469 - DNA, 960 bp, Glycine max
  Peptide Sequence Number=SeqID_130247
atgaagaagttgtgttgtgttaaatataatactttgaaaaactcacaacatccagttgaaaatcagcatgccagttatggaaagcgtattatcttaccttcatcttttattggtagccgtaggtatatggatcaattgttctttgatggaatggccatatgtagcatggttggatttctggattttttcttaacattcacttgcaatccgtattggcctgagattcaatggtctatttcagctcttaaattaactgcagaggattggccagacatagtaacaagagattctaaactcaatctagaacaactaatgtctgacttaaaagatagaaaagttttaggcaatgtgcttgcatatatttacatgattgaattccaaaagagaggttttccatatgcctatatcttgttgtttctggatgttgccagcaagtatccatctcctgcagatattgatggcgtcatatcagttgagatgccagattctattgaacaaccacaactctatgagtatgtcaagaaacatatgatgtatggtccatgtggtcatgcaaacagaaagttgccatgcatgaaagatggaaagtgttctagatatttcccaaaaaaaaggcaagctgaaactgttgttgaccaagagggctatcctatttatagaaggtgtaatgatggtaaatatattgacaataatgacatagcactagacaatatatatgtgattcacaagagatcacctgctgttgaaaggttgtactttcatttgcctagcgataattcagtaatatttgaagatggtgatgacattgatgctttgttgtccaagccaaccattaaagagtccatgtttacctcttggctgcaagctaacaacatttcccaacaagcaaaagatcttacatatctgcaattcataacaatttacatacaccagcaaaataagatgttggaagccacgtaa

SEQ ID NO: 13470 - DNA, 690 bp, Glycine max
  Peptide Sequence Number=SeqID_130248
atggaacgtaagctcaactccattatggacattactgctcaaaatgagacttggaaaattagtgtacgtgtgattaacttgtgggttattcaaagggctgtaaggattaacattgaaatgattttgatggatgagaaggctaataagattgttgctcaaattaaaaatgttgatcatggtaagtggaatgatgttgttaaagtgggtaagacatatatgattagatcagagtcagctaagccttatgacttgcagtcaaaggaatgtgtttgtttgattgttgccacaataaccaagttcttagtgggcaatggttgtatatatgagagttgtcctaaatgtaacaagaaagtggaatgtgagaaatttccatacacttgtcaaggttgtggaaatgaaaatgcaacaactatggtcaggttttggttggaagtgagagttggacaactaaatgaaattgctaactttactttatgggatcgtgagtgcaatgcactcattaatgaaagtgcaagtgagattaaacaacagatgattgctcaggaaggtgaatttgatccaaaggacattccgaaggctattgataggatactgggcaaaaaattggcttttagatttaaggttatgccgaacaatacccgtgttcctaaacaatatgaaaaaggaaattcgaaatccttggcaatttga

SEQ ID NO: 13471 - DNA, 3240 bp, Glycine max
  Peptide Sequence Number=SeqID_130249
atggggtcctctgttaagcttgaggacgcaattctctggctcaccaatcaccaggtgtcccttagggaatctatgcagtccatgacccaaaaatttgatgaattgcttcttcgcatgccacccatgctttcctcaccgtcgtccatgatcccatccacctccactcttccacctgtccctgcaacacaccatcacatgaaattagacataccacgcttcaatgtcactgacccttttgggtgggccctccagactcatttcgcaccctctcattatgatgaccctacggggactcttttcaagctaactcagaagggcaccgtcgcacagtacttgtcagagtttgaggacttggccaatcgaattgttggtcttcctccccagttcctgttgagctgcttcattttggggctcatgcccgaaatccatcgagaggtgcaggcattgcagtctttgacgcttgttcaaacgactggccttgcccgcctccaggaggagaagctcctggacacttgtcaagccttctgtagtactctacttccttcgccgccacgaccattgccgactcttaagcacttgtcatcggaggaaattgcgtctcatcgcgaacgcaacctgtgttttaattgtgatgaaaaataccatagaggccaccgttgtgcctcttgggtttttctcttggttgcggatgaagacgacactgttggagataatatggagggtattgactcggctcctgacccacccgatatccacgacccatttttggcccaaatcagtttcaactcattagcgggttatttagccccggaaacgctccgccttttgggcatgctcgccggtcaccaagttgtcatcctcgtggacgttatggttggcaacgaccacacttggcatgcacccgatggtgcgaggcagtctctattgacattcaggcagttaccttcgtcgtggacctgtattgcaagagcgaatatagtgcttggtgtccaatggctcaaatcccttaggccggtgctcactgactacaacactatgtgtatgaagttctttcatggtggtcaactagttgaacttaaaggagatactgagcccaccttgaatttgttgacgcaaccgcaatttcggtggttgcttagaaaacagggaactagttgccattatcatattgtggtgctctcagatgaagcccactcggcccttagtacgactcctcatcctcctcgactccaggccttaataagtcactttggtgctttattccagccaccttcatccctccccccagtcaactctggtaaatgtgtgtctgtatcgaagggactcatccgccccagcaccagtccattttcctcaccggtgctgctcgttaggaagcaggatggctcctggagattttttgttgactacatggctttgaatgcgattacaggctatcatcaaattagaatgcattcggaggacatagttaagatagtgtttcgcacgcatcatggacattacgaattcaaggtcgcgccctttggattgtgtaatgctccttccttcttccaggcgacaatgaatgtgattttctggccgtacctccgacgctttatcatcgtcttctttgacgatatactgatttacaatgtgacctttgatgatcatgtggaatatcttggccattttgtctcccaaaagggagtcaaacttgttgcctcgacggtttataaaaggatatactacgattatggccccattggtcaaggcaaccatcgtggaaccatttcagtggacagctacagcccaaatagctttcgactgcccttcaccattgaaaccgatgctttaggagttggcttgggtgttgtcctattgcaacaaggccaccccatcgcttattacagtaagccgtttcccccgaagctccaacgatcctccacttatgtcctggaattgtttgcagttacgatggcggtcaagaagtggcgacaatacttgttgggccattgtttcaccatcatcactaaccaccacagcctcaaggagctgctaacacaggtcattcagaccccagagcagcacatgtaccttgctcgtttgatggggagttgcacacccaattggccaaagacccagagtatcaacaccaatgtcaggccatccaggactttctggccgcacactcggacttcacgctctccaataacattgtcctcaggaaaggccgcatttggcttccatgaaatttccctaattcccacgctcctcactgagtaccacgccactccgactggaggtcatttgggcaccaccaagacaatagcccgcttatcgaagaatttctactcggacggacttcgagaggatgtcaccaaatttgtcgctagttgcctcgattgccaacattcaaagtataagaccaaaaaggtgtccggattgctatgtcccctacctattcctcaccagccgtgggaggacctctccttagatttcatcatcggcctaccaccttaccatggaaacactgttgtcctagtggtcgttgactatttttctaagggcatccatttgggcatgctaccaccttctcacatggctcatctcagtggaacccagttacacatgagttctgcgtatcacccacaaagtgatggacaaacaaaggtcttgaatctcgtgatcgagcagtaccttcgcgcttctgttcatcaccgaccaagctcttggggaaaattattgttgtgggtggaatggtctcataacacatcatggaatgcagaatacatcaccgggatttcgaaggtggatgtcgttgacgatatgctggtcaaccacgaggagacattccgtgccatccgtaagaaacttctcaaggcacaaactctcatgaagcaatatgctaacaccaaacgtagggaggtcgaataccagcccagggactgggttatgctcaagttctcgaacgagttggccaggttgcctatcgcctacaacttcccgagggagcatgcattcacccggtgttccactggtctctctcccaatgagacgtcttgggaagattggtcgcaattacgccaagactatcaccttgaggataaggtgatttcgcaaaggccgcagaatgatagagaaacaaaggtgcaaggagtagctagcagtgggcctagtgaagtaatgaacacaggggtgcagctagaagaaaaaccaaagagaataattaccaagcctgcatacctgaaagactatgtgtga

SEQ ID NO: 13472 - DNA, 264 bp, Glycine max
  Peptide Sequence Number=SeqID_130250
atgaagaatgagtcatccaagactaccactccaaagcccttggtcagaaggaagaaggcagatgaaacacaagaagctgtagccacttctaagaaatctcttgaggccacatctaagccttcagaaccagtggcagatacaacttcacctcagcaggcagcagacccttccactgctgaggatcatactacaccagtcctgtctccgaacacctctcctacggctacccttgtgcttcacttaacagacgaggaggatgtttag

SEQ ID NO: 13473 - DNA, 363 bp, Glycine max
  Peptide Sequence Number=SeqID_130251
atgacgccaaaagttaaaggaatggagattttaaaacgttgtttccgcgtgttaccactactgcaaaagcgccttttcacgtcctggtatctacatcggttatcaaaaaccgatttggcgaagaagcgagccgacaacctcgctctgatcgacgagtccggagcggtggcggctctgattccgctgctctggtgcagcgattcgtggacgcaggaacacgcggtgaaagcgttgctgaacctgtctcttttggaagagaacaaggcgcttataacgaatgcgggtgcggtgaagtcgctaatatacgtgctgaaaagagggacgaagacttcgaagcagaacgcggtgttagtttcttgttga

SEQ ID NO: 13474 - DNA, 1169 bp, Glycine max
  Peptide Sequence Number=SeqID_130252
tgcctgagatcgaaggcatgattgctgccaccagattgagttcactgatcaggtgttctgttatcaccactgatcctggactcatatccgccttcgtcgagaggtggcattgcgagactagcacgttctacctgccagtaggcaagttgacgatcacgctggatggcgtggcatcactcctacacgttcccatcactggcacgctgcctaagttcgagccgctggttacttcagatgtgattggtctactaacggagcttcttaaggtcagtcatgaggaggctacagctgagacccaacaggctggtgggcctcatgtccgattggggtggctttgggacttgtatgagagccagtgcagggctagacgatgggttgtagcagcccgcacggacttggcccaggcagggggattcgcctggggagcaactgcattggtccacatgtacgagcatctaaacgacgcgtcgcaggcctctacacggtggcttacgggtaaggctcatatgacgaggatcaagggagccccgtatcagagacgtatggatgccctgactatgactgacgtgtgctggatgccctatgctgagcaccggggagtcaggggctttgacctgatatcatcgtacaccggccagctcagatggggtcaaattgtcatgtacgttcgacctgagcaggttcttcgacagtttggctaccttcagacgatccctctgccgccggtttgtggttctttggcgggtggaaatatagatgaccggtggctgcatttttcagaccatttggtgcctgcaggggagctctgtgtagttcctgggcaggtggcgccaaactacatggagtggttttttcggatttcgcacccgttcgtcacacggaccgaggagactgctgagccgagacatccgcctccccctcatgatgaggagttcatcgagccacccatccccgaggtttcagtcacgtccgatctccctacgcattcagtggttgactgcaaaggatgtcaagggatggctgaggatttaggagcgattgctaaggatttggagtgggtcatcaacctcaggatggtcactgaagacaatgacttatatgacatcatgacttgttgtctgaggagagctagaggtgacgccgcagatggaagtcttaggccgcgatag

SEQ ID NO: 13475 - DNA, 186 bp, Glycine max
  Peptide Sequence Number=SeqID_130253
atgatctggaagacaactaggaaccttatctctcagatcattgaagctcagaagactatcatggttagaacacacggtttaggtcgtgtgttaggagctggtagaggtagaggcattagtgaggatgcgcatcaagctgatgttcctcggcgtcgcaggcctactacttcagcacgtaggcaatag

SEQ ID NO: 13476 - DNA, 1140 bp, Glycine max
  Peptide Sequence Number=SeqID_130254
atgggttccccagtaaaggggggccacgaagccgtgcaccaaccccacatgcagtgcccagcagcccagcgcacccgaaggaggcagcagcttggatgtgccgtccttccccggcagacacactactaccgcaccctcggtgcgtggccttgtgggtgtcttcaaatgtcttcttccgattgcagtcccatacaaaccagctgcaaacagattattgccttccttgcactcggaccatgcacgccatgcgaagcacaggatcccaccatgaaacgacggatcgtcccagaggctgtctcggcgccagagcggctcacatgccagtctgtaaatgatttgcgcccgctgcagattcaagggactcgctcagagggcggagcggtgccggcaggcagcaaatgtgcaggcttagagcggagggaggatggaaacagtgaaggggacagcggggaagagaaggaggcttcacctagtgcatgcaggaactgctgttgtgcgctttgcttcgcactgtgtgcaggaaatgacaacatgactgctcaacccttgcatgaatgctggctgatcaagagccggaggcatgggtcggagcactacatcgcagtgacagtagctcgagaccttttctctgatggtgccccaggagacagccttgaagagcgattagatgctcttgagtgcttctatgatgaggaacacttttggcttgaaagccatatggacaccctggcggccaaagttgagccattcggcctgttgattccctgtgcacatttgtttgggtgtttgagcactgatggttctcctgtggttctcctgtgtacagtcccggatgcattgagcataaatgctatctttgatacacctgacatggtatctttgcttgcctatgagatctttcagctgaagggcaagattaaggagaaacagaaaggtatgtcactctggcggcctaagccgctgtggggctgcacagcaaagatagtgtggtggccgtggtcaggttttgatcattctgcgtcgggacactctgttgttcccccaccagctggagtagatgacctcaagactgccatagcacacctaggaggtcccaagtttccggactacgagctgttcccatccctacatgatgactag

SEQ ID NO: 13477 - DNA, 2316 bp, Glycine max
  Peptide Sequence Number=SeqID_130255
atgtcggagactcttggatgtttgcctgctgcacttctattgttcgcatcccatgcaagtccattgcagcttgtgagtcatctgccgggagtaggtacagtcattgcacacctcgcatgcaaagcgggagtccgaacgccaggcaatgtggtggtcaggggcagtgatgttgccagaacgctgaatgcgcaggtagatgaacgccttgtgcagggcttcagcatgtcaattgccggcgaggccttggaaggaggaggccttgggccatgcaggtgtccaattgcggccagggacttgcagcaggaaggcagccaggcacagcagagtaatgctgcactgagcacaatgcacagtcttccgcagttattgggaggctggaaattcgcacaggagtgtttcatgtacatcactgaccaagggtgccattcaggtggaacttccatcaagcttaagcttgtactttcgaattcgaacgctggaatttttgccttgcttggcaaacacttgcgtatccctgtgtctgacgctgacgatgacgggatactccccagcgatcagaatacccgtgaaaagctggtatcagatgtcctaaaatgtacagatgagcccaagtcatctgaagcacacctcataatcaagcgcaaaatggacaatgagaaacacttcggcttcgcaattccgcaattgcatggatccatgcaacttaggggtcgagatgaaatattcagcagccgtccatggaagccttcacagagcgagcacggaatgcagaccagacaggagcgttccatcaaacttccgggtgcgggcttgtggcaggcaaccaagaatgctctgccagtggggcacttgcgcactttgtgccagaagcacccattcgagccgaagatgggaccacaaaacagcacagcctgcgaattgtgctgttgcactgtgtgcgactttgaggcaagcatctgcacgaaatggggacagcccgatgcacaggggtgtctgaattggaccactgtaatgcccacccacactggagggaacattacgcaacggagcacgggtttactaattcctgtattgcactcggcattcatctctgatgtttccggaatgcacatcatgctcgtggcacatctctggactggtgcacattgcaaggacggccagagcgcgccaatgccggctgcccacttcccggcaattaataggccccaagcaggcacgccacaacagccagctggagctgcccttgagcccagggctgcgccaggagggaaggagccggccgccttgggcggcactaaggacggcgctaggcagaagccggcgcccactcaattggacacctgctatgcatcatcgcttaccatactagaagctgatgcgcgcactgcggcgcaggttggctacaccatcggtcacccaaggggcctcaaaaaaatttgcctcgaagatcagcctcaacccttgaggagcgggaagaaattgttgtttgccaatccacctctggagaaaatgagcgcccggaaaatctattgcaagactgcaacaaggcagggccatgatggagaaaccttacagtcaatgccagaaggcatcaagcctctcgtaggcgcgacaagcagcaatgatggacgtgtcagccctgtattaagcacacgagctgggtctcctcttgcccacgctgatgctcccaagaagaaacctgaggatcccgtgcgtgggcgagaggttgaccattctgtggtggtccccgaggacgagcctgcccatgggccactacgcgcatgggtcagcttcaaccagcaaggtggacctgcaccggcggagccgttggcggcgggcctagcacttgtggcacgcacatcgcctgccaatcaaagctctgcaacaatggccttgccaggcgcaggggaacgaccaggcacttttggctggccatggccaagcatacatttcacaaaacctgaaggcctatacaccttagacacgtttctagggacgtgccaattggtgtacacctcctgtcaagcaatctacatgtactttggtgccgcgtccggctatggcaaacaatttaatgaaacggacgagtgtaaatttgtggttaaggccttctctacagcaatcttgaagccaatggaagggtttctagcactaaagatcaacaaaattgtgaacgggattgttcaagccttgacagttgctgccttcctagcattcgcttttggtggctacacaacttggggaaaggcaattttttatgtgcttggcagcattgcatgtatcaatgctgctatgggcaagaacggggcttactag

SEQ ID NO: 13478 - DNA, 1161 bp, Glycine max
  Peptide Sequence Number=SeqID_130256
atgggaccttctcctgggacacaaagagatttggtaatgctctgcatgatgcatcctcgtgtagcacatgaagcttactctcatgaccggagacagtccctgcctgctgtatctcactgcaaaacatggaggtcatgcacgctgattgacttgtgtgtgtgctcaggtgtggcccttctgatggcagagatcatgcccaatgagttgctgtattcggaggccatccaaaagttctgcaactggtacatcccgcctctgcgctctgtgcctcacacagccaacggcctcgcgtttccttacaagctcatgacacgaggctattgtgcacctggatcaggcgactccttggagttggttgaaaggcagattacccggggttgcatgcaggggtggggagcgctgcgctatgcaagcaacgccgctgcgatgacattgttttatgcagaaatgctgatggcccagccctccccttcaaagaatgtgactgcatacgctgcccagctcttcaactaccccttggtgcgagaacatgccagcagctgtcatgcatcccgaggccaatgcgtgcatgtgcaggggaagtcgcagatagactttgcattgggcagcacggggcaaagctacctggttggctttggcaagaactctcccaagagccccttccagaagaatgcttggaactcctggctcaactacaagccaggcaccgcaacagaaggtcagatcaggaatgactttcttgcctcaccacagcccaacaggtggcatatggggcgatggtgggtggccccatggacatcaaagggacagcctatcaggactccagggaccaaaccttcaggcatgttctgccctgaattcttctacacgcagacttgcccacataaaaaaattaccgcgtgtgtggtgtggtgtgcatcaaataggtacacagagcccgcgatcgactacagcagcggcctcattttggccctgtcagcacttgtgaactaccacaccggcctggggccttacaacgaatgcggcctggattttggctacgccttcccgggcgcgcctgcaccgccaaacgccctcgtggccgcctgcggactcaactctatcgctgccggccaccgcactgtcctcaatgtgtcagctgtgttgcctgtggggggctga

SEQ ID NO: 13479 - DNA, 150 bp, Glycine max
  Peptide Sequence Number=SeqID_130257
atggaaagggttcctagcactaaggatcaacggaattgtgaatgggattgttcaggctttgacagctgcggccttgctggcattcgcttttggtggctacacgacatggggaaaggcgctgttttatgtgctaggccagctttgcgttaa

SEQ ID NO: 13480 - DNA, 215 bp, Glycine max
  Peptide Sequence Number=SeqID_130258
gctttgacagctgcggccttgctggcattcgcttttggtggctacacgacatggggaaaggcgctgttttatgtgctaggcagctttgcgttaatctatgctgctatgggcaagaacgggcccgggggcttactggcagatgtcatcaaaagccccttggcgctcagagaggaacgccaaaagcaggaggcggcaaggcagaagctgctcagtga

SEQ ID NO: 13481 - DNA, 203 bp, Glycine max
  Peptide Sequence Number=SeqID_130259
atgcctaaatcatctcccaacatgcatgtgaagcaagaagtatcaacaagagtcaagccaaggctattgtgcaagcaatcaatggggcaaaacacaccgaataaaatagatgattgtcatactctaatttcgtccggagaccattgtctggtggcatgcaaccttcgcttgaccgcctcgaggtacttaacacccatcgttag

SEQ ID NO: 13482 - DNA, 201 bp, Glycine max
  Peptide Sequence Number=SeqID_130260
gccacttcagagcctcctgcactagtggtggacctaccctcacctcagcatacagcagacccctccactcctatgttagagataccaaccacaccggtcctggctatggacacatctcctccagctactccagtacttcatctgaaagatgaggaggatgttcagacaaagaacacccaggaccagtcacaggaattctaa

SEQ ID NO: 13483 - DNA, 249 bp, Glycine max
  Peptide Sequence Number=SeqID_130261
atggctttcatgacgccgccgtcatcctcatgctcattcaccagactatttccagtaaggacaacatcaacaacattgtcgcaacctacccttttgcgggcgagcgaggcgaggctcacggatgcgtcttccataggaggaaaatgtgcggagtcgccaccaacgtttattgaaaggaaaacgttagaaaaaccaaaggaaaccggtcatgaagaatattccagatccaggagttatctttacgtttga

SEQ ID NO: 13484 - DNA, 1473 bp, Glycine max
  Peptide Sequence Number=SeqID_130262
atgcagatatggtcgtcgaccctccattcccctattgcgagacatgagaagtggaaaaaggctaggacaaacaaatttgggcaaatgacatctacagcagctcaagaaattgcagacaaaattgatgaattacaagaacaagctaaacaaggagctttagtcccacatggtcgtcaagacatcctgaacactgccattggccgtccagagcatcctggacgtgttcgtgttggtggacatggtgtgaccataaccagctactttggacatgcttcctgtgcgtcccacagttcttcgcctgcgatcaccgccgaaagattggttgaaatcatacaaactattaagcaagaagtgaagaaagaggtagaagatgagaacaaagactgtatggacaagatgaaaatggagttggatgcgatcaagactgaattatcccaaattcatacgcaacagtcagctcccccaagaccgtctaaccctgacatatttgttgcacgtgttagcacgaaagagagttgtgctgaagctgctaataatgttgttggtaacgagcggtctacatttgatacatgtagtatgggcttatacattgtttgtggtgacagtacacagctggtggcagggggaaaggtctttggagtaggtggcacgatacacactgttgcttatggagatgatgtactaagggtgtgtgttgacactgtatacgatggtgaagccattgtcccgttacctacttcagagattcagtatgtcagggacgtcgtgaactcattcattggatggcctagacatctagtgaaacctttatcttatgattcagaccttaatgtgcggaagccagatgaacatagtagtgatgcaaagcttgcaggtgaatccgatccattgggagagttgatgaagatattgttttatgtgtaccaaaatccagtggaagtgtcgtgggaggcgagccaatttggacttcctgatattggggcaaaattttacatcacacatgtagatctagcggaaataatatcagctaatcagtcactgtatggttttctggagcctcaatctatgcaaaatgctaaggaaagacgtcaacaatgccaacaatacattgaaacatggttcaaggaatcacaaaggcagttgtatttaggagcttacttgcatcagaagaagcctgatatttacatcaaaggcgcaattaacagtgcaataaagacaataaccaattcttttcaaggcatgtctaatcaaggtgcacctaggtgggttgaacccaagagtaatgttcaaagtggagggtttgagtgcggatattatgtgatgcattggatgtggtgcatcgtgactgcgagtttgaaggatgactggcacaagtggttttttgatggatcaccgttagacgtagaggccatcacaacagttcggcagaaatgggcaacttactttttaacttttaggaaaagcagttgctaa

SEQ ID NO: 13485 - DNA, 387 bp, Glycine max
  Peptide Sequence Number=SeqID_130263
atggtgggggagagaaagaaaacacaaaagcaggggcatgagaatgaaaacgaagaagcaggggcatggaagaaccaacaaccacaaaggcgcacaacgaatacaaaccaaaacataatacaatacacaatagctaaggagaaggattcactaacctcgaaggcgatcaagaaggcgaaagcaccacagcaacaagaacaaaagccaccagcagcaacaagaacaaaagccaccagcagcaaccatggaagcagttcgtacgaaattttaaccctttcactcacgttgttgggtgccccaaacaacacccttagcttcactgtctacatcatccatgccctagcccagatgctcacttatagagatgcctcagccagacagaattga

SEQ ID NO: 13486 - DNA, 363 bp, Glycine max
  Peptide Sequence Number=SeqID_130264
atggacccagagaagtccaatagagcactgggaaaaatattgcatgccaaggcaagcacaacagcagtaggaggagttccagcagcagctgactcaggatgcaccgccaccacctctacggcagccaccacctctggattccatctcttctcacctgtagaagatagagctccagatgcacacgtgcaactgaatgagaccttctaccggtacaccctgcaccaacagagccaagaccccagtcctttcctgtggcctacccccgagcagttcggggccacagttgcatggcctggagatgagcccgattttcagacaggggtaggacccataggggcccctggagacaaggatggagcttag

SEQ ID NO: 13487 - DNA, 204 bp, Glycine max
  Peptide Sequence Number=SeqID_130265
atggtggaagcttcacccttagaaccaacccttagaaataagttatcttcttcgtcttctaatgaggcgtcatctttagattgctcctcagataactcattagcttttagagcttttggtgcaatcatatgtggtcttcactcagtggaaccttcatatgatacagtaaaagtgtcccacatttctttgatgcttttgatataa

SEQ ID NO: 13488 - DNA, 612 bp, Glycine max
  Peptide Sequence Number=SeqID_130266
atgcttattccccggataccgtcattgcttcttctccgggaaaagaagttcatgacccgtaggcctttctaccttcacgcggcattgctccgtcaggctttcgcccattgcggaaaattccccactgctgcctcccgtaggagtctgggccgtgtctcagtcccagtgtggctgatcatcctctcggaccagctactgatcatcgccttgacgcgagcccctcctcgggcggattcctccttttgctcctcagcctacggggtattagcagccgtttccagctgttgttcccctcccaagggtaggttcttacgcgttactcacccgtccgccactggaaacaccacttcccgtccgacttgcatgtacaaagctgattcggaattctcttccattccaaggcataacttgtatccaggcgcttcatattcgactggagttcgctcccagaaatatagcccccccacccctcgtgtaatcccacgagcctcttatccattctcaattattattcgatcacggcatacaaatagaaaaacttacattgggtttagggataatcaggctcgaactgataacttccaccacgtcaaggtgacactctaccgctga

SEQ ID NO: 13489 - DNA, 177 bp, Glycine max
  Peptide Sequence Number=SeqID_130267
atggccggcgaagtaaaaaccaaaggcaatgcaacttactccttcgacaactacgtcacgaccatcttgcatttgccatggctctggcccttatcccatgtcagaatactagcggatggcggtggcatagtcgttgttggagaaatttttacattaattatgattgaaattgattaa

SEQ ID NO: 13490 - DNA, 498 bp, Glycine max
  Peptide Sequence Number=SeqID_130268
atgggtgaaatagaggaggtacaagagcagatgatggccgacatggaggccatgaaagagcaaatggccacaatgatggaggccatgatgagcatgaagaagatattggaggtcaatgcggctgcagtttcagctaccagcaccgttgctgaggtgtacctgactccctcatctggcctcaaccaaataaatcatccaacctcaaatatggtaggtcaggcgggcaaagaattgggaagtatgggcggtccccattttgtgcaagttcaaaacaagcatgccttcccgccatatggcttgcctcccaactatacaccacccaatgtagcgcacactcccgatgagaatgtcaataactccactcctatactcattgagagccaacaacctcaatctgatcatgcacatgtctctcaaccaatgcgggaggcacatgaaataccccaccacaatctagccgactttgagtcttgcctcggatatgccactgaggggtaa

SEQ ID NO: 13491 - DNA, 321 bp, Glycine max
  Peptide Sequence Number=SeqID_130269
atgggacaagggtgcaacgaaaggaactggactatttttagaggacactacaatatcacaaaatcaacacaaattggaacattagcagttgtaacactaggcattatctcggaagaaagcgcaaacgagaacaaagagaaaaagaaattgctggtaaagagaggcaaagtgagcactggatgcagaggaaggggaggggaaagagagaaaaagaagggcaaggggaaggaggactcaaaagggcaaggtgaacgaggacagagaaaaagaccacacgacctgcacacctgcccaaaatcctcacccttacttcatttttag

SEQ ID NO: 13492 - DNA, 648 bp, Glycine max
  Peptide Sequence Number=SeqID_130270
atggtgatcccggcgcttaacctggcggtggtgagttttgtcagcatgatgctcaccgcccgcagctttgccgccaaaaacggttatgaggtgaacgccgacgccgagtttcgcgcgctggggctggtgaatatcgtctctgcgctgtcgcaagtttattccggtggcgggattgggcgtggtgctgatgtatgcggcctggtcgctgctggacatccgtggcatctggatcttgcgccgccgcaacgcgcaggcgttccgcctggcgctgtttacctttctcagcgtgctgctggtaggggtgatcagcggcatcgggctggcggtgttactggggctgatgcagtttctgcgcactgtcttccggccgacggaacagctgctgggcgtcaacgacgaaggcatgatccattccatgggcaacaacaatggggtgaaggcggtgcccggcgtcatgatgtatcgtttcaattcgccgctgacctatttcaacgtggcgtacttcaaacgccgtattctcaatttggtcgacggcacgccgttccagccgcgttgggtggtggtggacgcggtggccagttttacccatgccgatatcagcgtgctggcggccatcgacgaactgaaacgcgatctgttacagcgtaa

SEQ ID NO: 13493 - DNA, 606 bp, Glycine max
  Peptide Sequence Number=SeqID_130271
atggctcaggtagctgcctcacgatccattcaaagcacccctttgtgccccacttctggatctgcacgtgacagagcccaaaacctgttaaagcctccatcttttgcttccaaggtgtttccttttgtagggaacaacaacaaacgctccaaactcagcctcagaggccttcagatcagtgcaaggaaatcagccccttctgaagtcatccccgtgtcacccgaagatgatccaaagattgaggagcatttgcaacatttacgtggggtgcagccatttggtgagaactctgttggtatgtggtctaagcccacgtttaggcgcaaaacgaagatagtgtgtactattggaccttctaccaatacgagggaaatgatttggaagctggctgaggctggcatgaatgttgctcggttgaatatgtctcatggagaccatgcttctcatcagaaagttattgacttggttaaggaatataatgcttctcatggagacaatgtgattgcaatcatgcttgacacaaagggctgtgttgctcttgtatatttgctttgtaacaattttgtattggacataaggtcgatagtttcctcaacaatggtttaa

SEQ ID NO: 13494 - DNA, 1066 bp, Glycine max
  Peptide Sequence Number=SeqID_130272
tgggaagaagaggatgatcctgcattacaactagatccaccagacgaggttgagacagctggtgaccccagtttgcaagatcatcatttgtcttataatgctttaaaaggctcatcaggtcttggaataatgaagtttcaaggatcaataaatggattgggagtgcagattctactagatagtgggagttcagataacttcctccagcctagactagctcaatgcctgaagttacctgtagaaccaattcctaatttgcaggttttggttgtaaatggaaatgccttgactgctgaaggattaattcaagacttggaggtgaaaatccaaggtcatacactaaagctaccagtttacctacttccagtttctggtgctgatctagtgcttggggctgcatggttggcaacaattgggcctgatctttctgattatagtactctgacattgaagttttacttgggtatcaatttatcaccttacatggcgagagaccctccctaccacaacaggcttaatttaatcacacgagaagaatgcagcatacgcgtgccattgcagaactgtttactttacaatactcaagtctttgatgtgccatcagctgacatgctcaaggaagggattattgcccctagcagaagccctttttcacctccaatcattcttgtcaagaagaaggatggcacttggagattttgtacagattacagggccttgaatgccatcacaatcaaagatagctttcctattcccactgttgatgaactaattgatgaactacatggggcagtatatttctcaaagcttgatttgagatttgctttcaggacacatcaagggcattatgaatggcttgtcatgccatttgggctcactaatgcccctgctacatttcagtctctcatgaatgagatcaattacttgggccacacagtatcaggcaagggagtaacaatggatcaagaaaaggttcaagcagtcctgaattggccatatcctataaatctgaagcaattgagaggcttcctccgtctgactggatactacagcaaacttatcaaag

SEQ ID NO: 13495 - DNA, 285 bp, Glycine max
  Peptide Sequence Number=SeqID_130273
atgttaacatctttacttataccagagcccccaaagctaatcagccgaaagtattatactgttaaaggatcaagggcagtccttagctcccgtgcttataatggtcctgaagttaggagtggggatttgccacaaccaattacattaatgcctggtcaggaattcacttttactattcagagaggtgttggaactgctgattgtgttagtgtgaactacgatgattttgtcaatgatgtggaagtgggggacatgcttcttgtcgatggtatggttatcaactga

SEQ ID NO: 13496 - DNA, 243 bp, Glycine max
  Peptide Sequence Number=SeqID_130274
atggcatttgggaacatggcagctcgcccaggcgagctcatgcttactcctgaagtaactggctcgcccaggcgagctggttccttaagcctgaagcagtttggggacccaggcgagccagaggctagcctgggcgagctggggtccagaaaactcattgaaaagacccttttgcccctcccttttgtaactggtgtcgaacaacaccgttcagctagcgagaatcaaaacatcaatgaatga

SEQ ID NO: 13497 - DNA, 168 bp, Glycine max
  Peptide Sequence Number=SeqID_130275
atgggtttaaagatagaaagattgatgcacatcattgtcagtcctgagcaagcggtggtggatgaggttgagaagaaggtggtgaacttcccttggttctttttaaaatcttgcacatgggcaaacactggacatgatatcatgcctaaatgcagtgagatagagtga

SEQ ID NO: 13498 - DNA, 4188 bp, Glycine max
  Peptide Sequence Number=SeqID_130276
atggctcaccctcctccaaacacaccagatcccgtcgctgagcttacacgtcaggttgctctcctctccacccaggtcgagcagatgcgcaaacagatgaacgatcccgcttccacggtgtcttcttcttctaccgtcgattctgcaaatcgacctcgcatgaagctcgatgtacctcgttttgacggctccaatgctcacgggtggatcttcaagatctcccaattttttacttaccatcagacgttggaggaggatcgtatcacaatagcgtcgttttacctcgacggcccagcccttgcgtggtatcaatggatgcaccggaatcaacaaattgtgtcgtggacgcaatttctcacggcgttaaagactcgttttgctctaacggcctacgatgaccctcggggaaagctctttaagctcacccagtccaccaccgtagctgcttacttgacggagtttgaagcactggcgaatcgcttggaggggctctcaccagcagatttgctgagttgttttatatccggcctcaagaccgagatacgccgtgaaattccggcattccgaccgttttgtctttctcaggcggccgatccatcggcgccacccaaaatcactgcgggattgctccctactcctccagggaaacctcgtttccggcatctctctgggccagagatggatgaacgcaaggagaaagggctttgttttaattgcgaccaacgctggtcacgcaatcataagtgtggtgcccgtatattcctcatgcttactaatgatgataatgatgttgtaacaggtgatttggactctgcggtggctcaactcgattccgggaatgtcgaggttgtctcggaggctgctcagttaagtttgcacgccctctccagcgaccaggccggagacacattccgggtccaaggcatcatcggatcccactctgttagcgtgctggttgaaggagggagtacacataattttatcagaggttctgttgttgataaattgggattgtctcttgatccaatcacctcctttcgcgttatggtgggcagtggccaagtcctcctctgttctcatgcttgtagggaagtaactgtgttaattcaaggtcacaaattttgcttggatttgtttgttctggacttgcgtggaacagatctcgtgttgggggtccaatggcttaaacacatcgggcttgtactgatgaattattccaccatgtcactcaccttcctttataataattccaccatagaattgcatggcgacaccaccccccactctatgagccttcactcctttaacaaactaacccgaattgaaccagaggcccaacttttttccttccacatctccaacccagatactaacctgatacacccacccccaaatactggacctgaaccaattcccacccttcccgacttagccacccttgagccccaagtgcaaactataatcacccaatactctcatctcttctctgaaccttctgctctcccccctcctagaatcactgaccacaccatccctttggctcctcatgcttcaccagtcaaggtgcaaccctaccgttacccacattcacaaaaacatgaaattgaaaaacaggtggctaagctcattagtacaggctggattcaacccaacacgagtcccttttcctcaccggtcttgttacttaagaagaaagacggctcttggcgtatgtgtgtcgactatcgatctcttaatgcaatcactgttcgtgaccgttttcctttacctacaattgacgaattgttggatgagttgggcaaagctcgtgtgttttccaagcttgatttgacctcgggttttcatcagattagagtggcaccagaggatttacacaagacgatgttttgcactcacgacggacactatgagtatcgagtaatgccgttcggtctttgcaacgctccgtccactttccaagccattatgaatgacatttttcgttctctgcttcgcaagactgtgattgtgttttttgacgacatcctggtattcagttcttctatggatgaacatgcggggcatctctctcaggtattctctatccttaacactcatcagttccatcttaggccctctaagtgctcctttgggcagaggcaaattgcctatcttggccatattgtagctgatgggacagtggctcctgaccctagtaagattcaaggggttattgattggcccactcctaagtccactaagagcttgcacgtgtttttgggcttatctgggttttatcgtcgttttgtgaagggatatgctagcattgctcacccccttacttccttattaaagaaaaattcttttgaatggtctgttggtgctcaggatgcatttgaggcattaaaattggctttaacttctgctccgatactatcattgcctgactttaacattccttttgtgatacaatctgatgcgtctggttatgctatgggtgcagtgttgttgcagaacaatcaccctatagcttattttagtaagttgttttgtcctcggatggccagggcatctacttatctccgggaattacatgctattacttgtgcagtgaagcgttggcgtcagtatctgttgggaaattttttcattatccaaacggatcaccggagcctcaaagaattactcacacaagtcatccaaacacctgagcagcagctttatttgtcaaaattattgggctatcattatgaaatccattatcgttccgggaagagcaatgttgtagctgatgctctttctcggggccctgagattcctacggctgaattgcagttattgtctactcctcagtttcttttcattgaggaattgcgccaagaattagctgctgatgtgccttatcaggatctatgtcgcaaggttcttgctgagcctttgagtttccctgagtacactttgcagaatggtctattattgaggaagggcagaatctgggttcctagtaactcacgttttaaattgttgctaatgaaagaatttcatgaaaccttgattggtggccatgtaggggttgttaagaatttgaagcgcctctcagctaacttctattgggactccatgcgcaaggatatcaaggcgtttatcgctaattgtcttgtctgtcagcagacaaaatatgtccctgccaaaccaggggggctgccactctctggagggtattctgtgttgtttgtagtggttgatcggttctccaaatatgtgcatttgggtgccttacctgctcattatacggcgtacaaagtggctgagctatttgtccagttagtttgtaagcaccatggactacctcgcagcattgtttctgaccgtgacccggtcttcatcagcaaattctggactgatttgttcaaattcagtggcactttacttagaatgagttctgcctatcttccacagtccgacgggcaaactgaggttaccaaccggacaattgagcaatatctgcgtgcctttgtgcatcacaaaccatctttgtggcaccgctatttaccttgggctgaatatcactacaacacgtccttccattcctcggcgggaatgcctccttatgagatcgtgtatgggaaaccacctcccaccttcccttgctatgtgcaaggctcttctgcgattgctgctactgacgaattactggccactcgtgaggaaatgctagctctattgcggaggaacttggccaaagatcaagcaagaatgaagactttcactgacagcaagcgcagggaagtttcctttgaaccaaatgcttggcgtgttggcgttgtggcttacaaattggagctcccttcatattcaaagattcacaatgtgtttcattgttctctcttgaaaccttaccatggcccccttcctccaccggttgagctgttacctcctgatgcagttgataattgtccattactttctccacttactgtcattgattctcgttctgtgcaagtaaatggacaggagcgtacacaagtactggacaaggttgttcttgatggggtaagtattgatacagctgtggatactagaggtgctgatagtaacattgatgctgctaatccagacacttccagcccgttagagcagcctactacaaggcccaagcgtactattcagctaccaaacaagtatcaagactatatcacttacaaatga

SEQ ID NO: 13499 - DNA, 126 bp, Glycine max
  Peptide Sequence Number=SeqID_130277
atggagcatccagtaaatcatcaaaatatggagatatgcatagaagatcaaaccgatttatcctcgattgtgaggagtactgaatcgaagctcaggttgtcttccaagggaatagtgcaaggatga

SEQ ID NO: 13500 - DNA, 405 bp, Glycine max
  Peptide Sequence Number=SeqID_130278
atggagcctaatgaaagagtttggggggcacttcttagttcgtgtcgggtgtactccaacatggatattgggagtttagctgctgacaaactacttcagttggctcctgaggaatcgggtgacacgtaccatccacagtcaaaggagatatatgaagagctaagtgtgctgatggggaagatgaaagagttaggttatgtgcccgagactgattctgcccttcatgatgaggaagaggaggataaagaatgccatccagctgttcacagcgagaagttagctattgtgtttgctattttgaagactcaagaatctcctatgagaattaccaaaaacctccgtgtttgtggagattgtcatattgctgccaagcttatctcccaagatatatatagttcaacgtga

SEQ ID NO: 13501 - DNA, 360 bp, Glycine max
  Peptide Sequence Number=SeqID_130279
atctatatttacaaatggagaaatgtgaaatggaacccgatgcaatcacttgtgctagtgttcttcaagcatgtggggattcatgaatatgttgagagaaagaagctatgtccaaatctgcttacggagaattcactgatagatatgtatgctgggtgtggaagtcttgaagatgcaaaaagagtgtttgacagaatgaagtttcgcaatgttgcatcatggacttcattgatatctgcctatggtatgactggacaaggctataatgctgtggcattcttcactgaaatgcaaaattcaggccaagattcagattctattgcctttgttgcaactctctcagcttgtagccattcgtga

SEQ ID NO: 13502 - DNA, 246 bp, Glycine max
  Peptide Sequence Number=SeqID_130280
atggttatgggagatttcatcagcagactctccttccccgcatgtttgcattttagtggagaaaacaccgagactttttcaagtctcacaagttatccagaactacgtaggtctgagttcctcattggaggatacgtaggagcaagagcctcgcttttgtcgaccacaccgccttttgttgccatgactcaagagctggtagcccgcggagaccccttacggttatccgcactcgtcattcagtga

SEQ ID NO: 13503 - DNA, 285 bp, Glycine max
  Peptide Sequence Number=SeqID_130281
atggtgcccatgtttcatacgttgtatgttgtgtattttttcatgaggaaaaatacttgtactggggggcatgtcactcggtgtgaaactcccttgagactcaggctgatccccgtggggggggggggagttgcctatgcacgacagggtgactttgacacttactgcctagttttcctaagtgagagtgtcgtgtggacacgcttaggctatttccttagggatggtaccacattgcatttgagagttgaggtcagctgcatgtatcataccgagcatgattaa

SEQ ID NO: 13504 - DNA, 219 bp, Glycine max
  Peptide Sequence Number=SeqID_130282
gacggtgtggaggacactgtctgtgagaaatatggcatcagcaaggaaaaatgggctcagttttgccagactcacagaaacccttcttgggaggttgtgcgcaaaaaggcacaggccatccagaagcaaaacattgcccttcacgttttgtctggaagtcttattatgctctttcaacaccctattcttggtcatttttgggttactttctttgactaa

SEQ ID NO: 13505 - DNA, 231 bp, Glycine max
  Peptide Sequence Number=SeqID_130283
atgggcgaaagcctgacggagcaatgccgcgtgaaggtagaaggcctacgggtcatgaacttcttttcccggagaagaagcaatgacgcagccgcggtaagacagaggatgcaagcgttatccggaatgattgggcgtaaagcgtctgtaggtggctttttaagttcgccgtcaaatcccagggctcaaccctggacaggcggtggaaactaccaagctggagtacggtag

SEQ ID NO: 13506 - DNA, 555 bp, Glycine max
  Peptide Sequence Number=SeqID_130284
atggaatacagaacgttggaacttaacctcacatcagcaaaggtcttaaaagatgtaaaccgtccatcatgggaagaagaagacctcttctcggagatggggctatacgtcgtcgtctcactccccggcaataatgaagagttcaagactccggtggaccgaagcggcggcactgaccccgaatggaattttccgatcaaattcaccttcgaagaatcgctgctgcagcaggaccgcttgaccctccaaatgaagctttgctacgaccatcacaccgagacccacatcatcggcgaggtccatgtctcgcttagccagctcgtcgacctaaatactcctgaaaacctattctttaaccacgtcagttacttgctcagagaacagtcctccggatgccctaagggaatcttggacttcttctacaaattcggcgaaaagtttacgtctcgggtgaagaattttccgacgccgagtcccggggcacggtaccctcggccgcggcgggaccttctgcaacatgtagttgagttcgggtgccttcctcccaaggattaa

SEQ ID NO: 13507 - DNA, 528 bp, Glycine max
  Peptide Sequence Number=SeqID_130285
atgcttgttaataagactttgtgttggtgtgagaattctgtcacaacctttggccccaaaaataggaacgaaatctgccacaaccttatgggttatgcatatggtagtagcttcataaacccctcgctcgaacccacaaaaccccctacactgctcttggaagtgtggatcgaagagaaccctacatacactcttggtactagggtgctgaaacacttgtgggtgctcaaagctcaaagctttctccgcgagtattgttgtatgaggtacgaggaaagcttcaagtttcgtgccattttgttagatctcactgccattgtcactatttgggttcgagggtctgagcagaaagttggtccatctattgtctgtgttgctttttctagtttcttcggcaattttcaggatagcaataactccggtaaggctacctactttgctgcttttgttcctctgagttgtaggcaattgatgaatactaaagaaatgcagagaaaatgcttgactctttctcatcatgctgagtaa

SEQ ID NO: 13508 - DNA, 208 bp, Glycine max
  Peptide Sequence Number=SeqID_130286
attgttcaaggttttgatatcagggtattggtctaaaactttgcccagaagctccaaagaaagaactgggtttttagggacaccaatgattttcgaattgaagaagccaaagcttagagtgagattgagagtgaaatcaaaattaaaccaaaaactcacagctaaatggcaaaagaacgagaaatttgtgttgttaacgttacgataa

SEQ ID NO: 13509 - DNA, 123 bp, Glycine max
  Peptide Sequence Number=SeqID_130287
atgggaggagttgctgttaaggatccatctgctccccatggagttcgacttttgatcgaggactatccttatgcttctgatgggctagagatatgggatgctatcaagtctaaaggatattga

SEQ ID NO: 13510 - DNA, 387 bp, Glycine max
  Peptide Sequence Number=SeqID_130288
atggaagggaaaaagtttattatgtttatcgcttatttattagaggttgcagtagcacaaaagcataaagcaaagagggtggagagtgtcaatgttgatgcagaagcctttggtgatcactgggaaagttcagattgctctatgcattctgaagctgaagcactagaacatatgaagaaaagaaatagaggccatcaaagtttgttattggagaataagacaggagattcaactgtggtcaagatgagtcagaaaaataataatgttgatgccggcaactgcatgactcttgaagaccatgaaggagaagagcattgttgtggcaaaggaacaaatgcgaggagtgtttcttttttgccaagaagccaagagaagataggagattaa

SEQ ID NO: 13511 - DNA, 299 bp, Glycine max
  Peptide Sequence Number=SeqID_130289
atggctactaggatcatagaaagcttggtaaaaatcagtgaaacatattctctaatctttgatctgctctacggattcaacagcttcaatgataatgtacaagtgctagaaatgaaactagaagagttatgcagcctagaatatgacataaacaaagagcttgaaattgcagagctacagcaaggcaagaaaagaaaacgagaagttgaaaattggcagagaaatgttcaaaggaagaaaattgaagtctatggcatagttcaggaattgagggactgtggagtgtttaagcatctaaa

SEQ ID NO: 13512 - DNA, 1824 bp, Glycine max
  Peptide Sequence Number=SeqID_130290
atggcagcgctgtcctccactgtcactctggccgccaaatcgctctcactaccccaaaatcaccgtgccaaagtagcggcagcgttccactctcccaagcgccacctcaagagaacggaattcaagttcttcaccaatggcttagctgcctctctccgctctcttcgccgcctctacgcttcctccaacgacgcccgcttcaattccggtcccgaggagagcttgcaagaacagtcgtcaagttttgctgagttcatcacttccgagagagtcaaagtggtggccatgctggctctcgctctctgcaatgccgatcgcgttgtcatgtcggtggccatcgtgccgctgtccctcgccaatgggtggagccgagccttcgctagaatcgtccagcatgcagacgaggtcttccatctcgggggagactttgcggggtttcatgataccacagattttgcgggctggcttagacgactgagagacggtgcaacagctaacgaaaatggtgcacaacccagcagaaaaaggcctcgtcctcatgaaagtgtgggtttctgcattagcttagcaaataacactgtgatcatggaatacaaaacgcttgaactcaacatcacatcagcaaaggacctgagagatgtcaactccaagaagatggacgtatatgccattgtctcactctctagcaattatcaaaagatcagaacttttgtgaacaaaaatggtggctccagccccacatggaattttcctgtcaatttcactttcgaacaaccggtcgaccgcgtgatcccttgccgctcatccaccaaatcagtggcgacggaaaatccttcacattcgtctcctaccagaccagagatcaagcctctaaggaacccaagaacggggtttctaggaggaacgcttgctggggttctctttgtggaaataatgtctgtcttaggtgtggaaaatgtttggccttggaaccctaacatgaacttggtgcttgctcttgaggacatggattgtgttatggacgaggttttggaagtgtttggtaaattttccataagggttcatcgactgctgtcaaggataattgatatagggattatgggggtcataaatgtttctgagtgccccaaaattgtgaggattgatgagaaagacattcatgaactactaagagtaagggatggtggtgtctccgagaagaaaaatttggatacggtgatcactgaccaatgggaggtgtttgatgatgatctgatagttgatgttattggtagtgcctccaatgagttctacacctatggagatgttgtagtgtgtagaaacttcttgatggataatgtggaagcaatgccttccaaggttattttgatgatgccaaagaatcaagagttaagcaaagtttcaagcaaagattcaagaatcaagtttcaagattcaagactcaagaatcaagtttcaagaatcaagatcaagattcaagactcaagattcaagaatcaagaagaagactcaggtacatcctttgtgctaaaagtaaagggtacatctacttgggttgttgtaactgagaacaagagaaggtacatctcttgtggatcagttcaagtggagggtacatccactaggttgttcaaagagaataagggagggtacatcccttgtggatctttgcttgtaaaggattttacaaggttgaaagaaatctcaagaaccggtggttgcttggggactggatgtaggcacgggttgttgccgaaccagtataaaattcttgtgtttgtcttcttcttccttacactctttaatttccgctatgcactttaa

SEQ ID NO: 13513 - DNA, 909 bp, Glycine max
  Peptide Sequence Number=SeqID_130291
atggaagcaagttcgtatgcatcagttgtttggagtattatgtatgctcagatctatactcgaccaaacataagctttgcagctggaatgttaggaagatatctaagtaacctgggaatggaacattggaaagctgcaaagaaggaatcaaagtgcactgaagagaagtctcactatgggcaaagtattgatggttgtggtggtggtgacaatggtgatggtggtaaatacctgtgtccaagtggtggaggaggggagattgtacatttcttggaggaattccatgcaaatagtgtttttcctaaaggcactaattcttcatttatctctcttatttctaagattgatatccaacaaaatcttggggactatagacccatctctttggttggttgcatgtacaaaattgtttctaaaatcttggctagtagaatgaaaagggtgttgggaaagattattgatctgagacaaagtgcttttatgggtgatagaaatttacttcatagtgtagtggtggaaaatgagggggctacatcaaggagaccctttgacaccttttatctttacgttggtggtagatggtccaagggtcttatgagagacgctctacaaaagaacttgttcaaaggatacaaagtgggggatggggaggtggaagtgagtttattgcaatatgcaaatgatactattttcactaaggaagcttctttggcaaatgtaaaaaccatcaaatgtacactttggtgctttgaacttgcttccggtcttaaaataaactttggaaaaagtaacttcatggctttgggggttgaaaattgtgtggaggagaaattcacgggtttattgaattgcaacttgatgaaattgccatttgtgtatcttagagttccaattggagcaaacccatga

SEQ ID NO: 13514 - DNA, 285 bp, Glycine max
  Peptide Sequence Number=SeqID_130292
atgacgatagtcatgacggcaatcatggtgttagtggtggtgactgtaatggtaacaacaatcatgttggtggttgcgatggttgatgatcatgatggtgattacgatgacaatcatgataattatgacagaaatggtcataacaatgatgatggtcatgaacaagattattgcaaacgagaatataaggtacgatgctcaaagaatccacaaaagggttatagtactggtggtgttaggatatgggacgcggttatgccttttttctatggaaggatatggtag

SEQ ID NO: 13515 - DNA, 573 bp, Glycine max
  Peptide Sequence Number=SeqID_130293
atgaagagcaaagaaggagtgaggagggtttgggaatgtagatgggaagagggttgtcggggaaacagagaagaggttgaattggagagggagaagttctatcgtttgaaggccaagaaaaagatgatttccccaaatctagaagttagaattagatataagcttgaaaagtcttttattttaacttataattctaaaggccaagcaaaaggaaacttggagctaagaaaatttgatgtagcaaaatcccctccagaaactatcattgtttaccatggaaagaactatgtagaaccggaagtaatgccacctccaaatacattatcaaaagtgaaggccttggagaaatataggtatgagcagtcccttgaacatactagccagttcattgaaaggttggagaaagggcttgaagagtatcatcaacaccttgcaaagtttaaaaatgggaaaaatgatattgctaaagatgttaatttagctggattagggaagcatgactctatctatactggacacaaaatgccgcatacaagaggcttagacaacctgattttgtttgctattgagtaa

SEQ ID NO: 13516 - DNA, 519 bp, Glycine max
  Peptide Sequence Number=SeqID_130294
atgttgggagcgtttttggtgctcacaaggggtgtgctcagagaaggtggacacgcagggagggaggtggtaggtggcgaagtcaagattggagttaccagaattgggaaagagagagaaaagatgggtcacccgagagaggcctacgaggcattacgagagaaaaagctcgccgtgggtcaagaccagagagctacaagtacaccaggggcaacaaagcacttaggcggggtcagggcaagggcagcacgtcacagaagttctcagcttaatcttatcagagctatatcttgggtgcgtgatatggtgggactgtctagcacagacaccccaagcatccctgaattacaacatctaacggaggcaacgcaaatcggggaaccgacaagttcttccacagaagttatcatacaaaaaaggagagagatgagtgtgctgcgaaaagagaaggagaaggagaagggaagcggaggaagtgtgaagaaatgccaggaaggaagtttttcagaaggattttaa

SEQ ID NO: 13517 - DNA, 144 bp, Glycine max
  Peptide Sequence Number=SeqID_130295
atggatgaacaattgaggatactaaaagtcattgttgtgcaaggcaaaaaattagtgatccgggattcaagagcagtgacccttatgttgttgtcaagctggggaatcagacaacaaagaccagggtcattcattgttgcttga

SEQ ID NO: 13518 - DNA, 171 bp, Glycine max
  Peptide Sequence Number=SeqID_130296
atggttgcaagaacaagaaaggcactcactcactcagtccttcattcactctctaaagccgtcactcactcaccgtacacgttgtgccctcactcagatcgtgcccttcgtcagtcgctggccgtcaaaggtgtctcccatgccaccccgcagtcattgtcatcgttgaag

SEQ ID NO: 13519 - DNA, 654 bp, Glycine max
  Peptide Sequence Number=SeqID_130297
atggaagctaacatatccctaggttggaaaccactcaacctagagaggaacaatggaaccactaatctagatgaacatctggacacatttctcacccaggcgaatctctacaccgatgacgatgcaatcctgtgtcgtgtctttccaacatccctcaaatgggcaacattaacttggtatggaggacttcctccaaggcccatcgatagcatgaacgagttgtgcgaacgagccaagggctacatccaaatggaggagatgtctaggttcaaaaatgaggtccgacaagacaaatcaaagcgtgacaagagagaaggaggtaccgataaagctacctccgctacttcctcccaggccgagggagacaaagacaccattagcaaagatgtgatcaacaacctcagtaaaaatgaacccgtccaacaaatcagcggtgtaatcaacaccattgcaggcggattctcctatggaagtgatgtagctccatgtggagcttgtaggccttggattttcttcatcaatgaagtcctttgtttcttaaagtttgatgacagcggaatggagaaggagaatgatgattggagacgccactttaatgagaagatgagtctagaagaaactcaccaccataggaagtcgtggataagagcttga

SEQ ID NO: 13520 - DNA, 585 bp, Glycine max
  Peptide Sequence Number=SeqID_130298
atggtgctgttatctgataatcacagtttgtctcatcatgggttgtctcaatgcattaacaacgctgaaaaagaaaataagtttgagaaagagtttcaaccagatccaaaagatgaagctaatactagtgagtctttaaatgctactgttccataccctattgctgatccagtctggaggggaagtttgcgcatctctgacccaagttttggtactgtcattggtcttctggcccatgtgtccactttagcaagccccaaagttctggaggagacaagatttttccctgatgtgctttgcccagacttgcgcccaagaactgcggtgtggccaaagtctttcatgaaatgtggaccaaatatggatagcattgctctttatttttttcctgatagtgaaagagttgagagggcctttcacaagctggtagaggacatgatgtactttgacctttccttaagaacagaggttgaaaatgcagagcttctaatttttccttctatattactccctattcaatgccgaagatttcaagaaaagtactacttgtggggtgtcttcagagcaaagaaaccatcactgtaa

SEQ ID NO: 13521 - DNA, 537 bp, Glycine max
  Peptide Sequence Number=SeqID_130299
atgaaacttaaagcacatactattctcatgtccatgttgttgacttcgataggaatcaagtatgaaggctcaaacaccaaccctttgcagcattcaagtccaattaagatgcttttcatcacagctatatgttgtcatgtccttggacacactgctgaaatgagcttgccaaccactattttcatattccatgtttctgggattgttggacgtcaagcactgatgtggattctcgtggctgagttattatggtggtacatcatcaacttgcttcttttactggtggcctcattttgcttcaactacaagcatgttattgagatcatctgtggtggcatgggtgatatcatgacaaatttggaagcacatgaagctcagatggagaaaaaggaatcgcatgaagacagtacaagtggaggcttcaatctcttctccgtctctaacgttagagaattctattggagcagtcagaggaaaaactggaggaatatcaggaaaccgctagagatgccgcaattgttgtcgaaagacacgtga

SEQ ID NO: 13522 - DNA, 273 bp, Glycine max
  Peptide Sequence Number=SeqID_130300
atgttctgtttgttccagcatatcacaacagttggaggattgagatgctatgagaatccaaagaataagattactgcagtacctgccgaggaagagcaaatatggggtgcattcatcaagaacagagaatcagtgatcggtcccaacagtaatataaggttaatgtcagttgagactgcattaggtacaaagggaaaatgtgaggtaatcttagagcttaagaagttagagttgaacatccattatgtaactaggattggcagttgcaactaa

SEQ ID NO: 13523 - DNA, 513 bp, Glycine max
  Peptide Sequence Number=SeqID_130301
atggaaccctctagaatgtctatgatgaatttatggcattgctcatattttgaaccatatattccctatgaggaacataaacaaactgaaatctctttttcagaaaaaaatttcctttcccaaaaactccttaaagcagttgaaaaatgggaagaagacaagaagtgtcaaggacaaagtttcgtaaataatgaaacagatcctgatgacactgatgaagatgatgaatatgttttcagacaaaaattattctcatcaatagataaagaaaattcagatacaaaaagtattgaggatttacttgagaagattgatttacatgaattttatgaaaaagaaatcaacttcaaaaatactttagaaattaattccaagattgatgaaacagaatcactagtttcatttcctgaatcttataaaggtctcatggctgatgcttctggtcatgtatccaccagccaagacatgatagcaagagctgaaacatatctaggagatatagctagagcctaa

SEQ ID NO: 13524 - DNA, 225 bp, Glycine max
  Peptide Sequence Number=SeqID_130302
gatcacttcttagttactgcattttcatgtttatttgattcgggtacgacctcgatcaaccctactccagatcagtttagggctgaggtcacatggcccgaagattggcccgagacccaggcaggggaggcgcctgcagaggctcccggcgatgcagaggaggcccgcatggatgaggagatgacggatttgcttggtttcttgggagggagcggagccacatga

SEQ ID NO: 13525 - DNA, 384 bp, Glycine max
  Peptide Sequence Number=SeqID_130303
atggaattgtacattgatgatgtagtagttaagtcaatcgatataaaccaacatctagctgatttagagccagctttgcagaaattgagattttgtgggatttttggtacatcaaaagggattaaagttgataaaaacaaggcaataacagtgttggaggctagcccacctagaaacaagaaagaactacaaagcctcactggtaagattaatttcttacgaagattcatagctaattcggctgccaaaccacaagttctagtgtcgcttatactagggaagcctttgaagttgtgcatatcgactgcaaataggtctattggatgtcttctagcacaatatgcaaaagatggaatcgaaagagcaatttattatcttagctaa

SEQ ID NO: 13526 - DNA, 1080 bp, Glycine max
  Peptide Sequence Number=SeqID_130304
gaattggaggcaagaaaggtgcatgttggggagaattcggcttcctctatgtctagaaatctagaagtgaggaatcaagcaactctgccgaatacgacatcaacaagaatgtctaacacagtccaaccaattgggaaccaaatggggtttatccttagagccttggtagctattatgagttatatgcctgtcaatgttggtaatttgtttgccactacctttggggggcaagcagatgaaaatgattatgctaatcaagttgttcctacacatgtcgtaaacaaaagagttaataatggagagccctcatatgtcaatagtgatgtgggtctcggggcaaatgttgtgggtcatgacaattacctgccactaaggactaccatgacacttttaattgatctagaattgctagctgaaaccatgaagaagtattttgacattcaccagaaaccaatgaagaggtgtaccttttcttggtactcaaatttgccaccttattcagtacaaagatgggcagacatggagaaacttcacagaaatgttggaagatgttgttcaatgcagtttccagaagtggaatgtgcaaccatgactgttgggaatatgcatcctcggttgaaagaaaaactggtggctcaagaatatggagatctcagtcaactagcttccaaggccaatcaaatagatcaaaaggtctttcaaaaggaagttgagatcatggctgctgagatattgtgggggaaaccttattcatgtccagtgttaaagctagggaagaataaagagtttgctggggatgtaaaattgaaggctttgaaagaaggccactttaagctagccaataagggaacaactggaatggctgtagatacagatcctttttcaaaactaaatattaatatggtcttctatgagaagcctaccaccaaaaagaaagaagatgaagcaaaaggcacctctaaagggtcaacatatcaaattactggtcctaagttagtcgatatgcgaaaagccttgagaaggaaggaagaatccatggagtttgagaaattgaggaagcaaatccatggcaacatatag

SEQ ID NO: 13527 - DNA, 1014 bp, Glycine max
  Peptide Sequence Number=SeqID_130305
atgttgggaggcaacaacggaaattgcttgcttcctgttttcttggacgaaactcaatttcagcatcaaactaatgtgtcaaatcaattgcagttgtttggaaatttacaagctggatgtagtgttgacccagttaattactttggaaatgagcatatcagctccatgattcagcctaataaacgaagcaaggaaatggaagatatatcaaaacaaaggcttcagatttccttaaactacaatgttcatcaagatgatgctgaacgattagcaagtattccaaatcctaaccccgtgtcaacaggattgaggctttcatatgatgatgatgagcgtaactcatctgttacttctgcaagtggaagcatggctgccacaccgtctatcatattgtctcttggtgacaatatcagaactgagcttgataggcagcaagaagagttggaccagtatgttaaacttcagaaggaacaactgtcaaagggagtgagagacatgaagcaaaagcacatggctgctctccttacctccattgagaaaggtattagcacgaagctaaaggaaaaagacgtggagatagaaaacatgaaccgaaaaaatagggagctggctgaaagaataaagcaggtggctgttgaagtgcaaagctggcattacagagcaaagtataatgagtcaattgtcaatactttaaggaacaaccttcagcaggcaatctcacaaggagctgaacaggggaaggaagggtttggagacagtgaagttgatgatgatgcctcatatatagatcctaataacttcctgaacattctggctgcgcctataaactctactcacaagagctaccaagatatggagaatctgacttgtagagcatgcaaggtgaagacagtttcgatgttgttgatgccttgtaggcacctgtgcttgtgtaaggattgtgagggatttatcaatgtttgtcctatatgccaattgataaaaactgcaagtgttgaggtgcatctgtcttaa

SEQ ID NO: 13528 - DNA, 1596 bp, Glycine max
  Peptide Sequence Number=SeqID_130306
atgggttcagaaggtgatgatagctctcccagtgactatgattggaacactgatgatgagcttgaggtgtttggaatacctccctcggatccaaccatttctagtcaagagagctgtgaagatagtgtgggggagagtagtgcaagttgctcgagcgctaaacattccaagctgattcatctcttcgtgggaatgggattttccagagagacagtgatcaaagcaattgatgaaaatggaagagataatgaggaggacattatggaagctctgctaacacttactgctgaaaaacccttaacagtagagaaagatgaggcattgtccgtacttgtcaatatgggatacccttttgaggaggctttgacagctatagacaaatgtggtcctaaggcccatatcagtgagctagcggatttcattagtgcttctcagttagaaaagggtcttcactcaccgcaagagtcacctaacaataaacatgatgcatctgattatacgcatgaaaagccctgtcaaccaagtggtgaatattatcttcatacaagtaagaaagtaaaacttggattgggtatatttaatgaagccagtcaagtgatttcaagaaagttcccaagagaagtagcaaataaaccatacttctattttgaaaacgtggctcttgctcctaaaggagtttggaaaactatatcacgttttctttatgagattgaaccagaatatgttgattccaaatacttttgtgctgcaacaagaaaaagaggatatatccataatcttcccacccacaaccgctcccccctgcttcctatcccaccactaactatccaagaggcttttcctacaactaaaaaatggtggccttcatgggatagaagaacaaagctcaattgccttctaactagagtagcccctggcccagttacagagagaataaggaaactccttgagaaatttggtgatgaacctcctctacatgtccaagaaaatgtacttgtagagattagaaagtggaacttggtgtgggttggaaaaaacaaattggcacctcttgaacctgatgaatatgagatgttgctgggattcccaagggatcacaccagaggtggtggagtcacccggacagagagatacaagtcacttggaaatgcatttcaggttaatacagttgcctaccacctttcagtgttgaagggtcgttttccaaatggcatcaatgtcctgtctcttttttctggcatcggaggtgccgaggttgctctgcatcgacttgggatgatgcttaaaaatgtggtatctgtggaaatagctgaggtgaacagaaacatcattcgcagttggtgggaacagactaaccagaggggaaacttaattgaggttgaagatgtacagaaagtctcttcaaatgagctgagccagtggataaccaagtttggtggatttgacctcatcattggaggcagcccctgcaacaacatttctggcagtaatagagttagtagacatggactagagggagagcaatcttcactattttacgaatattttaggattgttgaggcagtaatggaaatacagagagatgagcttctgtga

SEQ ID NO: 13529 - DNA, 861 bp, Glycine max
  Peptide Sequence Number=SeqID_130307
atggcaccagatactactgccttaagttattggttgaattggaggttcttcctctgtgcactatttattttattaactatgggcctggcatcatttttgatatggaagtatgaagaattcaataaatcgaggaatgagagaagagaaaggcagcgagaaacggctgggtcactttatgagtatgaagcatggagtacatgtcttaacggaattcatcctgcttggctgcttacttacaggataatttcttttcttctgcttttttctttgctcactgccaatgtggttgctgatggaggtggcatattttatttctacactcagtggacatttactttggtcactatttactttgggcttggatcttgtgtctcaatatatggatgtcgctataaacacaataaaattgatagcagcacagtcaatcgtgctgatttagatactgaagaaggcacttatgtggctcctacacttgatgggactccagaattacctaacctgtacaagaattccaatgccaatcaggagctttacactcgaaatattgctggtgtatggggttatatttttcaaataacttttcagacttgtgcaggtgctgtagtgctcactgacgttgtattctggcttgtcctttatccaacatatctgaatactaaagatttccatctgcattttatggatgtttgtttgcactcccttaacgccatattcctcctcggtgatgcatcattgaattgcatgtggatcattcatgcttgtgtttcattatggtggccttatcctttccttgatctgtcatccccatatgcacccttatggtacgttcttaaattcaatgcatcaccaccactcaaatag

SEQ ID NO: 13530 - DNA, 664 bp, Glycine max
  Peptide Sequence Number=SeqID_130308
atgcctcaaaactacaaggagaagcttaagctcaaggagtggcataaggaggtttatgggaatttatcctttgggataaggactgtggtagatgagttagatgacgtggaggtaagactttgtgaagagcaaccagttgattgtgatcagaggaaacttctatcctctgagttttggagggctaagtggatcaaagagggtaataccatctcacattttttccatgcttccttgaaggacaggtacataaagaattatctagtggggctacatactgagaacgggggtgaggtaaaggatgttgttgttcatcactttcagaggattttcatggaacctaacttggagcgtcccttcttatcaggtattcagtttaatcaggtgtcatcttgtgattgtgtttctctaactgttttgaagaaggatgttgtggatgatgttatggtgactaatgagctcattgatcttgttcagaaaggccaaaaaagttgtttccttttcaaaattgactttgaaaagacatatgactctgttagcagtatgtcagttctggttaacgatagtcctacaggggaatttgtggctcaacgggggcttaagcaagggactctgttgggcactctgttgttttttatggtggctgaggggttaagtggcttagtgg

SEQ ID NO: 13531 - DNA, 324 bp, Glycine max
  Peptide Sequence Number=SeqID_130309
atgtctccacttgtcagaaaccttgttaagagagcagttaaactttccctagatgacttgaaggcgaatcattcccaggcttttttaagttcacgtgacgtcgagggagaatgcatttctcttcttggattacagtcccaaggggttggaactgaaattgtggaaaactgtattgaggaaagaattgtttcagttgtagagatggacaacaagaagccccacaattctcaagaacccgcacctttccttttcgaagaagaccctgtcgaggaattagagtttcaagaaaacgatttcagccccttgaactctttactgttttaa

SEQ ID NO: 13532 - DNA, 882 bp, Glycine max
  Peptide Sequence Number=SeqID_130310
atggcagagattcagtcaaaacaagcagcatcgtcatcaacaacatttgtcagcaatagcatatttgtctgcaaaaggatttcatacttgcttgtctttgtgagtgcaagaagtcagaaatttaagtgtaacgtccgaatacatgattatggatcagtgaggcccatccacacgctaatgggcctggccatcgggtcgtaccatgagcccaccgcgttcagtgttatatataaatttgattttcgaaaaccgttgctcatttctgcccgcgaattccagagagttttgattctgaatggagtcttcttctgctcagaaactgtgtttacatttaatatcttcatcgtatcagagatgccgattatcggagcagatttgcagactcgctgttattctcactcgctcttcatcttcgcacccttctcttcgaatctcaaatggaatgcttcctctcaaaaccaccaccatgtggaaatttgtcaagttttatgtttccttggtgcccgtgtaattatactatgtcactgttcaagagtgaagcagtctatggacattgtaggcatcagcgataccgagatacataattatcagataaacctgaagggaagtggttcctctagaataactcgactatctccaaacataaaaaatggggaaaaaatcaggcatgcaatggtagtgaagtttgtatgtcttcttttgttagccttgatctcttactggttgatattcatacctttttatagaagcttaattatcactgtgcctcagtcatgtgatagtcctatagaaaattttaaccatgaaccaagatcgaaacaattaggccatatttttcagttggaacttgaaagtaaattgagcaagttaaatgcttactga

SEQ ID NO: 13533 - DNA, 456 bp, Glycine max
  Peptide Sequence Number=SeqID_130311
atgtctttacaagttcagccacagtcacagacacagccactgatgcagcagcaacagcaacctgtccaggtctaccctaccagtgtcacatatgagtcaccaccccaccattcaaatggctcttttgggtcagtgtttgttgttttggctataataatagtcatttctgcggttgcttgctgccttggaaggctttgcaaccgtcgcggccacagccacggccacaaccagaaacatgttaagccacaaaagcagcagcagcagcagaaccaccacaacttccgtccgaaagaagtggacatcgaattcggattcgacaagagaatcgcggcttccaagcctaatggagcaggagcaggagcaggcagaggaatcaagccacttcctcatcatggtgacatgagaacttttgaaatgaagcttggccaccaaggaaaaattagaccaggtccatga

SEQ ID NO: 13534 - DNA, 314 bp, Glycine max
  Peptide Sequence Number=SeqID_130312
atgaagctcatcaagcttgactgtggcactcttggagatactccacttggaaatgaaactctaaccataggagtatttgcaagtcgaataagagttggtttgactataggtgcaagtggtacaaatgtggggacattagcagcttcaacaacagttgctggtgctgcagtaggagtaacaacaacttcagcccttactcttgtgaccttcaaggccacatctcatacaagtaccaatgggaaaattccttttcatcctagttctattgttactgatttctccctcaattgtgttctttctcctagccttcttag

SEQ ID NO: 13535 - DNA, 327 bp, Glycine max
  Peptide Sequence Number=SeqID_130313
atggagttggtacagcttgaacttgacgcttctgcggcccacaaagaaagtcagatggcatctcaacgccttaaagagctctgcgttgcaaaggaagagattgaaggcatggccgcgtacgttaaaagtcacgagcaagcattggaggttgaagtggacgctctgcgtaaaagtgtagacagccaaagcggagtggcaagtgcaatggactcgactcgggtccgagatttaatctcaaagattgcaatggacaagcaagttttggaattactacttgcccaactcaaagatgatcaggatgcagccaatctctcactagcaatctga

SEQ ID NO: 13536 - DNA, 579 bp, Glycine max
  Peptide Sequence Number=SeqID_130314
atgaactcgctaagtgagcttgctgcgctaagcgagttcatccatactcattgtataaaaagaaagagcattggtgcaaggcccacaactcaatatgacacaagaagattccactccttcgaggcctggaccagatacacatacaatgtgctaggaagacatatgctagttgagagaaaggtagaaatataccaaacggagttggatgagttcaaggctgaattggagaggcgtaacttccataagcgccttaccaatttagctgacaacagcatcaacctagccttggtgaaggagttctacgccaacctctacagtcccgaggggccttccccaaaacaagtcaaaatccgaggccacttgataaaaattgatgcaaacaacctcaacaccttcctggagacacctgtggtactggctgagggtgaatccttacccacttactctagatactgcaggatgcccactgatattagagagattgaggctgctttgtgtatacccggccgagggtttgttttaaatgttgaaggccatcctgggaagatcctcaagaaagatctgacaactcttgctcag

SEQ ID NO: 13537 - DNA, 717 bp, Glycine max
  Peptide Sequence Number=SeqID_130315
atggaagtttatttggttcacgattgggcgagatcatcgtcagaattggaatcggaatccattcctgtcggaccagtacagttgcagcctgtgattcaccctgcaataaaatccacatcagctagcaattcacctgtggtctcttttgagacaaagctggctataatccacggagccaaatcttgtccgaaacggtttggcgtggtagttccaatgacagcaaatcaaggttttgcaaatggaaccacatcacaagacccattacaatccttggaacatcaacttcgatcaacagcaccttcaactgaaaagacctccaataccactcacactttgtttcaacctgtcgaatctgtgcctccaaccctgtcactcaacactgctcactctcatccgacattgaatacgcttcttgttaaacggatagtatcatcacgcgagcttgtggttgtgaatggcaacgaatcaacatcccctcaaaaacatactttgactagttcagtgtctcaatccaagccctactctacgtatacaaaagcacatgcagatgcagatgatggcgttcaatgtatggatgagtttgctggggtaaagtcctatcaggccatttcagatgcattatcccttctaccagtcaacccaccccaagatgaggaggatgaagaaacacctattcaatatacgatgaagcggttggcatcccgtccccgtgcagat

SEQ ID NO: 13538 - DNA, 756 bp, Glycine max
  Peptide Sequence Number=SeqID_130316
atggccacatcttccatctcaactaatagtacactcctcattgttgtttctgttaccaaactcatagagttcgatatgcattccgttccctctcttggtttggaggatgagaccaagaagttatgggaaactcaagtcatgatctcgtattctcttactgaaaaatccttttgtagaggctcgagtaaaataggaatttatgacctacttcagccgagtaaactcgatgtttccaacattgacatttcaatgatcatggcgactgctttcttctggaatcaaaatacttgtgctcttgaattgccatgtggacttgcttcaccaacccttctcgatgttgcagctatcattggtttaatgcccatcggtgaaaaatatttggtagccttcaatgacattgtcaatgttatgagaagagaagaacccataacgggactctcgagaccgtcttggtttattcaactatggataaattcaatcttgaagaaacacctcagacccgacatgagattctttcctcctcgcgcattagaagatgcaagattaatttactatacccctacaaagaaacctttagagaattctttcaaaatattcatcgaagtgctccagataaccactgaatttactaaagacttagctccttttgctctctccacaataataggtcccctttgtttaaagaaattttttcttgccgacacacttggtgaacaagctaagttgatggagatgtggtcaagtttcctaacttag

SEQ ID NO: 13539 - DNA, 606 bp, Glycine max
  Peptide Sequence Number=SeqID_130317
atggctccagagtatgcaacaagtggaaaattaacagatagatcagatgttttctcttttggagttgtccttcttgagcttataactggaaggaaacctgttgatccaatgcagcccataggagaggagagtttggttgagtgggctcgtccacttctccttcgtgcagttgagacaggtgactttggtgaactagtagaccccaggcttgaacggcaatatgcggacactgaaatgttcagaatgattgagacagctgcagcatgtgttcgtcattctgctccaaaacgacctcgtatggttcaggtggctagatccttagatagtggtgatcaacaatatgatctatctaatggggtgaaatatggtcagagcactatttatgattctggccagtataatgaagacattacgatattcaaaaggatggttaatggcagctttgatgattctgagtttgatatggacagcacgacggattaccgttcaactgtttcaagagaaatgtctggatccagacatgcaaggatgttatatagtgaaggtggtgattcagattatagagttttccacggccaacggagcaatacgcagaacatgtcttga

SEQ ID NO: 13540 - DNA, 1439 bp, Glycine max
  Peptide Sequence Number=SeqID_130318
atggctaatgatacatcgtcaaatgagtcgtcttcatccgattccgacaaggacaaggcttcgcctccgtcgccgtcatcttcgtcgaatgattcagagtctccgaaaagtgcaccatcaaagtctccgccaccatcgccgcctccttctccgtcaccgccaccgccggaaaaatcttctcctccgccaacagaatctctgccggcgccggagaattctccgccgccaactccgtcacaatctccaccgccaactccgtctcaatctccaccaccttccccttctccgccaactccaccatctccgccgccatcgtcaactcccccgccttcaaaagattcagctcctccaccctctccgtcagagccaccaccgtcgccgccccagtcgtctccgccacctccacaaaattctcctccagcaccacaatctcaagcccctcctccacattctctttcgcctccaactgcaattcaaactccactttcacctggttcccatgttactccgccgccggcaccaaccggttcagggccaaaccacccttcaccaccgcgatctccgccgtctacccaaccgaaaccaagcggtgctctcccgaaaaacgaccctccgtccacatcacctagctccggtaataatacaggagaaactgttggtcttgctctcgccggggttgtcatgattgcgtttcttgctctagttattttctttatattcaggaggaagcaaaagcgtgcgggtgtctatgccatgccaccccctaggaaatctcatatgaaaggaggaggtgcagatgtgcattacttcgtagaggagcctggttttgggagtggtgcacaaggtgccattaatctaagatgtccttcagaaccggctcagcacatgaacactggccagttagtttttacctacgaaaagatcgcggagatcacaaacggttttgctagcgaaaacataataggggaggggggatttgggtatgtttacaaggcttccatgcctgatggtagagtgggggcacttaagatgttgaaggctggtagtggccagggagaaagggagtttagggctgaggtggacatcatcagccgaatccatcatcggcatttggtgtcattgattggttattgcatatctgaacagcaaagagtgcttatctatgagttcgttcctaatgggaatctcagtcagcacttgcatggaagtgaacggccaattttggattggccaaagaggatgaagatagcaattggctctgcaaggggcctggcatatctccatgatggctgcaacccaaagattattcacagagatattaaatcagcaaacatacttttggacaatgcttatgaggcacaggttgcagactttggacttgccaggctaaccgatgattcgaatacccacgtatcgactagggtgatggggacctttgg

SEQ ID NO: 13541 - DNA, 366 bp, Glycine max
  Peptide Sequence Number=SeqID_130319
atgaatcagcagtgggatgagctgttagatgatttaaggcagaatttgttgaaggcccgggacagaatgagaaagcaagctaaaaagtataggagatgtgtggagtatgctgtgggagatcaggttttctcaatttgcagcccaattaggtggcctatgagcttgatttacaggaggatagcaggattcaaccagcttccgtgtcattgtttgtgcctcttcaagaaggcagtcagcacaccacagtttgttccaacttttcccctggccttagctgatgacatggagttccaggttgaaccagcaaatatgttggatctcaggcagaacctccgcccttgtgaagatagctgggaggcagcataa

SEQ ID NO: 13542 - DNA, 831 bp, Glycine max
  Peptide Sequence Number=SeqID_130320
atggcaggagaatcatacgaggaagccatcgcgagtctgaccaagcttctcagtgaaaaagctgacctcggtggtgttgccgccgcaaagatcaaggatctgacggcggagcttgatgccgccggttcgaagccgtttaacccggaggagaggatcagaaccggcttcatccaatttaagaatgagaaatttgagaaaaatcctgatctatatggcgaacttgccaaaggccagagcccaaagtttatggtatttgcatgctcagattcgagagtttgtccatctcatattctggatttccaaccgggtgaggcctttatggtccgaaacattgccaacatggttcccccatatgacaagggtcaatataagtcaagctttaagtgcactaacagaaaaacgaagtattcaggagcaggggctgccatagaatatgcagtgttgcatttaaaggtggagaatattgtagttattggacacagttgctgtggaggtataaaggggctcatgtctatcccagatgacgggaccactgcaaggcaacttttcagtacttccaatgaattcatagagcaatgggtccaaatttgtactccagcaaagtccaaggttaaagcaggaaaaagtgacttaagtttttcagagcaatgtactaactgtgagaaggaagctgtgaatgtatcacttggtaacctattaacatatccatttgttagagatggtgttgttaacaaaactctggctttgaaaggagcacattatgatttcgttaatggcaattttgagctgtgggatttgaacttcaaacttttgcccactatatccgtttaa

SEQ ID NO: 13543 - DNA, 489 bp, Glycine max
  Peptide Sequence Number=SeqID_130321
atggcagattccaaagctggattgaggaagccagtgtttaccaaggttgatcagcttcgcccggggaccagcgggcacactttaactgtgaaggtggtcaatgctaagatggtgatgcagaaaggtcgttctgatggtcctcaatcccgtcagatgcgaattgctgaatgtttggttggcgatgagactggaatgatcatattcactgccagaaatgatcaagtggatatgatgaaagaggctgctactgtgatcctgcgcaatgccaaaattgacatgttcaaaggatcaatgaggcttgctgtggacaagtggggccgtgtggaagtcacagaacctgctagttttactgtgaaggaagataataacttgtctctcattgagtatgaactgagatttgagaagccagtagtaccaacagttgcttcttactgttgcaacagactatgtggatcttgtagcttaaccactgaacagatggtggattga

SEQ ID NO: 13544 - DNA, 267 bp, Glycine max
  Peptide Sequence Number=SeqID_130322
atggcagattcaaaatcaggattgaggaaaccagtgttcaccaaggttgatcagctttgcccggggaccagtgggcacactttaactgtgaaggtggtcaatgctaagatggtgatgcagagaggtcgctctgatggtcctcaatctcgtcaaatgcgaattgctgagtgcttggttggtgatgagactggaatgatcatattcaccgccagaaatgatcaagaagaagacacacagcagtacacagatagggagagagcaggatag

SEQ ID NO: 13545 - DNA, 959 bp, Glycine max
  Peptide Sequence Number=SeqID_130323
atgaacaaacaactcaggctgctctgtctctttatcctcttctccttatttctctgtgtgggtttcgccggcgccggagacacggcggagaaaaacccgttcaccccaaaagccttcgcgattcggtattgggacaaagagatccgcagcgggttaccgaagccaccgtttcttgtatcaaaggcgtcgccgctgagcgcggcggaggcggcggcgttcttaaagctcgtctccgggaactcgctctccacgcggctgccggaattctgcgccgccgcgaagctcctctgcttcccggaggtggggccccgcctcgagaaacacgacaaagacgcgaactttgctgtttacagagacaataacttcaccaactacggaacgggtcgacctggtggactcgactcgtttaaaaactactccgagggagagaatattccggtgaacgatttccggcgatatagccgcgactccgccgggcataaagatggttttctgagctacggcacgaacggcaacgtggtgcagcagagcttccatacctacgccgccggagccaccggcggcaccggcgagttcaagcactacgccgacgaaaccaacgtcccgaacctcggcttcacctcctattccgacaacgccaacggcagaacccaatctttctcttcctactccgaaaacggcaatgccggcgagcagacattcacctcgtacggcaaaaatggcaacggcccgaccaacgtgttcgcctcgtacggaacagagtccaacgttgtcgggtccgggttctccaactacgctgagaccgccaacgccgccaacgacaccttcaaaggctacggcatagacatgaacaaccccaccaacacgttctccaactacgctgccggcggcaacggcgccgtcgagagattctccagctaccgcgacaaggccaacgtcggcgccgactccttcacctc

SEQ ID NO: 13546 - DNA, 1722 bp, Glycine max
  Peptide Sequence Number=SeqID_130324
atggcaacactcgctcccgggattttgttgaagctcctcaacggattgaacaccggcgtgaaacccacgaacgagcaccgcagctcgctcctgcaagtgaccgacatcgtccccgccgatctcgacgaaaaaaacctaatcccaaaacaagggtttttcataaaggtctccgattcctctcactctatctacgcgagtcttccctcggaccaagacgacatcgttctcagcaacaagatgcagctcgggcagttcatctacgtcgaccggctcgaaccgggctcgccggttccggttctcaaaggggccaagcctctccccggaagacaccctctgatcggcacgccagagcccttaatgggcctcagagaccaaaaccaaaagcccaattctgttcccagaagagggtcttggggaaccggtggcgacgggggttttaattttaagccggtgaatttggactttgaccaatgtacccctgtgaaagtgaggaatggcggatttcaaccggtgtcgtcgtcgccgttgattcgagggactccaggctctgctgtgcggtgctctgttggtggagggcttcttctagcgaaaatgagtgatgctaaagcggaaagtcctgcgttgcttaggaaaagttgcgtggttgctacttctaattcgaaatttgctaggagcaggagtgtttctgaaagggaacatagaatccctgctagccccttcaagtcagctgagaagaaattcgggactacgccaccacggttgagaaatgcgagagtgataacttcttcttcttatggggatgctcagggtcaaaacacggacacgagtgtctcttcctcttctcaatcccaatctcagtctactgctaattcagcttttgataattgcaacaacctcagcatacccatgaatttaccaggaaagctgagctcgctgggaaaggaagctgtgcagcaaagagaagtggctcaaaagattgcccttcaggctttaagagatgcttcagctactgagacagtagttcggtccctcaagatgttctcgaatttgtgcaagtccgctcgaactgatgctcccaaggcttgttttgaacggtttctggaattccatatggagattgtgcaagcagttaatgaaatggtgtccattcaagctgctacttcagcctcagagttggctcagaaatcagataaacaagaactgcaggttttgcatgaagttatggacaattgtgagaatagtgaatcaaacttgtccaaaagaaggggtgctttgtacaagtcaatggctgtcattcctgaaaagcatgagcaaaaagcaaacatggggaggctcctaagatccagtaccaaccaaaaggagattttggagaagaaaggttcaactcctcttacaaaaatgcctctgggacctattgttgaaaatgatgagaataagaaaccaggaggatcatgcagcttaagcaacacaatcaaactgggaaagcagatagaaactgaagcaggaaattggtttatggaattcattgagaaggcattggaaacaggtttgaagaaaacaaaggatgcatcagatggtgatgtcaggaaagttcctcagtctctcatactgaaagttatgaactgggtggaggtagaacagtgccaaagtaacaagcggcctggtcatcctaaagcagcacaagttgctcgaaagttgagaataaagatgaaaaatccttga

SEQ ID NO: 13547 - DNA, 1656 bp, Glycine max
  Peptide Sequence Number=SeqID_130325
atgaagtctgaactgtactttattggctggcccctgttccttttcagctaccacctgtttttttcacagtttcactgccctttcaagctttgcttttgctttggggctttcattaatggcggaagtggtgctcttggtgcagggctcagtaaattcagcactgctgctgccattgaagaaccaattaaaccaccacttaaagttgaacacacccagctcttaattgatggaaaatttgttgatgctgctactggcaaaacttttccaacgttggaccccaggacaggagatgtgatttctcatgttgctgagggtgaccatgaagatgttgatcgagcagttgcagctgctcgcaaagccttcgaccgcggaccttggccaaagatgacagcctatgaaagacaaaggatattgctgcgcgctgctgatctgtttgaaaagcacaatgatgaccttgctgcactcgagacttgggataatgggaagccatatgaacagtctgctcaaatcgaaattccaatgctggttcgcctatttcgatactatgctggttgggcagataagattcatggtctcacagttccagctgatgggccatatcatgtgcaaacattgcatgaacccattggtgttgccggtcagatcattccgtggaacttccctcttgtcatgtttgcctggaaggttgggccagcattggcctgtggtaacaccattgttctcaaaacagctgagcagactccattatctgctttgtatgcatcaaagttgcttcatgaggctggactgcctcctggtgttctgaatataatatctggctttggtccaactgccggtgctgctattgctagtcacatggacatagataagcttgctttcactggttcaaccgaaactggaaaaattgtccttgaactggcggctagaagtaaccttaagcctgtaactttggagcttggtgggaaatccccattcattgtatgcgaagatgctgatgtagatgaggctgttgagttagcacactttgcattattctttaatcagggacaatgctgctgtgccgggtctagaacatttgtacacgaacgtgtgtacgatgaatttattgagaaagcaaaggcacgcgctttgaagcgtgctgttggtgatccattcaaggggggaatagagcaaggtcctcagattgattcagaacaatttcagaaaatactgaagtatattagatccggtgttgaaagtggagctactcttgaaaccggaggagatagatttggcaactcgggcttctatattcagcctactgtcttctcaaatgttaaggatgacatgctgattgcgaaggaagagatctttggcccagtgcaaagcatattaaaattcaaggaccttgatgatgtgattcaaagagcaaataacacacactatggccttgcagcaggggtgttcacaaaaaacattaacacagctaatactttgactagagcattgagagctggaacagtgtgggtgaactgctttgatacatttgatgcagcaattccctttggagggtacaaaatgagtggtcaaggaagagaaaaaggagaatacagtctcaagaattacttgcaagtgaaggctgttgttacatccttgaagaacccagcttggctttga

SEQ ID NO: 13548 - DNA, 345 bp, Glycine max
  Peptide Sequence Number=SeqID_130326
atggttggtgccatgattaatgggattaatactagcgagccaatcaatgaaaggatcaatctccagcttataattgaacaaactgttgttggtcttgtgacttgtgaatacccaaacacagaagctagtaacattactacataccagaaagttagaatttttttacttcgtaccccattgcccggaggctcttcgctatgcgaaggtatgggggagggatgttgtacgcagccttacccttgcatatgcaaagaggctgtttccggattcgaacccatgaccaacaagtcaccaaggcacaactttaccgctgcaccagggctcgccctcataccagaaagttag

SEQ ID NO: 13549 - DNA, 516 bp, Glycine max
  Peptide Sequence Number=SeqID_130327
atgaggggtgagaatgagagagttttgaggtcaaaggatgtgtggaatggtgcagtggggagccaaaatcagaagaggaaaattggggatgagcctgctttgcctttggctggtgatggtgacaagaaaattgggttaagagggaatggagatgctaatggaatgacagtgagcacgaatcgtgatattaatagtcatggagttcctacagttgctcctctgctagagcagaagaaggaagaggaaggggtagctgaagatgtgaaggtgaatctttttccagagggggaggaacctgttggtagagggtggcagggagcatctggattgaaggcgagccctggtgcagcggtaaagttgtgccttggtgacttgttggtcatgggttcgaatccggaaacagcctctttgcatatgcaaggtaatgttactagcttctgtgtttgggtattcacaagtcacaagaccaacaacagtttgttcaattataagctggagattgatcctcaagtttaa

SEQ ID NO: 13550 - DNA, 1734 bp, Glycine max
  Peptide Sequence Number=SeqID_130328
atggaatcggatcgagtcgcaactcagtttcgggtcatatccagatccgtggccacagctttggacgtttttcctttcggttctgtggagatctctgaggaaactaaagagcatgttttgttgctgaacgagcaagcaaggagggcaaggcttgaatttgagcaagaagataaacgggttgtggtgagtgttgtgtcgggtttgacccgatttgagaaccgggttcccccgggtgagggtgatttgaagtgggttcttgagtatattggggttaaaaagtggagtgagtgcaacaaagaggttaagtttttggagggtgaaattgggtttgagtgcttgaagaatgaggagaaggggaagatggtttttttgagtagtttgatggggttcatgagttattgtagatgtgtggtgatggaggatgttgattgtgaagagagtaacaaaaaaattaatgtaagagaaagtagtgttgagagtgaggtgagtctgagtttgacttttcttaactcggatgattttagatgtccaatctctttggagttgatgagtgatcctgtgactatagagacaggtcacacttatgatcgttcttcgattctgaagtggtttagtagtgggaatttgatgtgtcccaagacgggtaaaaggcttagcagcactgaaatggttccaaatttggtgcttagaaggttgattcaacaacattgctatacgaatggcataagcattccctttgttgattcgagtcataggaatcgtaaaattactaggacagaggagccagggagtgtggcagcagagggagcaatgagaatgttggctagttttctgaatggaatgattgagaatggaagtggagaagagaagaatagaggtgcttttgagataaggcttctttccaagacaagcatttttagtagatcttgtttggtggaagctggtttggctcctcttctgttgaagttgttgtcatcgagcgattcgttgactcaagagaatgctgctgcagcccttctcaacctctcaaaatgtgcaaagagtagaagtgtgatggttgagaaatggggtttggaattgatcattgatgtcttaaggaaggggctgaagattgaagctagccagcatgttgctgctgtgttgttttaccttagtgccgagtatggaaacttgataggtgaagagccagaagcaataccatcattgataaggctaatcaaagatggctcttatcgaagcaagaaaaatgggttggttgcaattttcggccttcttaagcacccggaaaaccataggagggtgctagaaggtggagcaatttcttcgctagttgacatcttaaaagggtgtgaaaaggaagaccttatcacagactcgctcgcaattctagcaactctggcagagaggagtgaggggatgttagcaatccttcacggagaggctttgcatgtagctgttgaaattttgagttgttctacttcaagggtgggaaaggagcactgtgtggctttgttgctttctttgtcactacatggtggagaagatgtggttgcttatttagtgaagagaacttctctaatgggatctttgtattcccaactcagtgaaggcacatcgagagcaagcaagaaagccagtgctctcatcagagtcctccatgatttttatgaaaggaggtcctctggtttcaaggcttcagttattccacaagaacagttcattcatgttcggtaa

SEQ ID NO: 13551 - DNA, 504 bp, Glycine max
  Peptide Sequence Number=SeqID_130329
atggctataccaagtaaaacaagttccccgagagttcgatactcggtattcacttaccgttttatactacttgcgcaatctgatgcacttgtcggccgtcgaacaatgttttgtatgcatagatctcctacaaataatttagttcctatggacttggaaattgaagccacgttaagaaggaacagagccgaaaggagaaggaaactattgcaagggtggagacaggagttaaatccttacaatcaatatgaagaagaaagaacccctgatcttgaaagtgtattttcagaattcatggcatatcatgctagctctaaagctaattataattcactacaaaatcaggagattcattttggcaagagctattctttagaagattatcaaggggaactagagttacaactctactatcaaaatgaagcaggaagaagttccaatctggatactttgttaatgcaattcaaggatacaattggatctattgaacgtgcatttaaaagt

SEQ ID NO: 13552 - DNA, 255 bp, Glycine max
  Peptide Sequence Number=SeqID_130330
atggctgcggaaaacgttgtagagttcacagacttacccgtcaagagacctagagaagaagaagaagaagaacaaaccaatggagtctccaacgacgccgtttcaacgctacccaatgaccctcaataccctggtatctctgctgttattcccggttggttctcagaaatcagcccaatgtggcctgattctagagttgttgaacccttttctctcttggattttaaggatgctcttatatgtgtcatttcttaa

SEQ ID NO: 13553 - DNA, 864 bp, Glycine max
  Peptide Sequence Number=SeqID_130331
atggcacaaacctacttgctcttcctcctccccgacctccttatcaactctttcctccacccaatcagagtctaccttcgcgcccagaacgtcacccaccctgtcaccttagcgtccctcgccggcaccctcctccacgtggcctttaacctggctctcgtcgagcgcggcctgggtggcgtcgccgccgccgccgccgcctccagcttttccattctatgtttgctgtggggtccacctggccacgtggaccgcgccgagccgggagtgtttaacctgctgggagccgctaattcggctcgcggcgccgagctgtgtctccgtttgtttggagtggtggtgcgtggcggctatggggattttaatccagactacgtccttgatctacgtttttccctcctcgctggggcttgcggtgtctacgcgcgtgggaaacgagcttggcgccaacaggggacgacgcgccaggatgtcggcggtggtggcggtgttctttgccgccgtaatggggttctccgcggtggtttttgcgacggcgatgcggaggaggtgggggaggatgttcaccggagacgaggggattctgcggctgacgggggcggcgctaccgattctggggctgtgcgagctgggaaactgcccgcagacggtgggatgcggggtggtgagggggacggcgcggccgaacgtggcggcgaacgtgaacctgggagcgttttatctggtggggatgccggtggcggttgggcttgcgttctggctcgaggttgggttctgtgggctctggctgggcctgttgtcggcccaggatccgacggccacaaacaaccgttgcttgccgctgtggacaacaacaactcttga

SEQ ID NO: 13554 - DNA, 208 bp, Glycine max
  Peptide Sequence Number=SeqID_130332
atggcttacgatgcaaggttaaggaagatgacaatagaaacaaattgcatagatgttgttaggcaactagaagctggtagtttctttggaagccattatgcagttcttctttatgagatttcaaatgccaaagccaagtttcaacaatgcctcatcgtgcatattctcaggaacaaaaacaagttggtagatgcctttgctagagttg

SEQ ID NO: 13555 - DNA, 507 bp, Glycine max
  Peptide Sequence Number=SeqID_130333
atggagtttctattagcgcgctacgacggcgagctagacgtggatgcggtggactccgaggggaggacgacgatccacgtggtggtgagggaggggcacacgagggttatccggttctgcgtcacgatggggggaaaccctaatcgcgtggattcgaaggggtggaccccactctactacgcagcgtggaaggggcacgtgaaggctgcggagtgtttgttggaatgctccaacgtgaagtgcgtgagggacagggaagggagaagaacattttctgttgtcgcggagagtgagcacgaacattctgctggtgctccagttattgacaaagtccagaaagaaacaaagagccgcgctggtaagccttgttcacttgtacatattattttttggcatgggtcaatttcactgtcttctgtctcagaaatactgatagttgaggaggtaaagaaagtgaaacatgacatgaggatttggtcacttggtagagctaaactatggttgtaa

SEQ ID NO: 13556 - DNA, 267 bp, Glycine max
  Peptide Sequence Number=SeqID_130334
atgttttcaaactcgaaggagataactataagatatgctattgatgaccaatttatcacttcagataaggctttagcaagcactctgatgaagttctcctttctccagctcattagggtgaaagtcttacgtaggttcataatcaagaaaaacatgtatgagggtttcaaggtggttttggcaacaatgataaagagagttagggtatgtttagttgtagggagagaaaatgacagaataagtgagaagagaaaagaaaagaaataa

SEQ ID NO: 13557 - DNA, 270 bp, Glycine max
  Peptide Sequence Number=SeqID_130335
atgttaaaacgaaaggacgtacctcaatcgataagtggcagagacgaactccacaaacacgaactccacaatgtggttgcagtcacggaagcgcaggccagtttgcaacaaagacgaactcaggcagaaggagaaagaagaagaacgatagggttcgagcgtgcggtcactcaagggttctccgttagcaatggtggcgtttctgttgctctctataactcctcctctggttgctctgttagcgccaaagaaaaagaacaaagaacgtag

SEQ ID NO: 13558 - DNA, 486 bp, Glycine max
  Peptide Sequence Number=SeqID_130336
atgaatttgaagaaatgtcaaaatgccctaggtgtggggcatcacggtacaagacaaaaaggaataactgaatgtggctactacgtgatgcactggatgtccacgataatcttaggatctttcaggaataattgggagacgtattttaatgaagttagaccattggaagcagagagattcaaggcacttcgcatacagtgggcacagaattatctaaaaaggtatgtgtataggctattgaagaaagtgcaccataaaaggggaatttcttccaagtgcatgactgttctaaacaacttgatgtatgacatgtttgacaggctggcttttgaggcttctaagctgaacaactacattggacacatgacattgtctttaagggagattcaaggagcagtgaggttggttttgccaggagaacttggaaagcatgcaattgttgaaggggtcaaagttgttaacaactacacatcctatgatgcttga

SEQ ID NO: 13559 - DNA, 330 bp, Glycine max
  Peptide Sequence Number=SeqID_130337
atggctgagcacgtgtggctggcttggatgaaattagcagttcctcctcttcatcatgcttttgtttgcaacgtgcgcttcttgcaaaggaagctatctgttgagaagctagcttccactgtgctttggaaactctccactccatgcagctatactgaaacggaatcctggggctggtacatgtttccaatgcttcctcattccatgtttggatactttgttttgaatgtgatccctcaccattttgttccgcaacacccctgcatgttgggggcacgtgttgattcacaccatgttacccttcgaatatcaaaaggttcaagctcataa

SEQ ID NO: 13560 - DNA, 225 bp, Glycine max
  Peptide Sequence Number=SeqID_130338
atggctataccatcaaactctcctcatcctcctcctactgatgcagcatcacattctccttctaccttgaagcggacaagaaaagccacacacctgaaatcattggctactagaccagttggggcaaagagacccctggcccatgtggatcctgcaactggcaaagtcgacggtccctacagaaagaagttaagaacatatttggggatcgtcacttgggataag

SEQ ID NO: 13561 - DNA, 288 bp, Glycine max
  Peptide Sequence Number=SeqID_130339
atggtgcaagcaaaccgccaatggaattggcgggggcgatatgcacatgcacaggagcaaatcgccagtgagactggcgatataggtggaaggtgggaaccgtcagtcaaactaacgagttctaggctgtttcgtaagccagctttttgcaggtggcagaggtgttgtttagctttttcaggccaaaaggcaagttgcaactgtcattggcgagttcatggcaaatgtcattggcaacttagggccaagaaaatagtcattccaaatggcgattcagtgcctttataa

SEQ ID NO: 13562 - DNA, 342 bp, Glycine max
  Peptide Sequence Number=SeqID_130340
atgacgttgccacttagcaacattctccccaacgaccacaatgtcaatctccctctacggaagtatcagttggggtcgcgcccacaagacacccaatggacccggagaagtccaacagggccctggggtttccagcttgggttacgggcctctgtcagtcctacagggtgcccgttccccccagcaaggtcataccatcatgacatagctctgattacgggcctttgtcagttatacaaagcatccgtcgcccccaacaaggtcattaggcctcccattaaccgggctttcatcatgaagtactgcgcccccaggcaggcgcagggtgagacaccacagtag

SEQ ID NO: 13563 - DNA, 453 bp, Glycine max
  Peptide Sequence Number=SeqID_130341
atgccactgaagggcaagcaattggtgatatacccctgcaaaacacattggagggtcctcagtatcacccataaccacacccattgcattccacagcgggtaaaaacccttatgctatggcaaaaatgggagaagttggatcatctagaggaaaggctcagagtcattgaaggaggcaaagattatgcctttactggcgtagaagagttgttcctagtacccaaacatgttctcaagttcaaggtgctagactttgacaagtacaaggggactacttgccccaagaaccatctaaagatgtattgtcgaaagatgggggcatacgcaaaagatgaggaactgctgatacatttcttccaagaaagtcttactagggcagctgtcacctggtatactaacttggaaccttcccaagtccaattcttggaaggacctaatggttgccttcgttag

SEQ ID NO: 13564 - DNA, 248 bp, Glycine max
  Peptide Sequence Number=SeqID_130342
gtaaaggtgtgccagtaggccaccgcaaaacgcagatggtcttccatgcgcttgcccgcgacgatttcatcagggttgtagtggcggaaggccagcggattggtgctgtcggggccttcatatttgatcttggcgatatcgccgaagaagcctgtgctcattgggtggttcctccttggtgggtgtccacctcttgcgaggctgaagatgaagcgaagtgtccgccgcttgccgatctccccccttga

SEQ ID NO: 13565 - DNA, 198 bp, Glycine max
  Peptide Sequence Number=SeqID_130343
atgggctacgtgggagtacgtgagctcaattggaggtgggcaataggggatggtggagtggtacctggagatatgtcgcgggggtcaggagaccttggggacgtcaggcgagctcctggcagtcaacagataaaaggaacaaagaccacaaagcaaggaggcttgtgtggtggctggccagctatgaactttgattga

SEQ ID NO: 13566 - DNA, 243 bp, Glycine max
  Peptide Sequence Number=SeqID_130344
ctgaaatgcatagccaggggggttagggatgtatggaacagccccattttgcctatttataggaaaaagggggaggaggttgccgcccaactcgctcagattacgcaacaatgcttcttttttacttctggaatgtcgcggaactttgcggattacctaatgatggatgttaagtatctcgaggcggtcgagcgaaggttgcatgccgtcaaacaatggtccccgaacgaaataagggtatga

SEQ ID NO: 13567 - DNA, 1119 bp, Glycine max
  Peptide Sequence Number=SeqID_130345
atgcttgcggtgtcacctttgaggagcaatatcaaagatgaaaagaagcaaggagagatggagggtaatttctcaatggcaacaacaacaaccgatgatgttgtctttggtgacctttctgaagggaacttgttggagagcatcaacttcgacgaactcttcgtcggcatcgacatccacggagatgtcttgccggacttggagatgttcggcgagttctccgtggatgtcagcaccggcgaggaatcgtcggagatgaactcgtcggctaaaagcagcaaacttgagaacgatcagaatgtcatcgccactacttcaaagaaagaagaggaagaagataaaacttcttgcaatgcttctggtcaagacttggggtcaaaccgtggagaggagattgtgagcgagagagatgaatccgtggtggtgaatccagcaccaaaggatggtggaaaaggaagaaaatcttcttcggctcaatcaaagaataatagtagtagtaataataatcctcaagggaagagaaaagtcaaggtagctaaaaatgagttagctagtttcagtgaagctagcaatggttcatgtcatgagacatatgagtcatgtgccactgagctaactcttaaggtggattggaccccagaattgcacagacgattcgtgcaagctgtggaacagctaggagtggataaggcggtgccttcaaggattttggagattatgggaattgattgtctcactcgccataacattgctagccaccttcaaaaatatagatcccataggaaacatttgctagcacgtgaagctgaagcagcaagctggagtcaaaggaggcaattgtgtgctggtggagggaagagagaagggagtccatggttagcaccaaccatgggtttccctccaatgactcccccaatgcaccattttagacctttacatgtatgggggcacccttccatggaccagtccttcatgcatatgtggcctaagcatcttccaaattcaccaccactctcatggccgccgccggctgcaccgcctcaagagccttcattttggcaccaactggttaactttctaaacattgacctatcaatccaatctttgattttcttttaa

SEQ ID NO: 13568 - DNA, 186 bp, Glycine max
  Peptide Sequence Number=SeqID_130346
atgtatattgggataattcaaggcttgcgaagggaaattaaggttccaaaaggcaatgctatcaatgatgttggagatgtagaggtggctccattgaaagaacctaggaccatgaggggatgggtgagcttgaggggcttattagggcttggaggtcaagctagtagaggcaagaacaatgcatag

SEQ ID NO: 13569 - DNA, 822 bp, Glycine max
  Peptide Sequence Number=SeqID_130347
atgttaaaattcatcctgcgtcggctccttgaagccatcccgacgctattcattctgatcaccatctccttctttatgatgcgactggcacccggcagtccgttcaccggcgagcgtgcgctggcgccggaagtcatggccaacattgaggccaaatatcatctcaacgacccgatcggcaaacagtatctcagctacctggtgcagctggcacacggcgatttcgggccgtcgtttaaatataaagactactcggttaactacctggttggtcatgcgtttccggtatcggccaaactggggctggcagccttcttccttgcggtggtgctgggcgtcacggcgggggttatcgccgcgctgaagcaaaacagtttgtgggattacgcggtcatgggggtggcgatgaccggggtggtcattcccagcttcgtggtggcaccgctgctggtactgatctttgccatcaccctgcgctggctgccgggcggcggctggaatggcgggcagtggaactacatgctgctgccgatggtggcgctgtcactggcttacatcgccagtatcgcccgtatcacccgcggctcgatgattgaagtcatgcactccaacttcatccgcaccgcgcgtgcgaaaggtctgccgctgcgccgtattgtgctgcgccacgcgctgaagccggcgctgctgccggtgctctcctatatggggccggcgtttgttggcatcatcaccggttcgatggtaatcgaatcaatctacggtctgccgggcatcggtcagctgttcgtcaacggcgcactaaaccgtgactactcgctg

SEQ ID NO: 13570 - DNA, 240 bp, Glycine max
  Peptide Sequence Number=SeqID_130348
atgtctcctttccaccgcccgcatcgggtcggccgcgccaggatgagtctgcgttatcgcaggtattcaccctgccacgtgccggttataccgcagacgacgaacggaattcatcacgccgctgatgctggcgcgttacccggattaaccggtgccttatcgattaacccattgatttactccagcaaagccggccgggaaaagtgtttagaaaacgtaaagatcaatgcaaagtggtga

SEQ ID NO: 13571 - DNA, 312 bp, Glycine max
  Peptide Sequence Number=SeqID_130349
gtgccgttctcctcactgccaggcgcgcagagcaaagtggataccagactggccaacggcgccaactatggcttcccggtgaacaccatgcatatcgtggccaacaaagcctgggcagagaagaatccggcggcggcaaaactgtttgctgaaatgaagctgccgattggcgacatcaatgccgagaacgccgcgatgcatgccggtcacgcctcagaagcggacatcaacggccacgttgacggctggatcaaagctcatcaggcggaatttgataaatgggtcagcgacgccatggcggcggcgaaataa

SEQ ID NO: 13572 - DNA, 603 bp, Glycine max
  Peptide Sequence Number=SeqID_130350
atgacctccttgactcacctcgacctctctcttactggattcatggggaagattccatctcagattgggaatctctccaatttggtctaccttgacctcggaggatgcaaactccctcactacaatgaaccatccttgctcaacttctcatctctgcaaaccctccatctttcccgtactagttattcccctgccatttcttttgtccccaagtggatattcaaattgaagaaacttgtttctcttcaattactggataatggcttccaaggtccgattcctggtggtattcgaaacctcacacttcttcaaaatcttgacttgtctttcaattcattctcatcttctatacctgattgcttatacggtcttcatcgtctcaagttcctcaacctaatgggcaacaacttgcatgggactatttctgatgccctgggaaatttgacttctcttgttgaacttgatttatcacataatcaacttgaaggaaacattccaacttctttgggtaatctctgcaacttaaggaaattcttgctccttgtatttcccatggactcacaagacttgcagttcagagttcacgactttcaggcaatctga

SEQ ID NO: 13573 - DNA, 177 bp, Glycine max
  Peptide Sequence Number=SeqID_130351
atgttgggcgttgcagtggttggcggtggcaaacgaggtatgcagaaggtgatgaacgaagatgagtggatgtatgaaataatgtctgaacgagtggatgtggattatgaaaatgcagaagcatgtggtgcgaatgaaccacatgttgattgttcggatgcgttcaacacttctcag

SEQ ID NO: 13574 - DNA, 549 bp, Glycine max
  Peptide Sequence Number=SeqID_130352
atggaggacaaatctcttcaaaaggagagtctcactcaagattatgaagctaagtattggcaacaacgttacagcctcaaagatggaattcctagtttccttgcaaatattgcaggagcaattttgacaacaggaaaatatctaaatgtcatgagagaatgtgggcatactgttcgggcccctccatcagaaaattcaaaactaatgagttttggctcaaatcatcattatcttgaatgtattaaggctgcttataactttgcaagcagtgaactcttgaatctcattatggaaaagtatgatcttacaggaaggctgcgttctataaaacactaccttcttcttgatcagggtgatttcttagtacattttatggatattgcacgagatgaactggctaaaaagcctgatgaagtctcagttgagaagctgcagtctcttctagaccttgcattgcgtactacagcagctgcagcagatccttttcatgaaggcttaacctgtgttgtggcaagttcactggccactgtctatagtgttatcacgtaa

SEQ ID NO: 13575 - DNA, 267 bp, Glycine max
  Peptide Sequence Number=SeqID_130353
atggaggttgtttgctcaaaaagaggaattgttgtttcccaacagaagtatattctagacctcttggaagaaactggaatgagcggttgtagaccagcagatacccccatcgatcccaatgggaaactgtgggaaaaaggaagtgttcctgttgatattggaagatacgaaagtgacttggagaagagcaaaaaacaaggtgttgttgccaaaagcagtgtggaagctaaatttagagcaatggcccaagggatttgtgaaggatag

SEQ ID NO: 13576 - DNA, 297 bp, Glycine max
  Peptide Sequence Number=SeqID_130354
atggaatatgatactacttcgaataagatgccacctgcaaaggcagtgttgttgataccaatgagtattgattatgatagttacttgacaaatatacaagcaccatttgaaagtgtttgtggaagcaatgttttccaagtttattttgatgatgccaaagactttagtcaagaatcaagagtcaggcaagtttcaagaatcacagagttgttcaatcaaagcaagtttcaagaatcaaagcaagtttcaagaatcaagattaaagtgaagattcaagagaagactcaattaggataa

SEQ ID NO: 13577 - DNA, 429 bp, Glycine max
  Peptide Sequence Number=SeqID_130355
atggcgacgccaacgaagagaaggtggaggagttcccagtttctggtgaggagtgactggttgatgaattcaggagccttgggagtttttggtgctttgtggcgtggattgcacctgccattgttgcaaaaggagaatgtgaagaagggaagtagagaggttaaggaaaagcacaaagggaaaggagatggggaagaagagaagaaaagtggtgaggaaaataatctgaaaactgaaggttttgctttggctttgttctgtttttctctaggaaccgtcaaagacaaatatgtcaagcctagccttgcctttattccgtttgccatgttacctttttcgccctttcgattcccacaccaatatgctttgacaaattatataccagtttctttaagtaaataccccaagttgctgtatctgtctgtatga

SEQ ID NO: 13578 - DNA, 510 bp, Glycine max
  Peptide Sequence Number=SeqID_130356
atggagtatggctttggagcacatgagtaccctacaagtggtatatttgaggtggaacccagaagctgtcccggcttcatcttcagacgttcagtattgctaggcagcactgatatgtcttcttcagaatttcgttctttcatcgaacgcctttctggaaaatatcatggagacagttaccatttgattgctaagaattgcaaccattttactgatgaagtttgccaacagctaactggaaagcctattcctgcatggataaatcggctggctcgtgttggttctttttgcaattgtcttctgccagaaagccttcaggttgctgctgttagacatctgcctgaacatcttgcactttctgacgacgaagaactggaatctgatggcctctcagattcagaggagagtgaagacgaggattccaatcaccatctgctaactacatcaaatggtggtgaactcaccattataaaagaaaaaccaatgactctagcacgggacctcctatga

SEQ ID NO: 13579 - DNA, 1092 bp, Glycine max
  Peptide Sequence Number=SeqID_130357
atgcatatagaggaattggagggagttgaggttttagaaggtgtggaggaaggaggatcgaggtttgtgggtggttatgatgcgaaaagggtgctggttggagcaggcgctcgtgcgcttttctatccaaccctgttttacaatgtcgtaaggaataagattcagaccgagtttcgatggtgggataaggttgatgaggttgctcctaaatctgatgcacttaattttcagttcatattgttaggtgctgttccatttcctatagatgttccccacttaaaggagctcggtgttcgtggggttatcacattgaatgagtcatatgagactttggttccaacagcattatattatgcactgtggaacatctcaattacattgggttattatagcatcttgactgttttcatgacatcaaagtttcatgctcatggaattgatcatctggtgattcctactagagattactgttttgctccttctctgcatgacatttgccgtgctgtggacttcatacatgaaaatgcattgtcgggacgaactacatatgtccattgcaaagctggacgtggtcgcagcacgactattgttatttgttatctggtgcaccacaaaatgatgacacctgatgctgcatatgcttatgtgaaatcaattcgaccaagggtgcttctagcttcctctcagtggcaagctgtccaagaatactattaccatcttatggttaggagggctgttggatgtgctcccacagccaatctattagtaaaggcttctcagacggcagcaggttcacgagatcttgtgatgtttgatgacaattctgtagtcatggtaacagagtcagatctagaaggttacgacccaagtagtcaatcagccatggcaagtgaaatatgggcagatttaagtgttgtatatcgtgtacgagttgctggacaggcagcactggcgagaatatcatgcctttggctgcgatatgctactaccgaccagaagatttcctcggagaaactgagcagcagggaaagcagttgctcaatccgggctaatcacctgggagaaattagtgttgatatccacgtgtactga

SEQ ID NO: 13580 - DNA, 496 bp, Glycine max
  Peptide Sequence Number=SeqID_130358
ggtgccaagtatcttgaaacggccaatcaaaggttgcatgtcgtcaagtaataatccccggacgaaattagggtatgacactaacttggaaccttcccgagtctattcttggaaggacctaatggttgccttcgttaggcaatatcagtacaattatgatacggctccggatagaacgcaactacaaaacatgtgtaaaaaagagcatgagtcattcaaggaatacgcccagaggtggagggacttgacagctcaagtggcaccttcaatgacagagaaaaagatgatcacaatgatagtatacacgttaccggtgttctacaatgagaaaatggttggttacacactttcaagctttgctgatttagttttcgccggcaaaaggatcgaaggaggaatgatacaatcatatcccgcaagggcattggatagaagactccaagtagattgggccagagatccaagggaaggccctagggttctcatgagccttaag

SEQ ID NO: 13581 - DNA, 369 bp, Glycine max
  Peptide Sequence Number=SeqID_130359
atgaatgattcatatattactaggatgttcttacacgatagtattgatatactgttatacaattctggatgctgtaaacctgcagaagaatgccagtttagctatgtgaatccaacgacatggacgaagcccacaaatgtgactaatcagagcaacccagattgtgatgcttggaataacgatccaacagttctgtgcttcaattgccaatcatgcaaggctggcttactgcaaaacctcaagactgattggaagagggtggctgttgttaacatcgtattccttgtcttcctcattattgtctactccatagggtgctgtgcattcaggaacaataggagggaaaattggaagggttattctcgttag

SEQ ID NO: 13582 - DNA, 1335 bp, Glycine max
  Peptide Sequence Number=SeqID_130360
atggcgaccattttggtggcggaaaccctggagtcgcgccgttacctggcgcggcagatgatgatcgcggcgcttttgagccagggtacggtggtggtgttgaccctgatcctggcgttcgcgctgctcaagcgggtgttgaaaccgatgcgtaaactctccggcatcatgctgcggcgcgatccgggcgagctgacgcccttgccgcgggtgttgccgtggtcggagatgcagccgctgctggtggcgttcaatcgttacatcgaacggctgcggctgatggtggcgcgtcaggaacgtttcagcgccgacgcctcccaccagctgcgcacgccgctggcggtgttgaagactcaggtcggggtggcgctggccagcgatcggccgcagcagtggcgtgaaagcctgcaggcgatgagcgcgacgctggataataccgtggcgctgaccgatcgcctgctgcacctctcacgtctgaaggccagcgagcaccaggccgagcgccagctgcagccggtcaatctggcgcaggtgctgcgcgacgcctgcttttcccgcttgccgcaggcgcgcagcaaacagatcgatctgggtttcgaaggcgaggcggcgtgtcaggtggcgggggagccgctgctgttggccgaactgtgtgccaatctgctggacaatgcgctgaaatacacgccgcgtcaggggatagtgaccgcccgcctcactcaggataaggcggcgggggaaggcgtgctggagattgaagacagcggccccggcatcgccttgcaggataaggcgctggcgttgcagccgtttcaccggctggacaacgtgggcgatcagccgggcgccggcctggggctggcactggtgaaggacatcaccgcctatcacggcacccgcccggagctgctgagctccgccgcgctgggcggcctgttggtgcgggactcgacgttggccgccggggctttggctttacgcgtcagcggcgtgcgcagccgctgcgacaggataacgcccagcagggtgatgccgccgccgatcaggtgcacggcaatagcggcggtaaacaccggcgccaggttcatgaagatcgaggcggtgttggcgcccaggcgcatcacgccctggatccacaggaacggggcgatgatcgaagccggaatgccggcgaacagcaccagcggcaggttatggccgttcaagccgacatcctgcgccatcaggaaattaggcagcagcagcagcacgccgaacaggatctgcacgtacagcgattgccagttcggcagcgcgatggcccagcgtttggtcaacacgccatacagcgcgtaa

SEQ ID NO: 13583 - DNA, 252 bp, Glycine max
  Peptide Sequence Number=SeqID_130361
atggaggttaaggaatctttgataggcttacgactaccattgcattatcgagcagatacgggagggtggtgtttggtcttggatgtgcagcaggtggattttatggctgatttaggggtggcctttgtggatgattgggcgttcttggttggtagggtgggaggatattggcacatgggatttaaaagggctagtgggaaatttggtcatgtaggaatgacagtcaaagtatgggtttctccctccttctaa

SEQ ID NO: 13584 - DNA, 915 bp, Glycine max
  Peptide Sequence Number=SeqID_130362
atgtcactgcctgccctggacgccgcgccgcgctggtcacagcccgtcgatcacctgccgcagtttaaccatgcttacgccacggtcgcgggcgtgcggctgcactatgtcagcggcggcaatgcgcagggaccagtgctggtactgctggcgggctttccgcagagctggtttgcctggcgtaaggtgatggcgcagctggcggcagactattacattattgcgccggatctgcccggccagggcgattccgacaagcctgccagcggttatgacaccacctcgctggcgcacagcgtgcagggattgttgcagcagttgggggttgagcgttactacctggccgcgcatgacgtgggtgcctgggttgcctggccgctggcgatgctgcacggtgatgccatcagcaaactggcgctgctggatgccggcattcccggagtgacgctgccggatgcgctgcctgcgacgccggacaaagcctggaaaacctggcattttgcttttcacctgttgccggatctgccggaagcgctgatcgccggtcgtgaagcgctctatctgcagtggtttttgcagcgcaaagcagccagcccgatggtgtttggtgacgaagagatggcggaatatgtgcggctgctgcagcaaaacggcgcgctgcgcgccggcatggcggcgtaccgtgaggtcagcacctcagcggagcagaatcgtcagttgttgcaaacccggggaaaactggcgatcccgctgctggcggtgagcgccgatcagggctcaattgccgatatggcacagccgctgtgcacttttgcggccgacgtcagcgggattcgcctcgcgcactgtggtcactttatcccggatgagcaaccgcaggcgctggccgacgcgttacgtcagttttttgtgtaa

SEQ ID NO: 13585 - DNA, 894 bp, Glycine max
  Peptide Sequence Number=SeqID_130363
atggcggcaaataacattaaaaatcgggtggatgtattcggtgaacgctaccgtgcgcgcgtcacgacattatcggccagcctgcaaacggtggcgcgatatatccacgaacatcgtgaggctatattagacgcgactgcattggatatcgcccaggccacccaaacttctgacgccaccgtggtgcgcaccgtgcaggcgctgggctttgccggtttgcgcgatctgaaaaccacgctggccgcgtggtttggcccggcgcaaaactcggaagagaagatgagcgcgaccatcagcgaactgtcgtgtgacatcaactccggcatcgattttgtgctgggcggccatcagcgcgcctgcgaagtactggcagaaccggtcaaccgccaggcggtagcggctgcggtgacactgctgctggaagcgcgtcaggtggcgctgtttggcatcaacgcttccggcattctggcggagtacagcgcgcgactgttccggcgcatcggcctgccggcggtgacgcttaaccgtgccgggattgcgctggcggaacagctgataacgctacagcgcggcgatgtactgatcatgatggcgcagaaatcggcgcaccgtgagggcatgacgacgctgaaagaggcgcagcggctgggtatgccggtgattctgctgacccacgcgctggattcggcgtttgcgcagcaggcggatgtggtgattaacgtgccgcgcggcggtgaaaatggtcgcatgccgctgcacggcacggtgctggtgtgcctcgaaatgctgattctggcggtggcctccgccagttcggcacgcacggttaaaaccatgaaacgcattcaggatctcaatcgatcgctgaaacccacgtcgaagaaggcgggataa

SEQ ID NO: 13586 - DNA, 425 bp, Glycine max
  Peptide Sequence Number=SeqID_130364
atggttgagtctgaaagacttatctacatcaggaacaacaaaacaaaaaaacttagagttgacaagtattgtagtttacaaacatcattggatgctggaagcagtaaaggctcatctaaaggaaaaagagtgatttttccttcaacctttgttggcagtccatgttatatggatcaactttactttgatgatgaaattgaccagataatatcagcagaaattccttcacatgaaaatgaccctgaactctattcattagtgcaaaatcatatggtacatgacccatgtggaattctacaatctaagtctccatgtatgaaagaaggttatgacagagtcactgctgttgttgtttatgatgctaatggtgcacttgagaatcctatcactcaaaatgatgagattaaagaatatctagattgcag

SEQ ID NO: 13587 - DNA, 318 bp, Glycine max
  Peptide Sequence Number=SeqID_130365
atggcgcaggatatgggagttacaagtgggcaaggacaagcatcagtacttacaaagctattgtgtatggaggaaagggatatggaggaggccaaaaggatgggaaatagggaagttaagtgggaactacaatcagcaatcaatagagcaggaggactgctatgcttgtggaatgaaagctctttcagattggacaggaagacaagtggtcaaggttttatttatctagagggtatatgggtcccggatgggcagaaggagtgctgtggtgtatactgggagatttcaacagtatcaggagaccagaggagaggatag

SEQ ID NO: 13588 - DNA, 1572 bp, Glycine max
  Peptide Sequence Number=SeqID_130366
atgggcgcggttctctccctgaagaaccacccaattgcctatttcagcaaacccttcaccccgaaactgctccactcatccacctatgtgcgcgagttcgccgccatcacggtcaccgtcaagaagtggcagcaatacttgctcggacactccttcattatatcgacagaccatcgtagccttaaggagctcatgtcccaagtgatacaaacacctgagcagcaggtgtacctcgcgcgtctcctgggctacgattactccatacattaccggtcgggaaagtcgaatatggcggcagatgccttatccaggatacctgaagcttcctcaggggcactaatgaacttcacatggctaggcatcaaagaggacgttcgaactttcgtcctgaatcgcttacgatgccaacaaacaaaatatgaccaccaaaaatgtccaggcttactttgccccctgtcgatccctcatcgtccctgggaagatctatccctggacttcattggcggcttatcggcctttcggggccactcagtcattctcgtggtggtggacaggttctccacagggatccatctgggcatgctccagcccaattacacaacttccaccatggcccacctttttatggacatcgtcggaaaaatacacggcatgccgcacagtttggtatccgaccgtgatcctctattcttaagccatttctggcaggagttgttcaaactctcaggcattaagctgtgcatgagcttaacttatcacccacaattggacgaccaaacaaaagtattgaacagggtgatcgaacaatatctccgggcctttgttcatcaacagccttcatcatggggcaagtttcttatttgggcagaatggtcgtacaacacttccattcatactgccactggggtcacgccatatgaagctacctttgggaagaaatcgccttccattcctcaatacctcgtcggtacctcgaacattgatgctgttgatgatttcttcctcagtcacgaggcagtgttcgcagtgctccgaaagaagctccttaaagcccaacaggagagtgggtgctggtcaagcttcgacctcgtcgtcaaaccacgatcaccggcgcggctcattccaagctggccaaacaactaccccctcattcccgaatacacaccatattccacttttcacccaaattctactgagcacacccctgttgataccttaccacccaagtctgtggacaatgatccaggggtaactcctctcgcgatcttggataccaaatgggctacttctgctaatgggccaaaattattggttcttgttcagtggcggggcttacttctggaagacacctcctgggaattgtggaccacactgaaggactaccaccttgaggacaaggtgctcctcgatgggcaaatggatgctatgaagcaattcaacacagagcaatccaacacagaagaattgagagcagacaaggagcagacaggcactaacctcaggaccaaaaggaaaacatgcaggccgcactacctagaggattttgtgaccaatgcaaatcccaaacgctga

SEQ ID NO: 13589 - DNA, 687 bp, Glycine max
  Peptide Sequence Number=SeqID_130367
atggccaggcattcttcttcttgggtttttggaacattttcctctgatactgatggtttagccatgatgttgtctgaagtacatagttctatgaagaaatcaaatgatgaagaaacaagtcaacctaagagtgatagtgtaaatcaacttttgacgcacattctagctgtgttaacttttgcattgatcaataatgtaaatattgcttctgctgcacaagttgccaatcaactatctagtgttgttgttaatctggcagctaaacaattgagaaatgcatctaattctggggatgcatacccactggcagatttgttgtctgtggaacctttagcaggaccatttaaaagctttaaaaaagataatcttcctaaaatagatgctgcagattctgccttggcaacccttgaaggaattaaagctttgactgaagtttgtaatgaagattctttcattggaagcttaggagttgataacttggaagctgaagtctctaatgcggtaatgaacaaagccaccttaccaagagcgactaatggagccagaataaagagttgttggtatcagagcctagtctctaggttgagctcttcacagagtagaggaaagaaaactcctaagaggatggaagaaggatatgttgtgaacaagcctcccatgttcaagggagccaactacaactactag

SEQ ID NO: 13590 - DNA, 330 bp, Glycine max
  Peptide Sequence Number=SeqID_130368
atgctcgatgtgggctcttggttctttgtccttcattgtaacttcgacaatgaggaagagggaggattgttcctgaagtctggtgtaacacgaccaacttggggttggttctatttcatggccataatcttagggttaggagatatctggctaattgagaggaagaaagggtcttcgcccattgtaggagcaaagcttcatgatgaatcaagattgattcaaagatgttttgatgataaaaaaggtgatgacaaaaagctcaaaggtcaatcaaagaatgagttcaagatgttcaagatagaatcaagaacacttcaagattcaagatga

SEQ ID NO: 13591 - DNA, 249 bp, Glycine max
  Peptide Sequence Number=SeqID_130369
atgaagtttaatgacactgagtctgataaagatttgtcagagctagatgagtccattgcatatctaagactagacaatgagttcagaagctggagcacccactcaacatatggatggtccttaagaagaagggaacccactagatgtgtgacgaaaagaaataatctagaatgccaaatcattggtcacccaacagatcacatacaaccaaggtcatcacttagaccacaaggcaacactgcaagatga

SEQ ID NO: 13592 - DNA, 324 bp, Glycine max
  Peptide Sequence Number=SeqID_130370
atgccacatctgtggaggagcacacaagccaggccaaacaaatggctgaaaggcccactagcagcttcagagccaacacaaaaaaagaacccaaaggaggagtgcaaggcggtgtggactagaagccagcagagaactgaaggagaccagtctaaggaaggaagggcatacaaagaaggagatagagatgaggaaaggaagaaggaagaagagaaagaagaagagaagaaggtctccaagaccaagaaccagctagcccgagaggctaggaaaaaagagccaccagtttctctaaaggagccctcatatccttttgtgccataa

SEQ ID NO: 13593 - DNA, 618 bp, Glycine max
  Peptide Sequence Number=SeqID_130371
atggagcacctagccctgacagctactaatgtctacaagtcaatgctgcaatttttcacacaaggctggatcactccaaatttaaactctgacatggtaatcttgattccaaaaattcctcgtgttgattgtatagagaaatttcatcccttagctttggcaaactttaagtttaaggtgttcatcaaggcctatcctctttctcctctcttgttctatttagctgaggatgtgcgaagtcgggccactaggaagttggtggaagaaggtaatttacatctcatgattagtctgaagggatctcttgtcccctttcatctgatgtatgctggtgatattatgatttttgccaagcatatgaaacgcaatgtccaaaaacttataagattgctcaacctttatgaactctcctcggaccaagcaatcagtcctcagaaatgtaagttttaccaaggtgatatctcatcaagtcatgttaatgctttccatgagatgttgggtttctcgatgggcactcttcccttcacgtatcttggtgctctcattttcagtggaaagccaaagtgtgctcaccttctcaccattattgatagacttaaagagaaattggttaagtag

SEQ ID NO: 13594 - DNA, 240 bp, Glycine max
  Peptide Sequence Number=SeqID_130372
atggagtcttccttggaacaaaggacagtcaccaaaaccgatctactactaaaagggccaaaatggggacagatgtcgtacaggatgtcacgacatcacgcttcagaacatgcagattatatgtgtccgtatgaacagattaaacaagtaaataacacaagagaattgtttacccagttcggtgcaacctcacctacatctgggggctaccaagccagggaggaaatccactctcaatag

SEQ ID NO: 13595 - DNA, 213 bp, Glycine max
  Peptide Sequence Number=SeqID_130373
atggaaccttcatcttcttcctcttgcatgagacctttaagggagaagagatcaccattttcttcttcttccaagctccataatgatgttttttatacttcttctctcaaagctttgattaaacaagtaaataacacaagagaattgttaacccagttcggtgcaacctcacctacatctgggggctaccaagccagggaggaaatccactaa

SEQ ID NO: 13596 - DNA, 261 bp, Glycine max
  Peptide Sequence Number=SeqID_130374
atgtcaaatgaagaattgaagttgcaggatccacgatgtcggatacaatgtcctgacatcctgcccgagaatactggagttgctgtacaatgcaagataaaagtcaagtgcagaagtgaagttgcaggatccacgatgtcggatacaatattttttcagaagaagatagatctcctccagcacaagccgttgcagcccagaaacgcaaattgctatataatcatggaggctgcacgagttctgtaccaagtccgggattga

SEQ ID NO: 13597 - DNA, 210 bp, Glycine max
  Peptide Sequence Number=SeqID_130375
atggcatttttccaaagctacttggactataaggctcaaaacgcacaagtgactaatgctcttggaaacggaaatttcgcgcacactccagatgtcttctcaaagatcccaacagtcaaatcatcatttttaccgagacagcttcatgtagcttccttgagaagcttcattaagaggctttctcaagaagcttcctcgtggcttctttga

SEQ ID NO: 13598 - DNA, 302 bp, Glycine max
  Peptide Sequence Number=SeqID_130376
acattgctattggaaaggagttttatgcgaacctctatgaccctgaggataaaccacctaagcaggtgaaggtgaggggtcatttagtgaagtttgatgaggataccttgaacacattcttgaagacccctgtagtgctggaagagggggagaacttgtgtacttattccagatttgcactcctgaggcctgatcctcaggagttggctgctaagctttgtatcccaaggaggggatttgagcttaatgctgatgggcagcctttgaagattttgaggaagaacatgaccactctagcttag

SEQ ID NO: 13599 - DNA, 234 bp, Glycine max
  Peptide Sequence Number=SeqID_130377
atggaactctacattcaacatttggctgaccaacaggtagccaaccacagaggccagcatcaggaccccaacccttacccatgggctactcctaagaaattcagggccactattgcatggcctggggacatgcctaattttcaggcaagggtaggtcccacagaggccccaggagatgatgatggaactgagggagatggtgacatggcagatgtgatagatttcttcctctga

SEQ ID NO: 13600 - DNA, 411 bp, Glycine max
  Peptide Sequence Number=SeqID_130378
atggactctagagatggtggctattgtagaggtggtggtggtgtgtctgtggccggttgctactactggtcttgccccagctcctttgtctgccttggcatgcagtatttctcaatgaacgacctattaatgggaggtcggatgagctttaagtgtgatacctgcaaattggtaaatggcattcgagataagttaggctacacaaacactgatctaggtcaaaatagcataaaccagctagcatttaggcagccggagatcagagttatggttgttgggaaggatgttgctgaggagaagcatcattcagatctgtgtctaggtggtcatgctagtgcgcatgatccacacccgccttggatcttcttcatcaacggagtcctttgcttcttgaagtttaatggcaattga

SEQ ID NO: 13601 - DNA, 453 bp, Glycine max
  Peptide Sequence Number=SeqID_130379
atgatttacgacactaatgatcggttgaagtttactttacaagaagaaaaaagattactcatgataagagaaggagatgaagatgcacaaaacaacaaagaggaccctaaatggtgcatagatcatatccaaatccttaaaacaaaaactaaccggatgacgaatgaagaacatcaaatgaagaatgatgtagaagtcgattatggtcacaattcggtagcgcctcggcctcgttttgtcttctttcttcttcttctcacttctttctctcaaaatctctcaatgctgaaccttcgaaccctttactcaacctccctcatgcctacttatagcaaaaaacggcacttggttgacttgcagctcgcccaagcgagcttttgcttagtccataagaaactagctcacccaggtgagttgcagcttgcccaggcgagctggttccttcaaccataa

SEQ ID NO: 13602 - DNA, 156 bp, Glycine max
  Peptide Sequence Number=SeqID_130380
atggttcaacttcaaccaccactgctgcaggccaatgccgttgtttggcttccgagattctttacaacaagagactcacagtctcttaatcccttagagaatgagaagaagaagaggaacaaatctctcttgaaagagatggattttacagattga

SEQ ID NO: 13603 - DNA, 237 bp, Glycine max
  Peptide Sequence Number=SeqID_130381
atggtggatcatgggattggtaatggggttggagctaagagagctcacttggaggtggcaactgatgaaagaaatgttcccccatccttgcccgaggaaggacaaattccagtggataatgggagtaagaccagtagttcaagcagctccagcggtgattcaggctcttcttcaagtgattctgatagtgatagttcctcagcctctgggtctgatgcagggtcaccaaaaatttga

SEQ ID NO: 13604 - DNA, 120 bp, Glycine max
  Peptide Sequence Number=SeqID_130382
atggctcgaggaatccacacacgcatcggcattcccagctcgcatacttgtctcagtcatatgcctattgttgttaacacaaaaatctacaactgtataacaaagatgctgagacattga

SEQ ID NO: 13605 - DNA, 525 bp, Glycine max
  Peptide Sequence Number=SeqID_130383
atggctttggggccaatagttggagatgatggagccaaagagaagcagaggtacactaattgtaaggtttacactaggaaagcgttgaaaggttcgaagaaaaaaggtaacaccattagcaccgtgaacgttgttcctcctcaacagaagcctagttctttggggagtgaaagtagctttgcacaagtgacaggaaacacaactatggatttagtagagaagaggctcaatgagcttgtggtttctttcttcacttggtttgttgggattgcaatggctgagatatgctcatccttcccgaccatagggcttgtagctaggatagggactcaggcatatgcaagatcacaaacgttgcagagtataatcctactctcaactggcacaaataaaggtggagggtacttcactccaaaatggctattcttatgtatgtatattggcctcactattacatgggaagcactaaacacatttgcattggaagtgattgatttgatcgatatagtttcaatatggtggcag

SEQ ID NO: 13606 - DNA, 183 bp, Glycine max
  Peptide Sequence Number=SeqID_130384
atgccctggttcggtgtgagtgcagcattgaaggatagcattgaaaaaggaattttagaactcatctcccagcatggcatccgaaagtttgttatgggagcagcatctgataagtactttaatagtcatatacaatttgtctgcatagggcaccttatacacataaggtacaaggcctcctaa

SEQ ID NO: 13607 - DNA, 247 bp, Glycine max
  Peptide Sequence Number=SeqID_130385
atgaaggaagaagtggaagagaaagctgaggagagaggagttgagggtttgcggtgcgagaatggcgagctactccttgcacgcggaaaagctcatagatgtggggcacaagggaaagtggttgagggagaggcgagagaagtagaagaagagagacagagaggggtgagcgggaaagaaggcaagggggaggaagggatgcatggaattattattcctattgtgggacttttcaagcgaaatgaag

SEQ ID NO: 13608 - DNA, 348 bp, Glycine max
  Peptide Sequence Number=SeqID_130386
atgcgcctcaaccctggaaaatgtaattttggggtaggtagaggtaagttcctcaactttatgatcactcattgggggattgaagccaaccccgacaagtgcactaccatacaggagatgggcattcccaccaacattcaagaagttcctcttgatgaggacatgaccaagagcaagggagaggatccacttgaaggacttggaggacctatgacaagggctagagaaaggaaagccaaggaagctcttcaacaagtgttgtccatactatttgaatacgagcccaagtttcaaggagaaaagtccaaggttgtgagttgtatcatggcccaaattgaggaggactaa

SEQ ID NO: 13609 - DNA, 984 bp, Glycine max
  Peptide Sequence Number=SeqID_130387
atgccaaaaggttcgtttgtcccccaagttcgtgacgacatacttaagacaaccatagggagaccagatcatggaggtcgtgttcgtgtagctgggtctggggtgacaattactcaatactatgggaggtcatcacgtgcctccactgcatcatccatatccatctcccaagaacagatggctgagataataggaagcattagggaacaagtcaggaatgagattgaagaagaaaagaggcaaagtatagagacatggaaaaaggagttgaaggatgccattattattgagatgtcgcaaaagggatcgcaggttgcacaagctactcatgtggatataaatgtgttaggtgcacgcgtgagcactaaggagagcaatgctgaaatttgtgtgaacccatctggggaagaacaagttcctgatgtatcgccgactatggggttgtatgttcaacatcaagattctacccagctagcggcgttgggaaaaatatatcatggagcctctaccatacattgtgtggcgtatgcagatgatgtcgtaagggttagcattgacaaagtaattgacggtgaagctgaagtcctgttttcgacatccgaaattaagtatgtcaggcaggcccttaacacattcattgcatggccaacacctcttgtaaaactggattcagccattagtccaaagaaagtcgttgaagctgttaacggggtcaaagatgttgttgtgcatgaccccttgcgtgagttgattaagtgcctggtagacatttatgacaaccctgttcagtttgtgtgggatggtggtaaatttgggattccaaatgtagactcaaccttgttcttaacatatgctgatgtcaacaaaataacaacaggggacaaatggttgaacatagccatacttcagttgtggaccatgtatatggatgagtggagtaatagcttgggtcatggatcgctatatggattccttgagccttaa

SEQ ID NO: 13610 - DNA, 219 bp, Glycine max
  Peptide Sequence Number=SeqID_130388
atgaaatgttacatattggagcctaagtctagtaggaggaaagcagactatccgcacaaagtgcttgattttaggcggtattctcagcctccaaagttgattccagccaccagggataaagagatccctaactgtgaggtccataaattccggggaaggctcgtttcaaatgaggtttcgggtaaggatacaagcttgatgtacaaggatttgatttga

SEQ ID NO: 13611 - DNA, 1332 bp, Glycine max
  Peptide Sequence Number=SeqID_130389
atgggatatttttttgaaggaattaaacttcataatttggcaacagaaaatcttgaagccatcctccttgttgaatgtcaagccaatggccctcctcaaacaacaatgaaggccaatgctctatccaaaatgagtaaccttaagttgctcatacttcgtgatgttaatttttcagatagacttgttgagttgcatttgcctcacaacaacatcaagcgaccatggaaagacacaaagcctctacgtaatttgagaattgtggatctctctcactcccaaaaactaatcaagatacaaaattttggagaggccattaatcttgaaaggataaatcttgaaggatttatacaactcaagcaaattgatccatccattgattttctaagaaagcttactgttttgaatttgaaagactgcaaaaatctattattggatatagcaagggatgcagagcatttgaaaaagctttgtataagtgaaaatcctattcattctcaatcaacatcctccatcatcaaaaggtggtttacttggcctttacatttgttgtattctcctattcattccaaatcaacatcctccatcgtcaaaaggtggtctaagtggcctttatatttgttgtattccagagcacataaaaatttagttagttgttctttgccttccttgcctacttccccgagtatgcatgaacttgatctaaatttctgcaatttacttcaaatccctgatgctgttggaaatttatgttgtctagaaaggctgaatttaaggggaaacaattttgctaaactacctagcctcaaggagttttctgaattgaaccaggagctaacatatagcgttgtgtggtaccaggcggagcacagatacaagtgtctcgaacgcgttaccgtgtgttcaaacattcaaagtattattgctggaagtcaaataccaagatggttcaacaatcaacatgttggcaggagaagtttaacaagcagagaggcaactccccttttgcaggatttcaatatctgcattggctttgcttgttgtgcagtatttgtgctacgtgatgaaatggacacaattgagatggatcttctaaaagtagaactttatactgtcgatatttcagggtttctggagggagatctaatcatgaacgagtcagataacatgtggctatgctatatcactcgatcacgtttccttggattatgtcgtttgcatatgttaccttataatgataaactgaaattgaatttttttataaagaacaagcgaggttttcctattgtggtgaagaaacacgggtatcgttgggtctatgaagaagatctatga

SEQ ID NO: 13612 - DNA, 465 bp, Glycine max
  Peptide Sequence Number=SeqID_130390
atgctgctgaggaacagatcaagggcagtgacaaagccaggtttgatagctgatcacaacacccataattcttcatccaccatatctcagcccaacattctagttgttctgccttcaactcccacttctgcatggactgtggctacttccctactcacagaaggcagtacaagtgaggatccatcctcttccactactctcatcacagcagcacatattaatattggttccccttccgtagtggtgcccactcctgaaataccagctccagaaactgcactaaagttggtattgtcaaacccacaattcaacctacactactaccttattcatggtgaaccgaaatcaacaaagttagcctttgccagtcctatctgccacacgactatgaaggcagaatatgatgcatttctaactaatcagacttggactcttgttcacttacctccctccagtcctatctag

SEQ ID NO: 13613 - DNA, 1114 bp, Glycine max
  Peptide Sequence Number=SeqID_130391
ggagtacttccccgccttcgaccaccgtaaacggtggccggaatcaccatcaccacaaccacaacaacaaccacaagaagatcaaattaaggaaattctggttgataccttcgaaattcgttcttctccgccgccggtgaagtcaactacgccacctccaccacctccaccacctccgccacctcctcctccgccagaatctgctcgtcgcaatacccgacggacgcatcggaaaatagagcgagagcgagagagtgagataactgtagagctcgaccacagcgagttcacgacgatccgctctcagccggcggctcctccgacgccgccgcagcctccgtcggcgaaggcacgatcggagcgcaagagtgagcgaaagaagagcaccgtgaagagagagatggcgatgatttgggcttcagttctctccaatcagagaaagaaaaagaagaaacaaaagacaaagaataacgaaaatcacgatcagcattacgatgataatgtcgatgaattaacgagtaacacgacagtgccaccacctccaccgccacctccgccgcctccttcagttttccacagtctattccgaaaaggactaggcaagagcaagaaaatccactcggtgtcggcgccacctccgccaccacctcctccgccgtcaaagcgcaagagccagatccctccgtcgccgtcttctccgccagagcctccacggcggagaaactccggccgaccacctctccctaacagagctgtcactttcaacgacgagactctaaacgccggcaaccagtcgccgttaattccgattccgccgccgccaccaccgtttaagatgaaggcgatgaagttcgtagttcgcggagatttcgtgaagatacgtagcaaccagagctcgcggtgtagctctccagaacgcgaggacattattaatgtgtcggaaactacaatcattgacgccgttactgattctgttaatgaaaccgttacggatcgtaacgttttctgtcccagccccgatgtgaatgttaaagccgcaacgttcattgctcggcttagaggagaatggaggctcgaaaagcttaactcgttgaaggagaaaggcaatggctaa

SEQ ID NO: 13614 - DNA, 378 bp, Glycine max
  Peptide Sequence Number=SeqID_130392
atgacggacaataagagttccttccattcgtctcttgcggtttccaatataaggaaccatatctccatcactcttgaaatggagaatgtctgtcgaaaagctgcctcgtcattcaacttgttttgggtctcacaagtgcatatcgaggctcgatcaatgctcatacttgaggaagccggatcggcaatggtggctgtttcacaatccatttatgactcaaatatctctcattcagaccaacagcaacgtgggaagccgtctggatatcacaagaattctgaaaagaaaaaaaaaatagtgggggtggtcttgggtccagttcgagacagtctcaatgttcgtgttcgtcaacctctcgcttcgactgcggaggtgtga

SEQ ID NO: 13615 - DNA, 1002 bp, Glycine max
  Peptide Sequence Number=SeqID_130393
atggaagaacaagaggccgtatttcactctcggaattctggttctggttctgcttctgcttctgcttctgcatacatcatatcacaaacaatctttctctgtctgaatcgaacacacatgagtatgtctgataacgaagaccatgcagactacacggacaataattcctctgcaaagcgtaggttcagggataggtccaaggaggtattgtccaaacaagccgttaagttagccaagcaagctgaagagcatgaaaggttcatcaacaaggtgggtctgttctgcttaatttctgattcacgtgactcattttttgggggttcttggctttggttggttttgcttcatctttggggcaaggccacaagccgttcccttggtatattgcttgttctatgtcgtgtttgttcctctccgttggatatattacaggttcaagaaatggcattactatctcctggattggttttctttaccattcgatggtggaatcctgcaacctttgaagccatgcgaccagcgggaatggctggaagatctacatggccttatattgaggataaatcctatctctggatgtggctgtttctggtacccttagcagtttacattctctggcaggttctatacttcctcattgtcaacgtcttgcgccaacaacggtttttaagagatcctgaagtcatgacttcctacagggaactctccaaaaaagctcagaaagcaaacaatatttggtggcgcttaagtggcttacttggagatcaaaatcgcttgttaatgtacattgttcttcaaggcatatttaccgtggcaaccacggctctgactgttcccattttcttgtcatatgaattgtctgtagtcttccaattgcttaagatttctgcatcagtgtggaatgggggaagcttcctaatagatgtgatgcctaggcaagtaattctcaaggagaaaaagaaatcagagatgcaacttgttcaaaatcaaaaagatcagtga

SEQ ID NO: 13616 - DNA, 329 bp, Glycine max
  Peptide Sequence Number=SeqID_130394
atggctcactttcttgctggaggaattcagggtccatttccagcatcctactactttgtagggggttggatggggatggcagttcgggtagtgtttggattagatagaggtgggaggagtgaggcagccgatgtgggacttgagtatttcccaacattgttgttggtactcaacaaccgtgccttgcagctagagcttgaaaacccaccaaaccagtctccgaaaaacgacgatctcgaacccgttcaccgttggatcgtcgtgaaatttgagtatcatgttcgcaacacaattccgagcattctcaccgttgggaatttcgatatcat

SEQ ID NO: 13617 - DNA, 627 bp, Glycine max
  Peptide Sequence Number=SeqID_130395
atggttgtttcttggcttgttcatccgattacaccttcaattagacagagcatattatggatgaatgatgctcgagatatatggaaggatttgaagtcaagatactcacaaggtgatttgttaagaatttctaggttgcggcaagacatggcatcaatcagtagtgttatggaaaggaagaaacaagatcgagagatgtcgtttcttagaggattaaatgatcaatttaacatggtaagatccaatgtattgatgatggatccattacctagcatagctaaggtcttttcatgtgttgtccaacaagaaagacggataagtagcaatgatttgatgggaggcgataatctaatcaatgcaacatcaagcacaattccattgaatttgtgtacatactgtggtaaggataatcatattgttgatagatgttttagaagaatggttttcctccaaattatgtttccaaaggaggaagaaataatcaaagtggctcgggcagagggagttctagtggaagaggaagcaagatattcacacattttggtttcaccaaccacactattgatgagtgttacgaaaagcatggatatcctcctggacacaagctctataagccttaaggcttaa

SEQ ID NO: 13618 - DNA, 399 bp, Glycine max
  Peptide Sequence Number=SeqID_130396
atggagagaagctctaacaagagtggccaatatctctggccacaatatgcaaagattgatggaattgttcgaaagataataaatatattgggtcccaaattttcttgtcttccaaatgatgacctagctggaatggaatctcatgttgaagaattagcagttgctatgtttggtgataaaatagaatggataaggagaatgaagaaggtggttggaagaatcactcctccagaattgatgatgacaaaggtgatgacaaaaagctcaaaggtcaatcaaagaatgagttcaagatgttcaagaaggaatcaagaacaattcaagactcaagaggaaaagttgaagaacacttcaagattcaagattgaagaacacttcaagattcaagaggaaagttga

SEQ ID NO: 13619 - DNA, 192 bp, Glycine max
  Peptide Sequence Number=SeqID_130397
atggcgtgcggcggagacaagttgatgctgccagcaaaaagacaaatccaacaattttctatgcacccaacagatttgcctccaaattcaccctctttgatatatatctctaagccccccaagagccatgacaacagctccaacgtgtcgacattctacctcccttttactttaagagtttatgttaattaa

SEQ ID NO: 13620 - DNA, 477 bp, Glycine max
  Peptide Sequence Number=SeqID_130398
atgggatcaacccttatggccacaacatccatgctcatctgcacgggcctaggagcagttataagcagcacttacagtgttaaaaatgtaatcaacgacacaatttttggagcacacagtgactttatggtgggactgaaatatgccatcatccttgcaatattattattctcgtttctatttcacactttctctatagggtttctcaatcaagtgaatatccttatttgcaccccacaagatgtcaagtctttagtgaccttggaatatttaactcaacttttggacaaggccatcttattgaacacggtagggaacaggcttttctattcggcacttccccttttactttggatctttggacctgtgctaactttcttctcttcaatggcaatggtgcttatattatacaacctcgattttctggctgggaatagcaacagcaagatagaggtctttatcccaaatggcatttga

SEQ ID NO: 13621 - DNA, 567 bp, Glycine max
  Peptide Sequence Number=SeqID_130399
atgtatgttacagcatctaaagatggtgctattcggttgtgggatggcatcactgccaattgtgtgcgctcaataactgcagcacatggaacagctgaggctaccagtgcaatttttacaaaagatcataggtttattctctcttgcgggaaggattctaccataaagctttgggaagttggctctggaagattaatcaaacaatatctgggagctatgcatacgcagctaaggtgccaggctatttttaatgagacagaagaatttattctatccatagatgaactaagcaatgagattgttatctgggatgcaataacaacagaaaaagtagcaaagtggccttctaatcatgttggtgcaccccgctggcttgaacactcgccaatagagtctgcttttatttcctgtggaactgataggcttgccctgcagaatcgtttaatgcattcaacgcttggaattggaagattgtctatctatggtgatgtgatgtgctcaatctttcaagcaattcttaataactatttgtgtttcatattccatattttcatcaaagtagcttaa

SEQ ID NO: 13622 - DNA, 645 bp, Glycine max
  Peptide Sequence Number=SeqID_130400
atggatcaagaaaaggttcaagcagtccctgaattggccatatcctataaatctgaagcaattgagaggcttcctccgtctgactggatactaccaacaaacttatcaaagaaggaaaacgttcattggaatgaccacgcttccaaggcttttgacaatttgaaagccgcaattaccaaggcaccagtactggcattgcctgatttttccaaagcctttacattggaaactgatgcctctggtattggcattagggctgtattgagtcaggaacaacacccaatagcttttttcactaagaagttcacacctaggatgcaaagacagtcagcttatattagggagtcctatgccatcacagaagcagttgcaaaattcagacattatttacatgggcatcgatttgtgatcaaaactgaccaaagaagcctcaagtcactcactgagcaagcaatccaaacaccagaacaacagaaatggctacacaaattgctaggatatgacttctctattgaaaacaaactggacaatgagaatttagttgcagattccttgtctagatcatttttcatggcatggtctgaaccaaaacttaagttaattcagttgttgaaagaggcaatacaagctgactctcagttgtag

SEQ ID NO: 13623 - DNA, 180 bp, Glycine max
  Peptide Sequence Number=SeqID_130401
atgggggaagcttcaacaggaagcaaccagcttgcctgggcgagcaaggttgcttctagaggaagcctccagcttgcttgggcaagctgggcggcaagctcatcccctattttggctataaaagggtgtgggaggctaaatgaaagggttcaacaccctgggaaagcgaatttcacttaa

SEQ ID NO: 13624 - DNA, 924 bp, Glycine max
  Peptide Sequence Number=SeqID_130402
atggcttcccgtaagagaaaagccacaactttagcgtctcgggatggttatgatagatcaagatttgtatcacaagaggcctgggaccgttacttagataatgttcttgccaggaacattctgacagaaacaaatgtcaagttgtatatcaatgagtttgatgatttcagaagagaattgattagaagaaactggcataaaaaactgactaacttgaccgagagaagcattgatgtggcaattgtgatggaattctatgaaaatctttatgtcccagacgacaagtttcccaagcaagttagggttcgagggcacctgataaaatttgatgttaattccctcaacacctttttggagactccagtggttgtggagcaaggggagagcttgcccttttactccaggaggggatttgttcttaatgccgagggtctgctgtggaagctcttgaggaaaaatcttaccactctagtccaaacctggagtgttctatcttattctaacttggccccaacatcccatacttctgatcttaatctggataaggccaagttagtctacgggcttgtcatgaagatgaatatgaacttaggttcacttatttctggaacccagaaatccaaagctagaagatctgaggccccatctacatcagctggccctgctccccctgcatcagctccatctacttctggtcttccttcaccaccagcagctccaattctttcagagcctgcatctgggccagctcctgatcatgcagagtttgcaggatatggtctagcaacgaccagttatgagcatcgaggagtttcttcaaaagctaccccacaggtgacaccaaagccttccactacagtgttggacatgtcttcttctcaacctgagtcatctacaccagtgccagacctacctcttccttag

SEQ ID NO: 13625 - DNA, 594 bp, Glycine max
  Peptide Sequence Number=SeqID_130403
atgggaaagttttctcagaatttatggagttgggatcttaagtggagaaggaacctgtttgaccatgagaatgagttagcagtagctttcatggatgacatttctgctatctctattcagcaccagttgcaggacaccatgttttggaaagctgaccctagtggtctctattctactaagtcagcatataggcttttgatgtccttcaacagccctgttccacacaggaggattttccagattctatggaagctgaaaatcccaccaagggctggggttttctcatggaggaggaggctggtcatcttttttttccactgcaaaatgactaggggtctgtggtgggaatccatgagatggactcagaaatgctacaaggattacaaagttgatcactcaaaggcagaagctgaggacaaaaatagtgagaataacaatgactggggtctcactagtgaagtatggccaaaaaaattgggtctcactggtgggggaagcaaggaggcaatcattcaaaaattccagcaactggaggaaagggacaaagtagaagtagaagcaaatagaagggatgacagcaacacgaatcaatga

SEQ ID NO: 13626 - DNA, 426 bp, Glycine max
  Peptide Sequence Number=SeqID_130404
atggaggggtcggccttagcgtggttccaatggatgatgagaaatcatcaactcaccacctggcctagttttctacaagctattgaagctcgttttgcccactcaccatatgaggatcctactggtcttttgttcaaactcacacagaagggatcagtgaaagattacctgaatcattttgaagccctcgccaataggatcgtcggactactgccctcttcccttctgagttgtttcgtctccggtctcgatcctgatattcaccgggagatgacccgacccgccccgaaacccaaattaaaccgcaacttacccaacctcaaaccgaaccattccaagcccaaattagtctacatgccttggcaggccaaaccggcctggaaaccttacgcgtggtgggtcggatttctcatcggaacgccatga

SEQ ID NO: 13627 - DNA, 359 bp, Glycine max
  Peptide Sequence Number=SeqID_130405
atggaagcagtagatgagtggctaaaggaacgggatcaaattcttactagcttagcaaggaaattgacgaaggcacaacgaatgaaagagtttgccgataaacaacgtcgtgatgtgaattttgaagtaagagactgggtactacttccagcagacacttcatgggagaagtgggagaaccttaaagaagattacaatcttgaggacaaggcagtttgggaagcccggagggatgttatgagtgaggacactgaacaaaatgcagcaatagagcatgaggcaaaatcaatacaaggagagcacagaaggtcaaaaagggaaattagcaagccacggtaccttaaggattatgcaatgaa

SEQ ID NO: 13628 - DNA, 633 bp, Glycine max
  Peptide Sequence Number=SeqID_130406
gtgccagaggatgtgagaaaaaccgcgtttaggacttatcatggccattatgagttcctggttatgccctttggcctctgtaacgcaccttcatccttccaggtcaaatatttgggtcatatcatctcaaaatgcggggtgaaactggttcccgccaaagtggaagttgttcttcaatggtcgataccacagtcgatcagagacttgcgtggcttcttgggtctctcgggcttttaccgccgcttcatacaagactatgccaccctggctgcgccactcatggaccttttgaccaaagattcatttcaatggtcgagcaccgatgaccaggcttttatcaggttgaaggaggccctgtgtaaggctccaattttagggctaccagacttctccttgccctttgtggtggagaccgacgcctctggaattagcatggggtacacagcttccagcgtggcaagaacgttcatggacatcaccggaaagatccgtggcatgcctcgaagtttggtttcggatagggatcccctcttcattagtcaattttggcaggaattgtttaagctaagcggcacgaagctccgcatgagcttggcataccaccctcatatgacggacaaacaaaagtcatga

SEQ ID NO: 13629 - DNA, 180 bp, Glycine max
  Peptide Sequence Number=SeqID_130407
atggaaattattgaggccatggcttcaaatgtctataacgatgctagagataagaggattctcaagaggcatactggagtgttccagatggagaccttgatgaagggccaaattgagatgatggcacttgctcccccaccccatatttgtgaccaatatggggagataggtcagagatga

SEQ ID NO: 13630 - DNA, 234 bp, Glycine max
  Peptide Sequence Number=SeqID_130408
atggcagctcgcccaagtgagctaagacttactcctgaagtaactggctcgcccagcaatgcagatgtcagcaggggtcatgctgaggacaacatggtcgtgcttgaatgtgtgacgctgatgaggagtttacttgaaaaattagcatggccatgttggaataacatggcctataggagaattataagcaattgggcttggatccgaaattgggctgaaccggcatggacttga

SEQ ID NO: 13631 - DNA, 684 bp, Glycine max
  Peptide Sequence Number=SeqID_130409
atggaacaacctgctatgaaatccttaagccactacaccactgttcaagcatgctttggggctacatctgcaacatccacattcgtagccactaataccagtatgttaggtgatattgtgaaacctatggtcttgaacgaaatccaaaagactcgagagaaggaatgttgtcacggtcaatcagaggcaacaactaattttgtacctagaattcagccttgtcagcctttggtcattggacctgtgataggtgttgaaatattcagacctcctgcaatgcaatttggtacattgaagccaattaacaggtcagtgtacaagaaaccgtattcgcaaccttatcaagagaagataggaagtccaccatggaacatatttttggtagccaatttgatgaataccaaacaatcatctaacgagtccatcactgatttcttagaatggtttaggcaaatgagaatttggttgcctttcaatccttcaccaaatgctggggacaaccccgccaacagtggagacccaagaaaaaaccaaagggtcaccatcaccaaaggaacaagaactcatttggatgtgatacgttatgtggaaggagacaagacacatagtaatggagttcacttggtaaccgaagtcaaggtcagagaaggcattacaaccttaaagataatgatgatgaattaa

SEQ ID NO: 13632 - DNA, 483 bp, Glycine max
  Peptide Sequence Number=SeqID_130410
atgatgatgaagcatatgaccaagagtgatgaaaagattaagtccttggaattaacaatgtcaaaccttgtcactctcatgtctcaaagagctcaaggcacattgccttctcaaactgaagcaaatctcaaggaggaagtgaatgttatgactacaaggagtgggagaccaatgattgagctgaagaagaaagagaaagtggctccaccacctgagcatgaagcttttactgaagagagctcagaaaaaggaggtattggaacctcctcagactttgcaataattggcctcaacaaagagtactttgttgtgattttaaagaagttgcctcctaagcttaaggacctgtggagtttttcaaccccctgtttcattggcaccttgtactttgatagagcattgtgtgatttaggtgctagcattaacttgatgccttgctttgtttataagaagttggggtcacaagaacccctaacccactaa

SEQ ID NO: 13633 - DNA, 426 bp, Glycine max
  Peptide Sequence Number=SeqID_130411
atgaccaccttagaaggtggcattctagccgaaaaaggggaatgggcaagtttggccaaagatcttggtgctgaaaagggaatttccaagcaatacaagccaccgacagatcatgtgcgacatttgaagccgttgtacgtgaaagtagtgataaatggaaggccaattagccaagccttctttgataatggtgttttcctaaacaaaattcctttctcccttgtcaagaagttagtccaaacaagatttgattggaacaagactatggaagtatgcacggatgatgtagtagtcaagttagctgagtttgaccaacacttgatagacttggagcaagcgttcaaaagaatgaggttgcataacttgaagatgaatcctgaaaaatgtgcttttgggataacgacagaccacttcctaggtttctag

SEQ ID NO: 13634 - DNA, 516 bp, Glycine max
  Peptide Sequence Number=SeqID_130412
atgaccattcctctagttccccaagtcgactctccacttccaaagcataagaagtatatgcatgataccctgcttcatctgtttctagtgactttgaggagctcccttctaaagttggcagtgatgaataatcctactattatccctgagtctaagaggaaagtctatgagaaaatctctttattgctaggagatttagaggtgaagtataagcccgatacaaggtgcaaggaccaaagtgcatctatcactcgggtgaatgattacaacgaaaaaaaggtggagttgtatgaaaaaggaaaccagttggataaagacattgcttcccttcacaagcagaaacatttgttgcttcaaactttggagaaaatagataaagaattggctcaagatgacatggagtggggtggcttccaagacatcttgattcaagctcaatctcctgtagcagttgtccttatatcttcaaccacaattgtttccaatacccctaaagggagttcatcagtctcctaa

SEQ ID NO: 13635 - DNA, 456 bp, Glycine max
  Peptide Sequence Number=SeqID_130413
atggctcgtgttcctgataagattaagttgatagatggatcaagggaaactcttaagctttctgtaaggatcactgatctttggttcattgggatccctgaaaagtttgaacaagccgaaatggtggttgttgattctgatggagatgaaatccatgttgtttgcaaacaagatcagctaaagtcttggaaggctgatttgaaggaaaatttgacttatgtgatgcataattttaaagttatgaagaatgatgggaaattcagaatttgtgatcatgaatataaattatgttatactggagttactgcggttaggcaatgtaatatggaacacttaccttttaggaaatttagatttgttgatttttccactgtcattgctggtcattttgaaactggactcttggttgacgtcattggcgtggttgatgaagtggtattccgatatgtctcataa

SEQ ID NO: 13636 - DNA, 336 bp, Glycine max
  Peptide Sequence Number=SeqID_130414
atgtttaatgagaattcaattcctaatagggaggcgaaagaggtagacggttctgatgtcgtcggcgtcgatgcaaaagaggaggtggaagtcgcggaaggagagggcggccttgcaaaggaaggtggcagagcggatggcggagtaggcgaagtcggaggagcagtgaggcttgatggagagactctccgacgagggagggaggagatcgaaggagagacggctgaaactggtgctgcaaatgctcttacagctcatggagcttttaagtgtggaagaattcacggtctccaaactcatctcagaatcacgttcaccaccacaaccactccctaa

SEQ ID NO: 13637 - DNA, 222 bp, Glycine max
  Peptide Sequence Number=SeqID_130415
atgagttatacccgtaatgaacctattatcgcaaaaccccctattaaactattggggccaaacaaattaaagtgtccaaaaagtactccccctgtcccccatctagctaggttgattcccggtgtccttaattactctgatatagatgatatatcgagcaagaaagaagaagaagaatctaatccaaggaaagtgatatccagctttatcaaaacgcaataa

SEQ ID NO: 13638 - DNA, 624 bp, Glycine max
  Peptide Sequence Number=SeqID_130416
atggacaaccattcatggtgtcatccggcttgcagtcaatgtcacaaaaaagctgacatagaaactatgtcattcacatgtccatgtggcaaagacaacgaccaacctatattaaggtatagagttgaagtaatggttaatcacaagggcgaacaaaccaaatttttgctctgggaccgtgaatgtgcagagttaattggtcaatcggcagatgaagtcaacaggctcaaaatagaagatggcgatgttgatttaaatgcctctcctcaggcactagatacgctattgggttgtttccttgcattcaaagtcaaggatatgcttcccgatactgaggttgtcttttgtcaaccatgttgcaagatcgagagttcaatacttgaattgatcgaccctacagtgcttgaatctcaatctgtgtctgttaccattgatgatgatcattcaatgcttgactcgactgagcctacagagcttgaatctataagctaccgttgtccttgtgtgtttttcatgcaatctgtctctgttaccgccgatcatgaccctcttctcaagattccattgacaccaactaagtgtgtatcttctgatgagttggatgatggacccaaaaacttttag

SEQ ID NO: 13639 - DNA, 1720 bp, Glycine max
  Peptide Sequence Number=SeqID_130417
atgaggtgggaaaaggtgaagggaataggaggagaagaagggccagggaagaggtggggccacacgtgtaacgcggttagagatggcagattcctttatctcttcggcggttacggcaaatttaactgtcagaccaaccaagttcacgtcttcgacactcacaatactgctcagccaactgagttaaaccccctgattggaaatgatgattttggtaacttgaatgtgaagcagagttggagtgaaccagcaattaagggccccccacctactcctagggacagccatagttgcactgtaattggtgatagtctgtttgtgtttgggggggaagcaccagatgcacgtgagggtcatgatgcagcacttgttggcaaacgactatttatgtttggtggttgtgggagatctgctgataacattaatgaggtgtactacaatgacctttacatattgaatacagaattgttcgtttggaaccgtgctacaacatcaggcactccaccatctcctcgtgatggccatacttgctcatcttggagaaacaaaattattgtgataggtggggaagatgaaaatgattcttatctgtctgatgtccacatcctagatactgatgctcaaagcctatacaacgacctgtatatgctcaacattggtgtgtttaacatagatgccagcgtggcaattacacctaatggtccttctgctagattttctgttgctggtgactgtttagacccatatatgagtggtgttcttgtgtttgttggtggttgtaatagaaatctggaagccctggatgatatgcattacctatacacagggattgcacgggaaagtgaacagcgaccaaagaagttatccttaaggaagcaattgaagctgaaatgtctagaacagaatcccaatcttgtccaaaacccagttctgtgtggatatggagtgggtgctgacagtaaccagcccatgtcaatcttgaactatagccaaccaataaatcaacccctgcctcctggaaagaaaatgtttcaagccaacgttaagggaaaaaactcagcaggatatactattgaaaccgttattgatggaaagcctcttcatggagttctgtttaaaaaccagccaaacactcttattccagttcctaatacttccagtaggaaaaggacttttagtgaaattttaagtcctgcttcaaatggtatacattcacacaatgtaatggcttataaggtgctcaggcaggacagaatgcaagataaacaggaattacggggagagagttcagaatctcatgaacgccataaggaagctgatactattgttgtatcaagtaacccgacaactgctgccaagtccattaaggtcaagaagttggttataaatgtgatcttttgcatggttagagattgtgttttatttgatattgctggaactgctgcaagggaatatttcaatggctctagatggagtgagttaatgaaagatcaccttccatttgctgtgcatgaatctaatcccaagtttgagctatttagtcctagttggtttctgatggtcccaaagattatcactgggaatgcattgcaagtttctgtcaacccagaaccagaagctgtttctatggatcaaaatggtgatgaaaaaaatgacacaccaaaatccttaattgagagcttgaaaaatgatggatccaatgatgtgaccagttccaaag

SEQ ID NO: 13640 - DNA, 582 bp, Glycine max
  Peptide Sequence Number=SeqID_130418
atggaaggaggaggagtagaagttgatgtctctgctttcagagaatgcttgtctctgtcatggaaaaatccttacgttcttcgccttgctttttctgctggaattggtggccttctctttggctatgacactggagtgatatctggggctcttttatatatcagagatgatttcaaagaagtggatagcaagacttggcttcaggaagccatagtgagcatggctcttgctggagcaatcataggagctgcagttggtggatggatcaacgatcgatttggaaggagaaaagctatccttcttgcagacacactcttctttattggttctgctgtcatggctgccgctaccaatccatctattctcattgttggtcgagttttcgttggccttggtgttggaatggcttcaatggcatcccccttatacatctctgaagcttctccaaccagagttcgaggagctttagttagcctcaatggctttctcattactggagggcaattcctctccaacctcatcaacttggccttcacaaaagtgagaaactatgcctcatctcttcactgcttttgttgttaa

SEQ ID NO: 13641 - DNA, 366 bp, Glycine max
  Peptide Sequence Number=SeqID_130419
atggatatctctaaagatactgacatccctgtaatattgggaaggccattcatgttgaccgcaagctgcatagttgatatggagaagaggaagctggagctaggttttgaagatcagaaaattgattttgatttgtttgttgaagacaagcctgctccagaacacaatgtctgcttacaagtaatggaaggaggtcaagagcttcacgctaagcacatctttggtcatgcactaagccgagagtctcaagtgcttagcccccaacccttgcatctgaggctgatttggtccgctaagctggccaaggataagctaagccaacttcaattcgatctgaattcagctaagcttcagcctaatcgctaa

SEQ ID NO: 13642 - DNA, 246 bp, Glycine max
  Peptide Sequence Number=SeqID_130420
atgggggtgcaaatagcaaccaggcccacttgggccttccagaaaattcctccaaaaggcggttgcttctggaggaagcaacctagctcgcctgggcgagctggaaaatccaagccgatgcgcttctgtaacgttttcgtgggtgatttcgcgaagattttcaaccgttcttcaatgttcttcgttcattcttcgtcgttcttcaatcttcaaccgatttctaaaggcctaaaaatcaacatgtga

SEQ ID NO: 13643 - DNA, 345 bp, Glycine max
  Peptide Sequence Number=SeqID_130421
atggctaaaccaagcagccccgcaaacttggcatcagccatcatttgtttctttgcctcaaagaagttcccccatagactaaaagcatcaccgggaaggtttgcaaggcaaaacccttcaccacacccttccgtcatggtccatgttcatggatttttcaaagtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgagggtgcatga

SEQ ID NO: 13644 - DNA, 123 bp, Glycine max
  Peptide Sequence Number=SeqID_130422
atgtggtcaggattttcagcacaattttatgatggggctgaagctacaagagtgccaactgctaattcaaagaaaaaagctgatcaatttggatctgaagggtggcttaactggcatgagtag

SEQ ID NO: 13645 - DNA, 426 bp, Glycine max
  Peptide Sequence Number=SeqID_130423
atggtaagaggcttcaggcgacttttgattatgggaggagtggttacagcagtgtttgcatctgcatttggaccatttttccaccttggacagatacaacaagtcattcaacggttgtttccatttggcagggggctttgccatgcatactgggccccaaatttttgggtattctatatcatgtcagacaaagggcttgctttcatattcagaaaacttggctttaacgtccagacaccaacaggttcattcactgctggtctagtaggggattcctcaccattttctgtactacctcagatgactgaagtgaagttccttatttgctgtatacatttcattagtatgaggagatggaggatgatgttatatcatttcttcaaactagttatcatgcaccatgacctagccactgatagattgtaa

SEQ ID NO: 13646 - DNA, 147 bp, Glycine max
  Peptide Sequence Number=SeqID_130424
tcttgtgtcgcgagtcgcaatcccattcgatcttgaagtctgcaaccgccggacaccgtcgatctacaaccgccggacgtcgacgtcgttgcggctctgtgttcgagcattcaatttcattggtatatcctccctcattcaaaccgg

SEQ ID NO: 13647 - DNA, 465 bp, Glycine max
  Peptide Sequence Number=SeqID_130425
atgtttttgtcggcgattgatgaacaagggggccacgcctctgcaagatcttcgtcggcaccaatgtcatccagcacgggtttaaagagcgatgctcttcttggaaaagaaactgtgatgacggctcgtgtggctagtggagcatatttggtggtgcgatgggtttttgcgaaaaatcttgtggtagcgttggttgtgggtttcttgaggatcttggtggtgggttggagagcttataatagtgctgaagaggaagagaagagggtagagtacatgatttgctgtagagggtgcaccaaattcttggtaaccaatttaactacaaacctagtcgggtcttactggattgcatcaagtttaatgcattgtgacggtgttgtgatcagaggaggctcaagagttgcctatggtggaatattgagggactacatgggtttttcatctttgcttatgcgtgtagattga

SEQ ID NO: 13648 - DNA, 270 bp, Glycine max
  Peptide Sequence Number=SeqID_130426
atggtgaaggaagtgagaggcatccaaaagtactgtggagaggttgcaccggctctcctcataactcctcataaaaaatattcccttcgttttccaaggttggagccaatcattgaagaagggtctgataatattcaaggcctccagattatgcctaagaggatgctgtttcttgttcctgcattgatttcttttgaagtgcttggtgtgcacataaagaaaccgaaagtgagaggagaagaagagatggattatgaaaagatattgtag

SEQ ID NO: 13649 - DNA, 228 bp, Glycine max
  Peptide Sequence Number=SeqID_130427
atgataacggaattaggctggtttggtgtttgttgtggtttgtggtgggttgttgttgctatcaatacccaccactggaaaaccaaccttacttctaagaattcaactgccaaggagaggattgggtttatgatccacgtcgtggaacaatcaaggaaggtgttaaagacgggtggcggtaatggttacggtggtggtgaatgtggtggcgaatgtcgtcatcaatga

SEQ ID NO: 13650 - DNA, 445 bp, Glycine max
  Peptide Sequence Number=SeqID_130428
atggatgttgtaaatgatttgcatatggggcctcctgcaacaaccaatatgggaggttccactagtacagaggatgtaaattcatcacagaagcagaaaatggcgagaaagaagaaacaagctgttgagtgtgaaggtgttgatttttcactggataagtctttaccgaagacggatgctactataaagcacccattacatgggtccccagctttacctaatttcttaagttgccaaatatttgtagaatattcaacaaataatgaaaagagcaaacggcagaagacaacacataatgctattgaagacaatgttaatggttgcagcactccagagtatattttttcaccaaaagcttccacacctgcattggatatgccttcagaacatcccattcaatgtttttctagtgatccaataactagtcaatcttgtgtggaagtgg

SEQ ID NO: 13651 - DNA, 714 bp, Glycine max
  Peptide Sequence Number=SeqID_130429
atggagcagccaagtgtggcgattctgccatggatgcatcaccctgtcgacatcactcgctgtcaagaactccccgtctgtagtgttcctttgatggaacgcaggttacagtcggtactggaggagaacatgggaatctcgaagctattctcggttcaagtcgcactttggcaagaaacggttggatcagatgactttgagcgagacctttgcataaactcgcccaccgaaagtggcaaaaccttggcttatgctcttcccatcgttcaaaacttgtccaccaacaccagtgaccgcctctttgctttggttgtagttcccactcgtgaccttgctttgcaggttaagcgcgtcttcgatgcccttgcatcatcgctgggtctccacattggcttggctgctggtcaatcttcgcttcgccacgagctttctagcctcatttatctacctggagaagacgacggtccagatcctggttttttgtctcctttgtggttccaaagcaaggtcaacatattggtagcgacccctggaaggctaatggaccatgttaacaagttgtcgttgaagcatcttcgttatctcgtggttgacgaagcagatcgattgctacgcgaggactaccagtcctggttcaaatctattgtccaagatcccgtgaaagtggtgaataggacgaaagtgcgaggtgtgggccgaggagcatggatctga

SEQ ID NO: 13652 - DNA, 1327 bp, Glycine max
  Peptide Sequence Number=SeqID_130430
atgagagaagaggttatcagctccggaggcaccgttgatccaacacctgctgccagttctgctggggcatcatccccagctgttccaatgaatgttggcagcatagatgggtcaagtcatggacaagtctctaaagcggcttctctctcatgtgttggttcacaaccaccatggacttcattgagcacaagtgctggtggttctgcttttggttcttcaagatcttcatgtagaccttgggaaagaggagatttattaagacgtttggctacatttattccttcaaattggcttgggaagcctcagatcatcagttcattggcttgtgctcagaaaggctggatgaataatggtgtagacaaaattgcttgcgagtcatgtggttcttgcctgagttttacagcattgccatcttggacattagctgaagggtgtccagctcatgtttgttactgggccatggaggctcaaaatgccaacgaatcctttgccaggcagctggattcgggtcataaagttaattgcctttggaaaggaaacagctgtcctgaaagcttagtgcagttccctccaactcctccatctgcattaattgggggctacaaggatagatgtgatggactcgtacaatttcacagccttcctgtggtagccatctctgcaattgagttgatgtctgtttctcgtggcccgcaaattgaacgctttctatcacagtctcagaattttatgtcaggagaagtagatatcaaaccagacattgtatctgaccttgaaaatgctcaagatgaggcatactgtttatactctcgcgcacagaagcttataagcctttgtgggtgggaatcaagctggcgtttaaatgttcaagattgtgaagaacactctgcccaatctgaaagaaatggatattcttttggcccaagcaagactcaacttcatcttactcaagatcccgggtcaaaggcagtttctgcttctactaaattggatgccagaaaggccaaggcgcctcttaaggagcctagacttgactctaggtcacctttgcttgattgtagcttatgtggcgctacagttagaatttcagattttctgacagttcctcgtcctgctcgttttgcatctaacagtatagatattcctgatactagtaaaaaaataggattgactcgtggagcgagtgctgctagtggaatcagtggttggattgcagctgatgatacagagaaagatcagactgaagaccgtgacgaagttgcaacaacgaatgaggggaaattgttggcgaacacagatttagatttaaatctttccatggcagggg

SEQ ID NO: 13653 - DNA, 1428 bp, Glycine max
  Peptide Sequence Number=SeqID_130431
atggagaacgagaaaattccatcagtttatgaacatggtagctgtagcagaagtgctgaacctgaacctagacctaatgattcccgtattctgggaagaaaataccatttatactgggcgctgggtttcggaagttccgccattgtgaagcttgcaagtgacgttaccaccggacacggcgtggccatcaaaattttcgacaaggaattcattgacggaaagaaaaaatctgtcaagaaacgaatgaaaatcgcgcttgaacgagaaatatcagcaatgacaatgcttagatcacaccctaatgtcgtgcgtataattgaggtgatggctaccacgacaagggtgtatattgtaatggaacttgtagttggtggtgcaacactgcttgataaaattggacgaacttcgggaatgtcagaaacccaagctagacagtattttcatcagcttatatgtgctgtggattactgtcacagtagaggtgttatccatagagacctgaatccgtcaaatttgttgcttgctgctgatggagtgcttaaagtgtcagattttggaatgactgcactgcctcaacaagctagacaagatgggctgcttcactcagcatgtggtgcgcttgattataaagccccagaggtgataaggaaccggggctatgagggtgaaaaggctgatatatggtcatgtggtgctattctgtttcatttagttgctggtgatgtgcccttcacaaatgtatatgacgatcgcaatactaaaattagacagattctccaggctgacttcatctgtccctcatttttctctgcaagtttagtagcactgattaggagaatccttgatcccaatcctactacacggattacaatgaatgagatctttgagaatgaatggttcatggagaattatgagcctcctagattttacaggcaaaattttacttttggtcatgattcacaaaagcgtgttgctaaggggcatggagcagggtcttcagcaccaccagtgccagtcatgaatgcgtttgagattttgaatacatttctgggctactaccttattattggaaagcttttaaaccagctggtacaacataaaagggaaacaagcttcatatcccaaaatcccgtggatgagataattgatggaattgagcgtgttgctgggattatgggatttgatgttaagaggataaacagttttcggatgagtattgaaggaggggcaaatgctagacgcaaaggtcatcttgctatattcattaagatttccgagatagcacaaccctttcacatggttgagcttcggaaggctgaaggagatgttctggaatttcataacttctgcaagcatatatatgctgcgttgtcagattttatttggaaagggagagcagaacctatagatacagaaacagatggttag

SEQ ID NO: 13654 - DNA, 798 bp, Glycine max
  Peptide Sequence Number=SeqID_130432
gcactggctccgaagaagcttcttgctaaaagggctaggaaggccaccccaggggagggatctagtacagccccgcaagcaaagattgagtttgacagacaccgtttccaaagcaaggagcatcaatgccacttcaaagcaattaaggattggaggcagtggacccaactgacggagcccatggctaagtatgaccttgagatagtcatggagttctatgcaaatgcctggcccacggaagaaggagaggggcagcattatgaatacaccgaaagaaaaagccaggtctcaggttttgatgaagaggccataggccagctactgtgctccccgggacaggattttgcatggagtgtgactggaagatgggtgcagatcatgcgcactagcatgaccaccttgacccagatctggatgatgcttctcctcagcaacatccttctcctcagtgttcatggcactgggatttccagcattgatcacaggtctctaccagttctatggggtaccagttacgaccaacagcagcaaccagttgtagatgcaccaccgccacctctacatcagccactatctctagagtccatctcagctcacatgcagaggatggagccctacatgcagcatttggctaaccaacaagtagcgaaccataggggccagttcagggccattgttacatggcctggggataggcctaattttcagggaggtgcaggtcccacaaaggcccgaggaaatgaagataaagctgaggaagacggagacatggcagatgtgatggatttcttcctttga

SEQ ID NO: 13655 - DNA, 237 bp, Glycine max
  Peptide Sequence Number=SeqID_130433
atggagaagaaaaagggagggaatggaaaaggaaaaacaatttctttgcaacaaacaatgtctgaaccatatacagagttgtggccttggatcttctttatcaatggaatcctttgcttcttgaattttaatggcatcgaaatggagaaggagaaagatgattggagatgccacttcaaggagaagatgagtctagaagaagctcacaaccataggaagtcatggataagagcttga

SEQ ID NO: 13656 - DNA, 648 bp, Glycine max
  Peptide Sequence Number=SeqID_130434
atgagggaggcggttgggaaaggactctttcaaggacttcccattgggagtaaccaaatgaaagtagagcttctccaatatgctaatggcactatcttcattggcaaagcaaaggtagaaaattttcttttcattaagagcatgcttagatgctttgagcttgtatcgagtctcaaaatcaatttctttaagagctctcttagggctattgggttggagaatgatcttttgacaaggtttgcgggaatgttgaattgtattccgatgggggcaatccatagaaaagagaacacttggcggcctattgtggataaatttgacaggaaattaacctcttgtggggaggaaagtgagggtaggtggtttgataggttaatagagttgacgattgggaatgatagcaagattaggttttgggatgattgttggttaggagaagttgattttgctagtattagactatatttaaattcatgtcaccaaggttgtcttgtggaggaaatgaggagttggattgatggaaggtggcattgggatttgaggtggaggcgtcgttggtttaagtgggaactagactctttcaagcaaattgaagataccatccatgatatcaatcttactcttgatgtacaagactcgtggagatga

SEQ ID NO: 13657 - DNA, 246 bp, Glycine max
  Peptide Sequence Number=SeqID_130435
atggaggtggatcctaagaaagtaaaatgggaggtgaagaatttctttcaaaaaatattcttggtggaggatttggatcggccaaagcttgatgggacaagattaaaacaaatctctcaacaacaatatgagagtttcattgcaagatttgaggaagatgaagtcaaagaagcaatatgggaatgtggcagctcccaaagccccaatctagatggctttaacttccacttcatcaaggctttttag

SEQ ID NO: 13658 - DNA, 585 bp, Glycine max
  Peptide Sequence Number=SeqID_130436
aatcagtcccactgtactgaaacaaagttcactactgttgagaatatagagaagccccttgtgttgaaggaaataacaaagttgtgggaaaaggaagaacctgatctaccatgggagaagggagagtttaatgagtcaaacacattattattggatgactccccttacaaggcactaatgaatcctaggcattctgcaatatttccttattcttaccggtactaccacaccagagactcggaattaggaccaggaggtgatcttcgagtttatctaaaagggctggctaaggccgagaatgtgcaaaactacgtgtgtgagtgtgattcgacttcaacaattcggggttggatgattgaaggttttgcttcttggccgtggtggtgtgaaggtaagattagggttcaaagagggaaaattgagagtgaaaggatcgaaggagagccaactccatgcatgaaagagaaccctatgcatgaccacaaccttgttgaaggctccaccattgaagatgatgctattccttttgttccagagacaccaaacaaccggagaccacaaggacaaccaacatttccattctag

SEQ ID NO: 13659 - DNA, 216 bp, Glycine max
  Peptide Sequence Number=SeqID_130437
atgaacccaaaagctgttagtcttttgagtccagtgataacaaccaagaagttgtacctacttcttgcaatgaacccaaaagcggttagtcttttggatccagtgatcaaccaagaagaaaatccacttcttgcaatgaacccaaaagcggttagtcttttgagtccagtgctcaaccaagaagacctcctcttgaaaaacagtcaccaagagtag

SEQ ID NO: 13660 - DNA, 639 bp, Glycine max
  Peptide Sequence Number=SeqID_130438
atggcaatggcatcctatataacagaagaattacaaggtcggaggggggtatttcgggcttgtaattggaaagaaaaagattgttacatcacaattgtgaacatctctattcaccttgtgacctttctcaatggaaaacaatgtgggaggaattggtggccaggaagtctagaatcaatgttgatatttggtgtattttgggtgatttcaactcttcgaaagattaataaaaggcaatggaatggtgttgtaggatccaagaacgatggaatctccatgtttaatcaattcattattgagatggaattggaagatgtaccaaaggtggggagagaattttcttggtataggcccaacgttaaagcaaaaagtttgctcaataggttcttggtccaaaaggaatggttcaatatttggtcaggaagcatccaattcatcttggatagaaatatttcggatcattgtccaattgttcttaaagatgctaatgttgatttggggccaaagcctttccgctcattagattattggtttcaacatgaaaattatgtagaggtggtggaaggagcttggaggaacatgtctatacataggtggggagcatatgtcctcaaggaaaaactaaaaggcctcaagaag

SEQ ID NO: 13661 - DNA, 591 bp, Glycine max
  Peptide Sequence Number=SeqID_130439
atggcacaacctccaccccgtgagaggactctaagggaaatggctacacctgatttctcctatgaaagcttatgcatccaataccctgatgaggatgtcccatatgttcttaaaactggattgatccatttgcttccaaagtttcatgaccttgcaggtgaagacccacacaagcatctgaaagaattccatattgtctgctccaccatgaaaccaccagatgtccaggaggatcacatatttctgaaggcctttcctcattctttagagggagtgacaaaggactggctatattaccttgctccaaggtccatcaagagctgggatgacctcaagaaagtattcttagaaaacattttccctgcttccaggaccacgaccatcagaaaggatatttcaggactcaacaacatggagagaagtatgatagatgctgccagtggtggagcccttggagacatgacccctgctgaagctagaaatttaattgagaagatggcttcaaactcccagcaattcagtgccagaaatgatgttattgtcattagaggagtgcttgaagtagccatgaattcatcttcatcaatctga

SEQ ID NO: 13662 - DNA, 195 bp, Glycine max
  Peptide Sequence Number=SeqID_130440
atggaatccaaaacctctaaattcaagctagggctacaaattgagcatcctcaagaactaataaacaccatacaggtagggctaggaattgagcatcctcaagaactaataaacaacatacagaatgctgaattggcttccgaggtttgtcatggacgttgtaaaattccagtggcagattacaaagttccctag

SEQ ID NO: 13663 - DNA, 324 bp, Glycine max
  Peptide Sequence Number=SeqID_130441
cttgggaggattgatggggactcggtgttgagagaaacgaggatatgggctacgtgggagtacgtgagctcagttggaggtgggcaacaggggatggtggtggtacctggagatatgtcgcgggggtcaggagaccttggggacgtcaggcaagctcatggcagtcaacagataaaaggaacaaagaccacaaagcaaggaggcttgtgtggtggctggccagctgtgaatcttgaagctaggggagcttctggtaatcgattaccagggcatgtaatcgattaccagcttcaaaagggaactggaagactgtggaggcctctg

SEQ ID NO: 13664 - DNA, 369 bp, Glycine max
  Peptide Sequence Number=SeqID_130442
atggcagacaacaccaaatctaaaaccaacaccactcacaatgcacaattcaatgagcttctgcaacgtatggcaagtttaaaatccaccttcattgacaagatggaggacgttcccaatcgtgtgacagcattagagaaccgatctcccatccattctgccacttcgaacttcagctcccccaattcctatcatcagaggcactttctgaaattagatattcccagatttcttagtgtcaatgggttgaatccttccttcttgctgagctgtttcatatcaagacttaagtcggagctcaagagagaggttctagcccaacagcccagatcattatcacagacggctggtcttgctagactcccatga

SEQ ID NO: 13665 - DNA, 1905 bp, Glycine max
  Peptide Sequence Number=SeqID_130443
atggttttccaaacaaacattaatcctcacttcgtattgtttcctctcatggctcaaggccacatgatccccatgatggacattgcaagactattggcacggcgtggtgtgattgtttccatattcaccaccccaaaaaatgcatcacgattcaattctgttctttctcgtgatgtttcatcaggcctcccaatccggctagtacaactccattttccatccaaagaagcaggactacctgaagggtgtgagaatttggacatggtagcttcaaacgatttgtacaaaatattccacgccatcaagctgctccataagccagcagaggagttctttgaagcactaacacccaaaccaagttgcataatctcggacttttgcattccttggactgctcaagtagctgaaaagcatcatattccaaggatttcattccacggtttttcttgcttctgcctccattgcctgtaccagatacacacatcaaaggtttgtgaaagcatcacttcagaatccgagtacttcactattcctggcatacctgacaaaattcaagttaccaaagagcagctacctgcaggactctctaatgaattgaaggactttggagagcaggtgattgatgctgacataaagtcatatggggtaatcataaatacttttgaagagttggagaaggcatatgtgagggaatacaagaaggtgagaaacgataaggtgtggtgcattggtcctgtttcattatgtaacaaagatggcttggataaggctcaaagaggcaaccgggcctcaattaatgagcatcattgcttgaagtggttagatttgcagcaacccaagtctgtggtttatgtttgttttggaagcctgtgcaatttgattccttcacaacttgtggagctggccttggccatagaagatagtaaaaaaccatttgtatgggtcattagggagggaagtaagtaccaagagttggaaaaatggatcagtgaagaagggtttgaggaaaggaccaaagggagaggccttataattcgaggttgggctccacaggtactaatattatcgcaccctgccattggaggattcttaacacattgtggttggaattcaacacttgaagggataagtgttggagtgccaatggttacctggcctctatttgctgatcaatttttaaatgaaaagctcgttactcaagtgttgaagattggtgtgagtgttggggcagaagttccaatgaattggggagaggaagagaaaactggtgtgttggtgaagaagaagaacattgagagggcaatatgcatggtgatggacaatgatgaagaagaaagcaaagagagaagagaaagggcaaccaaactctgtgagatggcaaagaaagcggttgaaaaaggggggtcttcccatcttgacatgactttgcttatacaagacatcatgcaacaatcaagtagcaaggaggataaacaacagacaataaacataccgcaatgttattgtgagaatctcgatatgataccttcatatagcacaggcacaagtttcttcaaagcaacaagtcttctacaacaaccagcggaaaaactctttgaagagttaacaccactagcaagctgcatagtctctgagtgtttgccatatgcaacccaaatcgtaaaaaaaatcaacgttctaagggtttcttttgttggagtaatttacttctgtcttttgtgtatgcataatataaccactcatactgttagggagagcataacatctgagtcagagtgctttgttctgcctggtatccctgacaaaattgagattaccatagcacaggctggacaacccatgaacgaaagctggaaaagattaatgaagaatttggggaagctgaaatgtctagtaacggggtaa

SEQ ID NO: 13666 - DNA, 1482 bp, Glycine max
  Peptide Sequence Number=SeqID_130444
atggctcaaggccatatcatccccatgatggacatagcaagactattggctcaccgtggtgtgattgttacaatattcaccaccccaaaaaatgcatcacgttttaattctgttctttctcgtgctatttcatcaggcctccaaatccgcctagtacaactccactttccatccaaagaagcaggactacctgaagggtgcgagaatttcgacatggtaacatcaatcgatatggtgtacaaaatgttcaatgtcatcaacatgctccataagcaagcagaggagttttttgaagcactaacacccaaaccaagttgcataatctctgacttttgcattccttggactgctcaagtagctcaaaagcattgtattccaaggatttcgttccacggatttgcttgcttctgcctccattgcatgctcatggtacacacttcaaatgtttgtgaaagtacggcttcagaatccgagtacttcaccatccccggcatacctgaccaaattcaagttaccaaagagcagatacctatgatgatctcaaattcagatgaagaaatgaagcactttagggagcagatgcgtgatgctgacataaagtcatatggggtaatcataaatacttttgaagagttggagaaggcgtatgtgagggattacaagaaggtgagaaatgataaggtgtggtgcattggtcctgtttcattatgtaaccaagataatttggataaggttcaaagaggcaaccatgcctcaattaatgagcaccattgcttgaaatggctagatttgcagccaccaaagtctgcggtttatgtttgttttggaagcttgtgcaatttgattccttcacaacttgtggagctggccttggccttggaagatactaagaaaccatttgtatgggtcattagggagggaaataagttccaagagttggaaaaaaaatggatcagtgaagaagggtttgaggaaaggaccaaagggagaggccttataattcgaggttgggctccacaagtgctaatattatcacacccttccattggaggattcttaacacactgtggttggaattcaacacttgaagggataagtgctggcgtgccaatgattacgtggcctctatttgctgatcaatttttgaatgagaagctcgtcactcaagtgttgaagattggtgtgagtgttgggatggaggttcccatgaagtttggagaggaagagaagacaggggtgttggttaagaaggaagatattaagagggcaatatgcattgtgatggacgatgatggagaagaaagcaaagacagaagagaaagggcaaccaaactcagtgagatagcaaagcgagcagttgaaaaagaaggctcttctcatcttgacatgactttgcttattcaagacatcatgcaacaatcaagtagcaaggaggaagtaaggacgagccttaaagagtcgcaattttcttgtaacgcttga

SEQ ID NO: 13667 - DNA, 441 bp, Glycine max
  Peptide Sequence Number=SeqID_130445
atgggtccccaagaacaacaactccactttgtcttgtttccattgatggctcaaggccacatgatccccatgatggacattgcaaaaatattggtgcaccgcaatgttattgtgacagtagtcacaacaccacataatgcagctcgtttcacttcaatctttgatcgttatattgaatctgggttccaaatcagattagctcaacttcagttcccatgcaaagaagctggagtaccagatggatgcgagaatctcgataccataccttcacttggcatggctgcgggtttcttcaatgcaacaaactttctacgtgagccagcagaaaaactacttgaagagttaacaccaccacctagctgcataatctctgatatgtgtttaccatatacaaaacacattgctagaaaatttaatattcccaggatttcatttgtcgga

SEQ ID NO: 13668 - DNA, 2766 bp, Glycine max
  Peptide Sequence Number=SeqID_130446
atgggtgcccaagaacagcaactccactttgtcttgtttccattgatggcacaaggccacatgatccccatgatggacattgcaaaaatattggtgcaccgcaatgttattgtgactgtagtcacaacaccgcataatgctgctcgtttcacttcaatctttgatcgttatattgaatctggatttcaaatcagattagctcaacttcaattcccatgcaaagaagctggagtcccagatggatgcgagaatctcgattccataccttcacttggcatggccgcgggtttcttcaatgcaacaaactttctacgtgagccagcggaaaaactgtttgaagagctaacaccaccaccaagctgcataatctctgatatgtgtttaccatacacaaaccacattgctaaaaaatataacattcccaggatttcatttgtcggagtaagttgcttctatctcttttgcatgtctaatgtacgcatccataatgttatggagggaatagctaatgaatcggagcactttgttgtgcctggtattcctgacaaaattgaaacaaccatggctaagacaggactagcaatgaatgaagaaatgcaacaggtcactgatgcagtgtttgcagttgaaatggaagcttatgggatgatcatgaattcatttgaagagttggagccagcatatgcaggtggatacaagaagatgagaaacgataaagtgtggtgtttgggaccactgtcatatagcaacaaggatcaattggataagtctcagagaggtaaaaaggccacaattgacgagtaccacctgaagagctggcttgattgtcaaaagccagggactgtaatatatgcatgctttggaagcatatgcaatttaacaacaccacagttgatagagcttggtttagccttggaagcatcagaaagacccttcatttgggttttcagggaaggaagtcagtccgaagaattggggaaatgggttagtaaagatggatttgaggaaagaaccagtggtcgtggccttctaattcggggttgggctcctcagttactaatattatcacaccctgctgttggagggttcataacacactgtggttggaactctaccttagaagcaatatgtgctggggtgccaatggttacatggccactatttgctgatcagtttttgaatgaaagtctagttgtggaaatattacaagttggagtgaaggttggggtggagagtcctgtgacatggggcaaagaagaggaagttggtgtgcaagtgaagaaaaaagatgttgagagggcgatcacaaagttaatggatgagacaatcgaacgagaggaaagaagaaagaggataagagatcttgctgagaaggctaaaagagccacagagaaagggggatcatctcattctaatgtgaccttgcttatccaggacatcatgcaaaaaatcaaacgagatggagaagtctcgttgaaaaaaaagaaagatgagtgcaacgctatcttaaaagaaagagatttcatcaaagcaaaaacagctttctctcatggtattccaactccggcagaggcagaaagctgggctcttctccaagctatccaatgggcagcacatcttggttatgaaagggtagtttttgagagcgattgtaaactggttgttgactatgtcactcatgacaccaatgaagctggagtaccagatggatgcgagaatctcgacatgataccttcacttggcaccgccgctagtttctttagagcagcaaaccctctacaacaaccagtggaaaacctcttggaagagttaacaccaccaccaagctgcattatctctgatatgggtttaccgtatacaagctacattactaaaaactataatattcccaggatttcatttgttggaggcataactaatgaatcggagaactttgttgcgcctggtatacctgacgaaattgaaacgaccatagctaagacgggaataacaatttatgaaggcatgaagcaggttagtcatgcaatgtttgaagctgaaaaggaagcttatgggatgatcatgaattcttttgaagagttggagccagcatatgcagggggatacaagaagatgagaaacaataaagtgtggtgtttcggacctctatcatttactaacaaggatcatttggataaggctgaaagaggtaaaagggcttcaattgacttgttccacctcaaggaagaaaatcagttagaagccctggagaaatgggttaagcaagccggatttgaggaaagaatgaatgctcgcggccttctaattcgagttggaactccacctgaggcaatatgtgctggggtgccaatggttacatggccactatttggtgatcagtttttggatgaaagcctagttgttgaaatattgaaagttggagtgaaggttggggttgagagtcctgtcaaatggggcgaagaagaggaaattggtgtgcaagtgaagaaaaaagatattgaaatggcaatagaaagtttaatggatgaaacaagtgaaagtgaagaaaaaagaaaaagggtgagagaggttgctgagatggctaaaagagcggtagataaagggggttcatctcattctaatgtaaccttgcttatcgaggatatcatgggaaaaatcaatttctgtattggaacccctttctgcgttggggctaagacgtatctgagttttgctccagagtcgagaaagagtataaactataagggttcggcccaccctttatga

SEQ ID NO: 13669 - DNA, 366 bp, Glycine max
  Peptide Sequence Number=SeqID_130447
atgggtaaatgtggttggaactctaccttagaagcaatttgtgctggggtgccaatgcttacaaggccactttttgcggatcagtttttgaatgaaattctagtcgtgcatgtactaaaagttggagtggaaattccgcttacatgggataagaaagtggaaattggtgtgcaattgaagaaggaagatgctgaaagggcaatagtaaagttgatgtatgagacaagtgaaagtgaagaaagaagaaaaagggtgaaagaacttgctgagatggctaaaagagcggtagagaaagcgggttcatctcattctaatatgaccttgcttatcgaggaaatcatgcaaaaaaccaagagagatgtgtga

SEQ ID NO: 13670 - DNA, 378 bp, Glycine max
  Peptide Sequence Number=SeqID_130448
atggtggaaagggagaaatttgatcatatagaggaaaggttgagggctattgaaggaggtagagattatgcatttgctgacatggcagaattgtgcctggtgctcgacgtcgttatccctctgaagtttaaggtgccagatttcgataagtacaaggggactacttgctccaagaatcacctgaagatgtacaacaagaaaatgggggcatactcgaaaaatgaaaaattgttgatgcatttcttccaagaaagtcttactagggtagtcgtcaccttgtatactaatctggaaccttcccaagtccattcttggaaggacctaatagttggcttcataggcagtatcagtacaattctgatatggctccggatataa

SEQ ID NO: 13671 - DNA, 891 bp, Glycine max
  Peptide Sequence Number=SeqID_130449
atgacaattaatgaaggcatgaaagagtttactaatacaatgtttgaagctgaaacagaagcttatgggatgatcatgaattcttttgaagagttggagccagcatatgcagggggatacaagaagatgagaaacaataaagtgtggtgtttcggacctctatcatttactaacaaggatcacttggataaggctcaaagaggtaaaaaggcttcaattgacgatggccacctgaagagctggcttgattgtcaaaagccagggagtgtaatatatgcatgctttggaagcatatgcaatttaacaccttcacagttgatagaacttggtttagccttggaagcatcagaaagacccttcatttgggttttcagggaaggaagtcagtcagaagcattggagaaatgggttaaacaaaacggatttgaggaaagaatcagtgatcgtggccttctaattcggggttgggctcctcagttactaataatatcgcaccctgctattggagggttcataacacactgtggttggaactctaccttagagacaatatgtgctggggtgccaatggttacatggccactatttggtgatcagtttatgaatgaaagtctagttgtagaaatattaaaagttggagtgaaggttggggtggagagacctattacatggggcaaagaagaggaaattggtgtgcaagtgaagaaaaaagatattgaaagggcaatagaaagtttaatgggtgagacaagtgaaagtgaagaaagaagaaaaaggataagagagcttgcagagaaggctaaaagagctgtagaggaagggggatcttctcattctaatgtgaccttgcttatcgaggatgtcatgcaaaaagtcaagagagatgtgtga

SEQ ID NO: 13672 - DNA, 327 bp, Glycine max
  Peptide Sequence Number=SeqID_130450
atgtctactaggaagagaagggacacaatttctagggttcaagagcaagaaccggagcctcccagactagatatgcagaaaacattgaaaaacatgaacattctttctcagaggaatatggaactgattgatggtgaaggaattctacgccaactgtcgcaacgtgcccttcgcgggcgagcgagggcgaggctcacgggtgcgctttccaaaggaggaaagatgcgcggagtcgccaccaacgtttatttgtgggaaacgtcggaaaaactgaaggaaactggtcaaaatgaaaattctaagttcgggagttgtatttacgcttga

SEQ ID NO: 13673 - DNA, 1470 bp, Glycine max
  Peptide Sequence Number=SeqID_130451
atggcttcccaagaacctcagcttcacttcgtcctgtttccattcatggcacaaggccacatgattcctatgatggacattgcaaaagtattggtgcaacacaacgttattgtgacagtagtcaccacaccacataacgcagctcgttttgcatcaacgactgatcgctgtattgaagcggggtttcagattagagtagctcaacttcagtttccaagtaaagagtctggattaccagaagagtgtgagaatcttgatatgctaccttcacttggaatggggttcagtttcttctgtgcagcaaacatttcatggcaaccagtggaaaaactatttgaagagttaacaccagcaccaagttgcataatctctgacatgggtttgccttatacagtccacatcgctagaaaattcaacattcctaggatttgttttgccactgtaagttgcttctttctcctatgtttgcacaatttacaaacctataatatgatggagaacaaagctactgaaccggagtgttttgttttgcctggtctccctgacaaaattgaaataacaaaaggccatacagaacacttaacggatgaaagatggaaacagtttgttgatgaatatactgcagctagcactgctacttatggtataattgtgaattcttttgaagaattggagccagcatatgcaagggattacaagaagatcaataaagataaagtatggtgtattggaccactatcacttagtaacaaggatcaagtggacaaggctgaaagaggtaacaaggcctcaattgacgagtgtcacctaaagcgttggcttgattgtcagcaaccagggacagtaatctacgcatgccttggaagcctatgcaatttaacaccaccacaattgatagagcttggtttagccctggaagcatcaaaaagacccttcatttgggttatcaggagaggaagtatgtcagaagcaatggaaaagtggattaaggaagagggatttgaggaaaggaccaatgctcgaagccttctaattcggggttgggctcctcaattgctaatattatcgcaccctgctattggagggttcataacacattgtggttggaactctaccttggaagcaatatgtgctggggtgccaatggttacatggccactatttggggatcaattttttaatgaaattttggttgtgcagatattgaaagttggagtgaaggttggtgctgagagtactatcaaatggggcaaggaagaggaaattggtgtgcaagtgaagaaggaagatattgaaagagcaatagaaagtttaatggatgagactaacgaaagtgaagaaagaagaaaaagaataaaagagcttgcagaggtggctaaaagagctatagagaaagggggatcctctcattctgatgtgaccttgcttatccaggatatcaagcaaacgatcaagagagatgtgagataa

SEQ ID NO: 13674 - DNA, 1101 bp, Glycine max
  Peptide Sequence Number=SeqID_130452
atggcactaaatgagcaaaagggcaaggatgatatcccagaaagtcaatatcagaaaggagtgaagcagttgtgtgagaaaggtcatcttaatgcagtacctaaaaagtacatacttcctgtttccgaaagacccaccaagagtagtgtggaagatccaaatgttgtgaagcaaaatcttcagttacccatcattgattttgccgaattgcttggtccaaataggccccaagtccttcaatccctagccaatgcttgtcaacagtatggatttttccagctggtaaatcattgcatgttggaggatgttgtgaggagcatgatagatgtgagtggtaggttcttcgatctccctttagaggagagagctaagtacatgacaactgatatgcgagcaccggttcgatgtgggaccagcttcagccaaaccaaagacactgtgttgtgttggagggatttcttgaaacttctgtgccatcccttaccagatttcctcccccattggcctgcttcaccagtggactttcggaaagtggtgggcacctacgcagaagaaaccaaacatttgttcctggtggtaatggatgccatcctagagagcttaggaatcatggaagacaatattctgaaagactttgaaaatgggagccaaatgatggtagccaatttctacccagcatgccctcaaccagaccttacacttgggataccccctcactccgattatggcttcctcactcttctcctacaagacgaggtagaaggcttgcaaatccaacaccaagacaaatggatcactgttcaacccattcccaatgccttcgttgtcaatgttggtgatcacttagagatatatagcaatggaaaatacaagagcgtattgcatagagttgtggtgaatgaagctaagagtagggtgtcggtggcttcgctgcatagccttccattcaactgcacggtgagaccgtcgccaaaactcgttgacgaagcgaatcccaagcgttacatggacactgattttaggacctttcttgcgtacgtatcctccagagagcctaaaaaaaaggatttcctggagtctagaaaagttgcattaaattga

SEQ ID NO: 13675 - DNA, 225 bp, Glycine max
  Peptide Sequence Number=SeqID_130453
atgccaagaccagacaaacccaattggcctacgatgcatttgcgctcagcgccacacctcgcgcttagcgcgttcagatcgcgcgctgggcgcgccatgcacgctgggccggtgcttctgttggatcgggcgctgggcgcctgtgcgtctgttggatcgggcgctgggcgcctagctggcttagcgcgcgtaacggtttccgccacgcccagcgcctccagttag

SEQ ID NO: 13676 - DNA, 204 bp, Glycine max
  Peptide Sequence Number=SeqID_130454
atggctgcactgccgcagaggttgcgtgagagtgagagtaagaaggatagcgcaagagctattgatttgtgtaaacccacttatttcttcgctaatcacgggggagtctttcttaaccccctaattaagtacttaaaactggtctcaagatactcttcaaggagtaaatcctctagtcaaggaatgcattactcaatgaaatga

SEQ ID NO: 13677 - DNA, 1506 bp, Glycine max
  Peptide Sequence Number=SeqID_130455
atggaggtggcagaggcatatgctttagatgatgctgaattgagaatctccatttcgccatatttagccgtccatggatgccgccatgaagccggaaccggaatccgcgaccatttcgacggatcagcctcggaaagtttcggtggtgatgtttacattgtttacacttgcgccaagaggttactcgattcgtgcaacggtttttcagaacgcgcggaattgaaggaggacgcgaagaatgagtccacagaggtggttgcgaggacgcgcaagcggtgccggcaatcggagttgaaagcgaaggttgagtgttgtgatcagacggtggtgagtgagtcggagcaggtagttgagaatggcgaaagtggaatcaacggtgctgcattgggagctccgaggaacaagatggagttgaagatgtcgaagaagattgtgatcaacaggaagcctatgactgctaaggagcttttggatacaggttttcttgatggcgtctcggtggtttacatgggtggcattatgttacgaacagaacagaggacaaagctagctatgccaaactacactaatggaataacagctagtataatggctagtaacagaatggataatcctggtgttatatgggctgttgttgctatcaatatccaccgttggaaaaccaactttgtcctcaaggctattgcattcggaatctacagtcttctaccccaacctgtgccagccatggttgtggtggaggcggtggcttcggtggtggtggtggtggatgtggtggcgtgtgtggcggcggacatcattgccgatgatggacagagcaagaggttgagggtcgacgacgtgatccacagtgagatcggtagatacaagaaggagcccgacagggaccgagttgatgcgcttcttggtgtccacggtggtgatgaaagcggagcgaagactcaggagggactgggtgtgagagcggatagccagtcaaggatgacgtcaagtttgatggtcatctctagagtcttggtggtcatctccaaagtttgggtggtcatggtggatagggtcggggcttcgggattacgaggtgtgattagagatggggaatattgtgctcgtgccagtctatgccatggacgcagggcaagacaccagtccaagagggaaggattgaagtggattaaggaatatggatttgaggaaaggatcaaaggagtgggtcttttgattcggggttgggctcctcagcagttcttgaatgagagttttgttgtgcagatactaagaattggggtggaaagccaggtactctggggcgatgaagagaaaactggggtcttggtgaagaaggaagatgttgtgagggctatagagaagttaatggatgagggaaatgaaagggaagagaggagaaaaagggttacagagcttgcggagatggctaagaaagctgtagaaggaggatcttctcacttcaatgtgacccagctaatccaggatatcatgcaacagtaa

SEQ ID NO: 13678 - DNA, 675 bp, Glycine max
  Peptide Sequence Number=SeqID_130456
atgatgcaaacatttgtttcttatctaaccacaacctcaaccaattcgacatggagcatcaaatggcaaagacggcgacgacaacaacaacaacacattgtcctgcgacaaattgctaaaggtatttcgttaggcctcagacaacgcaacgaaggaacaacaacaacacaagaagaagctgcatcaagtacaacgagtgggtgcaagaggacatccttaacaaaatcccggttttctcaatctcaacaaaaacaacaagtgatgccattaatgaatgctccattagtttggggcaatgggaggatggggatgtgtggttacaccccaagattacaaaggccacaccccatgttgcttcacacgcactctctctcgtcgcacatgcggagaaagccacgaggtttggtgatgatgggtttgaaaaggtccttgcctttggatcagacatcttcgtatattgccattaccatacaaagagatcaactaggagaggctttcacctcttctaattcttctaccaaaggggtgatcatgacgagtcagtactataactatagatcaagatcgcgtagtaggcaccttgatcacatgtcttcggtgttgatgagatccttctcgcagtttcggaacagtactactgcaagtggtagatacaatgtgattcttccaaattga

SEQ ID NO: 13679 - DNA, 276 bp, Glycine max
  Peptide Sequence Number=SeqID_130457
atggctctgttgccgtcactccaaaattgtcaagtgactgaatcaaacagagcatacactctgagggagtccccaaagagagacttcaatgtcttctgccctttacatttcaaagactatcagagtctttttcctccaagactatcaaagtttgttggcttgcggagactatcaatgtcatccgctcttcaaagacttcaaagtcttttgtcaagactatcagagtcttctttacatttccaagactattactacgtgtttggatggggaatttaa

SEQ ID NO: 13680 - DNA, 237 bp, Glycine max
  Peptide Sequence Number=SeqID_130458
atggtggtcagcctcactaaagcttacaatggggttgccacactcattcgccaatgtgatcttcttccaccattctatcaagcccgctctatgctcaccttagaagaagttggtctcgcgaagaaggttgcaacaatatttaccccctcgaatgatgatggagggatgatcgttgtcactttattaagtcaatgtgtggaggtggtgattaagaagggtgacctatataatttatga

SEQ ID NO: 13681 - DNA, 146 bp, Glycine max
  Peptide Sequence Number=SeqID_130459
aacaccgcgtcgcaaagaaccaccccttctccctcttaacctttgccaccattgccggcggtgttctgtacaattgggtcgcgactgaagacggtgaagcacacgacaatattgggatgccgagtgtaggtgtttggaaagggtga

SEQ ID NO: 13682 - DNA, 3350 bp, Glycine max
  Peptide Sequence Number=SeqID_130460
atgaattccccacccaagttgttgttgctgtctcttctctttctcactctcttcactctttcttcctcctcctccctcccggagctccgatctctcctcgaattcaagaaaggcataacccgagatccggagaagcttctagactcatgggcccccaccaccgtcgccgagtccaccgccacgtgtccttcctcctggcagggcgtggtctgcgacgaggagtccggcaacgtcactggaatcgtcctcgaccgcctcaacctcggcggcgagctcaagttccacactctcctcaacctcaagatgctcagaaacctctcgctctccggcaacgacttcaccggccgcctaccgccgtcgctgggatcactttcgtcactccagcatttggatctttcgcagaacaagttctacggccccatcccggcgcggatcaacgacctttggggcctcaattacctcaatttgtccaacaacaacttcaagggcggcttccccagcggcctcagcaacctccagcagctgcgtgttctcgatttgcatgcaaaccatctctgggccgaaattggggacgtgctctccacgctccggaacgtggagcgcgtggatttgagcctcaaccggttctttggcggcctctccctcgccgttgagaatgtttcctccctggcgaacaccgtgcattttcttaacctgagttgcaacaacttgaacggtcgtttctttacaaactccaccattggcctttttcgtaatttgcaggttttggacttgagtgataactccatcactgggcagcttccttcttttggctccttgcccgcgcttcgtcttctcaggcttcctcggaatcagttgtttggttccgtgccggaggagctgttgcagacttcagtgccgctggaagaattggatcttagcttcaatgggtttactggtaactgttggagaattgatccctttttatctctttcaagttttgtgcgggcagaattgccactgtttaaagctctggttatggggaattgttgtattgttagagatgggaaaggttcatgccggaaaaccagggacctttttgatcttcagaatattgttatgctgccaaaaagttcgctggctgtggaagttgttttaatgaaaggggagaagggtggtcgggtaggagatggggcagaaagagagagaataagaggggaaaggaatggctcaatcggtgtaatcaactctacaactttaaattttttgaatctttcatccaatagtttatcaggctccttgccaacttctttgagaagatgtacagtcattgacttgagcaggaatatgttatctggtgacatttctgttatacagaactgggaagccccgttggaggtcattgatctgagttcaaacaagctgtcaggatccctgccttctattttaggaacctattcaaaattgtctaccattgacttaagtttaaatgaactcaagggatccattccacgaggtttagtcacttcatcgtcagtgacaagactaaatctttctggaaatcaatttacagggccacttctgcttcaaggttcaggagcaagtgaattactacttatgcctccttatcaaccaatggaatatcttgatgtatctaataactccttagaaggtgtcttgccttctgaaataggtaggatgggtgggctcaaactgctgaatctggcaaggaatggcttttctggacagctgccaaatgaattgaacaaacttttttatttggagtaccttgatttgtctaacaacaaatttactgggaatattcctgataagcttccatccagcttaactgcatttaatgtgtcaaataatgatctatctggtcgtgttcctgaaaacttgcggcatttctctccttcatcctttcaccctggaaatgcaaaactaatgttaccaaatgattctcccgagacttcttcggtgcctgataacattccagataagggtagacatcatagttcaaagggtaatatcaggatagcaattattcttgcctcagtgggtgctgcaattatgattgcttttgttttattggtttatcatcgaacacagttaaaagaatttcatggaagaagtgagttcactggtcaaaatactagaagagatgtcaagttaggaggactttcgaggtcttctctcttcaagttcaatacaaacgttcaacccccaacatcttcattgagcttttcaaatgatcaccttttgacttccaattcaaggtcactctctggtggacagtcagagtttataactgaaatttctgagcatggcttaactcagggaatggtggctactagttcagtatctgtaaatcctaatttgatggataaccctcccacttcatctggaaggaagtcttctcctggttccccactgtcgtcctcaccccgttttatagaggcttgtgaaaagccagtgatgttggatgtttactcaccagatcggttggctggggaactgtttttcctggattcttccctagcattcactgcagaggaattatctcgagctccagctgaagttcttggcagaagtagccatggcactttatacaaagcaactctggacagtggtcatatgttgactgtaaaatggttacgggtgggattggtcaaacataaaaaggaatttgctagagaagttaaaaggattggttctatgaggcatccaaacattgtcccattactagcatactattgggggcctagggaacaagagaggcttcttttagctgactatatacatggggacaacttggctcttcatctctatgttgagtgtaatatcaatgtatctgtttgcacagagagcacacccaggaggtactccccattatcattcagccagagaataagagttgctgttgatgttgctcgatgtcttctataccttcatgatcgaggacttccccatggaaatctaaagccaacaaatatagtgttagcaggccctgatttcaatgctcgtcttactgactacggtctgcaccggctgatgacgccggctggaattgcagagcagatactaaatctcggagcccttggataccgtgctccagaacttgctactgcatccaaaccagttccatcctttaaggctgatgtctatgcacttggtgtgatcctaatggaattgttaacaagaaaaagtgcaggtgatatcatttcagggcaatcaggtgctgttgatcttacagattgggttaggctgtgcgagcgagaaggaagggtaatggactgtattgacagagacattgcaggtggggaagaatcctccaaagagatggatgaactgcttgcaatatctctcag

SEQ ID NO: 13683 - DNA, 1074 bp, Glycine max
  Peptide Sequence Number=SeqID_130461
atggcagaatcattgaagaagcgaaagggaacgtcctccaccaccgctgctgctggccatcgccgccacagaccatctgaagcacctacaacaccaattcacccttccttgtcatctccacaatcatctactctattttcttcagatgatcaacatttacggtacaattctcaattttcttctaggatcatcttagacccgaagtacctagacatagatttctttaatgatgagacatttgactgttatcaagtgtttcaaaactctagattagttgattttatgtccttaaaatttccttactatcctgaactagttagagtcttttacagtaatttaaatattcaggatggtattattcgctctgaggtgcatggtatttctatgattattgatcaaactctgttattttctttaactaaattacccaatcaaggtgcaccttttgagggcaccattgttgatgattggaagttcgactattctagtcatgatgcttgccgtatggtctgtaatgaccaggctgatatgaccggtagattgttggccagatcattaacctttgattgtcgcatcatgcactatattattgttagaattttgcttccccgttcttctaatctggctcaagcctctaaggaggacttgattttgatgtgggctttccttaccggttgtcaggtcgacagggctcacttggttaggtaccgaatgcataaggcattacgggccaatgcacctcttccgtatcctcaattggtcactctttttctccatcattttcaaattcctcttgatgatgaaccttttgttcaagtcaagcgatcttttgccatatgtgctagtgcaataacttcatttggttaccgtaaggatcgtgatggacaatggctaaagaaggacgcgctacctccgcaagacgagcgtactccctctcctcctccacagcgagatgattcctcagcccttatgaatgaagttctttcagaattacggggcctccgcacctatgttggcgaacgctttgattccttggatggtcgttttgaaggaatgaatactcgcatcacctag

SEQ ID NO: 13684 - DNA, 331 bp, Glycine max
  Peptide Sequence Number=SeqID_130462
tcggtttggccctgaacctacgtgcctatgacttcgtttctcaagaaatccgcgcagcggaagatcctgaatttgagactttctacaccaaaaatattctcttaaacgaaggtattcgtgcgtggatggcggctcaagatcagcctcatgaaaaccttatattccctgaggaggaaactaccggtttcgcttggtgggccgggaatgcccgacttatcaatttatccggcaaactactaggagcccatgtagcccatgctggattaatagtattctgggccggagcaatgaacctttttgaagtggctcatttcgtacccgagaagcccat

SEQ ID NO: 13685 - DNA, 422 bp, Glycine max
  Peptide Sequence Number=SeqID_130463
atcacgatgtagtgagggtctcagaaatccagaaagtgttggacatcagtggagtgcagacatatgtaatcaacagtgctcgagttttgttcctgaatgtgaggcctcagccaaaatctggaaaaggagtagctcagatttgtgagatttgtggaaggagcctcttggacccagttcggttttgctctttgggatgtaagcttgaaggaataaagaaaaatggggatgcaagctttgctttggatggtaggaatgaagaattgacaatggatacttcaaggggatcagtctcgtcaagacagcaagaagaaggattgcgtgaaggttcaacacaagacatgtattcatccacgccttctccaccttcttcaaatgcaaggagaagaaaaggcattcctcatagggcaccttttggctcctaa

SEQ ID NO: 13686 - DNA, 198 bp, Glycine max
  Peptide Sequence Number=SeqID_130464
atgggatttcagcaggacacagttgttctgatacctccttggcttgaacaacttcttcacacacccttcttcaacgtgtgtcggattcacgctgacgccgctagaagcgaatgtaacatgttttgcatagattgcaatggtgaagccttttgcttttattgccgttcttcaagacacaaagatcatcaagtcattcag

SEQ ID NO: 13687 - DNA, 438 bp, Glycine max
  Peptide Sequence Number=SeqID_130465
atgaatgggccaggcccgggaatccttattggatcaaactggaacagccattttccaacttctaagaagcaaccaagttttgttcccactttcctaagtttccttctcgctcccgtctctgaaatctcgagggtttcatcgttgctgaatcaacaattcggaaccaagattaatagcatatatgaatttccgattgtgcgcaggggatcacaagagcaacaatcgcaggatggttcttcgcagtcacagtcgtggtatccgccatcggtggtgagttcacctacttcatcgaggcctgttacaccgactgcatcttcttcttcattatcgcagaggccttcgtctcatgttccaccttccgaagctgctgcagttattgccgttttgaaggacaagaggtttgagttttcatcgtttattcgcttttcatggttttag

SEQ ID NO: 13688 - DNA, 591 bp, Glycine max
  Peptide Sequence Number=SeqID_130466
atggcactgtcaaaatccacatggcaaaagctgaaagatgaactttgcaaggagaatttacagcttgcagaggaaaatcttcaaaaggaacctcgcatcatggaacttaggaatcaatgtagaataattcgaacaactgagttagctgctgctaaggagaaattaaatgagcttgagaagcagaaagaagacatgttgaaattgaattccccagcatcccttctccaaaggatccaagagtctgcaaataagactgacgaggaatctgaaaacttgcaccagcatctccttgacagagagatagaccttgctgcttttttgcaaaagtacaagaagctacgtactacttaccacaggaaaactcttgtacatcttgctgctaaaacatcaacattcactattgtcaatagttatcattggtcaaagatatttgccaccaattatatagaagttgcagtcgttgggatagaaccatctactatcaatgagattgttcatattgtagagcctgagattgttcattgtgttgacattgtcaagtggtttcaggccacttgggatgaggctatgagatcatcatcgccgatatag

SEQ ID NO: 13689 - DNA, 1650 bp, Glycine max
  Peptide Sequence Number=SeqID_130467
atgggtggcggaggagccatgaggacggtggccaagttggccgccgccaggatcaggggcgtgccttctgttcagagagcttcgtcgcagaccgcggcggcggcgtgggacgactgggaagttgcagacggcggcgaggaagacggcgagggtgcggcgagggtggtgttgggcgatgtgcctagcattcaggaggccaaggcagccaccgctgaactgaaacatgctattcataatggtcaagtctctgttgtgtcaccttctcatactgagttggagaacaaatctcatttcactgaggctatcacatatccttcagcgccaaaccgtgctttacaggctttccaattgcttagtgaaagtcctgaggcccagagtgttgtagcttcgattgcttgtgacccgaatatatggaatgcaatcgcgcaaaatcctacgctacaagattttttccaatcacatcagacagcaatttgtgctgcaacagctgattttgaagttgagggaactcatgatcaaagagtgggagacttcctttattctgactcagtgtatgcatttgttgattctctaaatattctccacaacgtaaacttcacagtaactgaaatggtgagcagcgtgtcaaattaccttcagaatatgttcgggttcttaactggtcaaacatcttcagcggttattgatgctagaggaaatacaaaagcaaacttcgtggaccctatcactatgggaggaacttttttgggttttgcagtgttggtagtgatggcattgtcaggaatgctggaaaaattagtaaaggatgatgtgttacatggtattaaaatagcaaattctgctcctatgatttctcatcttttctttgcagatgacagtattatgttctcaagggccactagagaagaggcaagccacattctagccatcataaaatcatatgaggaggtttctgggcaaaggataaactacaacaagtttgaactttcttgtagccaaaacgtgcttggtactagatttgatgaattatcacagttgttggaggtaaaggcccttgaaagtcatgacagatatttggggttccctactttgataggtaggtccaagacccaacttttcgagtttatctttgatagagtttggaagaagctcaagggatggaaaggaagagctttgtcacaagcaaggggggtctcactgctcgtttcttttggcgaggagatgtcgaaggaaggaagcctcactgggctaatggtgaatgaggaatctttgatgtccagggttattaaagctagatacttcccaaagaaatctttgtgggaagtgaaaaaaaggatcaaatgcttgctacatgtggacaagcattatggagggaaggtggctgatggaaaaaggttgttcatggaagaggtggttctcaaggatttcagggtccaaaacccatttggggaagaagagggcacatggaataatgagttgattaaggatttgttttcttctagcatagctacaaacataaaagccaccccgctacaagtatcaacgatggccctggaaatacactcccaacgccatatattcgttgcgatgtgggtaggggagggtggagctgtagggggtgagatgaaggggtttgttgggaaaggctga

SEQ ID NO: 13690 - DNA, 1599 bp, Glycine max
  Peptide Sequence Number=SeqID_130468
atgacaagtgctgagatgatacccaccgcgctgtccattgaaaccagtgaccagagcaatgacctccggtcgtcgccggtgaagaaaatgtctgtggacgagatgctccagcaatactgcggcgagttcgggaagtggcatcttaggcactttgtgctcaccaatctttcatgggttttgctaggatttcacatcatggtcatgatttttgccgaccatgaaccctactggagttgccacgccggctccgtcggttccggttgcaacgcggccgccacgagcatctgccaactcaaaccgggttcgtgggagtgggtcggtggccacggcggcaccaccgtgtcggagtggggtttaatttgtggtaacaagtataaggttgggttggtccgggccgtgttctttgtcggctggatgattggtggtggagtatttgggcacctctcagactcctttcttggaaggaaacatagccttggagtagcgagtgccctaaacgccatctttgggtgcctaacagcactatctcctaactactggatctacgtcgtatttcgccttctcacaggtttcagcagcggtggggtcgccctgtgtgcctacgtccttgcatctgaaccaatcggccccaagaagcgcggtgccattggcatgtgcaccttctacttcttctcaggaggcattgcagttctctctggcatcgcttacatcttccaaacgtggcgctatctctacatagcctcctccataccctcctttctctacacattccttgtctttccctttctattcgagtccccgagatggtacctcgttcgcggaagagtaagcgaggcaatgaagctcatgtctgccattgcttcttccaacggaaaacaccttcccgagggcattctcctcgcgctcgacgaagaagtgaacaatgaatcctcgtgtcagggccgaaattcacaagatgaaaggttagaaaacaagggtggcgcgcgtgttggatccatcgtagacattgtccgctgccccaccacacgggtgcggctattaatcgccatgatgcttaatttcttgtgcgattttgtttactacggccttagcttaaacgtggtgaacttgaaaaataacctgtacttgaacgtgttgcttaacgcggtgggggagatgccagcatttgtgataacgacggtgcttttgggcaagtttaactttggaaggaaacccttgacggtggcaacaatgtggttcagcgggttcttttgtttgattgcaagtttaatgaaaaacgttggggtgtggaagattttgagaatggtgtgtggtgttttggcggtgtctgggatggcagggacttataatttgttgtatatttacacaacagagttgtttccaacagtggtgaggaacacagcgcttgggtttactacacagacggctcaaatgggagccatgttggcaccgtttgtggtggttttgggtggttggttgacctttgcagtgcttgcagcttgtgggataatgggaggagtgtttgctcttgttcttccagagacatcaaaccaacccctctatgatacattcagtggattggaagctggacttgcgtga

SEQ ID NO: 13691 - DNA, 297 bp, Glycine max
  Peptide Sequence Number=SeqID_130469
atggaggggtgtataaaacttaactgtgccggagcttatcttccagctatagaagtagcttcatgcgctgttgtccttagaggttgggtcattgttcgatattggaagcagagctctggaccgttttatatgatttgtgagaaaggaatagcatcgttgatggtggaaagggattcttttgatgctatcaagctcctagatgacaagagtggcgatggaaactgttttaaaatgcttgtgggtgagatttggagagtggaagagaagtttcatttgtgttatgagacatattcatag

SEQ ID NO: 13692 - DNA, 1146 bp, Glycine max
  Peptide Sequence Number=SeqID_130470
atggctggtgaaatttctgaacctggttcacgagccattgagatagtagtacgtcggggtcatattgttgaagatggatttcggcaattaaattcccttgggtcaaggttgaagtcatccatccatgtatcatttgtcagtgaatgtggtcttcttgaggctggcctggactatggtggattatctaaagagtttctgactgacatatcaaaatcagcattttctcctgaatatggactcttttcccaaacctcgacttcagacagacttttaattccaactgcatctgccagatatttggagaatggtcttcagatgattgaattccttggaagagtagtgggtaaagctctatatgaaggaatattacttgattactctttctcccatgtttttgtgcaaaagctattgggacgatatagctttcttgatgaattatcaacacttgatccagagctatacaggaatcttatgtatgtcaagaattatgacggtgatgttaaggagctctctattgatttcacagttactgaagaatcattgggcaaaatgtatgtggtggaacttaagtccggtggcaaagatatttctgtgacaaatgagaacaagatgcagtacatacatgcaatggcagactacaaactcaaccaacagatattgccattttcaaatgcattttatagaggggtaactgatcttataactccatcctggttgaagttattcaacgctagtgaatttaatcagttgctttcaggtggtaattatgatattgacgttgatgatttgaaaaacaacacacgatacactggtggttacaatgagggaagccggacaatcaagattttttgggaggtaattaaaggctttgaacctaaagagcgctgtatgcttcttaaatttgtcaccagttgttctcgtgctccattacttgggttcaaatacttgcagccaccttttaccatccacaaggttgcatgtgatgttcctctttgggcaacaattggaggacaagatgtagatcgacttccatcagcttcaacctgctacaatactcttaagcttccaacatacaaacgtccaggcactttgagagcaaagcttctatatgccatcagttcaaatgccggatttgaactttcttga

SEQ ID NO: 13693 - DNA, 1884 bp, Glycine max
  Peptide Sequence Number=SeqID_130471
atgagacacagcttccatttttggtatgcctttcttcttatccttgtccttggccgccacatttcttcactgaagacttgtccaaactgtggcactatccaagttccataccctttgagcacagattcaacttgtggtgatcaaaactacaagcttcgttgtgatccccactctcaaaggcttttgttcgacatcctcaacggaagttcctatcttgttctcagaatcatgtcttcaaaccaacgcatggtggttcagccatcaccttggttaccaggttcgtgtgtcacacaagacatgccaagaagcaatggtatatggttaaatcaatcactccctttcaacataacttcatccaacacagtgttcctctttaactgttcccctcgcctcttggtttctccacttaactgtacttcttctagtatttgccatcgttatttggagaattcaggccatgttgacacaaaactatcattagagtgtgcaagtggtcttcacccttgttgcacttttctagctggagggataccttcagcttacaggatccggcttcatgattctggttgcaaagcattcagaagcataattcacttgaaccaagacaagcctccgaatcagtgggaggaagttcttgaaattcaatggtctcctccacctgaaccagtctgcaacaatcaaagggattgctctgaagactctaagtgttcccctactaatagaaatggcctatttcgatgtctttgtaatgggggacacgtttggaacccttttgaagcaacctgtgtgaggtatgagagaaaatccaaatggaaaaccagcttggttgtctcaataggggttgttgttacttttttctcccttgctgtggttcttaccatcatcaaaaagtcctgcaaactctctaactataaagagaatcaggccaaggacgaaagagaagagaagctgaaatcaagtgctatggagaagccttgtaggatgtttcaactgaaagaggtgaagaaagcaacaaacggcttttcacacgagaggttcttggggagtggtggatttggggaagttttcaaaggtgaattacaagatggaacattggtggctgtgaaaaaagctagagtgggaaacctgaaaagcacccagcaagtgcttaatgaggccgcaatactttctcaagtgaatcacaagaacctagtcaggctcttggggtgttgtgtggaatctgagcttccacttatgatctatgagtatatctcaaatgggaccctctatgaccatcttcatggtaggtattgttccaactttctagattggaaaacaaggctcaaagttgcttttcaaactgcagaagcattggcttacttgcattctgctgcacacactccaatctaccatagagatgttaagtcaacaaacatactattggatgatgaattcaatgcaaaggtctcagattttggactctcaagattggctagccctggattgagtcacgtgtcaacatgtgctcagggaactttagggtacttggatcctgaatactaccgcaactaccagttaacagataaaagtgatgtttatagttatggggttgtgttgctagaacttttgacatcacagaaagcgattgacttcaatcgtgatcaagatgatgtcaacctagcaattcatgtgaaccaacatgccagcaatggtacaatcatggaagtgatggatcaaaggcttcttatttccctggagactttgggggataaaatgttcacaagcataaaactctttttggagcttgcacttgaatgtctaagggagaagaaaggtgaaaggcctaatatgagggatattgttcaacgcctactatgcataattaggattgtagaacaagagtga

SEQ ID NO: 13694 - DNA, 708 bp, Glycine max
  Peptide Sequence Number=SeqID_130472
gaagagatggagcgcgtggtgctggcggtgcttggagaggaaggagatgagggtggtgtaggagacgacgttgggggaagggagggagaggaagaggcggagggcgtgggggaagaggttgagtttgaggtaagtggagatgagggcgttggagagatgggtgtcttcttcgtcgcgtttgaggagcgtggcgtggacggtcttggccaggtgggtgtcgccggagcgggaggacacgtggagggcgtggaggagggagtgggactccgggggaaggtagtgggtgccatggcggagtttgtggcggagagagagggaggacggtggtttggagtagggaggagaaagggaagagttgaagaaggatttgcagtggaggcctacctgccattgccattgccatctatccataatgccatatcctctactgtttcgttgagaggagcaagtgcgaaggagataacaagagacgcgcttcttctgaaggtctctcaggaaagagaacttcgcaattacgcaaaaagagctgctgctgctgcgctcttcattcagcagttacaacaacaacaaagtcttatcccactaggtgaagttggcaataaagcagttacaacaatcagctgtaattctaacagattagctaaaagtatagggaggaatgatagacctgaagttgatatagtctattacaacatggctaccatttag

SEQ ID NO: 13695 - DNA, 1008 bp, Glycine max
  Peptide Sequence Number=SeqID_130473
atggagacgcttcaaggtcacaaagatgatttccctgcagcttcagcaggaatgggagatagcggtgaatcattatactggtgtgatgacagcaaattggatttcaaacgatttgttgagaccatttctgttctttatcacccatatattagtgcattagaaaatcattcctctcagtcaaagagtatcacccaggcagatgatttttttttcattactgcaagtgcaataactatagctgtgcggccattttatctgacaaactatgatgtagaagtgcctggtgcactggatgtcaaccatgctgctgagcagttttttgtttatcttctgactataccttggctagtgcaacatctcccacctgttcttctacctgctttaaagcacaaatctattttgtttccatgcttccagactctattgactttgaaagagaaagttttgccagagatgtcagagtttgtcaaatcagaaatacttgtctctttcaaggctattccaccagttggttgggctctcactaacagtatatgcctcgcaacagggaatgagattgaatccttcaatcaaggtttagagtatgcattgtatgtccgtgttgttactactctaccagaggccctactggcttgtcttgataacattggatgggtcaaaaggaaaaagaaatcccttcaaactgatgttgaaagttcaacacagccagttgatacaattcagcatgagggtgaagcaaccaatgaatccttaataatgtcatacatggatcaatttaggcctgtttgtcagcagtggcatctcaaaaatcttttggcatcaatagatagagatgccactaacaaggctgaggctgtgctctcaaatggcctggcatgtctggggaagctagaattgtgtgatgttgcacttttttattctaacttacttagaatattttcatttttgagtccaattcgtggctcattgtcagttctcaacatgctagcattcactcctggatttctt

SEQ ID NO: 13696 - DNA, 396 bp, Glycine max
  Peptide Sequence Number=SeqID_130474
atgtcagttggaggattcaaaaccgtgacctctctttcttcccttctcctttcactcttttccaactgccaggtcaaccttgtatttctaaaggtgttgcattgtgatattctaaagaaaggattggagagcaaagttgatgtgggatctgccatcacatatatgtatgcaaaatgtggaagactggatattgcttacgaattcttcagaggaatgttcgaaaaagatagtgtttgttggaactcaatgatttcaagcttctcacgtaacgggaaaccagaaatggccattgatctttttcgtcaaatgggaacgattggagccaagtttgattctgtgaccagaaatagcatctgctgtctctgctgctgcaaatttaacagcactatattatga

SEQ ID NO: 13697 - DNA, 276 bp, Glycine max
  Peptide Sequence Number=SeqID_130475
atgttggtgcgcatgatccgcactcgtctctttgcagcggtacgggtgaaatcttgccccggtatgcatagtagctgcgtgatagcctccctctctggatgtattcgcacagttggagccctccaatatcaggggtggcccgggaaaaagaatgggaagatgaccttaaatcctcttaaggtgtggatatggagcccactgaaagtgaggacgcatagccctcaaaaggcgagggagagtgcagccctccgaaggcgaggacgtgtcgccctttaa

SEQ ID NO: 13698 - DNA, 591 bp, Glycine max
  Peptide Sequence Number=SeqID_130476
atgagcaagtgggagcatgagtcctttaaggagtatgcgaaatggtggagcgacttggcagcacaagtggcaccccccatggtggaaagagagatgataactatggtagtggacacaccgccggtgttttactatgaaaagttggtgggttacatgccttctagcttcatagatctagtatttatgggcgagaggatccaatatgctcaacatcaaccaagatttttggcccgcatcggaaacccttccaatccggtgcccatccagcaaagggcactttctcaaagggcccccactcaaaactcggctccctcacaacctcgccctgccggcaactccaatcctagcacaagtgccaatccggggaggaattttctagtgaagaaacttacgaaatttgccccgattccgatgtcgtatgtggacttgctaccatccttgatcgccaaccaaatggcggtggtgacccccgggaaaatttaccaatctcctttccctggatggtacaaccccattgtaacatgcccttatcataggggtgtcctggggcattcgatagaacaatgtgtggccctcaaacataaggtctag

SEQ ID NO: 13699 - DNA, 240 bp, Glycine max
  Peptide Sequence Number=SeqID_130477
atggaagaagtaggggagatcaaagcaagaggaactcttcgacaaaagacaaaatatgactctaactcgctaattaacccagatttgaacgaggaagtcacaatgtggctctatgtgaggtctatgagcaagacttctattgtcacgcacggttgggctgagcaagcggcaattccgactatgtttggagattgtggcggagacgaaagtgggagcatgatagtggtctttttgggttga

SEQ ID NO: 13700 - DNA, 849 bp, Glycine max
  Peptide Sequence Number=SeqID_130478
atgaaaatgaaaaaaattatcgcactggcgttaggttctttgcttctggctggatgtaccactcctgctcacaattatgttccacaagtaaaatctttcagcattccccagctcaatacagtaacaaccacgtatgttggtgaggacatgattagacagggtgtggatgccagtatggaggttctgcattttgattcaccaaccgagatcgggtcgctgggaacttataccgttccagctggagactacgtaaaaactggtgatgacgccaaatcagaatactttctttcgactgaaagaacgaccggaacacaggtgcctttccgggtgatggtcaatgacccaccacaaagcattcaggtgtctaaattaggcaaagaggtgtgtgtagtttccatctatgggggcactaagtgctcatccaatgtggcttacagtaagaaaaaagttaacaccgagcgcgaatcttccttccagcagacgctaatctacaacggcaaggtgggtcaaaaaatcaatatcggttatagagagtttcagggcgggttagctagggcggcgttctccaacgaagtcgaatatgacttagctgagtccaaaaccattcgttacaaaggggctattgttgaaattatggatgccaataaccaatcaataaccttcaaaggggtgattatgattaagaaaagagtagcgccgatacttctcagccttgaacaggttgaggcactccaaaaaatccagcagcaggaacgcgccaaatcaccattaggcgtagctccaactattcatgttattgctcgcggtctcatggacaaagcgatcgcacagtttgctgagggggcgtga

SEQ ID NO: 13701 - DNA, 171 bp, Glycine max
  Peptide Sequence Number=SeqID_130479
atgacggtctatcatttcttcaactacgccattctcaccttcggcccccatgctgtcttctattttgccacgcccttatctgagtatgatacactcagaacctctatcaaagccgttgttgtttatcttgcaacgacattagtgaaagttggtgaatatactgaattctaa

SEQ ID NO: 13702 - DNA, 150 bp, Glycine max
  Peptide Sequence Number=SeqID_130480
atgcttaatcctgcaaagttcataactgagatgtccatctcccgacttgcagggggtgaggaagggacggtgaggctttggggtgagaggatctgtggcggtgactatgaggctttgggttcggtggcaggagtattgaagggtgcctga

SEQ ID NO: 13703 - DNA, 168 bp, Glycine max
  Peptide Sequence Number=SeqID_130481
atgacgatggtcatcaatcgatgtagttggtcccaaataaccaatgtagaatgttgtttctctagtaatgaaggtggaagagaaacatcaaggttcattgcgaagatgaagacaaaggtagttaacaacatcgacatacctggaactcaagctcaagaccatttgtaa

SEQ ID NO: 13704 - DNA, 270 bp, Glycine max
  Peptide Sequence Number=SeqID_130482
atgattgtgactggatctccatcgagtttgttgaagcttgagatttcttcattcccattgagttcaaactcagtattacatcataaaagaagggaaacaaagcacgtgttgatggaggcattggctttgtatgagtatcaaagggagcctaatcatgaaatgtggagagattcacacctaattagggttcaagatattgagagaagaatgaggcagctagagggcaagagactacgtgatgcaatcctaccccgcaagggcattggctag

SEQ ID NO: 13705 - DNA, 463 bp, Glycine max
  Peptide Sequence Number=SeqID_130483
atggtggcccaagcccgggctgttgatatgctcgtggagacgtcatcatcgcgattgtggatggcagcgcgcgcccttggcgtgcctcggcacctgcgcgctccgggcgtcggcctgtgggctccccattcggcccgtcttgaaacacggaccaaggagtctgacatgtgtgcgagtcaacgggcgagtaaaccccatacctgtcgggacccgaaagatggtgaactatgcctgagcggggcgaagccagaggaaactctggtggaggcccgcagcgatactgacgtgcaaatcgttcgtctgacttgggtaggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttg

SEQ ID NO: 13706 - DNA, 384 bp, Glycine max
  Peptide Sequence Number=SeqID_130484
atggcagcgcagttgatccatgatcgcgttgtgatggagtgcctagaaggtgtttgggagaccctcgaaggcaatgagaagtgccgattcgttggcacaattcgactcactgttgtctcattagtacatccggaggaacccgcacgtacacttcagcagcctgtggagtggatactacctactcctactccatatcaactagttgagccagttcaagtgatagagatgtcatcctctgaagaggatcttgaaaaggacccagaggagttacctcctgaacctgctatggatgcccttgacttacctgaggatgatgaagacccactccctgatgttgattttctagaggatattatgtcagtatctgaggtagactctacatag

SEQ ID NO: 13707 - DNA, 528 bp, Glycine max
  Peptide Sequence Number=SeqID_130485
atgcataaagctgttcagaaggctatcagtcttaaacaccagaagattcagtccaagattgacagatgtaagaaaaacaagaaatttctggatgatcttaataagaatgctttgaaatatgaggacatttggaaaacaaagatacttaggattgaagagagtaaatttgaaagcatgaataagctgcaaaaccaattggagaaagtggagtctcttactcaagatcttgaagaagggcttgagtttccatttaggaatttaataaacactaggggcattgttagatcctgtgcctgtcctataaattctagtgcagatcctgtggcaacaacagaaggagagtatgaggaggtgattcagctgtgtggcaagacccttgattctgttgagcagaatgcctgtcctttggatgctggttgcaaagtcacagatctggatgattcacaactctcgaaaggtttctatttcagaatatggcgatgctcaatgatgcttaaagcatacattcacctaggattagcagtgtaa

SEQ ID NO: 13708 - DNA, 339 bp, Glycine max
  Peptide Sequence Number=SeqID_130486
atgtatcattcacaaacatccatgcttatttttcttttcacatttggatgcgttgctctttgcattctttccttgaaaatccgaactgtaatcattgtaatcaaaaggaaagaactcgctttacgatgcccttaccaaacgcgtgccaaagctagagtaatgggtgaaatgatggaagccatgaaagagcaaatgaccataatgatggaagccatgatgattatgagaaggatgatgaaggtcaatgcggctatagttgttgccgcatgtaccgccacagaagtggacccgactcacccatctagcttcaatcaagtaaatcatccaacctcggatatg

SEQ ID NO: 13709 - DNA, 216 bp, Glycine max
  Peptide Sequence Number=SeqID_130487
tccacacacctccactgttgggatttgcaaagaattgtctgtggagggagaaatatgcatcgcacgaagcattacaaaatggaggcttcaatcccttctctttctctctaacgtttgggaactctatcagagcaatcagaggaaaaattgaggaatctcagaaaattgctagagatgccgctatcgctgtcggaagacacgtgatcccgcttagag

SEQ ID NO: 13710 - DNA, 383 bp, Glycine max
  Peptide Sequence Number=SeqID_130488
aagcccctcagcgtcgaaggccgacaacatctgctcgtagacaacggacagctgtagttgttgctgaggatgttgaccatgtcgatcatactgctgacgaggttcatgaggagcctcaggggccagttcctgatgatgtacgtgttgatacacagggttttctaagcaagcccaaagatacatcagtgttgacagattatgtttatcatgtgggagccagagtttgggaagaagagctgcccattactggcaccttccataccttcaatgctcttgatgtagaccaagtcgtggacttgttagttgagttgcttgaagtcagtacacaagaagcaaaagataagacacttcaatgccaaggggcctatgttcacctagtctag

SEQ ID NO: 13711 - DNA, 261 bp, Glycine max
  Peptide Sequence Number=SeqID_130489
atgagtgttgtgaatgtttggccttcttcggaattacaactaatcttggtacctatcttaccaccagattacatgaaggaaacgtttcttctgaaagaaacatcagcatatgtcaatagcggccgctatagcggcggagtggcccccatccccgacgggcacctctttagcgaagcagtttcgtgtcgcggctggagtggccgctatcgtggcggcacgggttctggagcagtttttcacgccactacttcgaagcactga

SEQ ID NO: 13712 - DNA, 237 bp, Glycine max
  Peptide Sequence Number=SeqID_130490
atgtatattgttgtggtacaacaggggcaggatcaccttgggctaccttctggagtgaagacaaaacatgaacggcagaaaccaatcaaggtacttaaggatgaacgcaagcagggatggggtcacgaccgaccgatcgttacctttctctgtgctaaacaagcagggaatgtcgctgcaaggcagccccgtatcctttatattttgcagctttcttttactatttgtttgttttaa

SEQ ID NO: 13713 - DNA, 402 bp, Glycine max
  Peptide Sequence Number=SeqID_130491
atggaagcggtactcccatttgaggtagaggtcccttcccaaaatatactagcggaatcgggcctagaagaatcagagtgggctcaaacacactacgaccaactaaaccttattgaaggtaagtgtttgacggccataagccatgggcgcctgtatcaacaaaggataaagaacgcgttcgacaagaaggtgcaccctcgcaagttcaacgagggggaccttgtgctgaaaaagatatcccacgctgttaaagataatcgagggaagtgggccccgaactacgaagggcctttcgttgtgaaaagggctttttctggaggggctctagtgctcaccaacatggatggtgagaagctaccctcacccgtgaactccgatgttgtcaagcgatactacgcttag

SEQ ID NO: 13714 - DNA, 306 bp, Glycine max
  Peptide Sequence Number=SeqID_130492
atggaagaaaagaaaccaaaattaaacgaaataaagatgaaagccaaaaaacaaaaaggaattaaaagtctcggatttggaaacttacccattgaagaacgaagaacggatgaacaacagatgaggaacggtgaagaacggaggaaaaccatcacgaatttacttacggaaacttctcggaagcgttacggaagcacctcggcttggattttttcacagaaacaatttttttcacccaaaatagctgaaatgcatagccaggaggataagggacccttagaacagcccccttttgcctttttatag

SEQ ID NO: 13715 - DNA, 462 bp, Glycine max
  Peptide Sequence Number=SeqID_130493
atggctccgaaacacatggagcagttgacgcaaaaaatcagggaccagctggaggagtcgatcacagaaaaagtgactcgacaagtactcacactacctcctgagcctgtagatggtcgttcagctactcatgtcagcacaaaggaaaatgttgttatctggttttgttcgttgcataataggctagacttcctgaaaggaattattatcaggtcagatatatttttcaatacatttacattagcattatttgggaacatcaatattttaattgtgcaattcacatccatgtttgtattgaacaatgctttgaaaggatttgacgatactccacaaagtaaatccaaggctactgctaggtggattgttgttaaatgtaatagacaaaaaggaagtactgcgtgcgagtattacgtcatgcaccggatgtcaactaataatcttaggaagtttcaagaataa

SEQ ID NO: 13716 - DNA, 318 bp, Glycine max
  Peptide Sequence Number=SeqID_130494
atgaccgaccctctcgatgagtcgatctcttgctttctcataagggtgaacccttgggtactagttaccctcaccatcagagggctgcacgccctcacctccagaggactacatgtcctcgccttgagagggctacacgccctcaccttgggtactagttaccctcaccgtcagaggactacacgtcctcgccaacagagggcttcacgccctcaccttgaagaggactacacgtcttcgccaacggagggctgcacaccctcacctttagaggactacacgtcctcgccaacagagggctgcacgccctcatcttga

SEQ ID NO: 13717 - DNA, 228 bp, Glycine max
  Peptide Sequence Number=SeqID_130495
atggcgtcatcgaccctccatcccccggattcgtttgaggagcaggccacacagggatcgttcgtcccccatggacgtcaggatgttctggccgctgctattggacatccagagcaccctggacatgtccgtgctgctggagccggtgtcaccatcaagcaatactttggatcggctccacggacgtcccgcagcgcttcctccatgcctcctgacgaattacaatag

SEQ ID NO: 13718 - DNA, 375 bp, Glycine max
  Peptide Sequence Number=SeqID_130496
atgcctgtccggcatcatggacaccctcaacaccctggttgccgatgccgcgcaccaggtgcgcacgccgctggcctcgctgcgcgcccaggccgaagtggcgctggacgaaaccgaccccaagcgcctgcacgagcgcctgggccgcatccaccagaatgccactcacgccagccagctcatcaaccagctgctgatggacgccaccatcacgcaccggctgggcaagggcgcgcgcgcgccggtgggcgtggccgagaccatcaacgaaacccggcgccgtatcgggccgctggaggcgcagcgcctgcgcatcgagatcgcccccgaggtgcgccgtgcccgcatcgcgggcgatcgcgtgtcgctgcgtga

SEQ ID NO: 13719 - DNA, 585 bp, Glycine max
  Peptide Sequence Number=SeqID_130497
atggcataccatgctagctcaaaagctaatcaaaattcaatgaaaaatcatgaaattcattttggtaagaactactcaatagaaaactttcaagggggacaagagttacaaccttactatcaaaatgaagcagaaagaggttccaatctggataaactgttgatgaaattcatggaaacaactaaatcaactcaacaagcactccaaagtgtagaaatccaggttggtgagctggcagaagcagtaactcaatttatgtccagacgagaaaaatcctttgtagaagctgaagctcaagagaaaagccctgtaaaagagcatgagtcaagagaaaaagataaggagaaagatgaggaacaagcacaacaacaatgggagaagtactcaacaatagaaaaccaacaagaaaatattctccaaagcaatagccttccacatcaattgattgacaagaaaggaaggcaaggagagcatgaggaaaccttaagtgccattctttctttaataactaacacctttcttgaaatgatttggaatgtccttccagattatatgaagttcatggaatttctagctaaaaggtga

SEQ ID NO: 13720 - DNA, 243 bp, Glycine max
  Peptide Sequence Number=SeqID_130498
atggtgggttacacaccttcaagcttcgctaatttagttttcaccgacgaaaggatcaaagcagccataaccccagccaaggttcatcaacctccatttctccgagaatacgactcgaacgcaacgtgtgcttgtcatggagaagccctggggcgttctattgagcatggtagggccctgaagcgtaaggtgcaagatctaactgatgcgggttggctgaaatttgaggagaatcgcgtgtaa

SEQ ID NO: 13721 - DNA, 186 bp, Glycine max
  Peptide Sequence Number=SeqID_130499
atgactaaagcacgtcaaaagagggaaaatgggggagatgcttgccacccagctcgtccaggtgagctaggttgcttcctccagaagcaaccgccttctggaggaattttctggaaggccaaagtgggcctagttgctatttgcacccctatttttactaagcacacccctgcctttttttggtga

SEQ ID NO: 13722 - DNA, 492 bp, Glycine max
  Peptide Sequence Number=SeqID_130500
catgctttacggtgccctcaccgaacctgtgctagagctagagtaatgggtaaagtagaggaggtacaagagaagatgaaggccgacatggaggccatgaaagagaaaatggccgcaataatggaggccatgatgagcatgaagaagataatggaagccaatgcggttgcagttgccgctaccagcattgttgctaaggtgaacccgaagtccccatcgggcctcaaccaaatgaatcatccaacctcaactatggtaggcaaagatttgggaagtacgggcggcccccattatgcgcaaagtcaaaacaagcatgccatcccgccatatggcctgcctcccaactatacaccacccaatgtggcgtacactcccaataagaatgtcaataactccactcctatacccattgagagccaacaaccccgaatgatcatgcacatgtctcttaaaccgtgggggagacacatgaaattccccaccacaatctag

SEQ ID NO: 13723 - DNA, 777 bp, Glycine max
  Peptide Sequence Number=SeqID_130501
atggcccgcacgaagaagacaggggagacgatgactgaggccgcaaaggaaatcgctgagaagattgattcgtttgaggagcaggccacacagggatcgttcgtcccccatggacgtcaggatgttctggccgctgctattggacgtccagagcaccctggatgtgtccgtgctgctggagccagtgtcaccatcaagcaatactttggatcggctccacggacgtcccacatcgcttcctccatgcctcctgacgaattacagcagctgacccagcagatcagggaccagctagaggagtccatcacagagaaagtgacgaggcaggtcatggcatccttcagccaccttcagtcgcagatgcaatctcagggagttgcagtgcctcctgagcctgtggttggtcctggtccctccattcctcgagtgatcacaaaggggagttgtgttgatccctcaggaaacgatcctgagatcggtgactctgacaagtgcggcttgtacataaaagcagatcctgcacgcctggttgccatcgggagagtttatgagggatccactgctgttcataacactcctttgttgcctggccaagtaaaggtgagtgtggaggaggttagagatgcagatgctccagttcctgtacccactgatgaggtttccttagtggggcacgcacttcacaccttccttgcttgggcgacacatctggtcaagtctttatcacaacaggtagctgtgtctccaccaaaaccacctccgaagcccgatccggag

SEQ ID NO: 13724 - DNA, 393 bp, Glycine max
  Peptide Sequence Number=SeqID_130502
atgaccggccctctcgatgagtcgatctcttgctttctcataagggtggacccttgggtactagtacctatcttcttcagaggactacgcgttctcacctccctgatattggagggggccaactgtgcgaatacaaccagagagggaggctatcacgtagttactatgcataccatggcaagatttcactcgtgccactgcaaagagacaagtgcagatcgtgcgtaccaacatgaccactcttacacagatatcggtcgcgcccacaagactcctagtggacccaaagaagtccaacagggccctgggtctccagctttggttatgggcctctatcagtcctacagggtgcccgtaccccccggcaaggtcatgccattacgacataggtaa

SEQ ID NO: 13725 - DNA, 111 bp, Glycine max
  Peptide Sequence Number=SeqID_130503
gttccttgctacaaggtcatgacgaaagacaatgattgtaccacaaagccttacactagggcaatgaaaggcaccatgcaaaaacctcaagcgaacctaggggcagattag

SEQ ID NO: 13726 - DNA, 942 bp, Glycine max
  Peptide Sequence Number=SeqID_130504
atgacaggcgccgtcgatgctattcagacagagggagtggctactgatgggagcttggggtcacctgccgcagatgagggtttccccggtggaccacgcgacccatcgattttgaccgattttgctgtgcatgtcgcacacagcatctggagtggacaggaacaacccgatctgaagttggtctcccacggtagaaaagtagataaaattgggagaccagcgcctgagatcgaagggttgattgctggcaccgaattgagtccactgatcaggtgttctattatcaccactgattctggacttatatccgccttcatcgagaggtggcatcgcaagactagcacgttccacctgccagtaggcgagttgacgatcatgctggatgacgtggcgtcactcctacaccttcccatcactggcgcgctgcatacgttcgagccgcttgttacttcagacgcgattggtctactgacggagcttcttgaggctttcaagaacctggcccaggcagggggattcgcctggggagcggctacattagtccacatgcacgagcatttgaacgacgcgtcgcaggcctctacacggcagctgggcggttatattacacttctccagtgttggatatacgagcactttcttacagtgcatacatgcgtcgttcatgatgcttatgatgaagggagcccacaggcctgcaggtggcttacgggtaaggctcatatgacggggatcaagggagccccgtatcggagacgtctggatgccctaactgtaactgacgtgtgttggatgtcctatgctgagcaccggggagtcaggggctttgacttgatatcgtcgtacaccagccagctcagatggggtcagattgtggtgtacgttcgacctgagcgggttcttcgacagtttggctaccttcagacggtccctccgccgccg

SEQ ID NO: 13727 - DNA, 404 bp, Glycine max
  Peptide Sequence Number=SeqID_130505
acagtttgatcttgaaagatgagttgaaagtttgctcatggtcaaaaagaaacttgtctcagcggttatgcgagacagagaccaacatgttagctatcgtcagcaaataccaagaagagctgaatctggccacggcccacgggcataaaatggcggacgagtatgcccaagtgtacgcggaaaagaaggctagaggaagggtgatcgactcgttacatcaagaggtaacaatgtggatggaccgatttgctcttaccttgaacgggagtcaagaacttccccgattgctaggcaaggccaaagcgatggcggacacctactccgcccccgaggagatccacagacttctcagctattgtcagtatatgatagacttaatggcccgtataattagaaactgctag

SEQ ID NO: 13728 - DNA, 444 bp, Glycine max
  Peptide Sequence Number=SeqID_130506
atggcattgagaaaaagagctagaacggaggacatcccttcatcatccactccagctcctcccctgcaagagttggctcataacaggtcaatcctaactatggagcattttcttgagcaagtagcctggcatgaagctcaacttccattggtgagacccaatgaggcttctccgcctgagcccacacctgtacaggttgatccgaagcaaggtggcccacaatctccagtggtgaatccaccgtcttctcctaagcgtgaagtagttcccccatctccacctctaattgtcatctctgatgcatcatcggatgaagcggctgcccctcctgattcaccagttggagaaacagccgaccctcttacttccccaattgaaggaattgccgatctttctgattcgtcatctggagaagttgttgctcccactgattccccagtttag

SEQ ID NO: 13729 - DNA, 260 bp, Glycine max
  Peptide Sequence Number=SeqID_130507
atgacattgctacttagcaacattctgcccagcgaccgcaacaccaatctccccctgcaaaagtatcagttggtctgtgtcgtcccgacatggggattgcacccacaagacacccagtggacccggaaaagtccaacagggccctggggtttccagctctgcaagggcatcaggccccctactgatcaagctttcatcaagaagtactgcgtccctaggcaggcgcagggcgaaacaccacagcagcattgggatggccg

SEQ ID NO: 13730 - DNA, 144 bp, Glycine max
  Peptide Sequence Number=SeqID_130508
atgccaaagctcatggaagctgatgttcagtttgaatcaccaacctgcccttccaatacagcagttgatcctgaattgaatggtgaggatcaggtgctttgttctgtaagcatagctcccttaaggcctacaactgagagttag

SEQ ID NO: 13731 - DNA, 540 bp, Glycine max
  Peptide Sequence Number=SeqID_130509
atgaccggccctctcaatgagtcaatctcttgctttctcaaaagggtgcacccttgggtactagtaccctcaccttccgaggactacacgtccttgccttcagaggactacacgttctcgccatcagaggacaacacatcctcgcctacagaggactacacgttctcgccatcagagggctgcacgccctcgccttcagagggctacgcgtcctcaccttcagagggctacatgcacgcccttagaggactacacgtcctcaccttcagagggctacatgccctcgccttcagagggctacacggcctcacctttagaggactacacatccttacctttagaggactacacgtcctcgccatcagaggactacacgtcctcaccttcagagggctacacgccctcacctttagaggactacacgccttcacctttagagggttgcacgtcctcgccttcagagggctgcacaccctctcctttagtgggatgcacgccctcacttttagagggctggatgccctcgccttcaaagggtga

SEQ ID NO: 13732 - DNA, 738 bp, Glycine max
  Peptide Sequence Number=SeqID_130510
atggggataaactgcccgcgatatcttgccttgctactgttccgtcaatcgctgctcaaaactaaggatggttatatggtcgacaatgcgtttatcgcgagaacgcgagccgtcaacggctgcttttccatgtttttgctgatgttcctgattacgtttattccgctgttccttgagaacagagccgccttgatgcgacaagggctattgctgccgctgctgtatggaatggaattcgtcgctatcttttcgttatacctgctctttttccgccgcagagaaggattgggcaaaggcgaggttaaacgcagcgattttgcactgctgctgttcgcgctgttggtgattcagtttattttcccgcgtttgatgggcgtggagaaaacggaaacctgggtgacggagcaggtggcattgcctggcgagattttggcgctcaatgccgctttgttggttttcgtcgtccccgtctatgaagagatcgtatttcgcggctgtctgtttaacgcgctgatgtattggtttaacgacaaggtgctttgggccgcgttaacggtgtctgtcatctttgccgttttgcatacccagtacaccgattggcgcacattagcagctctggtgctcatctcgctggtgttgacggccgcacgagtcaaatccaaagggatctatttgcccatcgggctgcatatgaccatgaacggcgtcgtgatggcggccagctatgcgttaagctga

SEQ ID NO: 13733 - DNA, 660 bp, Glycine max
  Peptide Sequence Number=SeqID_130511
ggatccggctggtgcgatgtggataaattgacgctgcagcataagcattggccggatatttttgcggtaggcgactgttgctcgacgccaaatgccaaaaccctggcggcagcccgaaagcaggtggtagtggcggcggaaaacgtcgcggcgctgattcaaggcgcgcctctcactgcccattatgatggttatggttcctgtccattgacggttgagaaaggcaaagttgtgctggcggagtttggctatgacggtaaattgctgcccacgtttccgctgctcgacgccacccagcccagccgtctggcctggtggctgaaagcctggtttttaccccggttttattgggcgggcatgctgcgtgggacgcttgactatttggcgagacgaggccaccatcgtttgcaggttcctcaggctgattgcaagccgttaccactaccgctgctgaacaccttcggcgacgatctcgcctccgtcaccctgatgccgggcaccggcggggtctatcaaatcagcgtcgatggcgtaatgatttgggatcgcaagattgacggcggtttccccgatgcggcgcagttaaagcaacggctgcgcgatcacagcttccccgatcgctctctcggccacagcgacggtaaaaaagcccggcactga

SEQ ID NO: 13734 - DNA, 652 bp, Glycine max
  Peptide Sequence Number=SeqID_130512
agggctacacatcctcgtcatcagaggacaacacttcctcgccttcagagggctacacgccctcgcctttagaggactacacgtcctcgccatcagaggactacacgtcctcgcctttggagggctgcacatcctaaccatcgaaggactacacgtcctcgccttgagaggactacaagtcctcacctttagagggctacactcccttgccatcaaaggactacgcgtcctcgtctttagagggctacgcgccctcgctttcgtaggattacacgtcctcaacttcagaggactacacgtcctcgcctttagagggctacacaccctcgccatcagaccactacacgtcctcaccttcacagggctatacgtcgtcgcctttagagaactacaagtcctcgcctttggagggctggacgccattgccgttagaggacaacacgtcctcgccttcagaggacaacacgtcctcacctttagagggatacacatcctcaccttcagaggactacacgtcctcgccttcagtggactgcacgtcgtcaccttcaaagggctacacgtcctcaccttcagaggactacacgtcctcgccttcagaggactggacatcctcaccttcaaagggctacacatcctcgccttcagatga

SEQ ID NO: 13735 - DNA, 471 bp, Glycine max
  Peptide Sequence Number=SeqID_130513
atggcaccaacgaaatccagtgggcagaagttcattgcccgcaatcgcgcgcctcgcgttcagattgaatatgacgtggaaatttatggcgcggaacgcaaaattcagctgccgtttgtgatgggcgtcatggcggacctggtcggtaaaccactcgagccgcaggcgagccttgatgagcgtaaattcctggaaattgatatcgataacttcgatgagcgcatgaaagcgctgaagccgcgcgcggcgtttcagcatggacgatttctcaccggatgcgattgcccgcaaagtcgaaccgctgagcaacctgtggaagcgcgtacccagctttcgaatctgctgacctacatggacggcaaaaacggtgcggaagagctgatcggtaagattctgcaggatccaacgctgttgaaagcgctgacccatctgccgaagcaggatgaaagcgctgaaggtaaggaggagtaa

SEQ ID NO: 13736 - DNA, 1017 bp, Glycine max
  Peptide Sequence Number=SeqID_130514
atgacgatgaatattgacgcgctgctggcgccggtcagcagtgataacccctgcggcgacaacctggagtatcacgcggattaccaggcgatggagcaggccagtaccggtaaagctgaacagcagtttggcgagaccattatcccggctgaatcagcggactggaataaagtcgaaaagctggcgattgacttgctcagccgcagcaaagacctgcgagtgatgttagcgcttactcacgcctggaccgagttgaaagggctgccgggctatgcgcaggggctgaagctgattgagcaggcgctgctgctgtactgggagccgctgtggccgcgactggaagagtacggcgaacaggatccgttttaccgcatcaacgcggtggcgctgctgggcgataaatcggcgctgagcagcgcagtacgccagagctggctgctgcgctacgcctcggatggcatcacgctgcgcgatgccgcagcgctgtgcgacggcagcaagaccgaagtcgcggactatcctggcggtctgccgcgcctgaccgatgagctggcgcgcggcgagcagcccggtattgaagcggtgctacagataagtgagcgtttgcaaaccattaccgaaaccctgaccgaacagctgggtgaagcggcggtgccggagctgtcgcagctacgcaggcagatcgccatgatcgccgaacgctgtcaggccactgacctcagcacgctgcagccggccgtggtaacagagccgccgccggaaccgagcgtcgccgcgcccgccgcagcggttcgcacggctgactggcgcagcgtgcagctcagttcgcgcgccgatgcgcaactgatgctggagaaggtgaagcactactttgctcagcacgaacccagccatccggcaccgctaatgatcgaccgcgtacagcggcttattgaactcgattttatggacatcattcgcgatctggcgccagacggcgtgcatcagctggaaaatatctttggacgccgcgactaa

SEQ ID NO: 13737 - DNA, 223 bp, Glycine max
  Peptide Sequence Number=SeqID_130515
aaaaccctacactgctcttggaacagtcgtgggtgctcaaagctcgaagctttctacgctgccagttaacaagcttgacgagagttacacgccgagcaaagtttccatccgtgccggtgatggttttcacaacttgaaggagattaagaccgtggaacttttgaagccaactgggtgggtttatctatccttgtctggagttgatcctagatttctagcatag

SEQ ID NO: 13738 - DNA, 189 bp, Glycine max
  Peptide Sequence Number=SeqID_130516
gcgcctggctgccctgcgctagccgtagcgcctgcagcaggggcgccaccagtagtgcctgacccctgggcactaccaaaggcgcctgcgtcaggggcgctacctccctgtgccacatgtcacgtgcacagtggaggcgcctgggtggggggtgctttgcaattaaaaaacagacccccccggaaataa

SEQ ID NO: 13739 - DNA, 330 bp, Glycine max
  Peptide Sequence Number=SeqID_130517
gcaaaaaggagttattttaaagaattgctaaaagttgatgtctcgctaagcgagctcaatgcgcttagcgagtgtcatccgctaagcgaggcatcagcgcacctaacgaataggaggaatctggaagggaatctatcatgcaggcacgcgctcaacacgtcattagctcgctcagcaagccgtttgtcaccttctaggcttagcgcgagtttggcgctcaacgaaagttcacttactcgcgctaagcacgagaatggcgctaagcgtgacatcaaggagcttccttgctatggaaggctaaaccctcagttggggattcttgctgagtaa

SEQ ID NO: 13740 - DNA, 213 bp, Glycine max
  Peptide Sequence Number=SeqID_130518
ttggaagttgacagtggaagttattggaagttgaaagtcgaaaaatggaagttggaagttggaagtgaaagttactggaagttgatgttcgaagttggaagttattggaagttgaaagttgaaaatggaagttggaagttggaagttggaagtaaaagttacttaaaattgaagttagaagttggaagttggaatttgaaatttaaaatttga

SEQ ID NO: 13741 - DNA, 269 bp, Glycine max
  Peptide Sequence Number=SeqID_130519
gtgctccagtggcttctgtttctatcagctgtccctcctgttcagctactgacggggtggtgatggaaccgtggccggagaaggaagaggaacaagtggtgttgccgtcagctaggtcgaaaccggttctgccggtgcctccgtcgtcgaagatggctgagttggacttgagtgggaagtcgctgtcgctgaagcttccggtatccaagccacctatttctaatgagaattttggcgggataccattatcggtgttgcttgaaggttaa

SEQ ID NO: 13742 - DNA, 303 bp, Glycine max
  Peptide Sequence Number=SeqID_130520
atgcctgtcaaagaaagaagtacaggttgccagtccactcattgctatctgatagcccttatcactattttcacatatagaataattatgctattcggacaatcttcttatagcgagtcaatgtcggataatctagcaagagcttctagcgcaagggagtaccagatagagcttcaacaagtgggaatcaatacagcaacaagtccgatgttgaatgagatagctttcatcttccaatctttccgagctaagaagtttgaaaggggcagtcttccatgtcactcggaaggcagatcaaggtag

SEQ ID NO: 13743 - DNA, 261 bp, Glycine max
  Peptide Sequence Number=SeqID_130521
atgagcacaaggcgatggccgagacatgtaactgtaagaggaaggaaaagaagggcgaaagtgtgtttggccaataataatgctgtgaaagtgagaccttccttgcaaaagaagcttagagagcttcagggagcagttcctgggagtgagggaatggacatgcacactttgttccaaagcattgaacaatacatacttcaacttgaagctaaagtcacggtcctaagagagattgtgctttttggatcaaagcaagcctaa

SEQ ID NO: 13744 - DNA, 561 bp, Glycine max
  Peptide Sequence Number=SeqID_130522
atgcgaaacatcaactcagttaagcaagaattcctgaagaaatggatatggggtctcagaaaatacagctctcagaagaaaaacatgagtctgatggagagaaagaaagccataaagctgtcagcagatttagccatggcttccaccagaaacaaatccactcgctggagcagggcccttattgcgaatgcttcaagagatggcaacaacaaagtcctcacggaacacgtgtcaccatcatcatcatcaccaccacagaggccggcaacaaggaaaagcttcagaaggatcagaagctgcagaaacatgttgatcagaagaaaccgtgcagcagtccactgcagaacaaaggatagggtggtggcggcgagtttcgttgcgaagaggctggtccagaagagaacgcgaaggctcaagagtctcttaccaggaggagaatccatggacgctgtgtctttggttgaagaaaccctagattatatacaatcactgcgagctcaagttgaagttatgagacgtcttgtcactgcctcagagatcatgatcctaaatccatcgtaa

SEQ ID NO: 13745 - DNA, 204 bp, Glycine max
  Peptide Sequence Number=SeqID_130523
atgaagctggaagagactcttgctcagttcatgctagtatcaatgtcaaatcaaaagagcacagaatcagccattaagaatctggaagttcaggtgggacaactggcaacacagttggcagatcgtctatcaagtagctttggagccaacaccgagaagaatcctaaggaggagttgatggaagcttgcttgtggggcttctag

SEQ ID NO: 13746 - DNA, 213 bp, Glycine max
  Peptide Sequence Number=SeqID_130524
atgtcttcagccatctatgctgtcaaagacgacaatgtcttcatctcaaagacttcaatgtcttttgtccttgaacttcataggactagacgtcctctatgctttgatgcgatcctacccccaagggtattggatagaataatcaaagaggattgggctagagctgcaaaagaaggccctagcgttatcatgaacctcagggtagatttctga

SEQ ID NO: 13747 - DNA, 657 bp, Glycine max
  Peptide Sequence Number=SeqID_130525
atgaactcgttatatggtagatttggcatcaatcctcaaagcacaaaaaccgagatgtgcaataaatctaaacgtgaccgtatatttagacgccctgagtttatagacgatgtctttcttagagaggatctatacatggtatcttatctaaccaatccgggtaaggggccttcttattgggaccccccgaagaactccgcggtacaactagccgcagcgatcactgccggctcaaggatctatatgtacaagtatatttcaagagaagactgcttatatacagacaccgactctattgtccttggtaatccacttccggaggaagatgtttcctcttctgtattaggtaaatttaaattagaagataagatcttggagggattctttttagcacctaaatgctatagctataccacagaagagtcagatggcaataagaaggtctataagtacaagggaccgggtagaaatgttataactccagaatggtataaagaacagtacgccgacccttcccgaagtctgataaagaaggtaacttatcaatttcgacccgattggaaagaactctcggttaaaaagaaagagagtacaaccactcttagaactctcagtaactccaagagaatacctttctttaatgaaaaaggtaaatat

SEQ ID NO: 13748 - DNA, 387 bp, Glycine max
  Peptide Sequence Number=SeqID_130526
atgtattgtcggaagacgggggcatacgcaaaagatgaggaactactgatacatttcttccaagaaggtcttactggggtagctgttacctggataggatacaactatagaacatatgcaaaaagggggcatgaatctttcaaagaatacacccaaaggtggaaagatctggtagcccaagtggcacccccaatgacgaaaagggagatgataatcatgatggtagacacatttgtagaagcaaagcttcatggtgaatcaaagatgatgacaaaggtgatgacaaaaagctcaaagatcaatcaaagaaaaactcaagtgaatcaagaacaattcaagagttcaagatataatcaagaagaattcaagactcaagaagaaagttaa

SEQ ID NO: 13749 - DNA, 191 bp, Glycine max
  Peptide Sequence Number=SeqID_130527
aaggtagaaggcaaaggcaaaggcataggaggaatagggatggaatggatgatgtgaatgtcaaaattcccaagttcctaggtacttatgatctagaggcttaccttgattggaagatgaaagtggaccaaaatttcatttgcaacaattttagtggaaaagaaaaagcagtcggcaagcttagaatttga

SEQ ID NO: 13750 - DNA, 486 bp, Glycine max
  Peptide Sequence Number=SeqID_130528
atggcaccatttgaagagggtgttttcgagagggacgaggtttctgttctgcatgaagacgtaggtttggttgaagaagccttgggagggagggaaggggttgaggatgacggaggcggagtgaggggtggaaacgaagacgtcgttatggagattggaatagacgagggcggcgtggagggagcagagggcgaggaggaggaggggggcgacggaggggagggtggagaggacctcgtcgccgagggagacggcggcgatgcgggtggaggggtggtaggcggcgacgtttctgcggatccaagaggtggcggtggtgttggaggaggcgatggcgaggagctggttgttggggacgctgatggtgacgtggatgtgggtacccgacagggcgcggaggatgtcggggttggggtcgtagaggccgatgtgggtgatcttctggtgcatgaggaagttgaccaggtgcgacatcgaagccattga

SEQ ID NO: 13751 - DNA, 366 bp, Glycine max
  Peptide Sequence Number=SeqID_130529
atggttctcgtggtatttagaaaactggtatggaaggatttcaatattgcatatgaagcaggaggagttggaaaggaaattaaaataccatttcctgcttatgtgaataataactctttagagattcgcttttattgggctgggaaagggacaaatgctatcccatataaatcaatatatggtcctcttatatcagctatatctgtcactcgtgagttaaaggatttaaatatgcaaacgagtttatttactaacaactttgatatttccaacaagattggagaaggaggctttggtcctgtttataaggttctgggtgttcttttgtgggatatggagcaacacaagagattggcccatttttag

SEQ ID NO: 13752 - DNA, 426 bp, Glycine max
  Peptide Sequence Number=SeqID_130530
atgaaggccaagtatattgttctaagcttgttaaagaacttagaaaaaatcaagaacaagcttgttcgcacatcgttcgtgtgtatgatatccactcgacaaggttatggttacgtgagcatgaactactaccaatatgtagatgttgtttacacgaataagcacatcttaaaggcttacttcgcacaatggtggcctctcgggaatgaagcgacaattcctccttctaacgacacatggacacttatccctgacccaactataattcgtgcgaaaggtcagccaaaatcagcaaggataaggaatgggatggattggctagaaccgtctgagcaccggcaaaaatgcagtagatgtggagcagaagggcacaataggcgacgatgtccaatgcaatctgagcgtgggagttgttcatttaattga

SEQ ID NO: 13753 - DNA, 309 bp, Glycine max
  Peptide Sequence Number=SeqID_130531
atgaagagagaagatgcaaggtggcatggtcatgtaggccttgaggttaaggacttgaggtgggatggctcgtgggggagtaaggtcgttgaactggatcatcggacttgcaatcacagctcacgatggaggaggatgaggggcagtgactgtgtgtactcgaaggagaagaaaatgaaactccaaattaggttttttgtgtatattcgcactatgtattttgaattcttacaagcaatcacaatcaatcgcagttcctatccagaaaaagagaataacgtacctaaccctagggtcctttatgaataa

SEQ ID NO: 13754 - DNA, 264 bp, Glycine max
  Peptide Sequence Number=SeqID_130532
atggagaataatatggcatgccaatctacaataggatcaaggatatgcctagcgccatccattgtagcccccaatcaaacattcaagccatggggagatggtacttacttgtatgagatgaaagaaaatgcaaaaaatgaaagcaaaagcgcacaatggaagcttggggctactgccaagggtggctcctgtaagcttgttgatggtggtgtgctttgggggaagaaatggggtgaaaaatggcttcacccctcccctttataa

SEQ ID NO: 13755 - DNA, 342 bp, Glycine max
  Peptide Sequence Number=SeqID_130533
atggatggggacgatgctgaagttggagatgaaaggggtgtactcttctatagcggttatacgttcttcactagaggcaagggcaacaatgaagagaggacagtggtgcttacctcgacggtcgacgctgacgacgctccctcgacggtggacggtggcgtagctcttcacggaaacctcctcaatgcacctcacaacctcttcacaataagctcctcttcacggcaacaatggttcgtggctgaatacgaaaatggtaaactagagttagcgggagagagagagaggtccgagaggtcaccaacaaaatacgaaaatggctttgaggaagaagaagaatga

SEQ ID NO: 13756 - DNA, 269 bp, Glycine max
  Peptide Sequence Number=SeqID_130534
gaagtcttcttaacaacaaagagaagaacaagatgaaagattgcaaaaatacaactggtgaggatgtctccttcacctctaggatctcacaatcactcacaaactcatctcaagctctcaaaccggcttctgcttcaagctctggtggtcttattcgtgcttatgtgcttatcacaccgatgcgcttagcgaacctgtacaactcatcttcttctggattcttcctcgtgcttagcccaggagtgttgcgcttagcggatgctcgctaa

SEQ ID NO: 13757 - DNA, 351 bp, Glycine max
  Peptide Sequence Number=SeqID_130535
atgtacgaccagctaaacgatgcctctatcaacagcagccgacaacttggcggttacatcacattgttgcaatgctggatttacgagcactttcctcagtcgcggagtccactactgatcaggactacgacgaggattcctcgcgtgcatagagggtcgttcgacagtttggatacacataggccattctggctccgcctgtcgattcatgggtgtcgtatgatgatatacacgacaggtggatgcactactcggatcatatcgttccagcaggtgaggtgtacgttgtgccaggtcagtgtgccagtgactacatggactggttcttccgcatctcgcatcctttcatga

SEQ ID NO: 13758 - DNA, 171 bp, Glycine max
  Peptide Sequence Number=SeqID_130536
atggggttatctttaccaggattaccaggctttggtggcacaactcgaacaccaatttcggcttggaaggctttcccttcaaggattgtggttctactgtcaggcaaaggctatggctggagacaatgctgtcaggatgatgctggagaaaatgacacaatgtgcaagtag

SEQ ID NO: 13759 - DNA, 360 bp, Glycine max
  Peptide Sequence Number=SeqID_130537
atgaagagaccagggcgcgagtgcgacgtagttgcttcgagtggacggaattgctctgtggctcagtgcaatggacgaaccgagagaactcgaaagttaggtattcattctacgatcaactacaaagctttaaacaacttaatgagtaggatggtctggaacatgctttccctcgatgggtcttttgctggagttcttggtaagaacaagaaatctgaacacctctctggtcaaccatcgaaggttgataagtcggtgcttaagttgcaatatgaaaagattcacttattgattctcttgtctttgtctaatgaagttctttatgaagtttttgaagaacaatccgcttttggtttatga

SEQ ID NO: 13760 - DNA, 315 bp, Glycine max
  Peptide Sequence Number=SeqID_130538
atggataaggaggagtgtaaggaggtaagtgtctcctccatgaggttagctaagaaggaaagtcattttgcaataaagacaaaaattaaagaaacttcccctcttagacaacctccacatcttctcctttgtaaaatgatatttgttagcactgtcacacctcttgggcttaaggttattcttcaagtaaaggagttgttggatgagggtttggttcgtaagagcttaaatccttgtgttttgttggtgcccaaaataggaataatcaacatgaaaatacagaaaaaggggtttccacggaccctaagagaataa

SEQ ID NO: 13761 - DNA, 540 bp, Glycine max
  Peptide Sequence Number=SeqID_130539
atgaaaaatcagtttatgaccactcaaccaaaggataagacagataatgtacaacacgttgatgatgtgattcgtagtggcaaagggagttgcaccgtcccttctagtaactttcctgagggggtctcaagttgtaaattatttgtagtaccaccttctcttctcctagttgcacatgggaaagtgcataacattcaaagtgatacactacatggcagacatctacccgatggtcacctaaaagtcagtgttgaagttgttgtggagttagatgcctcattgtcaatacctggcgatgatgatgacataatgacaataaaagatgcagttggtacttttgtagcatggccattgaaccttatacaagtttcttttatggctcaaataggagctaaggtttcaaagacaaagtcaagcaacatcacatggagcacgattaaatgtccaaggcaatccaacaacaacgattgtgggtattatgtctatcgatacatgaaggaaatcattaaacactttgaagggggttcaatcccaattgat

SEQ ID NO: 13762 - DNA, 255 bp, Glycine max
  Peptide Sequence Number=SeqID_130540
atggttttgcgagaacatgatgtagctccatgtggagcatgcaagccttggatcttcttcatcaatgaagtcctttgtttcttgaagatcaatggcagtggaatggagaaggaggaaaggtacaaagataagtgggctcatactgagcccatgggcccaaaatctatcctaaggctcatgagaatcctagggtcttctcctgcatctctggtccaatcttcctggagtcttctatccaatgtccttggggggtag

SEQ ID NO: 13763 - DNA, 657 bp, Glycine max
  Peptide Sequence Number=SeqID_130541
atgtccaaatcttatggatttgggatgaccggccctcttgatgagtcgatctcgtgctttctcataagggtggacccttgggtacttgtacctatcaccttcgtagggcttcacgccctcacctttagaggatcacacgtcctcacctttagagggctacacgccctcgccattagaggactgcatgtcctcaccttcagagggctacacgtcctcgccatcagaggactgcatgtcctcaccttcagagggttacacgccctcgccatcagaggactgcatgtcctcaccttcagagggctacacgccctcgccatcagaggactgcatgtcctcaccttcagaaggctacacgccctcgccatcagaggactgcatgtcctcaccttcgtagggctacacgccctcacctttagaggatcacacatcctcacctttagagggctacacgccctcgccattagaggactgcatgtcctcaccttcagagggctacacgccctcgccatcagaggactacatgtcctcgccaacagagggctgcacgccctcaccttcagaggactacacgtcctcaccttcaaaggactacacgtcctcgccatcagaggactacatgtcccccattttcaaagggggacatgccctcacctttag

SEQ ID NO: 13764 - DNA, 357 bp, Glycine max
  Peptide Sequence Number=SeqID_130542
atgtgcccgtcgcccctaacaaggtcatcaggcctcctactaatcgagctttcatcaagaagtactgtgccccctgacaggcacagggcgagacaccacagcagccaggggatggtcggcagcaggcaacagacataccgccgccacctacaaagcccctcagctcatctacaaatgctggagcgttgcctacgactcgtggtcgaccagcaggcgaccaagtccaaagccaaaggtagcaaaatacctcatgaaaaaagaaacagaaaactgaaaaaggcatcccctttatccccgaaccgctggccaaaccaacacccagacatatatcatgtccagtcgttctacaagccttga

SEQ ID NO: 13765 - DNA, 306 bp, Glycine max
  Peptide Sequence Number=SeqID_130543
atggagacaagagggggtctgttttaccatggatgtcgccagcagtactggcgagaaacgcgtgccgccattgtcaatggcgagaagcttggtgacgtggagggtgtcaccattgtcaatggcgagacagttgacgtggacactgtctcgctgctcccactggcgagaagcatgctgtctcgctgctcccaatggcgagaaaccttccacataagcaatgtcgccattgcttcctgcgagacaccttcacgccatgctgaagatgccacagttctgaagatggcagtgttggcttgcaatgtttag

SEQ ID NO: 13766 - DNA, 168 bp, Glycine max
  Peptide Sequence Number=SeqID_130544
atggagcaacatcaaataaaggaacaaacttctccaagttctgtcaacattgatcttgacaagagaatgttcaagatacaattgaaagtatctgatgacaccattatagcaacattcacaatattcgatcgagatgcacaacaaattctagacacaagatgcaaataa

SEQ ID NO: 13767 - DNA, 246 bp, Glycine max
  Peptide Sequence Number=SeqID_130545
atgggtttacatcattttggtcatcagagctacggttcaaggctttcaaaaattcttgaaggtggcggtgaatatcaattggatggggcacaaagattcttgttggatgctctcaatgctcaaatgcaaagactattgagagagaaaaatgaggagttgtatgaaagaattgagcgattagagaatcgtgaacgtcatgaagacgaaaggagaggaggaaatggtggtggtccaaggccaaactaa

SEQ ID NO: 13768 - DNA, 936 bp, Glycine max
  Peptide Sequence Number=SeqID_130546
atgggtggtgttagatggggtcaagagtcatcttcatccatgaaactcttgctgttcatggtgcctctcgtacttgttgctgggcttgtttttatattgggtcctaacccttctagttgggtttcttttgccaacgcacctgtgttattgggaggctctgttattacttcctcttcctcaactagtagtggtgctgtgactgtcaccgacccttctgaggcgaagcagagagaagggttagtggtggtggccgtggagaatcgcggtggagagaaagctatctccgatgacactgacttcaatcactcctctacacctccattttccgttcaggccatacaaacacctcaacaacctgacgaacaaaatgtttcccaactttcgcccaacgtgactcctgtgaacgagtcttatgttccaccagagaggccaaagctgcaaagaaaactcagcatcttagatagaaccgaagctggtctaatacaagctagagctgcaattagtgaagcaagaaacggaaatcaaacacaagacaaagactatgttccagttggacctatgtacaacaatgctaatgcatttcacaggagttacttagaaatggagaaacagttcaaagtatttgtctacgaagaaggggaacctccagttttccacaatggaccttgcaaaagcatatactccatggagggaaatttcatccatgctattgagatgaatgaccaattccgaacaagggatcctgagaaagcacatgtgtttttcttaccttttagtgtagcaatgttggtgcaatttgtctatgtacgtgactctcatgactttggccccataaaaaagactgtcacggactatgtcaacgtcattgcgggaagatatccctattggaaccgaagccttggagctgatcacttttatcttgcttgccatgattgg

SEQ ID NO: 13769 - DNA, 549 bp, Glycine max
  Peptide Sequence Number=SeqID_130547
atggttctcaaaactgaactatgccgattcagtggtgccaagatctaccccggaaagggcatcagatttgttcgtggtgattctcaggttttcctgtttgccaactcaaaatgtaagcggtatttccacaaccgcctgaagccctcaaagctcacctggactgctatgtacagaaagcaacacaaaaaggacattgctcaagaagctgtgaagaagaggagacgcgctgccaaaaagccttactctaggtccattgttggtgccactctggaagttatccagaaaaagagagctgagaagccagaagttcgagatgcagctagggaagctgctcttcgagccttactttttaatgtggattacatatgtttatctgagtctctgatgtggtgcagtgaaattaaggagaggatcaagaaaacaaaggatgagaagaaggctaagaaagcagaagttacagccaagtcacaaaaagcaggagggaaaggcatttctaagggtgctatgcccaaaggtcccaaactcggtggtggaggcgggaaacgctga

SEQ ID NO: 13770 - DNA, 555 bp, Glycine max
  Peptide Sequence Number=SeqID_130548
gatgtctctttcccagaaattaatctccaaaccggttcaataaacggtttcattggtgggccatctgcatctggacgtccacttttggccttctttgctggtgggcttcacggcccaattaggcccgttcttcttgaacactgggaaaacagggacgaagacattcaggttcacaagtaccttccgaagggtgtgtcatactatgagatgctgaggaagagcaggttctgtctttgtcctagtgggtacgaggtagcaagtccgagagtggtggaggcaatctacacagggtgtgtgccagtgctcatttcagatcattatgtccctccatttaatgatgttttgaattggaaatccttttccgttgaggtttcggttaaggatattcccagattgaaggagattctgttgagtatttctccaaggcactatataagaatgcagaggagagtaggactcgttaggaggcactttgaggaggaagggaaagaggaagcacgacttcgagaggaaggagaaagagagcaacctttgcaagtgagttggggaaagtga

SEQ ID NO: 13771 - DNA, 354 bp, Glycine max
  Peptide Sequence Number=SeqID_130549
atggttttgaatttgctgagtgaagaagcactcgagttctcacgcctaaatctgaaacactctcgtgccttacctttaaagctctgttgccttgtcgtattgaagctttcatcgccgtcgtcttctcaagaccatcgtgtccatcgacgtcgaagtgcgaactcctccaccacaggactctattcattagaagtgagtgtggatgttgatgacattgggtttgaggtgtggcaaggagtgttggggtttgttgttaaaatgcatcatgctagctcccttgagatgctttctttggctattagctatctttctagcgtttttgggggcagctactacgtgccgttagagatttaa

SEQ ID NO: 13772 - DNA, 944 bp, Glycine max
  Peptide Sequence Number=SeqID_130550
tggctcgtttcgacttctcttgggatgaccctgaatatcatcaggaaactttggagaatctgaagaatgctatcaagactactaagaaactctgtgctgttatgctggacaccgttggtgcagagatgcaggttgttaacaaaagtgagaaagcgatctcgcttgaggccgatggccaggttgttctgactcctgaccgaggacaagaagcatcgtcgcagatactgcctatcaactttgatggactggcaaagtcaatgaagaagggagacaccattttcattggtcaatacttgttcactggaagtgaaactacttctgtatggctagaggtatccgaagttaaagggcaggatgtcatttgtactataaagaattccgcaacattggctgggtcattgttcactttgcatgcctctcaagttcatattgacttgcctaccctcactgataaagacaaggaggttataagcacctggggagtaaaaaacaaaattgattttctatcattgtcatatactaggcatgctgaagatgttcgccaggcccgtgaattcctttctaagttaggtgatctaagccagactcaaatatttgcaaaaattgaaaatgttgagggattgacccattttgatgagattctacaagaagctgatggtattatcctttcccgtgggaatttgggcattgatcttcccccagagaaggtatttttctttcaaaaatctgccctttacaagtgtaatatggctgggaaacctgccgtgcttacacgtgttgtggatagcatgactgacaacttaagaccaactcgtgcagaagccactgatgttgccaatgctgttttagatgtgaaattcaaccaacctataggacatagaaatatgagcaatgctctggtacagtgttgtgcttgtgcttgtatgagaagtgaatgtaagtga

SEQ ID NO: 13773 - DNA, 1368 bp, Glycine max
  Peptide Sequence Number=SeqID_130551
atggaacccaatgcactaggtggtggaatatttcctaacataagtagtggtttgctaggagtagaaaaccctttacaacaacaaccaaaccttcaaaaccagcaaaacccccaccctttgcaccatctccaaatggtttcctacaccactaaccacgacactgacacacaccatcaacaaccaccacctcagcaatcaatcaaacatggctacaacttttcggccactaaatccaacaagtcacaaatcacactcagtgatgaagatgaaccagtgttcacagcagaagacaatagctccggagaccccaagagaaaagtgtcaccatggcatagaatgaagtggacggacaccatggtaaagttcttaataatggcggtttattacattggagacgaggctggttcagaaggcactgaccccaccaagaagaaagcctctgggttgcttcaaaagaaagggaaatggaaatcagtgtcagggggcatgatggagaagggttactatgtgtctcctcagcaatgtgaagacaagttcaatgacttgaacaagagatacaagagggtcaacgacatcctaggcaagggcacagcatgtcgggtggtggagaaccaaaccttgttggacactatggatctgtcaccaaagatgaaggaagaagttcgaaagctcctcaactcaaagcacttgttcttcagagaaatgtgtgcttaccataacagttgtggccacaacaacaacaacaactgtggcagtacttccaacgtgcaacaatcaactgatcagccactacatcaacataaccatcaacagcagcagtgtttgcactcatcagaaaatggggtggggagtctaagaatgttgaaagaggatgaggatgaggatattgaggacgatgattcggatgagttttctgatgaggatgaagatgaatcaggagaaggaggatcaaggggtatggaggaggatgaaaatgatcatgtgatgaggaagagagcaaggaataagggaggtttcggtgtttcatcgatatcatcacagatgatgcagcagttgaatggtgaagtgagtggtgtgttgcaagatggagggaagagtgcttgggagaaaaagcagtggatgaagaagaaggtggtgcagttggaggagcagcaggtgagttatcaaatgcaagcgtttgagatggaaaagcagcggttgaagtgggcgaggtttagcagcaagaaggagagggaaatggagaaagataagcttcaaaatgaaaggaagaggttggaaatagaaagaatggtcttgctacttcgccataaggagcttgaattggttaatgttcagcagcagcatcaacagcaacattcttctacctag

SEQ ID NO: 13774 - DNA, 927 bp, Glycine max
  Peptide Sequence Number=SeqID_130552
atgggggcctcgctgtcgaacctgggaagcaacggttcggccgccgctccgggcctcggcgacatcccggagaattgcgtcgctcgcgtctttctccacctcactcctccggagatttgcaacctcgcgcgcctcaaccgcgcctttcgcggcgccgcctccgcggattccgtgtggcagacgaagctgcctcgcaactaccaagatctgctcgatttaatgcctcccgagaggcaccggaatctctccaagaaggacatcttcgcgctgctctctcgcgcagtgccctttgatgacggcaacaaggaagtgtggctggatagggttaccggaagagtttgcatgtcaatttcggcgaaggcgatgtctattactggaattgatgaccgcagatactggacttgggttcctactgaagaatctagtgctctaaagcttgatgctgagggtgctttgtttgatcggttcaacactgtagcatatttgcagcaaatatggtggtttgaggtggatggggagttcagcttcccttttcctgctgatatttatactctctcctttaggcttcaccttggacgattttccaagaggcttggtcgacgtgtctgcagttatgaacatacccatggttgggatataaaaccagtgagatttgagttgtcaaccatggatggtcagcaagcatcatctgagtgctacttggatgaaactgaacctgatgatttacacggcaatcacaagcgtggacattgggtagattacaaggtgggtgagtttatcgtcagtggatcagaacctacaactaaagtaagattctccatgaaacagattgattgtacacactctaaaggtgggctttgtgtagattctgtatttattataccgagggatttgagagagcgcaagagaagtggcattctgaaataa

SEQ ID NO: 13775 - DNA, 609 bp, Glycine max
  Peptide Sequence Number=SeqID_130553
atgtctgctgtgtgcggcacaaaggaattgaaagtgaatgtaagaagtgatgcaatacttctaggtgctgagaccttacgtgggttataccctgttgagactatttccacagttggaaaaatttgtgcagaagctgagaaagtttttaatcaagacctttattttaagaaaaccgtcaaatatgttggagaacccatgacccacttggaatctattgcatcctctgcggtacgagcagctattaaggtgaaggcttctgttattatttgcttcacttcttctggaagggctgcaagattaatagcaaaatataggccaaccatgccagttctctctgttgtgatcccccgactcaagacaaatcagctgaaatggagcttcagtggagcttttgaggctaggcaatcacttattgttagaggcctctttcccatgcttgccgatccccgacatcctgccgagtcgacaagtggcacaaacgagtctattctaaaggttgcccttgatcatggaaaagcatcaggagttataaagtcacacgaccgagtagttgtttgccagaaagttggtgatgcgtctgtggttaagattatcgagcttgaagattaa

SEQ ID NO: 13776 - DNA, 558 bp, Glycine max
  Peptide Sequence Number=SeqID_130554
cggggtggacccacagagggcgtggtttccggagaagcttacattgccgaatttggtgagcatggaatcggggacgtggccgcggagttcgttgttggtgacgttgagtacggtgagattaaggagggaagcggaaagttgtgtggggattgggccgcggatgttgttgtcggagatgtcaaggcggaggagaaggcggagcgaggatatctccgccggaatctcgccggagaaatcgttgcgggagagggtatcaattgggccgcggaggttgagggaagggagagtgaggcccactactctgccgtttggggagcattccacgccgcgccacgcggcggagcaggcgtcggcgccggtccagttggtgaggaggttgccgtgggtgtcggtttggagacggaattcggtgagagcgagtgtatcattttgccctgcagcctctgcagcaacacagaggatgcacaagcacaaggccagtgccaggaatatgggacaatgacaaacttttttcatgttatggtctgggaagggagggaacgagtcgtggagaggtag

SEQ ID NO: 13777 - DNA, 1713 bp, Glycine max
  Peptide Sequence Number=SeqID_130555
atggggggtgaaacaatgaacgggtcatggttcagtgttttgtggccagtctctcgcaagagtgcatcagataacaaggcagtagttggagttttggcattagaagttgcagggttgatgttgaaggtggttaatttatggcaatctttgagtgatgcggaggtattgagcctgagggaggggatagtgaactcagttggagttaaaacactggtgtctgatgatgatgattacttgatggaacttgcattgaacgagatacttgataactttcaatctctggcacggtctgtggctaggttgggtaagaagtgtgtggatccagtttatcatcaatttgaacattttgttcataacccggctcagaattatttccaatggtctgagtgggagtataggtggaaaaagatggagaggaaagtgaagaaaatggaaaaatttgtttccgctatgacacagttttgtcaagaggttgaggtgctagcagaggttgaacagactttcaggagaatgcaggcaaatccagacttgcataaggtgaaattcctcgagtttcagaagaaggtcatgttgcatcgccaggaggtaaggaatctgagagacatgtctccatggagtagaagttatgattatgttgtccggttgttggcgagatcgctatttacaatcctggagaggatcatacttgtctttgcaattaatcaaccaccaaccgttcaagaacaaaatgattatcagcatatgaatgctaacaatcttctacgaagtcattccttttctgttatgcattcttctgttcatccttcagagaatgatctctatggcttcaattcaggacctgttggggggaggccagtatcaaaatcaggttttttagttgacaagggcagaagaaaaaagaaacagcagcaagctcttcacgaaccagctttattcagaaagaacctgcattcagaaagcaaacagttaggacatattgtggccttcaaaggctgtatgtctgctgcaaacaattctcctgtcatacagagctgtatgcagactaatggtggctccatgaggttaactgattgtcaattgaaatcttttgataaaatgaaaacagtggataagttatctctctccaacagaattaggatatactctaaattatccataaaaaactggttaaagccagtttcacttacccttggtgatgcagctctagccctacattatgcaaatatgattgtattgattgagaggatgttgtcatcacctcacctggttgatcttgcagcaagagatgatctgtacaatatgcttccaactactgtaacaactgctttaagggctaagcttaagtgccatgcgaaaagtaaatcatcctccaatgctcatgatgcaaaccctgctgctgaatggagtccggtgcttgcacagatattagaatggttggctcctctagcacataacatgctaagctggcattctgagagaaattttgagaaggagcactcagttttcaacgcaaatgttttacttgtccaaactctttactttgcaaatcaagccaaaactgaggccgcgataattgatcttcttgtaggtctcaactatgtgtgcaggattgatacaaaagttggcacaagagatacactggattgtgttagtactagatcttttaatggtgttcatttgagaaagaatggaatgtacactgaatttttatag

SEQ ID NO: 13778 - DNA, 1455 bp, Glycine max
  Peptide Sequence Number=SeqID_130556
atgtctctgcaacctggttctagttctgcttcagagaagaggaagagaagctatcatagtagaactgacccctacaaagacaccctcctcagtaaacgaagagaatcttttgctgtctattccaaagaagagctattggaagatattcctgtgatgaagcaacgactatggtctgagtccgctgccgaacaattcgagggaactattcacttcagaaaactgttagcaaatgggcaccctccaattgatgaggtgattaaagcagacgttgtccctcgcattgtggagttcttggaaagcgatggtttacaccagttgcagtttgaggctttatgggtgttaaccaatattgctagtggaacatcccaacacaaaagagctgttgttgaccacggagctgttcccaagttggtgaaacttctgagccctaccaacaactatgacgatgtcagagagcaggcagtatgggttttagggaacattgcttttgattccccatgctatagtgatcttattcttaacgaacatgctcttctaccattattatctctgttgaacccaccatctccaatattgtctatgttgaggattactacatggactttatccaacttggtccgtggaaagcctccggtaaagactttgatgcctgtccttaagacactcatccacaacagcgacgaagaagttgtatcagatgcatgctgggctctcttttacatttcagatgtctcaagtgacacaacaaagactattgttgaagcagaattttgcgtaaaacttgtggatcttctgacgaattcatcacttacagttattgtacctgtacttcggactctgggaaacattgttgctggtgatgatgctcagactcagcttacaattgataaaggattgatcacgggtctttcgaaacttcttcttatttctcgggacaaagaacagatctacaaagaaacttgttggacaatctcaaatatcacagctgggaatggagctcaaatacaggctatcatcgatgcccatattattcctgttcttgttgctattgtaatttatcgtaaagactgtgagattgacctaaagaaggaggtggcctgggccatctccaatgccactagaggatctcatgaccaaatcaggtacctggtggatcaacgttgcattcaggcactatgtgatctcttggcttatccaaactcagagattgtgtcaaactgtctcgaggggctagagaacattttggtggttggagaagttgacaaggatattgatagaggcaatagctttgctgaaagggttgataagtgtgatggatggggtatgattgaaaatttgaagagccatgacaagaaggagattaaagagagagctgcgaggattttcaagacattttgggcagaggatgatttggtggaagatacggatcttcaggatgatttgggcagaggatga

SEQ ID NO: 13779 - DNA, 243 bp, Glycine max
  Peptide Sequence Number=SeqID_130557
atgaagatagcatttaattgggaaagaaaaccgatgttaacgaatgtgttactattgacagttaacatcggaaggatttccagctgctcttcagaagtatcatgggatgacgatgttaatagcaactccatccaagagggaggagctttgtttagtttaggaaaaggagggtcagccaatgttggaggagcaggccgcgccggtactgtaggttgggttagtggagtggcctctaacttctaa

SEQ ID NO: 13780 - DNA, 100 bp, Glycine max
  Peptide Sequence Number=SeqID_130558
atggctgttgttgacagaattcgaggcactgaaggaactaggaaggactcaaggaagggcaggatgccgaagaccataaaagagattcatcatttgttga

SEQ ID NO: 13781 - DNA, 699 bp, Glycine max
  Peptide Sequence Number=SeqID_130559
atggatcgtttttcttctagtaccattctccccgaagcgtttcaaggtgccaaagatgacttcaccatgcagcttgcattggtctggaaccaaatcaaagcgccactcattgtcccgttgctgagaataacagtgtttctgtgcttgatcatgtcggtgatgatgttcatcgagagggtctacatgggcattgtcatcactctggtgaagttgtttgggagaaagccagagaaacgttacaagtgggaaccgatgaaggacgacatagagttgggaaactcttcttacccaatggttcttgttcaagtccccatgtacaacgaaagagaggtttatcagttgtctattggagcagcatgtgggctttcttggccttcagataggatcatcatacaagtccttgatgactccactgacccaacaatcaaggagttggtgcagcttgaatgccaaagatgggcaagcaaaggggtgaacataaagtatgaggttagggacaataggaatgggtacaaagcaggggctctcaaagaaggcatgaagcgtagctacgtgaaacaatgtgattgtgttgctatctttgacgctgattttcaaccagagcctgatttcctgtggcggaccgttccattcctcgtgcacaatcccgaattagccctcattcaagcacggtggaaatttggtaatcattttttttaa

SEQ ID NO: 13782 - DNA, 2031 bp, Glycine max
  Peptide Sequence Number=SeqID_130560
atgctcgacgaagccaccgacttgtactccaccatgcgaaaagacggttttgtcccttccacgcgttccgtcaaccgcttgctcaggaccctggtggattcccgacacttcgagaaaaccctcgctgtcttcgccgacgttatcgattctggtactcggcccgatgctgtcgcttatggaaaggctgttcaggcggcggtgatgttgaaggacctcgataagggttttgagttgatgaaatccatggtaaaggatggaatgggcccttctgtgttcgcttataacttggtattgggtgggttgtgtaaggtgagaagaatcaaggatgctcggaagctgttcgatgaaatgattcagagaaacatggttccgaatacggttacttataacacgctcattgatgggtactgtaaggtgggtggtatagaggaagctttaggcttcaaggagaggatgaaggaacagaatgtggagtgtaatcttgtcacgtataattccttgttaaatggtctttgtggttcggggagggtggatgatgcgagggaggtgttattagagatggagggcagtggttttttgcctggtgggtttttgagttttgtgtttgatgatcattcgaatggtgcaggtgatgatggtttatttgatggaaaagaaataagaatcgatgagcgaacttattgtattttgttgaatggactatgcagggttgggaggattgaaaaggctgaagaggttctggccaaactcgtggaaaatggagttactccaagcaagatttcatataacatattggtgaatgcatattgccaagagggtgatgtgaagaaagctatactgacaactgaacaaatggaggaacgagggttggagcctaatcgaatcacttttaatactgtgattagcaagttctgtgaaactggggaggtggaccacgcagagacatgggttaggaggatggtagagaagggtgtttcccctactgtggaaacctataactcgttgattaatggttatggccagaagggccattttgtcaggtgttttgagtttcttgatgaaatggacaaggcagggataaagcctaatgtcatcagctatggttctctaataaattgtctttgcaaagatcgtaagcttattgatgctgagattgtgcttgcagatatgataggtcgtggggtttctccaaatgcagaaatatataatatgctcattgaagctagttgctcattgagtaaattgaaagatgctttcagattttttgatgaaatgatacaaagtggaatagatgcaactcttgtgacttacaatactttgataaatggactcggaagaaatggaagagtaaagaaagctgaggatttgtttctccaaatggcaggcaagggatgtaacccggatgtaataacatacaattctctgatctcaggatatgccaagtcagtaaacacccagaaatgccttgaattgtatgacaagatgaagattcttggcataaaacctacagttgggacttttcaccctttgatctatgcatgcaggaaggaaggcgtggtgacaatggataaaatgtttcaagaaatgttacaaatggatttggtcccggatcaatttgtatataatgaaatgatttacagttatgctgaagatggaaatgttatgaaggcaatgtctttgcaccaacagatggttgatcagggagttgattgcgacaaggtgacttacaattccttgattcttgcatatcttagagatagaagggtttcagaaataaagcatcttgttgatgatatgaaggctaaaggactggttccaaaagttgatacatataacattctgattaagggactttgtgacttaaaagatttcaatggtgcatacttttggtatagggaaatggttgagaggggtttgcttttaaatgtcagcatgtgctaccagctaatttccggactaagagaggagggaatgctgcgagaggctcaaattgtatcctcagaattgagcattggaggactgaataactag

SEQ ID NO: 13783 - DNA, 837 bp, Glycine max
  Peptide Sequence Number=SeqID_130561
atgaagcagcctttaactacgtcaccaccgcctctctcttcccacccaaagccctcccttccaaactctcttatcttcggcgacaagctccaggaggcaaccttttcctacctcgactcagacggcgaggtgaagacgacgacattgtcggacctcaccaatgggaagaaggcggtgctgttcgcggtccccggcgcgttcacccccacgtgctcgcagaagcacgtgcctggcttcgtggagaaatccggagagctgagggcgaagggggtggatacaatcgcatgcatttcggtcaacgacgccttcgtcatgaaggcatgtaacggaaccttcaccaaagccattggagtcgaactcgatctcagcgacaagcccgttgggttgggtgttaggtcaaggcgttacgcgcttttggccgaggatggggttgtgaagctcttcaatttggaggaaggtggtgccttcactttcaggacatcctcgacgttctttgaaattatcagtactacctgtttcttgaaaataattggacttcctagatgctgctctgttgaacagttcgaatatcaccctgaaaaggttactgaagtaataatcactacaacaaaattgaacgccgtttcactacgcaaaagagataggatatgtgaaacacaattctggaattattctttgatgccgaaacttctggcaagattgcgatactatgcctcggtgtgtgcgctgaaaatttattaccgtttgtttctttttggcaaaaactggtggaatttcagcctcacaaaaaccatcaacaatgacatccagctaggagatgcagaatccttgacctag

SEQ ID NO: 13784 - DNA, 938 bp, Glycine max
  Peptide Sequence Number=SeqID_130562
gtgttgaggtgaaaagtggagaatctctcaaggttgatccgggagatgacaagattatccacctttcaaatgcatgcctgggggatgtcactaaggataaagaaggtctaccagtagccctgtatgtcaagtttggtaaccaaaagcttgtacttggaacgctttcttctgaagcttttcctcagatatcttatgatttggtatttgagaaggaatttgagctatcccataactggaaacatggaaattttgatgaagatattccagttagtgctgccaatggtaaacctgagattgaggtgaagaatggcatcaaacctgatgcaaatgaagctaaacagaagaagatagcaaatggtgaagatgaagattcatccgaatctgaatctgatgatgattcaagtgaagatcagctcacagcgaatggtgacatagaaagtagtgaaggtgatgatgatagcgatgatgaggaggagggggacgatgaatctgatgaggagacacccaagaagattgaagcaagcaataagaggggtattgactcttctaagaaaacacctgttcctgtgaagaagacaaaatttgttactcctcagaagactgcgataaagttgtgccttggtgacttgttggtcatgggttcgaatccggaaacagcctctttgcatatgcaaggctgtggtataagagcctctgaagaagtggtccagaatttgatccttattgctagtttaaccgtcaagaatgttgtccatgttgcaactcctcacccttctaagcagactggtaaagcaactgctaataacaagcagcagactccgaagtcaggtggagattacagctgcaagccttgcaacaggccaagcacagcactaagtgaaggcttgctttttgcccgagcagtgacagtgagtgttgatgtttctggtgttggatga

SEQ ID NO: 13785 - DNA, 508 bp, Glycine max
  Peptide Sequence Number=SeqID_130563
catcgcggttatgacaagtgagcaattgattgagtttgcatggggtcttgctaatagcaacaaaacctttttatgggtcataagaccagatcttgtggcgggcgaaaacgctcttttaccttcagagtttgtgaaacaaactgaaaaaagaggactattgtctagttggtgctcccaggaacaagtgctgactcaccctgcaattgggggatttttgacacacagtggttggaattcaacgttggaaagtgtatgtggaggtgttccaatgatatgttggcctttctttgcagagcaacaaaccaattgttggttttgttgtaaggagtgggggattgggttggagattgaagatgttgagagggacaaaatagagagccttgtgagggagttgatggatggtgaaaagggtaaggagatgaaagaaaaagctttgcaatggaaggaattggcaaaaagtgctgcttttggccctgttggatcttcatttgctaatttggataacatg

SEQ ID NO: 13786 - DNA, 213 bp, Glycine max
  Peptide Sequence Number=SeqID_130564
atgaaggtcggactgggagaggaactggaggagggcgtggtagcgaagaacgtcgacgagggtgacctgggaaaaatggtcgtcggtggtgaggtaggcgttggggacggcaagaatggagagggaggagcggtccgagagattcgcgacgaagggcgtggcaaacatgaggagggagctcttcctaaagcatctttagttagcgcaatttaa

SEQ ID NO: 13787 - DNA, 183 bp, Glycine max
  Peptide Sequence Number=SeqID_130565
atggtggtacaaaggtgtcgtatctcaacccccaatggaatccaacttattcctgagacaagccatagtgagatggcgggtacgaaggttccatatctcacacctcaaggaatccaagttgagggtgtaaatctccatggagtagagactgtctttggtggttgtattcggtgtacatggtga

SEQ ID NO: 13788 - DNA, 306 bp, Glycine max
  Peptide Sequence Number=SeqID_130566
atggtaaaaaaaataacctcaaccctaacacctcttctccctcttccttgcgtcgcccaagcaccctctcttctagaatacaaacacgacattgttgtcctcttttatcatccaataccaacgtggtgccatcgtcctcttggcggtgacatcacaattgtggatggtggtgcacggtggcgtgaaggtgcaaatgtgacacatgttggcacgaaggcttggaggcatgggtttgaagaaggaaaggggggtcgtgccacctattccaaaacaattattctgaaatatgatacgcttctgaaatag

SEQ ID NO: 13789 - DNA, 213 bp, Glycine max
  Peptide Sequence Number=SeqID_130567
atgaggtgttacaagatgtgtgtcgtcgatgtccctgatgacaacaccaaagagaacattcgtttcttcatttggtcagtagtcatgttgaagttcataaaggcatgggtagtggttcatcctcgtatcagtgaagtttttactcagtttcttttgcgaggagattccaaaggtagtataggcaatgaatcactatccaagggactatgttag

SEQ ID NO: 13790 - DNA, 288 bp, Glycine max
  Peptide Sequence Number=SeqID_130568
atgagtgtggatgagtttctttctcaggtggcttggccaggagtccagccttctccttctggagggggtaaggcctccgcagcccaaaagcctgcgccagcagaggagctcgtgccaatagcagacgatgagcttgttcctcctaagctgtttatctttgagactgatccagttgctcaggaggaagcagcagctcctcgtgtttctctgcacctgtcggggcccgttttcgaaagtaggcaatatatatatcaaaacgctcagaatgagaccctgagcgtggtttag

SEQ ID NO: 13791 - DNA, 252 bp, Glycine max
  Peptide Sequence Number=SeqID_130569
atggcttacactcacattccggattcaacaagcgattctcctcaaatttcagccagcccgtatcaattagaccttgcaccttacgcttcagagccctacaatgctcaatggaacgccccggggcttctccgtgacaagcacacgttgcgttcgagtcgtattctcggagaaatggaggttgatgaaccttggctagggttatggctaccatttgaattatcaagtagatatgggatcaagtttagcatatga

SEQ ID NO: 13792 - DNA, 186 bp, Glycine max
  Peptide Sequence Number=SeqID_130570
atgtaccaaaaagagagtgcctccaatctacacatcaatctgaacactgaagtatctttgacagactcgtggcacaacatgtgcgtgagtccaagggacaggatcctagtcaaggtcaacaacgcaatagagatcgaacatggtggatcaccatggttctcgagcaattctcgttaccatatctag

SEQ ID NO: 13793 - DNA, 315 bp, Glycine max
  Peptide Sequence Number=SeqID_130571
atggagcttcatgaccttatcattttgtcatcatctttcgaggcctcccagtgcaaaattcttaaaagtagtggtaagagttatctagcaaagatattgcatgatcttgaggttgaaaatggtggtgatgctcctcgaattcattccatggatgattattttatgactgaggttggaaaggtggaggatggcgaggcatcaaaatcttcaagttcaagcggaaacaagaagcctgtgacaaagaaggtcatgaagttttgttatgaacctgaaatggaggaggatgtagagcataacgtatacagcaaaaaataa

SEQ ID NO: 13794 - DNA, 315 bp, Glycine max
  Peptide Sequence Number=SeqID_130572
atggccgttcctgtgaggactttagctcttgttgctttgcttgttgccattaatgcaatggtgtgtgaaagtagagtggtaagaaaggaccttggtttggaccttggtggggtgggaattggggtgggtgctggggttggattaggccttggtggtgcagggtcaggatctggagcaggttctgaagctggttcctacgcaggatctcatgctggatctagcgctggctcaggctcctctagagcgggttctgaagcaggttcatatgcagggtctcatgcagggtcaggatcatatggtggtaatggaaagtag

SEQ ID NO: 13795 - DNA, 147 bp, Glycine max
  Peptide Sequence Number=SeqID_130573
atggagaataatatgacatgccgatccataataggatcaaaggagatgaaagaaaatgtgaaaaatgaaagcaaaagtgcacaatggaggcttggggctgctgccaagagtgactcccgtaagcttattggtggctttgagttttag

SEQ ID NO: 13796 - DNA, 327 bp, Glycine max
  Peptide Sequence Number=SeqID_130574
atggaaatggatccagaagaatttactccggttgcacaggatgagtctttagtgattgaaggtgaaggtgggaataatactcaacaaccaatgagtaactcaagagttagacgtagttggactgaacttgaggaggaaactttgctcactatacttgagaagatgatggtggctggcaataaaggagagaatggaacattcaaggatggtactcatgtggaagtctataagaggatgaaaaataagatttctagtatttttataaattccaaacaagttgttaacaagatgaaaaggtggtcaacaaagcttaatgatgaatactag

SEQ ID NO: 13797 - DNA, 606 bp, Glycine max
  Peptide Sequence Number=SeqID_130575
atggccactccacctgtctcgcctcctcctcctcttcctcctcctcctgcagatgcatcaacgtctccatctacgttgaagcggacacgcaaggcgacacggctacaatcattggccactagaccacctggggtagaaagacctgtggtcaacgtcgatctttctaccggcaaggccgacggtccccacaagaagaaattaagaatatatttagggattgtcgctcgtgataaggtcgacgtgacatatgacacctggaaggaagttcttgctgctcagaaggatttgatatgggaggatattcaggcggaatttgaaatccctgaagcttctaacagtaggacaaagaagaaaattcttcaaactgtcggcgagtgctggaggcagtttaaatctgacttgactaggaaatgggcacttgcagccgacaaggacggtgtggacgacattgtctgtgaaaaatacggcattagcaatgagaaatggacccagttttgtcagacccgcaaagactccttatgggagatgtgcggaaaaaggcacaggccatccagaagcaaaacattgccccccacgtattgtctcgtgggggttatgaatatttag

SEQ ID NO: 13798 - DNA, 667 bp, Glycine max
  Peptide Sequence Number=SeqID_130576
cgttgctcacgctaagtgccacccccgtgggctaagcgttattcattgcggcatgcataaggctaagctagcactgctcgctaagccattatggcatcaaggaaaaggaagagcactgcttctaggcctcaagctcaagttggagaggcgtaaccttcacaaacgcctcggcaaccttcaggagggaagcatagatgtggcggtggttaaggaattttatgccaatttatatagcccagaagaccaagctcccaagtatgccagagtaagacgtcgtatgatcaagatagatgcagacagcctgaacgaattgcttcaaaccccagtgttaatagaggagggggaaccgttacccacctactctagattttgcagattaaggtataatcccaaagagatggaggctagcctgtgcattcccggcaagggctttgttctgaaagctgagggccaaccatggaagctcctcagaaaggatcttactaccttggcccagacatggagtatcttctctttcaccaacctagctcctacctcccacacctcagtcacagggacggacatgaacattggcggcttgatctttggacagataaccattatggctcagtgcaactcttctcgcctaggcttcccagctttaatcacagccttgtgcaggtcgagg

SEQ ID NO: 13799 - DNA, 198 bp, Glycine max
  Peptide Sequence Number=SeqID_130577
atgcagctaccgcaagagcccttgaacaagaaaccaagagggctcgcaaagaagggcatggccgagacaaatttcgtggagctttgtggggcagcaacatgtgaatcaagtcactcccgcattttagctctagcatgcattgtatgttggtctcgtcctttgtcacgggaagccggaaggtccatatcaccttcttaa

SEQ ID NO: 13800 - DNA, 655 bp, Glycine max
  Peptide Sequence Number=SeqID_130578
gttctagatccagaagtagctgtgaagaaagaaaaataccaagtgtttgaagaactcgtccgaggccagtttggcaccgtgtttcactgcttccaacaacgaggaccgccgctgcatcaaaatggaggccttggaggttggtggcatggtggtggtggttttcgccagcgaggaggcgaaaaagaagcagccgctggagaagaagtcattgtcgtattcgtcggtgaagaagttgcggagtgcgccgatccagcgaagaagaaggagctggacggcctacgcgccgagatgtcggtggcgctggcagagtgcgtcaatccgatgaaatttgtgctggaggcaatcttagaggtgtttccggtcgacaagagaggggaaaaggccggccacgacttgggctgggcctgcgtccttgtccttgagtcgctaattccggtcgtcgtcgacccggtcaatggaaaatcgaggctgttggttacccctaccgtgaaggagcatgccacggagatcacggagacttggaagagcagcctagaggagcatggcgacgtggaaaacgttcaaacacttgagatgccactaatccttggaaactctagttctggaagcacaagtcaggtcaggaaatggaacatgaatagcacaaggtgggaag

SEQ ID NO: 13801 - DNA, 234 bp, Glycine max
  Peptide Sequence Number=SeqID_130579
atgacgttctcaaattctcagccacaaacaaccatctctctttggaaaaggatattggccatcatttgggcaatttcctttggaacggaaccaccttattcttcgcagagcgcttcacggagtcccgaactggcactgacaacggattcgtgtcacttctctaaccccacgcaacaaccacctcttttccgccgagacttcggtccctccgcaccacaacaggcttatgactag

SEQ ID NO: 13802 - DNA, 531 bp, Glycine max
  Peptide Sequence Number=SeqID_130580
atgacctccatgatggaggccatgttaagtatgagacagatgatggagagcaatgcggccgcagttgccgccactagcgccgccgctgaggcggatctgactcatccatccaccataaaccaaacaagccaaccagttccggacatggtaggtcagggaggagaggcgttaggcaacacgggcggtccccatccccgggatcatgctctgggtgactttgaaccataccctacatatgccgccgagggaccaatgtttagtggtatgcctcagtccaatgccgcgagagctcctcaacaccgcccgctgcaacctctgtacttctcggtggggagactgccttcgtccatggaggaaagagagaagttggatctcatagaggagaggctgagggtcatcgaagggatcgatgattatttgtttgctgacatggtggagttgtgcctagtgcctgacgtcgtcatccctccgaagttcaaggtgccgaatttcgataagtacaaggggactacttgccccatgaaccactga

SEQ ID NO: 13803 - DNA, 354 bp, Glycine max
  Peptide Sequence Number=SeqID_130581
atggtgcagaaagcatgtgtgtttcctattctctctctacacagtagcaacctcgtgtcaagcgccaaagctattaaacaacaactagctaaggggaagattaattgtagtgccaagagtggccctgtcgcaacgtgcccttcgcgggcgagcgaaggcgaggctcacgggtgcgctttcctaagggaggaaagatgcgcggagtcgccaccaacgtttatttgtggaaaatgtcgggaaaaccgaaggaaaccggtcaaaatgaaaattctaagttcgggagttgtatttacgcttgaggaaggtattagcacctctcacgtttgtctcaaaggacaacaacctattttttag

SEQ ID NO: 13804 - DNA, 1050 bp, Glycine max
  Peptide Sequence Number=SeqID_130582
atgaggttggttgacgatggctcctttaagcagactaccgtagtggatgaatccattctttatgaacttcaccagaaatttggactcaatacttggcgtgatgaccagttggatgcagtttgggagaaagctactgaggagaacgataagttggatatgggcacaccttcgtccaaagttgttattgcacctgaacgtccaccaccttctctggttgctcccaaagaaacaagggccatggcccctagttgcaccaccttcgatgagaccattgcgcctcaaatgaaaaaggtagaaccaacaccacaagctcttcctcctccattcaacgtcacaccagcaggcaagagaaaagaggaagagattgtcacatgccctcccttcatgtacaaaaaccttgaagttgcaccattttctgctacatcagaccaatctataggattgaagtctttcttccaccaacttggaatcatcttcaccctaagatatccaatcttacatccccatttgccttgcataaaagtgtgtacaaaattccatgtggggcttacagagcagtggtacgctgtgatcaagatatcattagatgtctatggccatcaagccattccattgactaaggatgacatcttcaatgttaggatgattctgatgcagcatggtctatctgaccaatggccaagctaccccctaggtatccacatccatccaaccataaccattaagttcatgccagacaaggttgttcttaggtttcctccattggacctctggaaaaagaaaggaaaaatgcctccttacaccaaaccaatgcctcatcctggtcttagagacaacatagccctacatccaattccctatgattggggtaggtgctttatgagggatgaagcaaccaagactgtcgctctgaagcaaaacattcagtttgaccagaacaacatcatgcttttttacttcaaagacatgtatgaaaacttatgtcttatgtccacttcagagtactacaaggaaaacacatccaatcacaagcgtattgtaatgccttga

SEQ ID NO: 13805 - DNA, 345 bp, Glycine max
  Peptide Sequence Number=SeqID_130583
atgaaggtggagaatgaaagggaagaagataagcactctagcttcaagaggagaagaaaatggacatgggcaaaagaagaggttgagaaaactcacctagacctccaagaacttgagcactcaacaatggaggaagagaagaagaagaagaagaaagcaaaggattccctttctctctcctcttggccagcggcttcatcaacaaaagggagggtgcttctcttttatagaaggaagggtgtcgagggaaggaacccagagtatgaagaacctcgggatttgaggtcaaatcctttccaaggtggaggggatgatgcaatcctaccccccaagggtattggatag

SEQ ID NO: 13806 - DNA, 189 bp, Glycine max
  Peptide Sequence Number=SeqID_130584
atgaagaatctgagacctgaacaggaggaggaagcaatcgtaattaaaaatcggtcggagggaacgaggaaagagaggtggagacaagggagcttggttggatttgacctaagaaacacggaggagaggaggagaggaggggacagtggcaattgttgtcaaacagttgctggaccttgcaagtgttag

SEQ ID NO: 13807 - DNA, 1557 bp, Glycine max
  Peptide Sequence Number=SeqID_130585
atggcttcaataatgaatgtccagcagattgtaatcacccttgaaatatatggtgtaaaaaacatcgtggggattccttttggttatcggggattttctgacaaagaattgacagaagtgccgttgtctagaaaagtagtgcagaatattcatctttctggtggaagcctattgggagtttcacgaggaggacctggagtcagtgatattgtggacagtctggagaaaagagggatcaacatgctttttgtattgggtggaaatggcacacatgctggtgccaatgcaattcaccatgagtgccgcaaaagacgcctgaaggtatctgtaattggtgtgcccaaaactatagacaatgatattttattgatggacaaaacttttgggtttgatactgctgttgaagaagcacaaagagcaataaactctgcctacattgaggcacatagtgcatatcatggaattggggttgtgaaattgatgggccgtagcagtggattcatagcaatgcaagcatccctgtctagtggacaggttgacatatgcctgattcctgaggtacctttcaatttacatggacctcatggagtattgagtcatctcaagtaccttttagaaacgaagggatcagctgtagtctgtgtggcagagggagctggacagaatttactccaaaagactaatgctacagatgcatcaggaaatgttgtatttggagatattggtgtatatattcaacaagaggggctactcgtttccccttctgttggacttcttctcccaacacaaattactaaaccagtgtcatacatgtctcattttgatcaagaggatatgactatactttacaagtatcctagggctcttcattgcaagaacctggttgagaaggctaagaaggaaagagctgatgctaagaaagctaatgctaaagaaaaatttattcatgttgaggtggctaataactggatgcctcatcttcctctcgccagttcaagaaagaaaaaggttgctaccccatcaccagtgctactccttcctccgttgagagtcaccttgccttcctttctacgaaggatggggtttcttctctttgggtctgccgaattgcaatatactaagggaggtggtccccgagcatccatggactatattgcccattttcaggtaaggtcttgggggattgctgaattttgggctgatgagttcaagaaggctaatgctaggtcccagaaagctcaagccaaacttaccaaagcaaataggctttggtcaaagctaccaaggcaaatgaaagtctcatgtagtcgatcgaggaatcctggaagtcattggaaggaggctttgaaaggcaagctaaaaaaggagacagactcggctaagactcttcaaaatgaggttaagcgtcttcacaaagagtgtctagatgagctcaagatgcttcagctggctaagtgcagattactcaaggatgagttgaagtcattcgaggaaggattggccaatggcactagaaatgctcgaggcaatttaagacactcaaggcttcttgaatga

SEQ ID NO: 13808 - DNA, 240 bp, Glycine max
  Peptide Sequence Number=SeqID_130586
atggcagcggaatggagatggaagaaagatgattggagatgccacttcaaggagaagatgagtcaagaagaagctcaccaccataggaagccatgggattgcatcaatgatgatggaggtagaatgaggtttgatagaagaaataatgagggtaatgctagagaggatagaattgagggagtgaagcttaacataccacctttcaaaggaaaaacttacccgaaggcctatttagagtag

SEQ ID NO: 13809 - DNA, 1113 bp, Glycine max
  Peptide Sequence Number=SeqID_130587
atggcttcaggtggtagcaacaaacctactaaagggcagcaaggtggtcttgaaactgcaaaggctaatggaaataagattgatgaaaatctgattaagaagtcttcacagttcaaagatgaaggagtttggaggaggatggagaaagagaaagagaaaagcaagagtcctaagggaattgtctttttgaaatatattgatgcttctgaaatatgtaagacatcaaaggcaattttcaagatgatggatgaagttgttgcgaaggtcagggaagaggcaattttcaagatgattggtgaagttgttgaagaggcaaattacaaggcagctggagatttgttgatgcatagaagaaagaatttgtattggacagcttgtgcagtgcattgcattgatttgatgttggaagattttgagaataaattgccactccatcaagagacaattgcaagtggtgctttccctctaatgaaggtgttgtccatggttgattcagacaaccaactagccatgggattcatttatgaagagataaatagtgccaaagaaaagatacaaactctattcaatagaattagtgaaagttgcactcctatttgggaaatcaacgatgcaagatgggaacaccaattacataggccattgcaagttgtggaaagaatggtgggaggcattgacaagatagctaagattgatgctcaaattgagaattccaagagcaaatccaagtcttttggtagtttaatagctcaacgcacactacaaaccaaaactccggcacaatggtggagtcttatggtccacaccaagaaaaggaatcatttacaaaagacaatgaatgatgtggtgtttgtgatgagtaattcaagattgaacaagaagaaggatgttaggaaatcaaaaaactttaaaattgatgatgtttcttctgatgatgaatggattgtggagaatgaagcaaattcagacttgaatgctttagatgaagacatcttagttgaattgggagaagatgctaatggtggaggtattagtggtgcatctatggatgatttggaggttcctccaattgttgatgatgatgaaggtggaggagatgctattaatgagtag

SEQ ID NO: 13810 - DNA, 732 bp, Glycine max
  Peptide Sequence Number=SeqID_130588
atgtctttatatattgctgttgaatttaatttatttgacgtgaatgctattgggtatgacattgactatgaagaatattacagttttgttcatgggaaattaccttatgagaacttaaagccagacccagttctgaggaatctgctgctgagtctcccctatagaaagcttattttcacaaactcagacaaagtccacacgattaaggcacttgaaagacttgggttggaagactgctttgaaggaataatatgctttgagacccttaatcctatccaaaagagcactgttttttattatgaagatgacgtaaagtttgagggttcaaagagcataagtccaacacccaaaaatggtgtagaaagctctgaaatctttgacatcatagagcattttgctcaacctgtacccagtgcagtcctgccagagacaccaattatctgcaaaccatcaggacatgccattaaattggccctcaagatggccaaccttaacccacaaagaaccttgttctttgaggatagtgtccgcaacatacaatctggaaaacgattgggccttcacactgtgctggttggtagatcctacagggttaaaggtgctgattatgccatggaaagcattcacaaccttaaggaggcagtgcctgaactgtgggacgctgacataaaagcacaagttgaatgcccgggaactgagaagcttgcagtggagacatcagatatagtttga

SEQ ID NO: 13811 - DNA, 251 bp, Glycine max
  Peptide Sequence Number=SeqID_130589
atggagaggtcctcccatggctacgatggaactggtaacgggcataataaaccccgaggttttgcagttttctgccacacgattcaaggtttttcgaaaacccatatggcctcctgttggagtttgatgaaattccatgagcaaagctgggatgaaaacagatcttcaagaaacgcaaagtggggcattgagaggatgaaaaatgaggcacttggttcctctgagcatcgtgataatgcgtctgcaaccac

SEQ ID NO: 13812 - DNA, 246 bp, Glycine max
  Peptide Sequence Number=SeqID_130590
atgaccctttcatcatggcaaaacaagctagacaagtattttacgtgcaagacccttgtgatgaaaggtgagacagaggtcaccaaagcaatttacaaaagcaaaggtgaaacgaaagatattgagctggtagaggaggaacaggcaaggattggtgctgatccttctagtgagacctccaataaatctgagaattataaggaggaagcacgaaatgcaacacagaagcataaccaaagaaggtag

SEQ ID NO: 13813 - DNA, 1077 bp, Glycine max
  Peptide Sequence Number=SeqID_130591
atggaagggagcattgaccctgcaacctcaacccttctgtctctggaaaacaatgccacgtgctttgatgagtttgattgtaatgttgcagatgaatctctttcctgggaccacaaacatcttaactttaacaatcagtgtctgattaaggacaatcatggatcggaacatttttgggatttttctgtactgagcgatgaaactgttatggatttggttgggagggagagcgagcatttgccccacgttggttacctcaagaggctgcttagtggggacttggacttgagtgttaggaatgaggctcttgattggatttggaaggctcatgcttactatggttttggaccctgtagtttatgtctatctgtgaactacttggatcggttcctatcagtatatgaattaccaagaggcaaaagttggagtatacaactgttagcagtagcatgtttgtcaattgctgccaaaatggaggagattaaagtgcctccttttgtagatttacaggttggagaacctaagtttgtatttgaagctaaaaccattcaaagaatggaactactggtgttaagcacattgagatggcaaatgcaggcttcaactccattttccttcctagattacttcctcaggaagatcaactgtgaccaagttatagtaaagtcatccattatgagatcagtaggacccatccttaacataattaaatgtatcaatttcttggaattcaggccctctgaaattgctgcagcagtggcaatttctgtatcaagggaaatacaagcagaagagattgacaaagccttacaaatgcaagcagaagaaactgctgcagcatgttttttcattgttgggaaggaaagaattttgaagggtcttgaattgatcaaagatttgtcattgatgcaagattctgcaaacttgggcaataacttagcatcatttgtaccccaaagccctattggggtgcttgatgctgcatgcttgagctctataagtgatgaattaacagttggatcatatagagattcttcccttgatactccaaattctaagaggaggaaatctgactaa

SEQ ID NO: 13814 - DNA, 579 bp, Glycine max
  Peptide Sequence Number=SeqID_130592
atgcaagtacaaccagaggagaaggctatcgtgaagctactatgcataccggggcaagatttcacccatgccgctgcaaagaaacgagtgtggatcatgcgcaccaacatgaccactattacccagatatggatgaccttgctacttagcaacattctgcccagcgaccgtaatgccgatctccccctgaggaagggtcgtgcccacatgacacctagtggacccaaagaagtccaacaaggctctggggtttccagctttggttacgggcctctatcagtcctacagggtgcccgtacccccctggcaaagtcatgccatcgcgatataggtaaggatcgcacccacaagacacccagtggacccggagaagtccaacagggtcctgggtttccagctctgattatgagcctctgtcagttctacagagtgcccgtccccccagcaagttcatcaggccccctattaaccgggctttcatcaagaagtactgtgcccccaggcaggcgcagggcgagacaccacagcagcctagggatggccggcagcgggcaacagatgcaccgccaccacctctag

SEQ ID NO: 13815 - DNA, 435 bp, Glycine max
  Peptide Sequence Number=SeqID_130593
atgtataactattatgagaaaggaagagatcttgatattgaaagtgcattggcagacttcacgacgtaccaagctagctataaagatatagataaaggtcgattggaactcagtgtggaggatcagaaaatctcttttgacctctttgaagccatgaaacacttagatatggatgatgcctgttttgaagaaggagaggtggagcaggaaatagcatcatcagtttcaaccatgatactacagtttcctttggaaaaagaacttggtcatgtggtagactgcttagtttgtgatgaagagcttgatgatccaaaagacaactctgatggtcatttggattttgaagaattaaaaaaaattaggaccaatagaaaagcccaaagcagaattaaagacccttctagcacatttaaaatatatgttcttggagaataa

SEQ ID NO: 13816 - DNA, 645 bp, Glycine max
  Peptide Sequence Number=SeqID_130594
atgggtgaaatagaggaggtgcaagagtggatgaaggccgacatagaggccatgaaagagcaaatggacacaatgatggaggccatgatgaacatgaagaagataatggaggtcaatgcggctgtagttgctgctaccagcgctattgctgacatggactcgactaccccatccggcctcaaccaaataagtcatccaacctcggatatggtagaacatgcatgccttcccaccatacggcttgcccccaactatacaccacccaatgttgtgcacactcctgatgaggatgtcaataactccactcccatacccattgagagccaacaaccccaatctattcatgcacatgaagcaccccaagatcacaatctagcagacttcgaaccttacctcggatatgccactgaggggcaagcagttgtccctcctgccgtggtgaaaaggggaaaatttgatcatatagaggaaaggctgaggggtattgaaggaggcggagattatgcttttgctaacatggcaaagttatacctagtgcctgatgtcgtcatccctccgaagtttaaggtgccggatttcgataagtacaaggggactacttgccctaggaaaattggggcatcgcaaaagatgaaaagctgttga

SEQ ID NO: 13817 - DNA, 398 bp, Glycine max
  Peptide Sequence Number=SeqID_130595
atgggagcggagttattaacaccctcactgggagtgtatgccatattgggtggtgtacagttgggaggcaagccatatggtgggaaggcatgcttgtttttcgcactaaatgagggccgcccgtccacctcaacaatggtgctggtagcggctattgcaaccgctttgacctctattatctcctttatgctcatcatggcttccatcattgtggccattttctccttcaaggcctccatgtcggccttcatctgctcttgtagctccgctacttcacacattactctaatttgtctctgcgtgccatcgaacacgattgtgtcgggatggcaaaagggcgagaaagtcgctagtgcacaggattttggttggcaatcaaagggagaggaccactttag

SEQ ID NO: 13818 - DNA, 219 bp, Glycine max
  Peptide Sequence Number=SeqID_130596
atggcatacactcccagtgagggtgttaataactccgctcccatactcattgaaagtcgacaaccccaaaatgatcatacacatgtctctcaaaccatgggggagacacatgaaattccctaccacaatctagccaacttcgagccttgcctcggatatgccactgacggacaagcagttggtggtatacccctgcaaatcactttggaggagccttaa

SEQ ID NO: 13819 - DNA, 372 bp, Glycine max
  Peptide Sequence Number=SeqID_130597
atgatgagatttctaagggagtttcatgccaatggtgtctttcctaaaggtgcgaattcctttttcatatcgctcattcctaaggttcagtactcacaaggactggagcaatataggcatatctttttggtgggatctaatgaggcgattgacgcagccaaaaggaagaagaaaaagtgtttgttctttaaagttgattatgagaaagcttacgattcgttcaattgggacttcctacgctacatgatgaagagattgggattcagtgaaaaatggataaaatggatttatggttgcttgcaaagtagtagaatctctgttcttaaagttaacttcaacaaaagcagctttggcactatcggggttgatgag

SEQ ID NO: 13820 - DNA, 230 bp, Glycine max
  Peptide Sequence Number=SeqID_130598
atggcagttttggagcctctttgccactggcaatctgccataccatgtttaatggcactgtccgccatttccgatatagtgcccgccattgatgttgtgttcatggcgtgtgtggtggctatggcagaagcaacagcagcgatgatcatgttggtggcaacaacaatagtcaaggcaacaattacagcagaagtgacaacaatggtgatgggtgtcgtggcgatcttgat

SEQ ID NO: 13821 - DNA, 852 bp, Glycine max
  Peptide Sequence Number=SeqID_130599
atggctgtggctgctgttgtgcacctttatgtcttcccagcagaaccttacaaaatgggagagagatgtattcgtaacgtagcagtgatggacgactatgcatcgctaggatcgcctctggaccctgaggaagttcaagacagtcagcgctcaacaagaacgtggctgggagcacataataatcagagagaaaaaaatcctatgaaatttacccagagtgttcgtgatgtggttgttggaagcggtgaaattattgttgatgacatgaagtttacagtttcacatgtggtggagcctgttgaaaggggcattgcaaagataaacaaaaccttccatcagatatcagaaaatgtgaaacgccacgagcagcggacgcgaaataccaaggatgattgttaccttgttcccttgcgaacgcaaatgtcagaattttctgacgttcacgatactatgggtgaaggaagtgtcagtgatagtggtatgtccagggtcccaaatatttcaaaaattttgtctgaggtccctgccgttagtccgaatccgttatctacttacgtggtcgttaattgggcacttagggcttcacacagtccagagaagagtacgacatccatgggagcttcttgttcatcatttgggtccgcttttgttcgttgttggtgcaacaaggcgacgattcaactaacatctcaaaccaagaagcatcctgacaagatattttggcgatgtgctaagtggaatgttctacaagttctttggaggttgtcaaaccctaatttcgtccgggaaccatccgttgttgggatgcgaccctcgtttgaccacttcgaggtatttggcaccaatcgttag

SEQ ID NO: 13822 - DNA, 1584 bp, Glycine max
  Peptide Sequence Number=SeqID_130600
atgtatgcattaaagcatgcatcccttcgacgattatgtcttttcttcttgaaagactggcagtttatttgttcagaacataaacagccaactattataaacaactggaaaggagggtttgatggcattgattcacattatacatcatttctaaatatcgagtgggaccaaatatctaatgttcttgaaaatttgaaggatagggacacatatcatggtgttggcttattaaacttcaatgacagtgagattgaccactggaagaagctgataccagaggcagagcatgtagtccttcacctgaactatgcttcaagtaatattacttggaatgtcctgtatccagaatggatagacgaagaagaagaatatgagttccctacctgtccaacactacctaggattcaggtaccaggaaagcctcggcttgatcttattgctgtcaagcttccctgcaacaagtcagggtgctggttgagagatgtagctcgtttgcacctgcagattgaagctgcaagactggctgcctcttccaaaggaaatcatcctgtgcatgtgcttttggtcactgattgcttcccaatccctaatctctttacttgcaaggaacttatacagcgtgaagggaatgcctggctttatgaacccaacctgaatactctgagagagaagctgcagctgccaattggttcatgtgaactggcagttcctttgaaagctaaagaaaggccacaccgacaagcttatgcaaccatcctgcactctgcacagatgtatgtttgtggagccattactgcagctcagagtattcgcatgtctggttcaacacgagatcttgtgattcttgttgatgaaactattagtgagtatcatagagggggcttggaggctgctggatggaagatccatacaatccaaagaatcaggaatccaaaagcagaaccagaggcatataacgagtggaactacagcaaattccgtctctggcagctaacagattatgataaaatcattttcattgatgctgaccttcttatactcagaaatatcgatttcctttttgagatgtccgaaatatccgccataggaaacaatgctacgctgttcaactcaggtgttatggtggttgaaccatcaaattgtacgtttcaacttcttatggatcacatcaacgagattgtctcctacaatggtggggaccaggggtatctgaatgaaatctttacatggtggcatcggattccaaaacacatgaatttcttgaagcacttctgggaaggtgatgaggaagagagaaaagcaatgaaaactcgtctctttggagctgatccaccaatcctttatgtcatccattacctgggtaataagccatggctttgcttccgagactacgactgcaactggaacgtggacatactgcaggagtttgcaagtaatgtggctcacgcaagatggtggaaggtgcatgatgcaatgccagaaaagttgcaaaatttctgtttgcttaggtccaagcagaaggctgcattagagtgggatcgtagacaagctgaaaagggaaactacagtgatggtgatacctag

SEQ ID NO: 13823 - DNA, 507 bp, Glycine max
  Peptide Sequence Number=SeqID_130601
atgtggcaccaaaacttaggtctggattccacgggaactgtgagttttacagtcttcagtgcaagtatatttgtgcttgttgctcttgttctctccatgtatttagtattcgagcatttagccgcctataatcaacctgaggaacagaagtttttgattggtctcattttaatggttcctgtttatgcattggaatcgtttttgtcagtattgaattctgatgcagcatttaacagtgaaattatccgagaatgctatgaagcttttgcattatactgctttgagagatatttgatagcttgcttaggtggtgaggagaaaacaattcaatttatggaaagcatgagccgaacagaatccattattcctcttctgaaagaagcatatgcatatggagttgtagagcatccatttcccttaaatctcttcttggaggattggaatctaggccctgagttctatcaatctgtgaaaattggcattgtacaatatgtatgtatgatttaa

SEQ ID NO: 13824 - DNA, 264 bp, Glycine max
  Peptide Sequence Number=SeqID_130602
atggacaagtttgatggccttcagacttttgttggtgacaagtttgatgccatggaattgcaagtcgacatgcggttcgatgccatggaatcaaggatcaccaaagttgaagaagatgtctccttcatccggattgtcatcataaaagggggagattgtagacaaagaatcaagccgcgccgatgttttgatgatgccaaaagatcacatgcgtctcaaagatttattcaagacaaagcaatgaaagatatacaagataaatga

SEQ ID NO: 13825 - DNA, 210 bp, Glycine max
  Peptide Sequence Number=SeqID_130603
atgtatgttagaataccccacacatgctggtcgtctaggtcatgcttgggacttgatgtctacatacaagaatacagaccctacatagttgacttctacgtttggtggacccaacccacaccgtcttactactgctttatcatgctcgtgctaaaggtttttatttctttcgagttgcattcaccgtctgtggatgatgagatgtcctag

SEQ ID NO: 13826 - DNA, 339 bp, Glycine max
  Peptide Sequence Number=SeqID_130604
atggtgacttgttgggtggttgaatcccgacaaagggaattcaggtggattgaggtgaatccttacaaggtttgggcaattcttaaaattccaccttcttccactgaaaaggaagttcgaggaaggatttctcactggcaagttctcttattggagtatgacattgagtatttgactcaaaaagcagtcaaagggcatgggattggagccatattaatctccctcgagaaacaatatactctgtccacgacaaggttatgctttgattgtgcaaataatgtggcagagtatgaagcatgcgccttggggttacaagcagttgtagaatctaaagggtga

SEQ ID NO: 13827 - DNA, 1299 bp, Glycine max
  Peptide Sequence Number=SeqID_130605
atggcattagaggtcacggcagcttgcccaggcaatctgttgcttcatcctgaagtaactttgctcgcccaggcgagctgggctcaaccacaaaataataaccttgctcctcaaggaaattctttgaactatcaagccacttcaaacacccatcaagtggcaggggggtttcaaccaacaccttctagtgagcaggttcattccaaagaaaaattgcaaatgttggaagagaggctaagggctattgaaggttgtagttatgacattagagatgctactgatctctacttggttccaagatggctaaactttaaggaggataaccttaatatcaggagtaatcctttactaggtcatggaggtgtggaagcaatgccttccaagggtaaatccacttggttattcaaagagaacaagggagggtacatcccttgtggatctttggcttgtaaaggattttccaaggttgaaagaaatctcaagaaccgcaggttgcttggggactggatggtggaagatgtgaaaaccctattgaagaccatttttagagatatgcacaaattcggaatgattaagggaagctttgaagaagatatggggagtggattacaccctagtgcaaatcatataatagaggaatgtgatgaatttaagagtattttgcaagacttaatggataagaaattgttacaggtaggatactttgtaaatgatgtattgacaattgattcatcaatgacttttctgaagcccttggttattcattacactatatgtgctacttacttgactcctagtgggccaaagtctttcactatacaagtaccaaaggatttctcttataaagataacaaggcagtaccgtggaagtatgacatagaagtttgtgtgaaaggaggtgatgtaaaccagtcaaagaatacaagggaagaagctcctgatgttacaaacattgcaggaattggtggtatgactcaaagtggtcgaatatacacaccaaacaagctaatggttaaacaaaggaaatatgaggagagactaaaaccagtgatgattgagccagaagtgaatggttccttgttgaatgtgatgccaaggatgacacttggcaagctatcatttggtgaatcgcacatgaagctaagtgctatggtggttagagcttttgatgggtcgctcagaaaggtaattgaggaaataagtctacctattcagattggccctgctacttttgaggctactgtggagattgaggatgatttgagactttctcccaagttattgaggttaatggagtag

SEQ ID NO: 13828 - DNA, 318 bp, Glycine max
  Peptide Sequence Number=SeqID_130606
atgaatggagtagttgaagcaacaaacaagaatatcaagaagataattcaaaagatggtggtgacttataaagattgtcatgaaatgcttccatttgtattgcatggatatcgtacctcaattcaaacttcaactagggcaactctattctccttggtatatgggatggaagcagtcctgccaattaaggtcaaaatcccttccttaaaagtgctaatggaaaccgagctagaacaaggagagtgggttcaaactcattttgagcaattaaatctcattgaagaaaagagattaaatgcaattttccatggtcattga

SEQ ID NO: 13829 - DNA, 402 bp, Glycine max
  Peptide Sequence Number=SeqID_130607
atggtcaagaaagaattttcaggaggatctttgattctcatgaacatggatggcaaagatctctatatgtggatgacatccacaaaactggtttgtacttctttgacagtgtccattcatctcactaaactcaatgctacttatgcaagggaatacatgtcttgtgttccttatgcaggtgttgtaggtagtcttgtgtatgcaatggtgtgcataaaaccagacctagcacaggcaatcaacattatgaataggcatatgggtaatcttgggaaggaacattggcaagctctgaaacgtatattcaagtaccttaagggcaacactttagcccataatgctttatccactacagaggcagagtatatggctctggtagaagtagcaaaggaagggatctaa

SEQ ID NO: 13830 - DNA, 222 bp, Glycine max
  Peptide Sequence Number=SeqID_130608
gtctctggctttgatgaggaggctattgcccagctgttaggcatatcgggccaggatttcgctcggaccaccgcagggagacgggtgagtgtgcacgtggctcagctgatttctgacgccatttatcagtttgcaggtgttacacccacgagacaccctgtggactcagagaagtccaacagggccctggggtttcccgctctgatcacgggcctttgctag

SEQ ID NO: 13831 - DNA, 228 bp, Glycine max
  Peptide Sequence Number=SeqID_130609
atgtcacccgacttcatgggtcaggatgacaaaggcgctgaagacgatgtaagtctccgcatgtcaacggcaatcgtttgtgcggataacagcttgggtatcttcgcatgtcacccgacttcacgggtcaggatgacacaaaccgtttatacggataaccgcttgggtatctcgacatgtcacccgacttcatgggtcaggatgacaaaggtgctgaagacgatgtaa

SEQ ID NO: 13832 - DNA, 177 bp, Glycine max
  Peptide Sequence Number=SeqID_130610
atgccccaaccacatgggatcaacatgggcttaaaggagcactcaaacagagtatctttacccccaaggcctagacttcgaagaatccatttgggcctcaccttcctgattcagccaattcaattatccaacaatccctacacatatgaatttcatgacgagaaatcacccacgtga

SEQ ID NO: 13833 - DNA, 135 bp, Glycine max
  Peptide Sequence Number=SeqID_130611
atgcaattcgtccatgtccatcagaaaaacaagtatcaatacatcagtaaaagtgaggatcataacaacgtgaatacaaaatatgttcctgacgaggctgggtttgctgggttaaagatctcatcagcacaatga

SEQ ID NO: 13834 - DNA, 180 bp, Glycine max
  Peptide Sequence Number=SeqID_130612
atgcagattgttgaaccattcacagcacactatgtttttgctcttggagttgcaaggttcttgagttgtgcacattgggtcctccaggtattagatactcgtggacgtctactgactgcattgggttatggattgtggccttctatgatttttgctactactacgtcaagaggtggataa

SEQ ID NO: 13835 - DNA, 244 bp, Glycine max
  Peptide Sequence Number=SeqID_130613
ggaaaaagagggaggtggttgtcgcccagctcgcccaggcgagctgagttgcttccaccagaaggcactgccttttgttggaaccccctggaaggcccaaattgcacaacaatgcttcctttcgacttccggcatgtcgcggaacttcacggattgcctaacgatgggtgttaagtacctcgaagcgatcaagcgaaggttgcatgccaccaagcagtggtccccagacaaaattagggtatga

SEQ ID NO: 13836 - DNA, 291 bp, Glycine max
  Peptide Sequence Number=SeqID_130614
ggctacgtgggagtacgtgagctcagttgaaggtgggcaacaggggatggtgggtttatatgtgatttgtggatgtggagaattgttttgcaccatcgcccgaccgccacctagtaccacatgtgatggagtggtacctagagatatgtcgcaggggtcaagagaccttggggacatcaggcgagctcctggcagtcaacagataataggaacaaagaccacaaagcaaggaggcttgtgtggtggctggccagctgtgaactttgagtgttatatgggatatggcctctg

SEQ ID NO: 13837 - DNA, 210 bp, Glycine max
  Peptide Sequence Number=SeqID_130615
atgagggtggaagagctgcaagggatacctgaatatctaggcataggatgctctaatcacatgactgaccataaaaagaggtttgtgaatcttgatgaaaaggtgaagagcaagatcaaatttgttgacaatagtattgtgtctgcagaaggaactgacaaggtgatgatccaagaagatatggacaacaatccttcatcaatgatgtga

SEQ ID NO: 13838 - DNA, 363 bp, Glycine max
  Peptide Sequence Number=SeqID_130616
atggccagaagcatgatgaaaggaaaggaaatgtctcgttacttttggggggaatcacaccttggagaagcttggtctaggaacaagcctcgtgcgagtcattttaaaatatttggctccttgtgcttcaaacatgtgcctaaacaaactagaaggaaaccaagtgatcatgttgaacaaatgatgcttcttggatatcatccaacatgtgcttacaagttgtatgatccaagaatgaaaaaggttgtcatcagtagagatgttacaatggatgaaacaaggtgttggaattgggaaacaagtgattccaggagcattgagaagattgtgagtgtgaaccttgaagatgatcaaagtatataa

SEQ ID NO: 13839 - DNA, 300 bp, Glycine max
  Peptide Sequence Number=SeqID_130617
atgatttgggaaggcaaggttcagaccccttttgcagttgtgcagagagctaaaaatggctttggagagtggaaaaccctcgttcttcatttgcaaccgcctaacagagtgctgtttttggtcccaaagaggctgaagctttggccctttttcattgcctggctgaatgagcttggtcttcagggagtgcatatcagtgttaaaggtccttattctgctcagtctcaccctgccacaattcttagaacttgcaaatgcaggattaatttttacccaaactctagggaagactatggttga

SEQ ID NO: 13840 - DNA, 1191 bp, Glycine max
  Peptide Sequence Number=SeqID_130618
atgaagaaaaaatatcaaggctcctcacaagtgaaacgtgctcaccttcaagcgttgagaagagactttgtagtccttcaaatgaaagaaggtgagtcagtaactgattattgttcaagaaccacgggtattgctaacaacatgcaatttcatggtgaggaaatgactgacgcatccattgtagaaaaaattctatgctcattaacaccaaaatttgattatgttgtatgctcaattgaagagtcaaatgatattgatgatctttctcttgatgagcttcaaagttctttattagtgcatgaacaaaagatgaatagaagatcaacaatggaggagcatgcattgaaggcttctaccaatactcattccaacatctctagaggaaggggtagaggaagagggtgtggagatcgaggaaatagagatttcaacaataattctaaagacaataatgatcaatctcaaggcaatgatagaggaagagatcatgataaatcaaaggaaaaaggggaaagttcaaattttatcaaggagaaacaagtggaaaccatattgatggctgttgaagatgcaaaagacagtgaggcagaaatccgatatgtagacacaggtcgtagtaatcacataagtggaaaaacaatttctaatgtgctctatgtccttgacttgaaaagcaacttgttaagtgctggtcaattgcaagaaaaaggttatggaatttttattagcaaaggtacttgtgaaatttttgatcctgttcgaggtgccattgcaattataaaaatgaattcaaataggttattcccactaaaaattgaaagcattcattctagtttaatggttaaatatactgtttctacttggttgtggcattatcgttatggtcatttgagttttagtggattgaagacccttgaacaaaaaaacatggtgatagaccttccacaaattattactccttctcaggtttgtgaagaatatgttgttagcaaacaacatcgttctcagttccctaatggaaagtcatggagagcaaaatgtgttttggaattgattcattcaaatatatgtggtctaataaatccttctttcaatggagaccgtggtgaagagtattgctcagatgaattttctactttctgtgtaaatcatggaatccggaaggagttgacatggtacggtgcctcttga

SEQ ID NO: 13841 - DNA, 414 bp, Glycine max
  Peptide Sequence Number=SeqID_130619
atgatgaaacaggggagtgggtcgtgtacgatgagggagaacgaggttgctgaaatcctcgttaacctcccaagtcttatatgggaattcgagtgtggctgtggaatcctacaaccttcgtggggttgcaagagaaagagatctgcgattggcgttgatccaaaagcacggcaagcttcaagtcctgccacccctctctccttctctcccagtgagtccgatgaaaacccctccacactcataagaacaagaacaagaaacgtttctctcaaaaggaagagagaacactatgtcaagattctacaagatttgaccaaacataacgatttgatccgtggggagataaagaatgtgaagcgtcacaatgaaaaactgaaggagtacaatttgaagttgaaagcaagaaaacaagag

SEQ ID NO: 13842 - DNA, 405 bp, Glycine max
  Peptide Sequence Number=SeqID_130620
atggcggggaaaaaaggagcttttgttggctcaattgagtcccctcctttccccaggttgcaatatctagagttttcatccaggttgatggaatcggggttgcttcctaaagatgtggcaaagaaagtatatgagaagaagaagaaagttccacagaagctcacttctccagttaagtcagtagctgctgtgaagagcaacactaagtctgtcactgttaagaagaaaagcccagcatcccctgtgtcttctgttaaaaagaagacaacaacaacgaactccacatcaaagcagtccaagaagaggaaggttaaggatctaagctctgaggatgacgatgacaccaactcctccgatgatgaatttatattatcatcagtagcaaagaggagaaaaatggcttaa

SEQ ID NO: 13843 - DNA, 319 bp, Glycine max
  Peptide Sequence Number=SeqID_130621
tttgccactaaaagaacatcttgatgagttaaactctgttctagtggagctccgtgacattgatgtcaagatagaagatgaagatctgacaatgattctgttagcctttctccttccttcctctaagaattttgtgagttcttttagtgtaggtaaagaatctattacacttgaagaagtcaagtccaatctttattctagagagcttcgattggaagtgtctaggaatggtgatgaagtctctgcgtctagattatcggtgactgattctgccaaggggcagaagaataagaaggcaaagaaagattttgttgctact

SEQ ID NO: 13844 - DNA, 306 bp, Glycine max
  Peptide Sequence Number=SeqID_130622
atgaggaaaagccttcagaaatatgtgatcctcttggacatctgggggtttcatggtgtagcagacaatatgaaattccttcaaatttttctggtgaaggggaaactgccaggaagccacattataaacgaaacctcaaagagagttgggcttcgtcctcaaaaggaaacaacaccagaaaatctagccttccatagattcaaacagaaagcgcaaatgaaactaaaagcagaaacacaaatgaaagtagaagaagaaacaagaacgaaattgttattagaagcagaaaatggaaaattgcattaa

SEQ ID NO: 13845 - DNA, 834 bp, Glycine max
  Peptide Sequence Number=SeqID_130623
atgaagattatgatctctattccactaatgaattgtgatttatccggaggagagcatcaccaggacagttgttatttttactctataaataactttgaccagagaaaggaactggccatgtacgactaccatgagaaagaaagaaccccagttcttgaaagtatattggcagacttcatgacataccaagctagctctaaagattatcaaagggagtcacaatggcaacctgatcatcacaatgaagcagaaggatttcttaatctggatgatctattaatgcaattcagggatttggtagagtcaatgcaacaagcctttagaaggactgaaactcagattagtaagttggtagataacatgactaacgtggtggccagaaaagaggaagagcgtgcagagattgaaatgcatcaagaaagcattcttcaagttacctcaatccatcatcaattgaccaatgaagaagaaaagcatgaattctccagcaccctggaatatccctgcttggccactatcggctatgttggagggaaagataaaggtagattggaactcagtgtggaggataaaaaaatctcttttgacctctttgaagccatgaaacacttagatataggtgatgcctattttgaggaagaagaggtggagcaggaaatagcattatcagcttcaaccatggtactacagtcccctttggaaagagaacctagttatgggatagattgcttagtttgtgatgaagagcttgatgatccaaaagacaattgtgttgatcatgtggtttttgaagaattggaaaaaatgagaccaacagaaaagcccaaagcataa

SEQ ID NO: 13846 - DNA, 660 bp, Glycine max
  Peptide Sequence Number=SeqID_130624
gaaacaacacgctttatggtgcccttacggaacgcatgccagagctagagtaaggagtgaaatagaggaggtgcaagagcagatgaaggttgacatggaggccatgaaagagaaaatgaccacaatgatggaagccatgatgagtatgagaaggatgatggaggtaaatgcggctacagttgttgccacaagtaccaccatagaagtggacccgactcacccacccggcttcaatgaaaacaagcattccttcccaccatatcgcttgcctcccaactatacaccacccaatgttgcacacactctagatgagaatgtcgacaactccgcacccatacccattaagagccaacaaccccaatctgatcatgcatatgtctctcaacccatgggggagacacatgaagcaccccaagaccacaatctagctgacttaaaacctcacctcagatatgccactgaggggcaagcagttggtggtgtacccctgccaaacactttggggggtcctcagtttcgcccacaaccacaacccttacattttgcggtggaaaaactccttcctagtatggtggaatgggagaaatttgatcatatagaggaaagactgagggctattgaaggaggtagagattatgcctttgctgacatgggaaagtt

SEQ ID NO: 13847 - DNA, 195 bp, Glycine max
  Peptide Sequence Number=SeqID_130625
atgacccttcgctcagcgctaatgcacagctcatccttcttccagattattcctcgcgctcagccgaggagtgttgtgctcagcggttggctcgctaagcttagcacacgactggcgccaagcccaaatgcacttactcgcgctaagtgcaagggtggcgctaagcacaatgtcacgatttcagaacctatttaa

SEQ ID NO: 13848 - DNA, 873 bp, Glycine max
  Peptide Sequence Number=SeqID_130626
atggcacaatcgctggtggcgggcgtatatgacaaggtggtagaccgtgaatccgcttatgagattctcaagcagcgtgccgagcaggcggcagcggcctctcaagcacccgcgcaaaaagagcaggaggggtcaggattcgatttaggcggcgttttaagcggtaaaagcagccgttcagattctgtgctggaatctgcagccaagtctgcggcacgcgccatcggttcgcaattgggccgcgccattatccgagccgcgacgctacagccgattatggatgttgcgatgaaagtgggcctgtcgtcgcaagatctgcatctctgtggtcaacatatggccaaattgacgcaagcgaccgtaaaccgcttgcaagcccagccggcaaaagccaagctaatcctggtgacggcgattaatccgacgcctgcaggtgaaggtaaaaccaccacaacggtaggcctcacggatgccttgaatcaggccggttaccatgcgctggcctgtttgcgtgagccttcgttggggcctgtgtttggcatgaagggtggggcgaccggcggcggttatgcgcaggtggtgcccatggagaacatcaacctgcattttacgggtgacttccatgccatcagtgccgccaataacttgctggcagccctcattgataaccacatttaccatggtaatgcgcttggttttgatcaagtgagttggcgccgttgcatggatatgaatgaccgcgccttgcgccggattacgctggaaaatgaagtgcataccggctttgatattacggtggccagcgaggtcatggcgattttctgtctggcgaccgatttgacagatttaacacgcaggctgggacgtatccag

SEQ ID NO: 13849 - DNA, 756 bp, Glycine max
  Peptide Sequence Number=SeqID_130627
atggtcattcccaagttcaaggtgccggactttgacaagtacaaggggactacttgccctaagaaccatctaaagatgtgttgtcagaagatgggggtatacgcaaaggatgagaaactgctgatacatttttccaaagaaagtcttactgggacaactgctacttggtacactaacttggaaccttcccgagtccattcttggaaggacctaatgattgccttcgttaggcagtatcagtccaattctgatatggctccggataggatgcaactacaaaaaggggcacaaatctttcaaagaatacgcccaaaggtggagagacccggcagcccaagtggcacccccaataatggaaagagagatgataaccatgatagtagacacataacagtgttctactatgaaaaatggatcaaagtgggtctgaaaagaggcaaatttaatcatcctgcttgcatgaatgagaaaactggggcaaatgaagagggtgaggatgagggagaaacccatgttgtgactgccattcctatacggccaagtttcccaccaaccagacaatgtcattacttagctaataacaacccttctccttacctaccacccagttatccacaaaggtcatccctaaatcaaccacaaaacccaccttccacacaaccaatgctaaacaccacccttagcgaaaaccaaaaaggaatttttcagcaaaaaaagcctataggattcaccccaaattccggtgtcctatgctaa

SEQ ID NO: 13850 - DNA, 417 bp, Glycine max
  Peptide Sequence Number=SeqID_130628
atgacgagcgaggcctccaccgcgtccagtcccgtcctcagagcttaccataagcaatgggctctagattaccctggttatgtgcagatcgaatacaacaaagagtggcacgtcataaagcttagaaaaaatggtcaccactgcataggcaatcatgtggaaggcctcccacaaccattcttgcctaccgctgctctcgattttgttgatgcttcaacacgatgtatgacaatgcaacataggattggcgttcgtggcatatggagcatctccatgcataatgctatacaatatgtggatgacccttggcacggattcttaatggagaatcacttgatgggtggagatgaggtcgtgttttattaccggcctaaccaacatgtgtgggagatcatcttgaggaaggagcccgtatag

SEQ ID NO: 13851 - DNA, 1515 bp, Glycine max
  Peptide Sequence Number=SeqID_130629
atggaaaacatggacaagcataatagaagaagaccggatgcaatcgaaaacactaactatacaatgttgaaggccatctgcaacttcgtaaagcaagaccagactgagtcaaccaaagatggtatggacgatgtcaaaatgagtgcaactcagaatacttctctgaatgatgaaacactacattgtctaaaccctaagaagccgctgtcgaccccgactttaaggtcaatgaaaaaggaagcatatgcaaaatccaaggcaaatttgacgaatattgaaacaatattcataccagcggatgacgatgatgaattttcgaagccattgccactgggaatcaaggggaaattcctaggtcaggaaaataaaacgacctactcgtctccgaaaacaatcaacatttcaggactgcacgacgtcaacacgacagatgactcctccccacaagaaccattcatgaacaactacgttactggactcacagcaaaggtgaaacatttattaacctgtattgcgaaacacttacatactaaatattgtttgggactattttctgacgtgcatgtaatccaaggcaaaaacaacaaagagaccttaatggcgcctaggaagttgactttcccccaagaaagttgtcgaacttcaaagaagccaaaaattgaccaactttcacaaacttcgaatgctcaaaaaatccaatacagtaaaggcagttcatttggaaagatggacaccaagaaggcaagccagatctttcataggcctcggaccaataccactaggggatacacacatacaattcctaaggacatgccctgctgcttcaagccaactgtcgacatgaatcttatttttgaggagacacaggtttgtgcatatgtcttcaaccctaatgtggacccgaggaacaaaatcttgtatagggtaggaaacaacttgggcacacaacaaaactttcagtcgttgtgtcccaataagccagtaagggaggaggttgcttacagccaactctaccgtacaaggagtgtttggtgtatgccaccagcatttgcgatatacatacccattgttcaaaattcggatcattggtatctgatggtgatagacatgcatgagaaaaaacattttcatctcgattgtgacctcacaagtgaaaccgcatatgatcggaaagatactattaaaatcatgaccaatgtgatgctcagtgttctggaaattgtgtttgcaacacaagatttggttattggatttcatcaaatggattgttgggatattgtggaagctagaggaattcctaattgtggctccagtgaaaaatcagcattatgggtcctagaatggatgcaaatggaggagtcatttgtcagtctcctgtatggagtgatagaagaaaaggccgtcagaataaaggtggcaatgatcttgcttttagggacacacaaccagtgcaagggagacttgattagaaatgcaaagcgcacttggcatgactgtatccatgccaaacactga

SEQ ID NO: 13852 - DNA, 498 bp, Glycine max
  Peptide Sequence Number=SeqID_130630
atgtctcttgctactttgtttggaaagttacaggaacatgaaatggaattgatgagattgaatcaacatgagaagaatgataaggaaaagaaaggaattgctcttaaagcttcatcttcaactcaagaaggaagtgataaggaggattcgattgaaatagatgaagatgatgatcttagtctatttgtaaaaagattcaacaaatttctaagagtcagagtaaatcaaagaagatcaaattttaaatcaaagaaaagggcagaagattcatcctctactctaaagtgttatgaatgcaatcaacctggacatcagagggttgattgcccaattttcaagaaaagaatagagaaatctaaaaagaaagtctttaatgaaaagaagagtaagaaggcctacattacatgggatgacaatgatagggactcatctaaagattcagaaaatgaagttataaacctgagtctgatggccaagaattatgaaagcaagggagag

SEQ ID NO: 13853 - DNA, 300 bp, Glycine max
  Peptide Sequence Number=SeqID_130631
atgacattgctacttagcaacattctgcccagcgaccgcaatgccaatctccccctgcaaaagtatcagttggtctgtgtcgtcccgacatggggatcgcacccacaaagacacccagtggacctgaagaagtccaacagggccctggggtttccagctctggttacgggcattggtcggccatacagggcgcccgttccccccagcaagttcatgtcgtcgtggcatagggcttgcgcccgcaagacacctagtggacccgaagaaggccaacagggtcttggagttgtcaagctctaa

SEQ ID NO: 13854 - DNA, 306 bp, Glycine max
  Peptide Sequence Number=SeqID_130632
atgcctaatataccctcgatttatccgcttcagataggatggaacaacgttctatatcagactaagacaacatcaccacaaatcaatgcttggtgcaccgggaccactggtaaccataacaacctattccaagatccttatacaaattgttgcttatatatgacaatgtttttttctgccctgcaaggacttccaaattgtgccatgccacatgttaatgcctgcggtcaccacatgaccatcctcagaagacttggacctccattacagtggaatgttgtggtccttcacaatggaatgaactag

SEQ ID NO: 13855 - DNA, 315 bp, Glycine max
  Peptide Sequence Number=SeqID_130633
gacagagagcttaggggaagcagtaatgggatcatcggcggctatcataagtggctgagagtccgaacacaaggattggattggctcccaaatctaaagactgtgagagacgatgaggttaaagcttcggaagaaagtgatgcggtacaagccctaaagacagagcttgaaagagcccgggtagtcgaagagaagttcaagtccatagccatcaaagaatcatcacgggtcaaaggcatgatctccgaagaggtgaaaggaatcatcacaggtcaaaggcatgatcttgaaggacgagctaaaggtttgccttag

SEQ ID NO: 13856 - DNA, 444 bp, Glycine max
  Peptide Sequence Number=SeqID_130634
ggtggacccttgggtactagtaccctcacctttagagggctgcacgccctcgccttcagagggctagacgtcctcgccttcatagggctacacgccctcacctttagaggactacacatcctcaccttgatagggctacatgccctcacctttagaggactagacttcctcgccttcagaggactaaacgttctcgccttcagaggactagatgtcctcgccttcagagggctacacactctcacctttagagggctgcacgccctcaccttcagaggactagacgtcctcaccttaagagggctacacgccttcgctttcagagtacttcacgccttcgctttcaaagtactacacgtcctcgccttcagagggttacacgttctcgctttcagagggctccacatctacactttaagagaatttaaggtcctctgcccttaa

SEQ ID NO: 13857 - DNA, 141 bp, Glycine max
  Peptide Sequence Number=SeqID_130635
atggatatctcagagccctacactaaggcaatgagaggcaccttgcatgagcctcaagcgaacctaggggcagatcaaaagttctcgcccggaaccaccgctaaaccagcaggaagaacaatgcaaacaacacatgcatga

SEQ ID NO: 13858 - DNA, 303 bp, Glycine max
  Peptide Sequence Number=SeqID_130636
atgagaaatgaaagcacaaagatagaattcttagaaccaaaaatgagattaagatcatttcgcattttgtttctaaagaacatcagaggaaacattggattcattcaaatagaggaaaacctctcaaaggtgtataaatctcacacaggcaagttgtcgcaacctacccttcggtgggagggcgacgtgaggctcacgggtgcgtcttccaagaaaggaatatgcgcagagtcgccaccaacgtttattttgaggaaaacgtcggaaaaaccggaaaagacgtggtctacaaactttaggtga

SEQ ID NO: 13859 - DNA, 319 bp, Glycine max
  Peptide Sequence Number=SeqID_130637
atgaaggcccagagacagagacactttctatttctattaattgttgctgaaggctcggggtggggtgggggaggtaatccttgtggcgtctaccctgacttatcttccttcactggaagtggcgtcaaccctgacttatcttccttcactggaagtggcgtctacccggacttatcttccttcaccggaagtggcgtctaccctggcttatcttgcttcactggaagtggcgtcgtccaaaaactctacagcctgtatcaaacgatctgccccgaaagattcacatcatctggtatcagagctttggctcttgatgcag

SEQ ID NO: 13860 - DNA, 630 bp, Glycine max
  Peptide Sequence Number=SeqID_130638
atgcgtagtgattgcttagtgcaattctccattctcaaccccttttcggagcccatgaattgcgttttcgttcatgtgtcctccaccttcgagtttggagctatgcgtagtgattgcttaatgcaattctccattctcaacctttttcggagccccatgaattgtgttttcattcatgtgacctccaccttcaagtttggagctatgcgtagtgattgcttagtgcaattctccattctaaacctttttcggagccccatgaattgcgttttcattcatgtgtcctccaccttcgagtttggagctatgcgtagtgattgcttagtgcaattctccattctcaacctttttcggagccccatgaattgcgttttcgttcatgtgtcctccaccttcgagtttggatgcatgcgtagtgattgcttagtgcaattctccattctcaacctttttcggagccccatgaattgcgttttcgttcaagtgtcccccaccttcgagtttggagccatgcgtagtgattgcttaatgcaattctccattctcaatctttttccgagccccatgaaatgggttttcgttcatgtgttctccaccttcgagtttggagctatgcatagtgaatgccta

SEQ ID NO: 13861 - DNA, 610 bp, Glycine max
  Peptide Sequence Number=SeqID_130639
atgggtgaagtagaagaggtacaagagcggatgaaggccgacatggaggccatgaaagagcaaatggacacaatgatggaggccatgatgagcatgaagaagataatggaagtctatgcggctgtagtttccgctaccagcaccgttgctgtggtggaccggaatcccctatctggcctcaaccaaataaatcctctagccttggatatgatagctcaaggaggcaaagagttaggaagtacgggtggcccccattttgtgccaattcagaacaagcatgtcttcccgccatatggcttgcctcccaactatacaccacccaatgtggcgcacactcccgatgagaatgaaaggcttagggccattaaaggaggcaaagatcatgcttttgctaacctagaagagttgttcctagcacccaatgtcgtcttccctcccaagttcaaggtcccagactttgacaagtacaaagggactacttgtcccaagaaccatttgatggaaacttacttgagaagaggtgagcagaggcgccatccactagggaataagccatggaagaaggagcttcgccaccaagagaatgccttggataagaagcttggagaag

SEQ ID NO: 13862 - DNA, 369 bp, Glycine max
  Peptide Sequence Number=SeqID_130640
atggtggagcatggtcatggaatgtattacacgccagcaacattttctcagtatccttcacagatgtatcggtatccttttgaaggtcatcacactgatacttctgcaagcgaacattcgttcggtggtgttgcagaaatacatcctcatttttcatggccgactatgactcattcacagcaacacgatgccccaattgcaacacctaacgccccattaggtatgcaatggaatgtacctggagcaataccttatatgggtgacttattaggtgttgatttgcgtcaccgattttctgttgaggtggacgaagtagaagcggggagacatcggggtagaagaaatccgaatcatcaagcgcgaagatga

SEQ ID NO: 13863 - DNA, 270 bp, Glycine max
  Peptide Sequence Number=SeqID_130641
atggcacatcaacgatctcttggggtggtcgacaaaagcggagcttttgctcctacttatcctcaattgcgatgtggaaatcagacctacgtaattcttgcaaaagtggtaaatgtgaccgatcggttagattttgctataacagtgattaaacgagattacaatgcaaatgatcggttgaaattcattttatcacttattaggcgagataacgacttaaacgatcggttaaagctcgttaaaaacggaagaaaagaaaaccgaaagtga

SEQ ID NO: 13864 - DNA, 333 bp, Glycine max
  Peptide Sequence Number=SeqID_130642
atggccaaaatacatcatcaagcatggtcaacaaaaacatatcatccaatgaagcataccccccacacttattcccaaaacaattccaaagctccaaaattccttaagggtagggggaacataggctcaaaggggctatcaagggaattaattcaaggtaggcttatttggctagaggcttataagaacaaaatgcctaaatcatctcccaacatgcatgtgaagcaagaagtatcaacaagagtcaagccaaggctattgtgcaagcaatcaatgaggcaaaacacaccgaataaaatagatgatgatggctcaaattctcaccaagggtaa

SEQ ID NO: 13865 - DNA, 111 bp, Glycine max
  Peptide Sequence Number=SeqID_130643
atgggagcactttacgtccccccgctcgccttcagctcacctggtcctttacttgaccaagggaaaatcccgaagaaatgtgccgagcagaatagcagcatcatgctttaa

SEQ ID NO: 13866 - DNA, 304 bp, Glycine max
  Peptide Sequence Number=SeqID_130644
ggagatgtcaccacacgttatgcaggatggtggaagcagtcaatactgtatcatcatcgtgattttgcaaagaatattactcggtgaaagagcagtctatgcaatgatgctggtgtttccacctgaattttctcctttgaaaactattttatttggaaatccttcccaagacaccgttgaaccacttatggaggctttggtggaagattataaagatgaaaatgagataaatgaatcaaggcagtttattggaggagtattggatcttgaaaagagaataaatagactagatacattgacttag

SEQ ID NO: 13867 - DNA, 548 bp, Glycine max
  Peptide Sequence Number=SeqID_130645
gagatggcttcgaggaagctttccgcaaagagatctaggagtggacgccacggccgaaggaaccagtgccgctcccgagtttgacaaccatcatttcaggagcgccgagcacctgcagcgtttcgaggccatcaaaggatggtcgttccaccgagagagacgcgtcccgctaaggataggcgtgcgggacatgcggtcatgggtaaggggccagtggattccttttgatgcagacgccctcagccagttcctgggccattgcccaactgttatgcataccgggtcaggattttgcccggaccgctgccgggaggcgggtgcggatcatgcgcaccagcatgaccaccttgacccagatgtggatgacgttgctgctcagcaatgcacccctctagacccagataagtctaacagggccctggggtttccagcattaatcacgggtctctgccagtcattcggggttcccatcacacctagtaaggttattcgaccgccgatcacccgggccttcattgagaagtattgcacgcctagacaggcgcagg

SEQ ID NO: 13868 - DNA, 552 bp, Glycine max
  Peptide Sequence Number=SeqID_130646
atggaaacctgccccgcggtggaagagctacttcaacggctcatggactgggggcagctcgaagtgtccgagagagatagggaagaaccgcaaatttgcacgcagtcggtagaaaggaaggctcccccaacccccaaagccatagtaatatgtttcactaggaatatgaccggccccaggtccgagtaccccccgacagtgcccaagccgacgccattttcctatcaaagcaataaggccgtcccatggaaatatacccctcccgcttttggagaaggggctgcaaccgaggttgactccttgtcagccaaggtgaccaacattaccggccttagtggcgtaacccgcagtggccgggtgttcgctcccccccgctcggcagaattgccctccaaggggaaagcacccatgacccaagagtccgcgggcgtgaccaccccctcaaaagaagtggatcccccggtagtaaagggagctgaaaagaaggaaggtctccaaggaaaggcggcgaccttggaagaggcttatgagttccttcgtctcatcaacaaa

SEQ ID NO: 13869 - DNA, 211 bp, Glycine max
  Peptide Sequence Number=SeqID_130647
gggttgctcgcccaggcaagctaacctgccatttttcttttacgccgtcatgagtatggccctctacaggccggcgttctcttactcgaacccactcaaggatactaggcggccttgcagcggcattttccgcttgtccagagtcgggaagggacgacgatttgtcggtcgtgaccctagcctttatttgcatccgtccctaagtacctga

SEQ ID NO: 13870 - DNA, 587 bp, Glycine max
  misc_feature (515)..(515): n is a, c, g, or t
  Peptide Sequence Number=SeqID_130648
ggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggtccgaaccgactgatgttgaagaatcagcggatgagtngtggttaggggtgaaatgccactcgaacccagagctagctggttctccccgaaatgccgttgaggcgcagca

SEQ ID NO: 13871 - DNA, 624 bp, Glycine max
  Peptide Sequence Number=SeqID_130649
atgagaggccctctcaaagagtcaacctcttgctttcttgtaagggtaaagtcctttggtgcttgtacctattggctcgccttcagaggactgcatgtcctcaccttcagagggctacacgccctcgccatcagaggactgcatgtcctcaccttcagaggactgcatgtcctcaccttcagaggacgacatgtcttcaccttcgtagggctacacgccctcacctttagaggaccacacgtcctcaccttcagagggctacacgccctcgccatcagaggactgcatgtcctcaccttcagagggctacacgcccccgccatcagaggactgcatgtcctcaccttcagagggctacacgcccttgccatcagaggactgcatgtcctcaccttcagagggctacacgccctcgccattagaggaccgcatgtcctcacctttgtagggctacacgccctcacctttagaggatcacacgtcctcaccttcagagggctacacgccctcgccattagaggactgcacgtcctcaccttcagagggctacacgccctcgccatcagaggactgcatgtccttaccttcgtagggctacacgccttcacctttggaggactacac

SEQ ID NO: 13872 - DNA, 391 bp, Glycine max
  Peptide Sequence Number=SeqID_130650
aaaagaagaaggagtagagacgagagttgtcatcacggaaagggcaggacgggcaaaatcagtgtcttatctttgctttcctcttatcttcgatgagagatacttggaaccctttgttgcacaatatgtgaagtcccgagacgtgccgaaaatcaaaaggaagcaggcttacgcgatccgtgaaaattccaaggcgattgtttctggaggaagcaaccttactcgcctgggcgagctgggtggcaagctcctcccctattttgctataaatagggggaggaatgaagggggaaagggttcagccttcttggcacttctgattctctcaaaattgctgaggaaaattgtttccgtgaagaaaatccaagccgaggcgcttcctcttcaactg

SEQ ID NO: 13873 - DNA, 456 bp, Glycine max
  Peptide Sequence Number=SeqID_130651
atgggggagacacatgagataccccaccacaatctagccgacttcgagccttgcattggatgcgccacagaggggcaagcaattggtggtgtacctttgtcaaacactttggagggccctcgattttgcccacaaccacaacccttgtattttgcggtaggaagagtccctcctgctatggctgaaaatggaaagttggatcagatagaggaaaggctaagggccgttgaaggaggtgaagattatgcctttgctgacatggaagatttgtgcctagtacccgacatggtcattcctctgaagttcaaggtaccagacttcgataaatacaaggggacaacttgccccaagaatcacctaaaggtgtactgtaggaaaaagggagcatatgcgaaagatgaaaaattattgatgcatttcttccaagaaagtcttactggggcagccgacacctga

SEQ ID NO: 13874 - DNA, 192 bp, Glycine max
  Peptide Sequence Number=SeqID_130652
atgagagacaatgaggttaaagcttcggaagaaagtgatgaggtacaagccctaaaggcaaagcttgaaagagcccgggtagtcaaagagaagttcaaggcagcaatagtgagctcaaactccgaagaggtgaaaggaatcatcacgggtcaaaggcatgatctggaaggacgagctaaaggcttgccttag

SEQ ID NO: 13875 - DNA, 1569 bp, Glycine max
  Peptide Sequence Number=SeqID_130653
cagagggatacacgccctcgccttcagaggactacacgtcctcaccttcagagggctccacgccctcgccttcggaggactacacgtcctcgccttcagaggactacacgtcctcaccttcagaggactgcacgtcctcgccttcagagggctacaagcgctcgctttcagaggactacaagtcctccccttcagaggactacacgtcctcaccttcagaggactacacgtgggctacatgcccatgccttcagaggactacacatcatcgccttcagaggtctacacatccttgccttcaaaggacaacacatcctcgccttcagaggtctacacatcctaactttcaaagggctgcacgccctcaccttgagagggctacatgccctcgccttcactgggctacacgccctcgtcttcagaggactaaacgtccttacctttaaagtgctatgcgccttcatctccaaaggactacacgtcctcgccttcagagggctacacgccctcgccttcagaggactacacattctcgccttcaaagggctgcatgccctttccttcagagggatacatgcccttgcctttagaggactacatgtcctgaccttccgagggctacacgccctcgcctttggaggactacacgtcctcatcttcagaagactacacatcctcgcctttagaggactacacgtcctcaccttcatagggctgcacgccctcacctctagagggctacacgtcctcgcctttagagggctgcacgccctcgccttcagagggctacatgccctcgctttcagaggactacacgtcctcacattttggaaggttgcacgtcctcaccttggatacttgtaccctcaccttcagaggactgcacgtcctcgccttcagagggctacatgcgctcgctttcagaggactacaagtcctccccttcagaggactacacgtcctcaccttcagaggactacacgtgggctacatgcccttgccttcagaggactacacatcgtcgcctttagaggtctacacatccttgccttcaaaggacaacacatcctcgccttcagaggtctacacatcctaactttccgagggctgcacgccctcaccttgagagggctacatgccctcgccttcagtgggctacacgccctcgccttcagaggactaaacgtccttacctttaaagtgctatgcgccttcatctccaaaggactacacgtcctcgccttcagagggctgcacgccctcgccttcagagggctgcttgccctttccttcagagggatacatgcccttgcctttagaggactacacgtcttgaccttccgagggctacacgccctcgcctttggaggactacacgtcctcatcttcagaagactacacatcctcgcctttagaggactacacgtcctcaccttcatagggctgcacgccctcacctctagagggctacacgtcctccccttcagaggactacacgtcctcgcctttagagggctgcacgccctcgccttcagagggctacatgccctcgctttcagaggactacac

SEQ ID NO: 13876 - DNA, 449 bp, Glycine max
  Peptide Sequence Number=SeqID_130654
atggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggcccccctactgctgg

SEQ ID NO: 13877 - DNA, 276 bp, Glycine max
  Peptide Sequence Number=SeqID_130655
atgcgggggtccggggaatttgtccccttcttagatacgacgtctaggggtagcgaaatgccccaacgcacgttttttaagaaggcgacacggaccctccgttggtttgtttacagtagggatcaagacagaacccatatgcatgcctatgcaaaagacacaatgcgggaatgtgcacaaggtatcatcccctttgaagaacatattgtagcagtagggactactagcaacaataggttttcaaagagaaaagctctagatgagggttcactgtaa

SEQ ID NO: 13878 - DNA, 1857 bp, Glycine max
  Peptide Sequence Number=SeqID_130656
atgaagtctgcgcgagtcaaagaagcgattctgttagtgtttatgtttagtctcttaagcattgcttgttcggatctagcttcggacagagcggggttgttgttactccgaagcgcggtggggggacgcacgttgttatggaactcgacccaaacaagcccttgttcgtggaccggcgtggtttgcgccagcgggagagtaattatgttgcgtcttcccgcgatgggtctctccggttcgcttccctccggtttgggcaacctcaccgaactgcagacactttccctccggttcaacgcgctaaccggacgaatccccgaagatttcgcaaacctgaaatctctccgcaacctctacttacagggaaacttcttctccggcgaggtctccgattcggtgttcgcgttgcagaatctggttaggttgaatttagaacgcaacaatttcactggttctatccctgaccttgatgctccgccgctcgatcagttcaacgtgtcgtttaattcgctgaccggatccattccgaaccggttttcgcgtctggaccgaaccgcttttctcggaaactcgcagctctgcgggaggccattgcagctttgccccggaactgaggagaagaagaagagtaaactatccggtggcgctattgcgggtattgttattggttccgtggttggtgtgttgttgattctgctgcttttgttctttttgtgtagaaaaaggaacaagaaagatgagaatgaaactttgccacctgagaagcgtgtcgtggaaggtgaagtagtgtctcgtgagaagagtaatgagagtggcgggaattcaggttcagtggagaagagtgaggttcggagtagcagtggtggtggtggagataataagagtttggtgttttttgggaatgtgagtagagtttttagtttggatgagttgttgagggcatcagctgaagttttggggaaaggcacctttgggacgacttataaggcgacgatggagatgggggcgagtgtggcggtgaagaggttgaaggatgttactgcaacagagaaggaattcagggagaagattgagcaagtggggaagatggttcatcacaacttggtcccactaaggggttatttctttagcagggatgagaagcttgttgtgtatgattacatgcctatgggaagcttatctgctctcttacatgcaaatggtggagtggggaggactccactgaattgggaaacaaggtctgccattgcccttggcgctgctcgtgggattgcatacattcattcacttggcccaacatcctcccatggaaacatcaagtcatcgaatatccttctcaccaaaacttttgaagctcgcgtctctgactttggccttgcgtaccttgctctcccaacctctacaccaaaccgtgtgtctggttactgtgcgccagaggtcactgatgcacgcaaaatatcccaaaaagccgatgtctatagctttggtatcatgcttttggagctgcttacagggaaggctcctactcattcttcacttaatgatgaaggggtggaccttccaagatgggtccaatctgtgattcaagatgagtggaacactgaggtatttgacatggagcttctaaggtaccaaagtgttgaggaggaaatggtcaagcttttgcagcttgcccttgaatgtactgctcaatatcctgataagagaccttcaatggatgtggtggcaagcaagattgaggaaatttgtcatcctagtttagagaaagaggaagagaagaatcatgattttaaagatgctgataatggattttcccaacagtaccattctgttgactcgggtgtgtcacaagcttga

SEQ ID NO: 13879 - DNA, 324 bp, Glycine max
  Peptide Sequence Number=SeqID_130657
atgacccataacattgctgcacaaccttcttcggctgattgtgaacctttcttctttaccgcttattaccttccactatgtccccgtcgcccatctccaagtacctccacacgcttgattcggacccctaccaccatctctcccggagattctggcagggacgatttatatcatatacaagatcattgtgaaaaaatttatcataccagcaccaccagcagctgcagtgacagcagaagaagccacagaaagacaatcaccaccaccaccaccagcagttggcagaataacaagtcagagaagtacaccgtaggagctcgttga

SEQ ID NO: 13880 - DNA, 450 bp, Glycine max
  Peptide Sequence Number=SeqID_130658
atggctaggagagttgggggtgttgatgagtttgaattcaaggctataggagaaaaccataaccaaggcaggctaggggttgagatcttagtctcaggatttgtctttgagaaggaagattttataaggccatgggaaggacagaatgacaacttggagaggtacaacagtgaacattttccttcaataatactagtaccactggtcaaggaagctgaacttgtagaaaaagttgtacttcttggagcacccatcccaatcatggatgagaactgggaagcaactagaaagttgggtttaattagaaaccttacagatgtcaaagctttatcggaaaggggaatccttttcttgcatgttggggataatgaaaacaaagacacaaattccattgctgagtttcccctcctcaccaagaatgctgttgaatctttacggtacagggctgag

SEQ ID NO: 13881 - DNA, 753 bp, Glycine max
  Peptide Sequence Number=SeqID_130659
atgcaggaagctgatagaaacaacaatgggaaagctgcacactcagcatggaggaattatgatgacttcaatgaatacttttggtcgcgtgcttgttttgaattaaactggccaatgaggccaaattcacctttcttgcggaaacctaaaagaactaaaaggactggtaaaagcagttttgttgagcatagaacatttcttcacttgtatagaagtttccatcgtctttggatcttcttggcattaatgtttcaggctttgacaatcattgctttcaatcatggacacatcaacttgaatactttcaaaacaatacttagcattgggccgtcatttgcaatcatgaattttgtcaagacaatccaaattgacaatgaggctattttctgcactgcccctgtgcctaggtggctacatctgccgttttgccaacactggaaggttttgcaggagagaaatagcaatagctctgacaattcattctatttccggatataccttcttgtgcttggtgtttatgctgctatacgtctattccttgcactgttgctcaaatttccagcttgtcatgcactttcggaaatgtctgatcagtttttctttcagttttttaagtggatttatcaagaacgatactatgttggacgtggtctttatgagaggatgagtgattactgcaggtatgtggccttttggttggtggtacttgccgtcaaatttacttttgcttactttctccagaaattgacataa

SEQ ID NO: 13882 - DNA, 231 bp, Glycine max
  Peptide Sequence Number=SeqID_130660
atggagacctctgtagtgatggggattgaagtagcaaccttcacgtccactatcacaccagagcgagacgacattatcgcgggctttgtagcgtctttgacttccatccattgttgccgccaacctccaaccttccttatgtcgtcggttacctccctcttccatttaggtgttgtgattttcactttcgtcggaaagacagatagtgcaaagaggctgaggtacgagtga

SEQ ID NO: 13883 - DNA, 741 bp, Glycine max
  Peptide Sequence Number=SeqID_130661
atggcgatgccagcattaaataatagccatggagagaaagagacaaatttacacagcattagcagcctgagaaagtatgataggtatcgagtgtgtgagcaggcatatagtatggctcaaaatcttgatcccaacagtgatggtaggggagttctgcagttcaagactggtttaatgtctgttatcaagcaaaaacttgttaagaaggatagggtacggattgatcgcaaccatgacattgaacacctgtggaagttttatcaacactacaagcaacgccatagagtggatgacatccaacgagaagaacagagactgcaagaatctggaacttttagctccaccacattgggagagttgaaacttagatcgtcagaaatgagaaagataattgccactctacgtgctttagtggaggtcctggagtcacttagcaaggatgctgatcccagtggagttggagggctcataatggaggagttgagaaaaataaagaagtcaagtgtgacattatctggagagttgacaccatacaatattattcctctggaagcaccatcattaaccaatcctatcagaattttccctgaagttaaagcagcaatatctgcaattagatatactgaccagttccctagacttcctgctggacttagaatatctggacaaagggatgcagacatgtttgatcttttggaatttgtgttcggtttccagggaaccgagctagactcacaataa

SEQ ID NO: 13884 - DNA, 273 bp, Glycine max
  Peptide Sequence Number=SeqID_130662
atgcaaataaccaaaagtgcaaagttcattttccatcaaaatttgtttggtgcaattactgatcttttccattttgtcaccaaaaatagtattgaagactattggaagacacgggatgttgttcaagttatggcacagttagtatggaaaggacttggacttggaggtgagataggtgtaggaaattggaggagagataatgataacaacaaaatccttcttgggatacctggaggacactatgcacctcggcatatgggtgtagtattgtaa

SEQ ID NO: 13885 - DNA, 597 bp, Glycine max
  Peptide Sequence Number=SeqID_130663
atggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaaggcgcaaggaagctgattggtgggatccccctccagaggaaactctggtggaggctcgcagcgatcctgacgtgcaaatcgttcgtctgactagggtaggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcgggttaaaattcctgaaccgggacgtggcggctga

SEQ ID NO: 13886 - DNA, 276 bp, Glycine max
  Peptide Sequence Number=SeqID_130664
atgttttcctcgaataaacgttggtggcgactccgcgcattttcctcccatggaagacgcacctgcgagcctcgcttcgccctcccgccgaaggtgtttcatcataggggttctttctgcagaaatccccatctacattacaaagaagaagatgtagatgtcattcgcaaccaggatgtggacacttggtcattctttgaagttgttgggttggttgttgaattaggatacccgaacaatataagttcagattgtggtggaagcaaaatcatatag

SEQ ID NO: 13887 - DNA, 627 bp, Glycine max
  Peptide Sequence Number=SeqID_130665
atgtatgtgcatagatattacagtaaggacttgtacaaaatgtgctatgagaatgccatatctcccttaaaaggtcaacctcacttgcccaaaacttcgtatgatgagtgtttaccaccaaataataaacgcggacctagaaggccaaagaaattaagaaagagaaagcctagtaaagaagggcctagaaccaaactaaggaagagacgcaaaacacttgtgatcaattgtgggatttgtgtgaaatctacttataatgtgatcatttgtattgtatttattcttttacggtatccgagaaccacaaccaatgttgataatgcaactactgaactagaaacaacaattgttgcatcaagtgcaccatcatctaatgcaaaaggcaaaggactaactgcaacaaccaaagtcaataaaggtaccaaaacaccaacaaagccaacaccatccagggttgccgaaaaggataaagtgaagccatatgagattattgaatcttacatggctttgaaagaaactcatgaagcgatggaaaaatccaagatcaagtcaatgggaaaaggaaaaaaaatagattacttggagaaagtttttttttgttgttgtagtcaactgatgcaaccttaa

SEQ ID NO: 13888 - DNA, 465 bp, Glycine max
  Peptide Sequence Number=SeqID_130666
atggatgatgttgaggcatctgctgtagttaatggggaggcaaatgtgatggatggacatgtgactggtgaggaggcagttatagaggaagttgtggatgaacatgaggttggtgtgaaggcagttgcagaggaagttgtgaatgagcaggtgcctgatatggaggaagttgcagttgatgtgcaggaagttctgcatgaacaaatggatggtgttgaaattgtacacaatggaggaagtgacaccaagagtagtgatgaagatgaatattttatatgtagtggagttgaggaggatagtttgcacactagcttggacacagagaacgaggatgatactactgataacttcaagaagaagtttggaggaggcactatgatgaaggaccttatgatgggggcttctaaggcaacatacgaagttgcatgggttgagaagatgaaacagatcaaggccgttaattag

SEQ ID NO: 13889 - DNA, 533 bp, Glycine max
  Peptide Sequence Number=SeqID_130667
ggttttgtgacgttttggaaggaaatgtgcaaaatgttcaaaaagaagggcaaaatggtcactttgggacattttcagcccttgggcccactagaaagcttaaggatgaagtaaccagctcgcctgagcgagcaagcagtcgtcccttgtggtgggcgtgtggggtgctaataccttccccatgtgtaaacaatgtagaagaaaagcttcatgatgaatcaagattgattcaaagatgttttgatgataacaaagatgatgacaaaggtgatgacaaaaagctcaaaggtcaatcaaagaatgagttcaagatgttcaagatagaatcaagaacacttcaagattcaagaggaaagttgaattcaagaatcaagaatcaagattcaaggatcaagcttccaagaatcaagatcaagattcaagaatcaagagaagacttaatcaagataagtatgaaaaagtttttttttcaaaaactgagtagcacatggatttttctcaaaacatgtttaccaaagagtttttactctctg

SEQ ID NO: 13890 - DNA, 600 bp, Glycine max
  Peptide Sequence Number=SeqID_130668
atgtgctcctccgggtctaccagtgctgcaccaacaagaccttgttacttggaacaaggccacggcttggcttccttaaaacacatggatgcgtgtcataatcgtgccaacaactttgtctctaggtccatgaccatgggttacggcacttcctaccacagaactagtttaaggaacaacaacaacaacaacaacaacaacgtttctgtttcttcaccaagatctgcgagattctacgacgccagattcgaagatcaacaccacccccacttcctctccgcttgtttcctctgcaaaaaatctctcggggacaatagagacatcttcatgtatagaggggacacaccgttttgtagcgaagagtgcaggcaagagcagattgagatagacgaagccaaagagaagaataggaacctttcttcatcgatgaaagctttaaggaacaaggagcagagaaataataataataaatcccaacgtcgccaaacaaggcgcaacaagactactcgttccgtacgggggctgttgcggcggcgtagggtatcggtttaccgtgtcgtgacggaaaaaacaaaccaacaaatgaacgaacggaactga

SEQ ID NO: 13891 - DNA, 339 bp, Glycine max
  Peptide Sequence Number=SeqID_130669
atggatgtggtgatgctgtccctaagaactgcacaaggcatagacctaatgagtctccaagaatcgtttggcagctctattgttttgtctttgcttgaggcttataaaacttattttgagagtggacatgtggtttgcttggacgagtataggagaaccgttagaatagatgaccttaattcttttttgaacaacactaatgcagaaggaagggtggcttatataaggctaagtgatccagaaggtttcctcttatcaaatgagttgatagccatagcttttggggttatcgactcttggaaggatatgcctccataccaagaagcagaagctacttga

SEQ ID NO: 13892 - DNA, 291 bp, Glycine max
  Peptide Sequence Number=SeqID_130670
atgtggaatgcgtcagaatctgaatgggtggaagcttcagatgatgatgaagaaaatgatgatgatgaagatgaatctgacaatgatggttcaactgatgaggatgaagatgatgaggaagaggaggaggaagaggctcagaatgcatcagttcaggtggtagatgccgttgctttaatcaaaggggtgggaaagaatctgcggaggaaagaaaggaggtcacggatagagcagattagagctagtcttggcttgtcagattcacagagaacaccattggtaatatattga

SEQ ID NO: 13893 - DNA, 1074 bp, Glycine max
  Peptide Sequence Number=SeqID_130671
atggggaagaagacgaagaaacccggcaaaggcaaagagaaaaccgagagaaaaaccgcgagagccgaagagaagaaagctcgcagggaaaccaagaagctctctcccgaagacgacatcgacgccattttgttgagcattcaaaaagaggaagctaagaagaaggatgtccaagtcgacgacaacgttcccgcgccttctcctcgctccaactgctcgctcactgtcaatccattgaaggagaccgagttgattctctacggcggcgaattctacaacggaaacaagacattcgtgtatggcgatctcttccggtatgatgtggagaagctggaatggaaattggtttccagtcctaacagtcctcctcctcgcagtgctcatcaagccgttgcatggaagaattatgtttatatttttggtggtgagtttacatctccaaaccaagagcggtttcatcactacaaggatttttggatgttggacctgaaaacaaatcagtgggagcagcttaatttgaaagggtgccccagtccacgttcaggacatcgaatggtattgtacaagcacaagattattctttttggtggcttctatgacactcttagagaaggtcaagatggtaattccacttgtaacccccttgcccgtgaaacaagtagaaatgaggaaggtgtaaggtactacaatgatctatttgtatttgaccttgatcaatttaagtggcaagaaataaagcctaagcccgcagcaatgtggccaactgcacgtagtggttttcaattatttgtttaccaagatgacatttttttgtatggtggctattcgaaagaagtttcatctgataagagcaactctgagaaaggaattgttcattcagatatgtggtcccttgatcctaagtcttgggaatggaacaaggttaagaaaagtggaatgcctcctggtcctcgtgctgggttttccatgtgtgttcataagaggagggctctgctatttggtggcgttgtggatatagaagttgaagcttatatttttaaagcaagtgattgggaagtcatctctatgacctaa

SEQ ID NO: 13894 - DNA, 777 bp, Glycine max
  Peptide Sequence Number=SeqID_130672
atgagtattgtactcggttcagagtatagccaaaaagatccttcaatgacagaatctcctactcctccttccgctactccttctttctcttcatcttcagcgttctcgcactcgatttctgagaagctcactgattcaaacttcttgctgtggaagcaacaagtagaaccagtgatcaaagcgcatcaactacactattacttggtgtgtccgaatattcctcttcgatatgcaaatgaagccgatcagaactctggcactgtgtacactgtgtgggaaatacaagatcagatgcacctaacatggctacaatcaactctctccagctcgattctgttgcgcgttctaggatctgttcactcctttcaactttgggaaaagattcatgatcactttcagaagctaactcgagcaagagctcatcaacttcgtgcagaattgcggtccactactcttgatagcaaaactgtttcagaatttctcttgcgcatcaaagccctagcagatacgctagcttctgccgaagatccaattacaccagagcaacatgttgatatcatccttgaaggtttgccttctggcaacaattctgtgatttccattatcgagagcaaatttcaaccgatgcaaattgaggaagtggaagctcttcttgcgcatgagatgcaattggaaaaatcgcaaaagaagcttgcctcagaaaccgcttcactcaatctaacagaaattcccttcactgcaacagtcgtcttctgctcaagcaaatgttgcatctaa

SEQ ID NO: 13895 - DNA, 980 bp, Glycine max
  Peptide Sequence Number=SeqID_130673
atgggaagagatctttgtgcaaatggaaaaatggaagggttgagaagctcatggtcccaaatggaaaaggccttgaacgatgtcgtttcaaagagctttgttgggaggtacttcaagttggaagcaaggaagagctgcttcaccagggagcttcgtgccgccatggccacttttctgaccatggtatacatcatcaccgtaaacgccaccatcatcgcggtctccggtggaacctgctccgtcgaagattgctcgtctccgacgaggccggactgtaaggtgaagcccgacgttgggtacgagagttgtcttgcaaagacgaagagtgacctggttgtggccaccgctgtttctggccttattgggtctgttgccatgggcctgtttgccaacctccctttgggcctggcccctggcatggggcccaacgcatacttcgcttttaacttggttggttttcatggtactgggccgctctcttaccagactgcactggctgtgatctgtgttgagggaattgtttttcttttggtctctgctgttgggctgagggggaagtttgcaaagctcattccccattcagtcaggcttggttgtgctgctgggattgggcttttcattgccttcacgggcctgcaggtcggccttggtgttggacttattgggcctgatgctgctaatctggttaccataactgcctgtaaagttgtggacccagaaactggggcttgcttgggtgggaaactgcaaagcccaaaattctggttgggtcttgtaggttttctaatcacaagttatgggttgatgaaaaatgtcaaagggagtatgatttatggtattctttttgtgactttggtgtcttggtttaggcacactgaagtcacttattttcctgacaccccgcttggtgatgcaaattataactatttcaagaaagtggttgattttcacaacatggattccactgctggggttcttag

SEQ ID NO: 13896 - DNA, 765 bp, Glycine max
  Peptide Sequence Number=SeqID_130674
atgctgaaatcaaccttcactccaattttctgggtactcacacccaaacccaaacctccaaaactcccttcccatgcaatcacaaacaccttcttcacaagcagcatgccacatgttcgacataatgcccctgtcaaccccatcaccccaccacccgcatcttcagcctacatccacctcccattctgccgcaaacgctgccactactgcgacttccccatcgtcgccctcggctccacctccgccctaatcgacgacgacccacgagtctcaaactacatccactggctctgcagagaaatcaatgccaccaatgtggaccaacctgatgatgccaacaccatcacaccccttcaaactgtctactttggaggtgggacgccctcgctggtgcctcctaggatggtttcctcagtgttggacacactgaggacgaagtttgggctgcgcgaggacgtggaaatatcaatggagatggacccgggcacgtttgatgctgagaagatgcgagggatggtggcgtttcgggaggagctgttgagagcttgtgggagggcacatgggctgaaagaggttcatgaggctattgatgttgtcaagttatgtgaagttgagaattggagtattgatcttatagcttcattgcctcatcagactagtgacatgtgggaggaaagtctaaggcttgccattgaagcacaaccaacccatgtttcggtttatgatttgcaaattgagcaaggcacgaaatttggacgattgtaa

SEQ ID NO: 13897 - DNA, 1556 bp, Glycine max
  Peptide Sequence Number=SeqID_130675
ccccaagctccgcgccaagcccgtccgcaccgcctccggaatcgccgtcgtcgccgtcatgtcgaaagccgcaccggtgcccacacatcgccaccaccgggaacatctgcgtctactgccccgggggacctgactccgacttcgagtacagtacccagtcttacaccggttatgaaccaaccagcatgcgtgcagttcgtgcgaggtataatccatatgtccaagcgaggtgcaggatagatcagcttaagcgtttgggtcatagtgtagacaaggttgaatttatcttaatgggcggtaccttcatgtcacttccggctgattaccgtgattactttataagaaatcttcatgatgctttgtctggacacacatctgccaatgtggaagaggcagtggcttactctgagcatggggcaaccaagtgtattggcatgacaattgaaacgaggccagattattgtcttgggcctcacttgcgccaaatgctttcttatggttgtacacgattggagattggagtccaaagcacctatgaagatgttgctcgagacacaaatagaggacacactgttgctgctgtagctgattgtttttgcctggctaaagatgctggtttcaaggttgttgctcatatgatgcctgatcttccaaatgttggtgttgaaagggacatggaaagtttccgggagttttttgagagtcccttgtttagagcagatgggcttaaaatatatcctacacttgtaattcgtggaactgggctttatgagctctggaaaactggcaggtatagaaactatccaccagagcaacttgtggacattatagcaaggatccttgcaatggtacccccatggacacgtgtttatagagttcagcgggatattcccatgcctctggttacctctggggttgagaaaggaaatctgcgggagctggcattagctcgaatggaagacctgggattgaaatgtcgtgatgttcggaccagagaagctggaatccaggatattcaccaccaaattaagccagaagaggtggagcttgttcggcgtgattatatggcaaatcagggttgggaaacatttctatcatatgaagatacacggcagttcataactggccttgttcctcttgctcatatttttccttctttaattgtaaatcaagagggacgtgtctcaacctgttgctcaaacacagcaatgaccttgtctgaactctctgcttgtaaacaggatatccttgttggtttgttgcggctgcgaaaatgtggccgcaacacaacttgtccagagcttatggggaagtgttctattgttcgtgaactccatgtttatggaactgctgtaccagttcatggacgggatgctgacaagctacaacaccagggttatggcacacttttaatggaggaggcagagcgcattgcttgcagagaacacagatcaacaaaaatagctgtaatttcaggggttggcacacgccattattacaggaaactgggatatgagcttgaaggaccttacatggtgaaatatctagtgaaataa

SEQ ID NO: 13898 - DNA, 1020 bp, Glycine max
  Peptide Sequence Number=SeqID_130676
atggaaggtgcaatgctgcaacaatatcgaagtaaaagaatgcaacaatatcgaagtgaaagaatcgtaaaaataagaggttttaaagcgagtcgagtcatctcggaagtggcagtagctgcgtgcaaactcgcggcggaaggcagcagagtggcgccgatggaggagggtttagagaagagagaattggaaggcgaagtagttaccaaggttgtcgaagtggtttcggctataaagaatgcgaagcacgtcgatcaagtcattcgcgcgcttcattccttagtcacccttcttttcccctttgactcttcactcctatcagatagcattgaccagagttaccgagaccaggtcgaagttccttctgcagaaaaacgacatgcttggtggcgtgcgttttatcgaggagctgcttttcctacactggctaggtttttattacttgatgttgcctcgaactggttgggttgttttccctttatggcgcagaagtacatttatgatgttttctttgttcgtggattggtcactgaggttctgcagattttggttccttttcttcagctgagtgcgagtgatggtcttgatgttaatgccgtcctctctaattccgaaagcatttattacagattgcttgtactgtgcttgcttgaaaataatggggtgctccagctggcaagagagtttggtggttcttctaaattggaaagagttacagatgtacagatcaagatggatgtatctagggtggcacaggttgttgcatctattcctgacaaagcaaggatgaactccacgacttcattgtcatcacagtatcctcctttttcctttcttcatttagatagtttatgggctccgttgattgaatatcatcatggttctgagttcctttgtaaacactcatgtattgttttcaccgagagtattcagtgtgttcttcaagcagattgttgtccaactactctccctggcagaagaaagagagatgattttgctagacaatgtagacatggatga

SEQ ID NO: 13899 - DNA, 273 bp, Glycine max
  Peptide Sequence Number=SeqID_130677
atggcatcagatctggtgaatgctcagaggaggaaagtgcatgagattgttataattataatgcagcaatttacatcaaatagggtgggaaatagcctttccacttacacgggtaaaggctacacttgccctcccccaaaccccacaatgaagaccatactgcaagcagatgttggacagtattcaaaagctcagggcgattatgtcctaataatgaggtaccaggtgggcattcatgcacagcaaattgaaggatccatttcaggcagctaa

SEQ ID NO: 13900 - DNA, 1461 bp, Glycine max
  Peptide Sequence Number=SeqID_130678
atggctagctgtgttgctttggcattgtctaaaattattgatccaaagaatcctctgtaccttgatgatagctgcagtggggagacaattgattgggaatttggattcactatccccaagaaagggaatctggctgcctcaaattgtggaggaaaaggtgttgaggggacaaaaatatctactgtgtcatgtccggagaaggactctgattccccttccaataaagagaaaagtatttgtttaaagggtaaaaagaagttattggactttaatgcgcttgatccagatgagattattgatccagcatcactgaatcttgaatcagacgatagcgatgaggatgctgacgatggtgctagtgagaattcatattcttcaagtgattcatctttacggccatatgatttgtcagatgatgactcagatttgaaaagaaaaatttcacagttggctgatgtagttgcagctcttagaaaatccaatgatgccgatggggtggaaagggctattgatgtagctgaaaagctcataagagcatcccccgatgaactaaaacatgcagcaagggatatgaccagaactcttgttcaggttcggtgctctgatatagctttagaaggtgcagaagaatcaactgaagacaaaagacaaagatcattagttgccttagtagttacctgcccatttgaatcacttgagtcactaaacaaccttttgtattcacctaatgtagatatcagtcagcgcattatgatactagatgtcatgacagaagcagctcaggagcttgcggaatcaaaaattatgaaacccaaacatcagattagttcccttatttcagttgtttcagatacccgaccttggttcctacctagcagcacaggaactcctggagctggttcctggaaagagatctcaggtactggctcttttaggaattggtcaaatagctatgagagggaacttcccccaaaacctaatcaggtcaagaaagggaaaacacgccggtggagcctacaatctcccacacaacaaaaccagatggagtattctcataataagttacccatgtatgctgctgcattcatgcttcctgccatggagggatatgataaaaaaaggcaaggtgttgacttgcttggaagagattttattgtcttggggaaactcatttatatgcttggggtctgtatgaaatctgtagccatgcatccagaagcttctatgctggctccttccctcctaaatatgttaagatccagggaggtatgccatcaccaggaagcatatgtgagaagagccgtgctttttgcagctgcatgtgtattggttgcccttcatcctacttacatttcatccaccttactcgaaggaaatgctgaaatttcgactggccttgaatggattcgcacatgggcacttgacatagccgagtcagacacagataaagaatgctatacg

SEQ ID NO: 13901 - DNA, 183 bp, Glycine max
  Peptide Sequence Number=SeqID_130679
atggatgaagttgaagaaagattggatagagcttttgctagacaagactggatggacacagaaatgacagaacgcataagaggggttaattggatgagaatgtgcgtggaatttatggaattcaatattttggtgaatggagagggagttaggacaattctaccacggaaagggcttagataa

SEQ ID NO: 13902 - DNA, 636 bp, Glycine max
  Peptide Sequence Number=SeqID_130680
atggaaagtggtttttggagcaacgttccgcagcgattgcaaacaaagaggaagagtaaattcaatggcaagggagcactttctacatcgaaggcagtgctttctaaaacgaaggaagcactttctagatccaatgaagcactttctgcacccaaggaagctctttctaaaccgaaggaagcacattctagacccaataaagcacattctagacccaataaagcactttctacacccaagaaagcgctttctacactgaaggaagcactttctagatccaaggaaaagctaaacagtggagattttgatatttacttgaagaaaatatggaagattttctcagaagataggttgaggcattgggtcattggagcctcgtgccattttggtgaaagcttggaatcaactaccagatcacggtgcatgttgttgctggattctcttgaaatggccaatccaagacggctcaaacctaagattagaagatttgttttagatatttatagaacaggggacaggcctgaggctaagcatctcatatctcgaattccttttttggtgcccaagatgaaaaaagattggtttacctttgaagacctagataggttttatgagagacttggttcactgaattag

SEQ ID NO: 13903 - DNA, 657 bp, Glycine max
  Peptide Sequence Number=SeqID_130681
atgaagtttgagaggttggcaaaatcgttatttttttttcatattgatgacaaggagaaagacttggaacatctcaaggtgacaagcaagaccgttgtagttggacagaagatgccttgctgttttatacattgcagcttggttttgttgacatggattttgatctcaatgctaaaggcaatgagaaagttgaaagatcactcttggttttctaacttgtgtcatggtgacagtttgtgtgaagaaggtggtgattgggagagaaagaattggctgaaagtacggcctgcctcgggtgtcgcggccgctatcgcgactgagcggcacccatccgcgacgaagagggtcgtagtggcgcggttcaatgtcgcggatgtcgccgccgctatccgctatcgcggcggggtggagtggcggagtggtgcaggatctgaaccggattttcgcgcggctaccgtgacgctgtggaaatttcagaaatgccctctaatgtggaaaagtgaggaaaacccccaagtcgaccagcttctagaaaacccccaagtcgaccagccaccacgagtctgcatcccgcgaagctgcgacccgacacctgcgtcctgcgtccggtggccccgacaacgagtttgcactgcgctgccaccttgcttgaggtga

SEQ ID NO: 13904 - DNA, 177 bp, Glycine max
  Peptide Sequence Number=SeqID_130682
atggctcttcaaacttcccgagcattggagtcagttctatattctgacaaggggatgaggttgatgccaatgctcccctacatgccccttgttgtcgcacgtgttacttcgccctcaaccttgtctgcatcgtcgaccctccaagatctggatttgcctcttcacctgcatctctga

SEQ ID NO: 13905 - DNA, 205 bp, Glycine max
  Peptide Sequence Number=SeqID_130683
atggaggtgcaaatagcaaccaggcccacttgggccctccagaatgttcctccagaaggcggttgcttctggagaaagcaacctagctcgcttgggcgagctggaaaatccaagctgaggcgcttccataacgtttccgtgggtgatttcgctaagattttcaaccgttcttcgacgttcttcgtcgttcttcggtcttcaaccg

SEQ ID NO: 13906 - DNA, 2058 bp, Glycine max
  Peptide Sequence Number=SeqID_130684
atggattcttcaatggcaagtgttggtggctctggtgatgaaggctctgacaacttcaaccagggaagaagaccctcctacaaacgtctcacttctgctcaaacagccagacttgaaagggaacatcttgctttatgggagaaggaaatgaaaaatcaacacgagcgagcagataacactgctcttcgggttgagaatgataggatacatagtaaaaaccttctaatgaaaaaggcattgaagaatatgctttgcccatcttgtgggggtgcaccgtgtcaagatgatcgtgaacatttaatgcaaaagatgcaacatgaaaattctcggctaaaagaagagcatgagaaagtgtctagccttcttgcaaggtacttggagaaacaaatgtcaccgcctgagttccaacaggtttttaatattcctatcataggatcaagttcacatgctccaaaacttgaaaattcatcactaaactatgaaattggtggaagttcaagtcatggtccaagtctttatggtatgcaaattatggatggtcatgaccataacttaatgggaagtgaaggtatagagaagaccctgatgttgaaggttgctgcttccgcaatggaggaattggttaggcttattcggattaatgagccctgttggatcaagtcttcaactcaagatggacagctcattcttcagcatgaaaattatgagaaaatgttcccaaggaccaataatttcaaaggtgtcaatctgcgtgtagaagcaacaaaagattcaggaatagtgagcattaatagcattcaactagttgacatgtttctggattcggacaaatggattaatttgttcccaacaattgttacaaaagcaaaaacaataaaggtacttgaaaatggtttggtaggaagtcgaagtggagccttgcagctgatgtttgaacaaatgcatgttctttcacctttggtgcaacctcgcgagtttcaattccttcgctattgtgagcaaattgaagaaggtgtatgggtgatagcagatgtgtcatttgattcctttcgacaaaaaacctctttttttcactcttggagacatccctctggatgcatgattcaagaaatgcctaatggttgttccatggttacttgggttgaacatgtggaagtggatgataagatccaaactcatcagctatacaaagaccttattggtacaggaattgcatacggaacagaaagatggattatggaacttcaaagaattggcgagagatttgcttgcttttatgttgaaaggatacctattcaagactctggaggagtgatcaattctcttgaaggaaggaggagtgtgatgaatttttgtcatcgtatgatcaaagtcttttgtgaaagtttaaccatgtcaggtaacttggacttcccacttttgaaaatggagaacaatagcggggtgagggtttctattcgcaaaaacagaaaccaccttggtcaaccaaagggcgtgattgttgtagctgctacctccatttggcttcctctccattatatgaaagtttttgagttcttgacagatgatagaagacgtgctcagtgggatgttctttgctgtggaaataacgcgaacaaggttgcacacatctcaaatggaattcatcctggcaattgcatatctatttctcggccattcatccctagcgagaacaatgcactgattcttcaagagagtttcacaactcccatgggatcgtatgttgtatatgctccaaccgacgtagcaagtatgatttcggccataaacggagaagactcttcaatgctaccagttcttccatcaggttttgtcatctctgcagatggtgaaccaaatgcagctttggaagcatttaacagttcagatattgaaagattaggaggctcattgctgactgtggctttccaaatacttgcttcaagtccagatggaatcaatatgccaaacatggaatctgtggcagctgtgaactcccttttaacctcaacaatcctaaaagtcaaggatgctttgaattgcaacaacttggagtga

SEQ ID NO: 13907 - DNA, 648 bp, Glycine max
  Peptide Sequence Number=SeqID_130685
atggctaatctctcgttgttgctggcagttttggctctttcactttcagttgctttagcagctgataatagtgctctccaagatttctgtgtggcagacccaaaagggcaagtgctggtgaacggtttcgcatgcaaggatccaaaacttgttgaagcaaacgacttcttcttcagtggtcttcacatagcaggcaacaccacaaaccctaatgggtcaaaagtgacaccagccttcgcaactcagcttccagggttgaacactctcggcatctccatggctcgcattgactatgttccatggggcattaaccctcctcacacgcaccctcgcgccaccgaggttttaaccgttctggatggtaccttagaagttggattcgtcacttccaaccccgaaaaccgccacttcaggaaggtcttacagaagggtgatgtgtttgtgttccccacaggacttgtgcattaccagagaaatgttgggtatgacaatgctgtggccattgcagctcttagcagccagaatccaggactcatcaccgttgctaatgcggtgttcggggctacgccggatatagatggagacgttcttgttaaggctttccatttggacaaggctatcgtcagttatctacagtcaaagttctag

SEQ ID NO: 13908 - DNA, 417 bp, Glycine max
  Peptide Sequence Number=SeqID_130686
atgatgtccaactataaagacgttaaagaagcactcctgggtatgcaacctagtgtcgcaacctacccttcggcgggagggcgacgcggggctcgtgggtgtgtcttccaagaaaggaaaatgcacggagtcgccaccaacgttcatttgaggaaaacgtcggaaaaactggaaaggtgtggtctacgaactttaatcgtgaaaggttcgggagttgtttttacgcatggggaagggtgtttccctcgctcctacgtatcctcaattgcgatgaggaaatcagacctatgtagttctttcataagaactgaacgttggtgtcgcaacctacccttcggcgggagggcgacgcgtgactcgcgggatgcgtgttccacgaaaggaatacgcgcggagtcgccaccaacgtttatttga

SEQ ID NO: 13909 - DNA, 2052 bp, Glycine max
  Peptide Sequence Number=SeqID_130687
atggaggacgcggaagcggcgaacacgcttcgcattctggtggcgacggactgccacctcggttacatggagaaggatgaggtgcgccgccacgactccttccacgccttcgaggagatttgcgccgtcgccgagcgccaccgcgtcgacttcgtcctcctcggcggcgacctcttccacgagaacaagccctctcgctccacgctcgtcaaggccatcgagattctccgccgctactgcctcaacgaccgccccgtccccttccaggtcgtcagcgaccagacgctcaatttccagaacgcgtcagtttctccttctctccttgatgacacgtttggtcatgtgaactatgaggatcctcacttcaatgttggattgccggtatttactattcacggaaaccatgacgatcctgctggcgtggacaacctttctgtagtcgatattctctcggcatgtaatctagtcaactactttgggaaaacagttcttgggggttctggtgtcggtcagatcactatccaccctattcttatcaagaagggttcaacatctgtagctctgtatggtctgggaaacattagagatgaaaggcttaataggatgtttcaaacaccgcatgctgttcaatggatgcgacctgaatctcaggaagggtgtcaagtgtctgattggttcaacattcttgtacttcatcagaacagggttaaaacaaatccaaaaaatgcaataaatgagcacttcttgccacgcttcctagacttcattgtgtggggccatgaacatgaatgtttggttgacccgcaggaagttccaggaatgggatttcacatttcacaaccagggtcatcagttgctacatcacttattgatggagaatcaaagccgaagcatggaaatcaatatcgcccaactaagatacctttgatgtctgtgcggccttttgagtatactgaggttatactaaaagatgagccggacattgatcccaatgatcaaagttctattcttgaacacctagacaaagtggtagattactctggatttatgactataaatcctcaaagatttgggcagaaatatgttgggaaggttgcaaatccccaagacattctcattttctcaaaggctacaaaaagggccaaggttgaaggaaaaattgatgattcagaacgacttcgtccagaagaattaaaccaacagaacatagaggctttggttgctgaaagtaatctgaataaacttgctaaggattcagacaacgtgaagtttgaagaggaagatttaattgttaaagttggagaatgcttggaggaacgtgtcaaggaacgatctgtacactccaaggaacccacacagctcactgctgatgctcaaccatggaaggatttccaaggcagaagtgctgctggaactggaagtgcagtttcctttagtgatgatgaagatgccatgccagtatctagttcaaagccaagtactagaggtcgaaaagggtcatctggtgcgtctcaaactacaaccagaggaaggggcaggggaagaggaagaggtagaggttccagcaccatgaagcagacaactattgatggagctttagggtttcgcgtttctcagagggcagagaatggagggatggcattggaggccatgcatgttgcttgctgtcatatcaacttgcagctccgacttgctgctcagctattgttggacagagagagatgcaacatggagaaagagatgtctgcatcagttgctgcagcaactgccatccgaagtggtgctgacgatgataacttggcttctgcttcaagtgatgatgccaataaaaatgatgttgaagagatcgatgatagttcggaaaatgaatccaatctaccaggacagaagagggctgcttcaaagggaagaggtagaggatctacacagtcttctaaacgcggaaggaaatcagataactcttcaatccatagaatgctcgtgaacaatgatgatgacgatgacgatgacgacaccgacatcagaaagagattaaataagtctcaacctcgg

SEQ ID NO: 13910 - DNA, 540 bp, Glycine max
  Peptide Sequence Number=SeqID_130688
atggggatccatgggaaactaaaatttctcaaaacatatcacaacaaccttagctgtctaagtcgctacgtttttttcgcattcttctccccctcctcccccatttgtgcccttcacagataccacaccgtcttcttccctcactcccatccaaatcctctgtcttcgtcaccaccgccattgcttcctctcagctttccctcctcccctcttttcaccactcccgctccctctcctccaccgcagctccttctgatgttgtccttgttaattctaaggaagagttcaaaaatatcctcaccaaagtccaagatgacttgttgcacgccatattctatttcactacggcttagtgtggaccttgctcttaacccccctcatcttcatggttgtgctgccctggccctaattgttgatggtatttcctctgtcgcagtgactccaatccatcgtgccaaagtcattgccgtgacctctaacattgacgttcaggagttctttgtcgcgtcttgtttgcctgattctcggatcctttgttag

SEQ ID NO: 13911 - DNA, 210 bp, Glycine max
  Peptide Sequence Number=SeqID_130689
atgagcactgctttgtggatggctgctgcctccaagaaagatcatgaaagtgatccatctgctcaacattcacagcatgggcggacagctttgcatacagctgttaagactgacgatgttaaattggttaaggttattcttgctgctggtgttgatgtgaacattcataatgtgcacaatggcattcctctttcacatagccttagctag

SEQ ID NO: 13912 - DNA, 936 bp, Glycine max
  Peptide Sequence Number=SeqID_130690
atgactcctcaaacacattatacagctccagaggcttgggggcaacttctgaagaaatcattaaatttgttctgggatgatgcaataggtatatcagcagagtctgatgcctggagttttggttgtacactggtggagatgggcacgggttttgttccgtacatggatcaactcatcattcaatttttctttttctttgcattctgttgggctggtttaagttcggaggaaatttatcaagcagttgtcaaggcaaagaaactgcttccacactatgccagtgtggttggtggtggaatacctagtgatttgtggaggttgattggagagtgcttgcagttcaagccatctaaaaggcctagtttaactgcaatgttggcaatatttctccgtcattcgcagggaatgccgcgcagccttcctgcaagcccaaataatgatagagttgtcccctgtgcaagaattagaagtttctcagaaaaacccattccatcttcatcaattgatcttcttttcaaggctgcatcagactatggcagcaacagcctatcttctctgctggaagctcaaaatgctgatgaacaaactgctctccacttagcttgtagatgtggcagtgcagaacttgttgaggcaattttggagtatgaagaggcaaatgttgatgtcttggacaaagatggagatcctcctcttgcttatgcattagctgctggatccccagaatgcgttcgcagtcttatcaaaagaggtgctaatgtgaggccacaattaagagatggctttggcccatctgttgctcatgtttgtgcacatcatggccaaccagaatgcatgcgagaattactattagctggagctgatcctaatgcagtggatgatgaaggtgaatctatcctgcatagagcagttcccaagaagtgttggacattttag

SEQ ID NO: 13913 - DNA, 1344 bp, Glycine max
  Peptide Sequence Number=SeqID_130691
atggcgtggtctttccccttggttgatgatagtttggtctccgagacaatacctcgtcaccgagattatagatcatcttcacaaggcaaaaaagaagctttgagaaagaaactgttacattctgtgaatgagctagagaaattgaaaccgaaggtgcaacagaagatcaatgagtttaacagcaggcgagcataccaacacaatgggtgggaaaaatatcattcaaatgattttatggatttttctccagcaaaaaaggcagtcataccaaccactggagagtttgtttaccaaggatcaaggggccagcagttttctagtgcaaggcctgtggaagagaatatgaggagactatctctaagtctcccatgtccaaaggaggaaactctctctagacattctgttctaggtcccaatgggctgaaagggcagtggcgaccacctgcaagtgataaaggggttaggtatccaaccatcatagatctgtctccagttgaaattccaagccttcaacattccttggaagatggatctctgaataaaaaagataatagcatttcagaacaacataaatcagatttagaatcaattcttacccagagtgatgactgcaaggcaaaacatgctgatgaagctccttctcttatctcttttgaagcaacagaagtccatgctcaaatagaagttaccagacagccttctcctccacctgtacttgctgaagtaaaagatttggttcctgcagtgttatctcatgttaatgaggaaggatgtaagacagagattctaacatcagatagtattgttcgtgctgagtctccactgcaactacacatttcaacttctatgatggagagttttatgaagcttgccaagtcaaacactgataaaaatttagagacttgtggaatccttgctggtttgcttcttaaatcgtgggatattgattgctattttgctaatactactggtctgcagaaaaacagaaaattttatattaccgctctaataatcccaaagcaggaggcaacatccagttcttgtcaagctacaaatgaagaggagatatttgaagtacaggataagcaatctcttttctcccttgggtggatccacattatgctgccagaagctgttgcaatagttatggcaccaacagacagttcaagaagccatggcatttttcggttgacaacccctggtggaatgtcggtcattagacaatgccagcagcgtggctttcatccacataatcaacctccagatggtggtcccatttatgatacatgtacagatgtttacatgaacccagatttaaaatttgatgtcattgatcttcgatga

SEQ ID NO: 13914 - DNA, 582 bp, Glycine max
  Peptide Sequence Number=SeqID_130692
atgccgcacaaggttaaccctatcgacttcgaaaactccgaagggaatctggggctggccaatgcggtaatgcagcacctggccagcaaactgccggtatcacgctggcagcgcgatctgaccgattctaccgtgctgcgtaacctcggtgtcggcgtcggctacgcattgatcgcctatcaggccacgctcaaaggtatctccaagctggaagtgaaccgcgatcgcctgctggacgaactggatcacaactgggaagtcctggctgagccgatccagaccgtgatgcgccgctacggcattgaaaagccgtatgagaagctgaaagagctgacgcgcggcaagcgcgtggacgcagccggtatgcaggcatttatcgacagccttgagctgccggaagcagagaaagtgcgcctgaagcagatgacgccagccaactatctcggccgcgcgattcagatggttgacgacctgaatcacgcacgtcacgtggtggctgaggttcccctgccagtgcatcacagcggagtgttaatctgcggtttagctggcgtagcgtatacttttcgccatcatcactga

SEQ ID NO: 13915 - DNA, 2963 bp, Glycine max
  Peptide Sequence Number=SeqID_130693
tgatggtgagaccctatgcagcataccccatgacatgcaagaagaggtggcgaatggctttgaatgccatctctttcgtcaagactcttcaccatctctccaacaaagcttttcacatcaataccccaacccagctcttgcgctccttctcgtacctttccattggcgttgctccagaagaaccctccttcaacaacgttgatcccaaacttctcagcgatatggtgagggaaaaaagcagcgagtctctcacccaacttggaggcgtcaaagaactcgccaaacttcttgaaaccgacgtgaagcgtggcatcagagacattgataaccgaaaacgtgtcttcggtgaaaacacgttcacgaaacctccatccaaaggttttctttcttttgtcctagaatcttttaaagatcccactatcattattcttttggtttgcgctgttctttcacttggcttcggcatcaagcaacatggctggaaggatggatggtacgatggaggaagcatcatactggcggttgttctcgtcattgttgtctcttccgtcagcaacttcaaccaatctagacaattccagaagctttcagcgaaaagtgacaacttaggagtggaagtggtacgaggtggtagacgccaaagggtgtcaatctttgaggtggtggtcggtgacgttgcttacttgaagatcggtgatcaggttccagcagatggggtgtttttagagggtcattcgttgaaggtggacgagtctagcatgacgggggagagtgaccacgtgcatgtgaacggtgacacgaaccctttcttgttatctggcacaaaggtcactgatggttttgcacacatgcttgttacttgtgtgggtatgaacactgcatggggtgccatgatgggttccataacgagagaggtcaatgaggagacacctttgcaggtgcgtctcaacaaattgacttctgctattggcaaggttggtttgtttgtggctgcaattgttttggtggtgtctatgatacggtacttgacgggaagtaccagagatgactttgggatccgagaatttgttcggggaaagactaagtctgaggatgtcatgaatgcggttgtggggattgttgctgcggctgtgacaattgtggtggtggctattccagaagggttgccattggctgttactctgaatttggcttattccatgaagaaaatgatgagggataatgccatggttcggagaatctctgcttgtgagacaatggggtctgctacaacaatctgcactgataaaacaggtacacttacgttgaatgagatgaaggtgacagaggtttgggtggggaaaaaggaaataggaggagaagatcgttatttggcgccaagtttagttcaattattgaaacaagggattgggttgaataccactgcaagtgtttatcagccgcaacaaacctcgctgcctgaaatttcgggcagtcctactgagaaagcgttgctttcttgggcggtggtggatttggggatggacaatattgatgaagtgaagcagaattgtgagataattcatgtggagacgttcaactctgcgaaaaagagaagcgggattctgatgagggagaagagagggaatatgaatatgaatattcatacacactggaagggagctgctgagatgatattggctatgtgttcaaattattatgaccatacaggtgaagtcattgtcatggatgatggagaaagggttcagattgagaacattgtcaagggcatggcaaccaaaagtttgagatgcattgcctttgctcaaaagagctgtgaaaagcttgaagagacgggactaacgttgttggggatacttgggttgaaagacccttgtaggccaggagttgaagcagcagttgattcctgcaagaatgctggagtgaagatcaagatgatcacaggagataatgtgcacacagcaagggccatagcctctgaatgtgggattctttaccctaataatgatgaattggatgaagaggcagtggttgaagggtttcaattcagaaacttctcacacgaggagagaatggataagattgacagaatcagagtcatggctagatcgtctccatttgacaagcttctgatggttcaatgcttaaagcagaagggtcatgtggtggcagtcacaggtgatggcacaaatgatgcacctgctctcaaggaagcagatattggactttccatgggaatacaaggaactgaagtggcaaaggagagttcagatattgttatacttgacgacaatttctcttctgtggttaccgtactaaggtggggaagatgtgtgtacacaaacatacaaaagttcattcagtttcagctcacggttaacgttgctgcacttgtcatcaactttgtagctgctgtttcttctggcaaagtgcctctttcagctgtccagcttttgtgggtaaacctgataatggacactcttggagctttggccttggccaccgaggaacccactaatgatctcttgaagatgccacctgtaggaagagttgagccacttataactagagttatgtggaggaacctcatttcacaggcattgtatcaagtgcttgtcttgctgatcttacaattcaagggaagatcaatctttgacgtcagtgagaaggtgaagaacacccttattttcaatgcctttgtcctctgccaagtcttcaatgagttcaatgcaaggaagctggagaagaagaacatctttgaggggcttggtaaaaataagttgttcgtggcaattgtgggcctaactgtaattcttcaactagtgatggttgagtttttgaagaagtttgccaatactgagaggttgacttgggagcaatggggtgtttgtgttggcattggagctttgtcttggccaattggtttgctggtgaagtgtatctcagttggtcccaacaagtag

SEQ ID NO: 13916 - DNA, 168 bp, Glycine max
  Peptide Sequence Number=SeqID_130694
atgtgttcttcggagactatcaacatcgctgcgagtacacagaaacttgatgttgataatcgaattgctctccgcttctactacagaatcgccgataatatcctcaaacaggaagaggatggggacaaagatagggttcactgcgatattacaattttcactggttaa

SEQ ID NO: 13917 - DNA, 165 bp, Glycine max
  Peptide Sequence Number=SeqID_130695
atgggtccaaaatctaccccaagactcatgagaacccttgggtcttctcctacatctttggtccaatcttcttggggtcttctatccaatgcccttgggagtttttaccattacaacggaaatatcattttcaaatatgaagatcatcaaaacaagattgcataa

SEQ ID NO: 13918 - DNA, 351 bp, Glycine max
  Peptide Sequence Number=SeqID_130696
atgtctcagactaactgggaagctgataagatgttagatgtttatatccatgattacttagtgaagagggatttgaaagcttcagctcaggcttttcaagctgaagggaaagtgtcctcggaccctgttgctattgatgcccctggaggatttctgtttgagtggtggtctgttttctgggacatatttattgccaggactaatgagaagcactcagaggttgctgcatcttatatcgaggctggttcatacatagcatatttcttcttgcacggtaaatctgagtcagacagttgtgctagaagttcagtgaagaaaaagttgtgtcaggatgaactagcagttgattaa

SEQ ID NO: 13919 - DNA, 774 bp, Glycine max
  Peptide Sequence Number=SeqID_130697
atgctcttaaaaagcaatgttctgatgaggtttggattcaaggctcgacggagggtttttatttcactgcgaaaccagcaggggctccaattcctactcttagccgcagatctctcagggcttgcatcttctcagttgggattagggggatttaatcctttggaaaattggaagtatttagggaatgttctaatcgagatgtacacatcaaggaagaaaatccacaaggataaggatgctgaaccaactgagtttgaagagtcagttggacaggcattgtttgatctggaaaataccaaccaggagcttaaaagtgatctgaaggatttatacataaactcagctgtgcaagttgatgtttctgggaaccgcaaggctgttgttattcatgtcccttacagattaaggaaaggtttccgtaagattcatgtcaggcttgtcagggagcttgagaaaaagtttagtggcaaggatgtaatcttggttgccacccgaaggattttgaggccaccaaagaagggttctgctgctcagcgtcctcgtagtcgcactcttactgctgttcatgaagcaatgctggaggatgttgtattgcctgctgagattgttgggaagcgtgtgaggttccgaattgatggatccaagattatgaaggtttacttggacccaaaggagcgaaacaacactgagtacaagttggagacttttgctgcagtgtacaggaagctatctggaaaagatgttgtgttcgagtatcctgtctcagaggcttag

SEQ ID NO: 13920 - DNA, 1590 bp, Glycine max
  Peptide Sequence Number=SeqID_130698
atggatgttgactttgttagcactaaatttcttgatttcaggcaagttttgcatggtgctgctggtgcaatgtcttcacaagttcaagctcgtagtcagcaattaccaggatctactcctgatataaagagtgagatcaatcctgttttaaatcccagagctgcagctcctgaaggatcattgatagcaatgcctggtattctttcaacatgtccttactctaatgtaactggttcgaatcaaggtagcaataatttgactctgaaagggtggccgctcacaggcttggagcaactacgttctggtctactccagcaacaaaaacctcctttcatacagtctcctcagccatttcatcaacttccaatgttgacaccacagcatcagcaacaactaatgctagcacaacaaaatttggcatctccatctgcaagtgatgataatagaagactcagaatgctgctgaataataggaatatcggtgtaactaaggatggtctttcaaaccctgttggtgatatagtatcaaatcttggatcacctcttcaagcaggtggccctgcttttccacgtagtgatacagatatgctaatgaagttgaaactggcgcaattacaacatcaacagcagaatgccaatccacaacagcagcaactgcaacagcatactctttcgaatcagcaatctcagacttcaaatcatagcatgcatcaacaagataaaatggggggaggtggtggcagtgtcaatgtggatggtagcatgtcaaactcctttagaggcaatgatcaggtttctaacatggtttcttctgaatgcacttttaaggtttccaaaaaccagactgggagaaagagaaagcagcctgcatcttctggtcctgccaatagttctggaacagctaatacagctggtccatctccaagttcagcaccctcaactccctcaacacatacacctggtgatgtgatgtcaatgcctgctttacctcacagtggtagttcttcaaagccattaatgatgtttagtgctgatggctctggaactctgacatcaccttcaaaccaattgtgggatgataaggatcttgaattgcaggctgatgtggaccgttttgtggaggatggatctcttgatgataatgtggagtcttttttatcccatgatgatacagaccctagagatactgttggtcgttgtatggatgaagtggtccaaggaccttgggtacacccaggatgttgcattgcatgtttcacattttctgaaataaattctgtacgtgcaagcactaacaaagttgtctgttgccatttctcatctgatgggaaattgcttgctagcggtggccatgacaaaaaggctgttttatggttcacagattctctaaaacagaaagccactcttgaagagcatgcatatttaatcactgatgtccgtttcagtccaagcatgcctcgtcttgcaacatcttcatatgacaaaactgtcagggtgtgggatgttgaaaatgtcataaggataggattttctctgcctctgaattgcaattggtcatcttttactgaaactttgtacatactgaaataa

SEQ ID NO: 13921 - DNA, 618 bp, Glycine max
  Peptide Sequence Number=SeqID_130699
atgaaatggagaaaagcatcgggggtgttatgtgatgcaaaggtaccgatcaagctaaagggaaagttttatcggactgcggtaagaccggcgattttgtacggaacagaatgttgggcggtcaagagccaacatgagaataaagtaggtgtagcggagatgaggatgttgcggtggatgtgtggtaagactcgacaggataaaattagaaacgaagctattagagagagggttggagtagcgcctattgtagagaagatggtggaaaatagacttaggtggtttgggcatgtagagagaagaccggtagactctgtagtgaggagagtagaccagatggagagaaggcaaacaattcgaggcagaggaagacccaaaaagactataagagaggttatcaaaaaagatctcgaacttaatgatttggatagaagtatgagttttgacctcatcaatggaaagaggttcaaacttactgcatatcaaagacacagtggactcattcatgaggtagcccttcaaaaatcacatcaagatgctcattcgaggaaaccaacactccaatcaaaccaagggaatcaactagagtctgaatctgaagcaaataatcagatctga

SEQ ID NO: 13922 - DNA, 447 bp, Glycine max
  Peptide Sequence Number=SeqID_130700
atggcttctgcaatcaacaattctgatcctcctcctcctccaccaccaacttcaactccagtggttgattcttctattccggtgaatgtgacggggaatgcgacagagattcctgtttctgcaacaccaatccaaacagtgttaccaatggcgacaccaattccacagccgattctgacgactactccgactagtgcaaccggtgtgacaccatcgccgcaatcctctacttccttctcgcattcaatttctgcgaagttgacaaattccaactacttgttttggtgccagcaagtagagccagtgctgaaagtacatcgtcttcatcatttccttgtcaacctgacaattcctccgagattccaaacccttgttgatcgcaatcttggaatttcttctccagagtaccttgcttgggaatcacaagatcaactcttgttaccctag

SEQ ID NO: 13923 - DNA, 207 bp, Glycine max
  Peptide Sequence Number=SeqID_130701
atggtatcagagcttattctagatccattaaatgggccacccatcatgtcgtccacgcaccaatcattggagctctggaacatgactgagaacaagacgatgactctatctgctcatgaaggtcttattgcggcattggcggtttctactgtaaatggtttggttgcttcagccagtcatgacaagtttgtcaagctctggaagtga

SEQ ID NO: 13924 - DNA, 2103 bp, Glycine max
  Peptide Sequence Number=SeqID_130702
atgggagaaggaagaagaagagggacttcaaagctgagagaagcagcaaggaaggtggctgtcgcagcagcatatgcatgtggctcattctcaaggagaaaggctttgctggatccagtctccattgacacctcttgtagtctatctgccactgcctcaaattcctcatttgtgtccccatcaacaacaaaaaattcttcagaggaggtaatggaagaaacatattcttgtatcactaccaatatcaacaatgagcttcaaagtaagagaatagcaaaggtggtgtatagaggatactggcatgtgaatgcccctgcacatggcacattagtgaagccaagaatcaattcatttaatgcagaccccacgttgggaagtttcacctgccacaacatgcatgatcatacttttccttctattgtcgtgaaaacctctctggacaaagtgtttgagatcactttgaaattatgggagttattcttttcttctcttggtaatgttcactgccataatttgtgtgcaatatgtttagatcctctgagttaccaaagcaagggcagcagtccaggccaagctatattcactgctcagtgctctcacgcattccattttgcctgcatctcttccaatgtccgccatggtagtgtcacttgccccatttgccgtgcccattggacccagctcccacgcaacctaaacaacaaccttggtcctttcacttctagtaaccaaagtgaccccattcttcgaatcctcgatgattctattgctaccttccgtgttcatcgccgttctctcttgcgctctgcgcgttatgatgacgatgatcctgttgagcctgatgaaacacatgagagtccaaagctgggtttctctcttgtgcctattccaccaaatgcaccaaccggttaccatccagctttgcaagtgactaaacatgcctcatgtccttgccatctatcccttcatcctctatcttgcagttcctcatcactgttacaatctccgcccatgcaaacaccttatatcatgtgtccctcttccaatagagcttatctctctgtgaaactgacccatgaacgtgccactgacttggtcttggttgccagtcccaatggaccacacttaaggcttctcaaacaagcaatggctcttgtggttttctccctcagacacatagaccgcttggccattgtcacatactcctcagccgcagctcgtgtctttcccttaagacgcatgacatcctatggaaagcgcaccgcccttcaagtcatcgaccgtttgttctacatggggcaatcggatccagttgaagggttgaagaaaggtatcaagatacttgaagaccgcgtgcacaagaacccggagtcatgtatcctgcacttatcagataatcctacaagaccataccatgcagtaagcatggaactgccatctacaccaattcatagatttcatgtggggtttggctttggcacttctagtggatttgttatacaagagtttgaggagttcttggcaaagatgctgggaggcattgtgcgcgaaatccagctgagaatatgtggggctggggaggaagttggcagtggcagagtcataagaataggagagataagaggtggaaaagaaagaaggattctgttggacctgggtgatttcactcatgtgtatgtggaatatagctacattgaaggggaaattgatgaatgtgttaggaggacaggggaaactgttgtaggtgttggagaacataaagatgatgttttagaaaatggtgaggaaacagtgagggatatgaacacaggtggtggtaggagtagcagtgttgaaagctgggactttcatgatccttacatggccagaagatgggccaagcatttgcatgtagaaacttccaattcagtaggaagtttgtgcaatctttttgtggagggaatccaccaaagagaagaagtggtggtgctcaagttgcttctttcagcctattggagtttagtggtaaacaagatagttcaagctcaatccattgttaaggttaaaataattgcactaaaaattgtcaacggaaaacttgagagggggggagttgcagagtga

SEQ ID NO: 13925 - DNA, 1731 bp, Glycine max
  Peptide Sequence Number=SeqID_130703
atgtgtgtctgtcaacaccgccgccgcatttgtcagcccagttttcgtttcctgaggcatttcaaagctacaatttccaccgacccagaaaaaggtttggtgaaaaatgccaatggggttctcgtttcaaacaaaggaacccccttaatacccaagaatttgagtttaaaaccaaggtcttcggatgatgcactccacaaacgcaacgcggagataacgattcacggtcgccccggcaagctcgaagaagcaaagaagctgttcgacgaaatgcctcaacgagacgacgtttcttacaactccatgattgccttttatttgaagaacagggacatacttggagctgaagcagtattcaaggcaatgccacatagaaacattgttgccgagtctgcaatgattgatggttatgttaaagttggtcgtttggatgatgtccgtaacgtgttcgacagtatgacccatagcaatgcattctcctggacaagtttgatttctgggtattttagttgtggaagaattgaggaagctttgcacttgtttgatcaagtgcctgagagaaacgtggtgttctggacttcagtggttttgggttttgcttgcaatgcattgatggatcatgctcggaggtttttctatctcatgcctgaaaagaatatcatagcttggacagctatggtcaaggcatatcttgacaatggctacttcagtgaggcttataagctcttccgtgaaatgcctgaaagaaatgtacgttcttggaacatcatgatctcgggttgcctaagggtcaatagaatgaatgaggctatagatatggctgcatggactgcaatgatcactgcatgtgttgatgatgggctcatggatgaagtttgtgagcttttcaacctgatgccacagaagaatgttgggagttggaacacaatgattgatggttatgcaaggaatgatgacgtaggagaagccttaaggctattcgttttgatgctaaggtcttgctttagatccaatcaaaccactatgactagcgtggtaacttcctgtgatggcatggtggagctcatgcacgctcatgcaatggtcatacagcttgggtttgagcacaacacatggcttacaaatgctcttattaaactttattccaaaagtggggatctttgctctgctaggcttgtttttgagctactaaagtcaaaagatgtagtatcatggactgccatgatagtagcctactcaaatcatggacatggtcaccatgccttgcaggtattcacacgcatgctagtatcaggaattaagccagatgagatcaccttcgtgggactcttatcagcttgtagccatgttggtcttgtcaaccaaggtagaagactgtttgtttcaatcaagggtacatataatttaaatcctaaagctgagcactattcctgccttgtagatattctaggtagagcaggacttgtggatgaagcaatggatgtagtatccactatccctccttctgagagggatgaagctgttcttgtggcattgcttggtgtgtgccgtcttcatggggatgtcgcaatagcaaattccattggtgagaatctattagagatagagccatctagttcagggggatcacatccccagattgaggaaatttacgtattgttgaaacagaatcttcaacctttgatgagggaaatgggttgcacaccagagaacttgctactcgtagattaa

SEQ ID NO: 13926 - DNA, 309 bp, Glycine max
  Peptide Sequence Number=SeqID_130704
atgaccagtcagtgcttgctacagccactcccagcctcagctgctacctaccctggagtttgtttacactccaaaggcagcttggaaataactgtcattgcaatgttgacttctttgcatgaggatgtcacacttttccttgtccatcagggtgaaggcaataaaatctctataaagagtaaagacacctatggaggagggggacatgggaaaatgacaactgttgtagaagagacagaagcactccttggcttaatggcagtggcaccattgccaaaataccagttaaatcaacctggttatgaagag

SEQ ID NO: 13927 - DNA, 453 bp, Glycine max
  Peptide Sequence Number=SeqID_130705
atggaacggaggaagaataagagagcaagagaagatgatggagttgagattgagtcttcttttgagaattataacaacaatattgcaaagaaggagaagaatgaagtggaggagaaagactgttccaaggcatgggattactcccatttgacaatgggagtgtttgatttcccttggatgaaggatggtgtcatatccaaatcatatgaatgcttggattttgaagacgattcctggtcatctctagaacgccaagagactttattcaaagcttcaggtattgatttctctgaggagtatggcttgtgtgaaactccagaggcatcaatggctcatattcaagaagccaagttggttgaggatatgtggaagccatttgagagtaatgggttggagctggaggcggaagatggagattgtatttggagctttctgctcaataagcctctttga

SEQ ID NO: 13928 - DNA, 648 bp, Glycine max
  Peptide Sequence Number=SeqID_130706
atgaaggttgtaaacctctcgagtgaactagtttcctcttaccactgtacggttctaggagttgggaagtcttgtcttctacttcaattcacggacaagcgctttcagcccgtccatgacttgaccatcggtgttgaatttggtgccaggatgatcacaattgataacaagccaatcaagttgcaaatttgggatacggctggtcaagaatcattcagatctattacaaggtcttattatagaggggctgcaggtgcactgcttgtttatgatataaccaggagggagacatttaatcacttggctagctggttggaagatgcaagacagcatgcaaatgcaaatatgactattatgctgattggcaacaagtgtgatcttgctcatagaagggccgtaagcacggaggaaggcgagcaatttgcaaaggagcatgggttgatctttatggaggcctctgcaaaaactgctcagaatgttgaagaggcattcataaaaacagctgcaaccatatacaaaaagattcaagatggagtttttgatgtatcaaatgagtcttatggaataaaagtaggatatggtggaattcctggaccttctggaggtagggatggcccttctgcttcggctggaggctgctgcagttga

SEQ ID NO: 13929 - DNA, 1032 bp, Glycine max
  Peptide Sequence Number=SeqID_130707
atggcttcatctgggaatccaaatccacagctgcagcaaccacaacaacaacaaaattttgatttcaataagcttttcaaagcaccaacaacatcatcaccatcaacatcaacatcaccctctatccctaacccttcaaatttgaactcttcaccatcattccctgctccttctccttccacaccccctccttcttcctaccctaccccttcttcctcttaccctccaccaactggcacatacccttatcaccatcctcactttctcccctatccagcccttcaccaccaccaacaacaacaccaagaacaccctcttatccttcaccatcttccccaaatgcatgcccctcaaagaccccctatttttcaaccgtctccctcctcaccacaccttccttcatcccccaatccccccactggtgcacgcctcatggctttgttgggcacccaaaaccctccctccaatcaggaaccatcgcttgcgtattcatctccctctgccacagtcccatcacctgtggtttctgatttctcagtgccaccaaacccttcagggttgccctccacacagccctcaggctctcctgtgaatctggctagtccgcagtccacaccaaccaggatgctcagcaccaagatgccgaaggggcgccacttgatcggagagcatgctgtgtatgacattgatgtgagggtccctggtgaggtgcagcctcagcttgaagtcactccaatcaccaagtatgcctcggatcccggcctcgtgctcggccgccaaatcgcggtgaataagtcttacatatgctatggactcaaactcggggccatccgggtccttaatatcaatactgcattgagatatctgcttcgaggccatactcaggtgtgttgtgtcgcagttgcatatgacctgattatgaatgcgatggctgctcacccttttcatgtttggcattttccattaacattgtatcagcttgatgtgtttaagtgcccttgtgccttagacaaattggcaggggtagtatga

SEQ ID NO: 13930 - DNA, 3072 bp, Glycine max
  Peptide Sequence Number=SeqID_130708
atggctttcttcgctgaggatcttcacctgttggctagtattatgtttattgattattttccccttgaatatgatcgtgttcacagtgctagcacggatgggagaatatttatatggaaaatcaaggagggccctgatgaggacgacaagcctcaaattactggaaaagttatcctagcacttcaaatattaggagagagtgagtcagttcatccacgagtatgctggcatccccacaaacaagagattttaatggttgctattggaaaccgtattctcaaaattgacagcatgagagctggaaaaggtgaaacattttctgcagaggagcctctcaaatgttccattgataagttgattgacggggtgcaacttgttggtaagcatgatggcaatgtcaccgagttgtcaatgtgccaatggatgaagagtcgattagcttcagcatcagctgacggcacggtgaagatatgggaagaacgtaaggcaacaccacttgctgttataagaccacatgatggtaaacctgttaattctgtgacgttcttgactgcgcctcaccgccctgagcacattgttcttatcacagcggggccactaaatcaggaagtgaagatatgggtttctgataatgaggaaggctggctattgcctagtgattctgagtcatggaattgtattcagactctggatataagaagttcgtctgaagccaaccctgaagatgcattctttaatcaagttgtagcattgtcccgtgctggtctgtatctgcttgcaaatgccaagaaaaatacaatatatgctgttcacatagagtatggatccaatccaactgctacccgcatggattacattgctgagttcacagtcacaatgcctatattaagtcttactggaactagtgatagtttaccagatggtgagcatatagtacagatatattgtgtccaaacacaagctattcaacagtatggactcaatttgtcacaatgtttgcctccacccctggacaatgttgagcatgagaaaacagaatccaatttatctcgtgcttttgatgctttggatggatctatggaaactggaaatatgccacaagttctttctggcagttctgaaagtgctcctgtcgtgagcgctgctatgaatttgccttcatcagatatttctgggttacctgaagcttctatatcttcagattcagagaccaagtcaaatgatttacctcctcgtaatggttttgaacatatccacactgctccacctccacttcctcagagtccaagattgtcccagaagttatctggtttacaaaattcatcaaataatttagagactagttcaacaagtgctgatcacagcagtgaacagacaaatcttgattcttcagctgaacggagagtagaatctgaaaaagatatggcagatgtacctggatcaggtgacaatttgcgaaaggatgataaagttgttaataatgatgtttctgtggtttctaatacctctacaacatataagcacccaacccatttggtaactccatctgagatattctctaatgcttctttatcttctgatacttcccatacttctcaaggtatgaacgttcaagatgtggctgcccatagagatgcagaaaactctgaagtagatgttaaagttgttggggagagaggttctattctagaaaatactgagtatgaaagagacagagacttgcacacgaatgttgctgagaagaaagagaagttattctattctcaggcctccgatctgggtattcagatggctagagagacctataacatagagggagctcgtcaagctgataatattaagaccatcgatgcacctgatcaaagtggtaactctgttgaggaagaagttcaagacacaagaaaggatttacctgcaaacatcagtgaatcagaaactgtggctgctgctgtgcaatctcctgcaccttctgcaaaaggtaaaagacaaaaaggaaaaaattctcacgtgtctggtgcatcttccacttctcccagtccttttaactcaacagattcatcaaatgatcaaggtggcaattcaggagggtcatccatggagcctgctttaccacagttatctgctatgcaggagatgatgagccagttattaagcatgcataaagaaatgcaaaagcagatgaatgcaatggtttctgccccagttactaaggaaggcaaaagattggaaggatccttgggtcgaaacatggagaaagttgtcaaggctcacactgatgctttgtgggctcgattgcaagaagaaaatgcaaagcaagagaagttagagcgagaccgtacacagcaaataacaaatttgatctccaattatgtaaacaaggatatggtatctatattggagaaaatcattaagaaggaaatatcttcgattggaacaaccattactcgttcaattagtcaagttatagagaaaacaatatcatcagctattacagaatcattccagaagggggtgggagacaaggcattgaatcagctagaaaaatcagttagttcaaaacttgaagctacagtggctaggcagatacaggcacaatttcaaacctctggcaagcaagctcttcaggaagcactcaagactagtgtggaagcttcagtcgttcccgcatttgagatgtcttgcaaggctatgtttgagcaaattgatgttgcatttcaaaatggacttgggaagcacacaactgctattcaacagcagttcgattctactcattctccactagccatgactttgagggatacaattaattcagcatcatcaatcacccaaactttgagtggacaattggctgatggccaacgtaaactgttagcaattgcaactaactccaaagtagctgcagatccctttgtagcacaaatcaacaatggcttgcatgagatgactgaggatcctaccaaagaattatcaaggttgataagtgagggcaaatttgaggaagcatttacgggagcccttcatagaagtgacgtttcgatagtttcttggttatgttctcaggtaattgggtaa

SEQ ID NO: 13931 - DNA, 1122 bp, Glycine max
  Peptide Sequence Number=SeqID_130709
atggagtttcgcgtttccgtcatttggagccttctcctcattgtctctttattctctcctgaaatcaagggtgaggcttctggttccgtcttcttcgtcgatagctccagtaatcaattccttcgcgctagatcatccaacgatgagcaaccttcaatgttgcttcaagaagttggtgctgctgtgtcagtcttgcttggttttgcacctccttccaccttttctgctgccagctcatccaagttgaatgaggttctaattcctaacccattcaagaggccccgtgctgtgtttttgctggaagtaaatggaatcaatggtctctggccttctcttggaaaaattgtccaggataatccaatgttcagcaattcattttggagtacaaattcagataaagttggcattcaacttccagatgaaactgatgtttctgtggtttctttggatgaacaactggaagactggactgacaaagaaattagtgatttttcttctttgataggtgggtcatatgctcctgatgcccttgagccattaaatggagtgcttaccattccattggcaaatggtgcctcagtgaatctccatatgtcaaagaaagcagaaaggaagttcatcgtaggtcttatgtctctcacacataatgtccaaagagcaattcaaatgcatgacaatttatcacagagtgcaaagggtcctgctgagttgttaactggatgctttaatggcattaaggttttgcaagagcaatatgaaactgaaagtattgctcagcatggagttgaattgttgtatgcaactatgacaaagatatttagttcattgcaagaagcatacaaaggtcaaattgttggaattatatactgtcatgtggccactactcaagagtcgggcaagaagtttgatgtgatctttactcctcaccatccgtatgctcgatggttggcagaaacaaatgcagtgaatgcaacattgccagaagtggtgctggttaggagaacccttgcttgggtaacaggaataatattgctcatttcaacctttatggggatatgctacctcatgaatatgccgcttacaagggacacgcttctatattctaatgtcaagcttgattag

SEQ ID NO: 13932 - DNA, 783 bp, Glycine max
  Peptide Sequence Number=SeqID_130710
atgaggccgccacatctcctccacctccgccgccacttcgccacaaagtacactgccaagataacctcaaccaccgccacaggccgctccctcgcggcggaagtaaccgttccgccgcccctcccttctgacccgcgcggctacctcctcccccggcgcgacctaatctgcaaggccacccaaatcctcctctccccaccttccccctccaccaccctctccgaccccttctccgacctctccgactacctctcctccctctccctctccctcacccctctcgaagcctccgaaatcctcaaggccctcaaacacccctccctcgccctccgattcttccaattttgtccctccctaaaccctagcttccgccacgagtccttcacctacaaccgcctcttcctcatcctctccaaatccaccaaccccgcgcgcttcgaccaggcgcgctcgctcctccatgacatggaccgccgcgctgtccgcggctccatctccaccgtcaacatcctcgtcgggttcttcggcgccggcgaggacttggaacgctgcgtttcgctcgtcaagaagtgggacctgaggctcaatgcttacacctacaagtgcttgcttcaggcgtatttgagggccctggattcttctactgcgtttagggtttacttggatatgattaggcatgggtataggttggacatttttggttataacatgcttttggatgctctggccaaggatgaaaaggctctaggagaggcttgtatggatagattgatggacatctaa

SEQ ID NO: 13933 - DNA, 781 bp, Glycine max
  Peptide Sequence Number=SeqID_130711
ggctggaagagtagacattgctgttaaattttttgaagaactagagaacagcgattgtaagcctgatgtcatttcctataactctttgatcaattgccttggaaagaatggggatgttgatgaagctcacatgagatttaaagagatgcaagagaaaggattaaatccggatgttgtgacttatagtacacttattgagtgttttggcaagacggataaagttgagatggcgtgtaggttgtttgatgaaatgcttgctgaagaatgcactcctaacttaatcacatataacattttgcttgactgtcttgaaaggagtggaagaactgctgaggcagtggacctctatgcaaaactcaagcagcaagggttgacaccagattcaattacgtatgcagtgcttgaacgattgcaaagtggtggacacgggaagttgaggtttcgccggcagaatcctattactggctcttcgctatgcgaaggtatgggggagggatattgtacgcagccttacccttgcatatgcaaagaggctgtttccggattcgaatccatgaccaacaagtcaccaaggcacaactttaccgctgcaccagggctcgccctcaattgttcattttatgattatggccatcggatgaacttggttgcaaccagatgcgctgcttcaagtgcagtggctaaagcatgctccagaacaggtagacttgcaagtttgttaggaacaaactcaagttttcctgcattgggatttggaactttcctcttgggaatcccatga

SEQ ID NO: 13934 - DNA, 1428 bp, Glycine max
  Peptide Sequence Number=SeqID_130712
atggaatctgcgcttacagcttctaactggaaccgttctttgattcggattcgccacactaggccacgcttcgttgccactcgccccacagcaatacggtgctccatcaactcgtatcgcttgtccaacctcactccctctgagcttcagagcctcaagagccgacctcgtatcgatttctcttccattttcagtgttgttaaccccattgtcgatgatgttcacaaaagaggggatgctgcagttaaagagttcgtctcttcttcattcaatctcatctatgatcttgttattgttgtgtgtggcttcttaacttctttgcttatcttgatccacctattaaggaagctttcgatgttgcctacgacaatatttatgcatttcatgctgctcagaagtcacccgagaaaaggagtccaatgcaagagagttgcaagaagtattaactccgtgggtctttatgttccagggggaactgctgtattaccttcaacagctttgatgcttgcagttcctgcacaaattgcaggatgtaaaactattgttcttgcaaatcctccaactcgggatggcactacatgcaaggaggtactgtattgtgcaaaaaaggctggggtgactcacattctcaaagctggaggagcacaggccatatctgctatggcttggggaacagaaacttgtccaaaggttgaaaagatttttggccctggaaaccaatatgtcactgctgcaaaaatgatacttcaaaacagtgaagccatgatttcaattgacatgccggctggtccatctgaagttttggtcattgcagacaagcatgcaattccttctcatgtagcagctgatttgctttcccaggctgagcatggtccagatagtcaggttgttcttgtgattgttggagatggtgtggatctgaatgcaatacaggaggaactcagcaagcagtgcgagagtcttccaagaggcgagtttgcctccaaagctctgagccacagtttttttgtgtatgcacgtgatatgcttgaggctatcaatttctcaaacttatatgcacctgagcatctaattatcaatgtgaaagatgcagagaagtgggagagtttcattgagaatgcagggtttggaggagtggggatggactcttgttctgtgtttttagggccttggacacctgagagtgttggtgattatgcaagcgggacaaaccatgtccttcctacttatggctatgcaagaatgtatggtggtgtgtcattggactccttcctgaagtacataactgtgcagtctctttcggaggaaggtctaagaaggcttgggccatatgtagcaaccatggctgaagttgaaggccttgaagcccacaagagagcagttaccttgagacttcaggacatagaagccaggcaggtttcaagatga

SEQ ID NO: 13935 - DNA, 1794 bp, Glycine max
  Peptide Sequence Number=SeqID_130713
atgcagtttgaaagaggctctatggcgaggtgctacatgacgccgcctccacagccgccatcgtcgtggaagccgccacattcacagtcccccagtgtgccgttttcagagagaaaaaaatcgccaaattctgcgaataaaattgatctttttcatataattcacaaggttcctgctggggactcaccttatgttaaagccaagcaagttcagttagtggataaggatccgggaagagcaatttccttgttttgggctgccatcaatgcccgagatcgtgttgaaagcgccttgaaggatatggccttggttatgaagcaattgaataggtcagatgaggcaattgaagctattcgatctttccgtcatctttgtccgtcagattctcgggattctctggacaacattttggttgagctgtataagaggtccggaaggatcgatgaagagatcgccatgcttcatcacaagttgaagcaaattgaagatggcttgacctttgtgggaaggactacaaaacaagcaagatctcaaggaaagaagattcaaataactgccgagcaagagatatcgaggatattgggaaatttggcctgggcatacttgcaaaaaggagactataaagcagctgaagaacattatagaaaagcattgtcttttgaggttgataggaacaaacagtgcaatctggctatatgtttaattcatatgaacaagatcaaagaagcaaagtttctactccaggcagttcgcactgctacaaaaaatagaaagatggatgattcctttgccaaatcattcgaacgagcttctcagatgctaattgagatagagacatcatcatcatcacagaatgcagcattttcaatgacgactatgtcgcagtgctctccacaaagctttgagaactcgattagaaagagctctgatagagttcagagtgggtcagaaagccggtctgagacctctgagggggatgtacctcatgctaggaggagattgtaccagtcccctgatcctagtagaagagatcttagtgttccttgcacaaaaccaaaaagatgttcatggggattcaatactggatatcgaagggaagcttggggtgatgtcaattcagattataaaccttcatttgggactcctcctaatgataagcatgccacaaggatgctaaactcaagagaaaatggtttgtcttctcctgccaatgggaagtggagggcaatgacattggaagaccaggctatactaaagcatgaagctacaacagcaacaagttctgattcgttgcatgctttgaatacggaagtagctatggagtttactgagaaggagaaatctgctgcagatgacagtagctatagatcaatactgtcagaatcacatgtcacagttgtgaatggtgccaatgagtttgcttcaggaaaaagaaaacctgagaagaaaagttgggctgacatagtagaagaagaacaaaatgaagaatatgacttcttgagtggtttcacaaattttgatgataagaatggtgcagaagtttttaatgatgaaaatgaagactccaacataatctatcctagttcttggctacagaacctgcctgaatggtcaaacaaaaagcttgaatcatcggataagaaagatgactatgcatctgagagtaccattctgtcaaggaatccgactgcaaggcgttctttgtgtttcaacccggaactgattggggagaagaagctaactaggagaagcaggttacaggatcttatggatggagaaggatcacattgttaa

SEQ ID NO: 13936 - DNA, 165 bp, Glycine max
  Peptide Sequence Number=SeqID_130714
atgatgaagtattacacgacatctatacaaccttcaatgaaaagagaaaacgcatgtaatgggaaaaagatcacagattcacaaggctggggcgttggatctataataagggatagtgatggagttgttggaagcagcaacttggtgcataccaagataatgtga

SEQ ID NO: 13937 - DNA, 348 bp, Glycine max
  Peptide Sequence Number=SeqID_130715
gtacttggagatatcatagagtctctggctggagcgattcttgttgattcaagattcaataaggaggttgtgtggcaaagcataaggccacttttggaaccccttgtcacaccagaaacactgaagctccatcccatccgagagttgaatgaactgtgccaaaaaagaagttataagattgtactagaggatgtgtcccgcaaagatggtgtgactaattatagaatggagctagaagcagatggggtcattcacgagtatgagtataccggccctgctcttagggacacagccaagaagatagcctgcaaggaaattttgaattccttgaaggaagaagaattatag

SEQ ID NO: 13938 - DNA, 381 bp, Glycine max
  Peptide Sequence Number=SeqID_130716
atgggcaaggtcaagatcggaatcaacggatttggaagaattggccgtttggttgccagagtcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccttctcttcggtgacaaggcagtcactgtttttggacacagaaaccctgaagagatcccatgggggtcaactggagctgacatcattgttgagtccaccggagttttcaccgataaggacaaggctgccgcacatttgaaggtttctacttcaagcactgcctgttacagctattaa

SEQ ID NO: 13939 - DNA, 132 bp, Glycine max
  Peptide Sequence Number=SeqID_130717
atggaaactagtggcagtcatgggaagatgagcatacctcaaacaattgggcaaattgtttcagaaagagagagtatagtaactgaaaggaatgagggttgcaaatttacgaggaacaaggcaagatcgtag

SEQ ID NO: 13940 - DNA, 873 bp, Glycine max
  Peptide Sequence Number=SeqID_130718
atgttcaatatgagatttgtatctcaagattgggtggtttcatgtgcactaatacttctggtgtcatgcacaacatactcatcagcttctttggggaaacctgagaacaacataaaaacatctgtttttctatcacccaagattgagctaggtccaggaggccatattgcactcaagagtttcaatgctgaattggttgatgagtcagggaaatcactgcctctccaagaaacctatctccatcactgtggcttttgccaggatggtcctcttatccagtattttggtcttggatcagaaacaagaggaactgccactgatattccagacccttttggaatagaagttggaaacccttcagatattccatatggatatgatgagaaatggttgatcaacgtgcatcccattgacacaaggggtgtggaagataggttggggtgcattgagtgtaggtgtgacctttataatatcacaaaggatgcagatggtaaccctttgagtccagattataagggaggtttggattgttgccctgataataccacgtgcaggctaaacaaaggcttcaagggtccaaagagaaccttataccttaaatacacagtgaagtggttcagttgggacaactacgtggtgccccttaagatttatatacttgatgtgactgatgttttgagcgtgtccaaaggagtaactccaatgcataattgcgaggttgagtatcaggttgaaccttgcagcaaaggctacagtagtagtgcttgcattgatgtcagaaaaacaagcttcccaatgcaaaatggtggatatgtaatctatggtgtaggtcatcagcatgtaggtgcaattgcatcaaaactatacggacag

SEQ ID NO: 13941 - DNA, 1368 bp, Glycine max
  Peptide Sequence Number=SeqID_130719
atgcatcagttggagaccaccacacctcacttcattcgctgtataaagccaaatactaagcaacaacctggagtatatgatgaagatcttgtgctacaacagctcaagtgttgtggagttttggaggttgttaggatttcaagggctggatatcctactcgaatgacgcatcaagagttttccagaaggtacgggtttctgctttctgaggcaaacacatctcaggattcattgagcatttcagttgctgttttgcaacagtttaatatccctcctgaaatgtaccaagttggcttcaccaaactgtatcttcgaacagggcagattggggcactggaggataggagaaaacatcttttgcagggaatacttgggattcaaaaaagctttcgtggttatcaagctcgtcgtcattaccatgaacttaagaatggagtgactattttacaatcatttgttcgtggagaaattgcaagaagggaatatggtgttatggtgaagtcttctatgactatttctactgaaaatattaaggagatagaggcagccacaacactacaatctgtaattcgtggctggctggttcggaggcatgctagtagcttgaataagtcaaagaaatctcctggaaatgcaagatctaggcgaaggtcacgtgtgaagatgcctgaagtaaaggatgtgtccggtgagcggggccagaatcttccttcagccttagcagaactccaaaggcgggttatcaaggctgaagctaccatagagcaaaaggaagaggaaaatgccgaattgaaggaacagctaaaacaatttgagagaaggtggattgaatatgagaaaaggatgaaatcaatggaggatatgtggcaaaaacagatggcatctttgcaaatgagccttgctgctgctagaaagagccttgcttctgagaatgccagcagtcaaattgcgaggcgtgatgttgcgtcacctttcggctatgattcagaagatgctacttctgtgggatcccgaacacctcgaacacctggggcaagcacacctttgaagtattccagtagtcttactgaagctggagcagggagagatgccaaaggtactttgacttcagtcagcaacctgatgaaggaatttgagcaacgcagacatacctttgatgatgatgccagagctctggttgaggttaaaacgggtcaatctgctaacacgaattccgttgaagaacttcggaaactcaaacatagctttgaggggtggaagaaagaatacaaggctagactaagagagacaaaagcaagactacataaatcagaaatggataaaagtcggcggaggtggtgggggaaattgagttcgagagcactataa

SEQ ID NO: 13942 - DNA, 225 bp, Glycine max
  Peptide Sequence Number=SeqID_130720
atggaggaatcagagggcaagttgaaagcaattcttggttacactgaagatgatgtggtttccaccaactttgtgggtgacagcaggtcaagtattttctatgcaaaggcaggaattgctttgaatgaaaaatttctgaagctgatcacatggtataataacgagtggggttacagcaattacattgttgacttgattgcacacatcgttaagatgtctcgttaa

SEQ ID NO: 13943 - DNA, 207 bp, Glycine max
  Peptide Sequence Number=SeqID_130721
atggaaactagtggcagtcatgggaagatgagcatacctcaaacaattgggcaaattgtttcagaaagagagagtatagtaactggtaatttcaactacagaaattcaattgttaaccttggaacaaaagatttatatagcgacagatggagttgtgcattaattgcggatgctctaagccatgacgtttataaacatgaatattga

SEQ ID NO: 13944 - DNA, 123 bp, Glycine max
  Peptide Sequence Number=SeqID_130722
atggtgatgtgtttattcaaaatgagtatggatgtgagtgcgggaacgtgggaaaagtctgacagtatgcttccagaattatttcttcttaactctaccttcaacctaaaacaaacgggataa

SEQ ID NO: 13945 - DNA, 2022 bp, Glycine max
  Peptide Sequence Number=SeqID_130723
atgatgatatcagcttccatgtcttctctaacgaggagttcgctggaggagatgcttgaatcgcttcgccggagagacgaggaggagaagccgaaggacttgccgccggcattgccgtcgcggccgccgtcgagggcgcggttgccgccggggaggaggtcgctgcctaacaacttcaaggtggatggtgagaatggtgtgatggggcacagaaggaagggcagttttgggaccaagaaggtcaagttgaatgttgaatccccttatgaagtcaaatcagaagagatagtgagtgaacaatcatcaccacgtccggtttttacatccaatgatgcttctgctgagtgtgaagctcctcctccgaccggggaattggaggatgataatgttgtttatttcatcaaaaaggcaaccgaaagggaagtgggagctgggaacaatacagtcaacttcaggagaggaagcatctgtttcactctcaaatggaaacgtgaatttctaagccttttctgtttttcaaaggttatcaaagtagccagatcagagctgttaccggccaatcctgatattttagagggtgttgaagatcttatacagctcagttatttaaatgagccctcagttctgcacaatcttcagtctagatattctcaggatatgatttacagtaaatcagggccaattttaattgcactcaatcctttcaaagatgttcaaatttatggagatgattatatttcagcttataggcagaaacttatggataggcctcatgtttatgctatggcagatgcagcttataatgagatgatgagagatgaagcgaatcagtccattatcataagtggtgagagtggatctgggaaaacagagacagcaaaaattgctatgcaatacttagctgctcttggtggtggctgttctggaatagaaaatgaagttctcctgacaaactttatactagaagcttttgggaatgcaaaaacatctaggaatgacaactctagcagattttcaagagttgttcaacttgccttggacgagaggtcatatcacatattttatcaactttgtgctggatcttcatctgatcttaaagaaagactgaatcttagggcggctagcgaatataaatatcttaaccagagtgactgcatgacaattgatggtgttgatgatgctaaaaagtttcataggctgatgaaagcattggatgttattcgaatgtgcaaagaggatcaagagctagtttttaagatgctgactgcaatattatggttgggaaatatatcattccaagatactgacaatgaaaatcacattgaggtggtgaatgatgaagctgtaacaaatgctgctttgctaatgggttgcagttcccatgagctaatggaagcattatctacccataaaatccaagctggcaaggataccattaccaagacattgaccttgcggcaggcaattgatgcaagagatgcattagcaaaatttatctatgcaagcttgtttggttggcttgtagaacaagttaataagtcacttgaagtgggtaaacgccgcactgggagatccataagtatccttgatatttatgggtttgagtcattccagaataacagctttgaacaattttgtataaactatgccaatgagaggcttcaacaacatttcaatcggcatctgtttaaacttgagcaggaggattacgaattagatggcattgattggaccaaagtagattttgaggacaatcaagtgtgtttggatctctttgagaagaagcctctggggctactctctttgttggacgaggaatcgaatttccccagggccagtgatctaacacttgccaacaaacttaaacagcacctgcacgctaatccttgctttaaaggggaaagaggcagggcttttagtgtctgtcattatgcaggggagtgcacccagagtattgcagtatcaagcataaacttcatgctgatattatcatactgtagcagtaacgttactgataattaa

SEQ ID NO: 13946 - DNA, 294 bp, Glycine max
  Peptide Sequence Number=SeqID_130724
atggcgaaaaacaggaacaacaagaagaagagaaacggtgtcgtttcaatggataccaccgacgcatccgtttcggaacaatctcaagcaatggatacatcagagtcaggagttctaaacacggcttctggtgctaccaatatagagattaatcactgtctggttttgaagctttggtcattggtggaccttgcgaatgttgccaaaatttcaattaagtgtttgtttcaattacttggaaaagtggattctaaaagcatccacttggtgcactgtaaggtgaagctttgttaa

SEQ ID NO: 13947 - DNA, 333 bp, Glycine max
  Peptide Sequence Number=SeqID_130725
atgccaggttggtgcttgagggaatggacctcgacggagggtcaggttttgacaccaaggatcttgttcttagtgtcaatggcagagtggatcatcttggcgatgcacttgttgtgcatggttgcgaacatggaggtcgaggccgagggccatgtagatctcaacatacttgttgtcgagcttctctggtgtcatattgacaccgcaacaagtcatgacgattacattaacaacctggttgacgatctagatgcactcgaagacattgccagagttgtcatgttatgtgacagtgatgctgaggatgtaggtgtcgttcacgaggtggactaa

SEQ ID NO: 13948 - DNA, 159 bp, Glycine max
  Peptide Sequence Number=SeqID_130726
atgttaagagaaactgcgaaggcaaagagtcctacaaaggtagagaaaaagaatcaagcacctacgaagatcatagataatgttgtaaagttcgaaccggattggtcaatccgacctagaatcaaacccatgatcgatttagtcaagttatcgaattaa

SEQ ID NO: 13949 - DNA, 132 bp, Glycine max
  Peptide Sequence Number=SeqID_130727
atggaaccttttgtgaggcatttcaagggaaatctgatggatggagagatagtgtatcttgcaacaaggacacagcactgtgcaattcgagaaatgagaactaagctagctaggcaaagtgatcttatctaa

SEQ ID NO: 13950 - DNA, 735 bp, Glycine max
  Peptide Sequence Number=SeqID_130728
ccttacccttgcatatgcaaagaggttgtttccggattcgaactcatgaccaacaagtcaccaaggcacaactttaccgctgcaccaagactcgccctcaaaaacttcgtaccccattgcccagaggctcttcgctatgcgaagatctcgattagccgaaaattgcaagaacggcttcaggctcttgcgatcaacaaacgcagcgttttgatctcagatttgagggggagagcttcgttgtggtttagaatggcaacaacagtgagaagtctgaagataaagacaagtacgtgcaaacgtatagtgaaggagctgcattcttatgagaaggaagttgagagagaagctgccaaaacagctgatatgaaggaaaaaggagccgatccctatgatctcaagcaacaggaaaatgtcttggctgagtctaggatgatgattcctgactgccgcaagcgccttgaggccgctttggcagacttgaaaggattattggaaaacccgccatggcgtgtttatatggcggaattttggccttctgccatgttcccaccatccgccattaataacactgatccagttttatacagaattgagtttcctagttcctacagttttactatgctctgggacaaggctgagttggaggagtcggatgagaaggccagtcctgagattgatgaagctcggaacaccatcgtagaagttgaaaaagtatttgaaacaacagaagattaa

SEQ ID NO: 13951 - DNA, 1173 bp, Glycine max
  Peptide Sequence Number=SeqID_130729
atgaacaccgaaggcgtggcctactccgtcgccttccccggcctgaatgcgctgcagttcaccaatacgccgaataccggtacggtgttcttcggtctgaagccgttcagcgagcgcagccgcactgcggcggaaatcaacgctgagatcaacgcgaaaatttccaaaatccagcagggcttcggtttctccatcatgccaccgccgatcctcggtctgggccagggatcgggctattcgctgtatgtgcaggaccgtgcgggcctgggctatggcgcactgcaaaccgcgattaatacgctgtccggtgcggtgatgcagacgcctggcatgatgttcccgatctcctcctatcacgccaacgtgccgcagctcgatgtgcaggtgtatctgggttcgtcttacgtcaacgacttcaacaagtttggtcgtacctggcgtgtgatggcgcaggctgacggggatttccgcgacagcgtgcaggatatcgcgaacctgcgcacccgcaacgatcgcggtgagatggtgccgattggcagcatggtgaacatcaccaccacctacggtccggacccggtgattcgctataacggctatccggcggctgacctgattggcgatgccgatccgcgtgtgctctcttctgcgcaggcgatggaaaaactcgaggcgatgtccagccaggtgctgccgaacggcatgaatatcgaatggaccgacctgagctatcagcaggcaacccagggcaacaccgcgtttatcgtgttcccggtggcggtgctgctggcgttcctggtactggcggcgctgtatgagagctggacgctgccgctggcagtgatcctgatcgtaccggtgacgatgctatccgcactggtcggcgtgtggctgaccggcggcgataacaacgtgtttgtccaggtcggtctggtggtgctgatggggctggcatgtaagaacgctatcctgatcgtcgagttcgcccgcgaactggagatgcagggcaaagggattgtggagtcggcgctggaagcctgtcgcctgcgtctgcgccccatcgtcatgacctccatcgcctttatcgccggcaccgtgccgctgattctgggcgaaggtgcgggcgccgaagtgcgtggcgtcaccggcatcaccgtgttctcgggcatgctgggg

SEQ ID NO: 13952 - DNA, 951 bp, Glycine max
  Peptide Sequence Number=SeqID_130730
atgggttatgtttctgtgaaagtggttgtaatctccaccggggttttatcgatggcaatgggtttgaaactcacactccctttgctctcgcatttcctcctcaaccaagccccgcacctgtggaccctcctcctcacgtgcttcactcctccttacctctacatcttcctcaatttcatcatcctcaccatagtcgcttcctccaaactcaacaaccaccatcactctccgcctgataccaccctcctccccgccatctacgacgggccacccgcctccgtccagatccccgctcccgccgccgctgtacaatcggactacaacgccgtttcctctgacaaatacctctacgaaacgaaaccgacgctcagctacgattccgttgcgggaggtaacggctctgccggttacgtttacgacgagaacacgccggtgaaagcggcggttaacaacaacgacgacgacgacgacgaagcagttggcgttggcgttctctctccgagcctgcagaggaaagactcctcggacttcgcgttcgcagatgagaacgagaaaccgctggtttccgccagattcagccaccgcaaatccgttagagccagtcccgaaggtggtggcgttgggagtggcgaaggcgaagaagcaggaaacgttggagagcacgtggaggacgataagggaggggagagcgatgcctttaacgcggcatctgaagaaggcggagacgtgggagacgacgcagcaggggacaccgttacgggacttgaacggcggcggagggccggtgatgaagaagtcggagacgttcgcggggagggagaagaacgcgtcggcgaggctactgaggaaggagccgtcgctgagtcaggacgagttgaaccgccgagtggaagcgttcatcaacaagttcaacgcggatatgaggctgcagaggcaggagtcgctgagaca

SEQ ID NO: 13953 - DNA, 448 bp, Glycine max
  Peptide Sequence Number=SeqID_130731
ggatctagtaggagtaaatgatgctcaagtagcagaaactccttcagaattctcatttgctgtagccaaaattgcggttgctcaggtttgccaatcagttggattcaaaaccttcaaatgcaatgctcttaaaaccttaactaatgtttccacaagatatctggaaaccattgtgagatcagctgcctcttttgctaatgcctccaatcgtaccaactccaacctatttgacatcatcaatggcattcatgatctgtgttctgctcaaggatttcctggtggctcagtgatgcacaaagttaacttgctgaggtcttcagctctaaaagatattatgaattttgtcaacctctctaataaagttccatttgctaagccaattccattcagaaatgtttttcaagagaggaaatgtggtgagaaactgtgggaaacattcacttgctag

SEQ ID NO: 13954 - DNA, 192 bp, Glycine max
  Peptide Sequence Number=SeqID_130732
atggagagtgtcagtgttgcgagggttggtgctgaggtggtcttcgaggaccttctcagctttgtcctcagtgagggcagggtcggtattggcaacagggggagtgagcgggccggcaatgatgatgtagcaaaaagcatgcttgttttagaggtaattgactattgtaaacacaagagcaagagaaattaa

SEQ ID NO: 13955 - DNA, 360 bp, Glycine max
  Peptide Sequence Number=SeqID_130733
atgtcttccaataaacttgtttctcctaaattagtacatctcattgcagtgttgataccaatagtaggtcttggtgctttcctcttgtgggcaggacgagacataatgcaaggcacttgtccaaattgtggaaatgattttcaggttttcaaatcctctctgaatgatgatttgcagctatgccctttttgtggtcaacctttttctgttgttggcaatgagtttgtgaaagactcagtgaagttttcgaaccaatctacaacatttggacaagcattcaataatttcacccgttctagaaatgaaaaagattctggtaaagcaattgatgttgaagctgaaattaaagatgtagactga

SEQ ID NO: 13956 - DNA, 814 bp, Glycine max
  Peptide Sequence Number=SeqID_130734
atgggtttgaactcgctgttcaaccgcaacagggacggcgacggcgacggcaccatcgattttgaggagttcaggtattttttggaagcattccacgggaaatctagacacccgagtaaattgggtttcataggaagagttgggagatatttgggctatggccactgggaagacggttatgtgttcgctgagccagttgcgtccgctaacatgcgcatcgacgtcagcgtcacgattagtgccccagccacccgacctcatcaagtgggtaaccagagaaggaagaaattccacgtggcagtgatcttattgtgctgccgcaccatcttcccttgcgcttcacctctctccaacaagacccttctctgctccatcacttggcgcgccaagtccctgcatttgacagaggaactatgggcaatgaagctgggtttgaagcttctgcaagaaagggcaaaagttggatcgttctggtggccatatataagtaatcttccagaaacatacaccgtgcctattttcttttccggggaggacataaagaacttgcactatgctcctattcttcatcagcgagaagtcaagcgtactttggtaagtcttacacaagataagcatccttttggtggtcaagaagtagatgcatcttctcttggatgggcaatgtcagcagtatcatctagagcgtttcgattgtatggtgaaaaggatcccaatgggatacgcattgacataccaatgatgctccccctaattgatatgtgcaatcatagtttcaatccgaatgctagaattgttcaagaacaagatacca

SEQ ID NO: 13957 - DNA, 834 bp, Glycine max
  Peptide Sequence Number=SeqID_130735
atggaggcaaagggtgtgcggttcttagcgtatcaatcaatattttcgagcgttggatctggggacttcgatggggtgaagaaactggtggaggaagtgaagaaggaagaagggtcatcgctctctgatgtgatgtctcttcagaacgatgctggagagactgcgctatacatcgctgcagagaataatctgcaagagatgttcagcttcttgctcagcatctgtcactttgaggtcgtcaagattcgctccaaggctgatatgaacgcctttcatgttgctgccaagcgtggcaatctagcaccaattcagaaaaaagataataaaaaagcagttgaggtagttcggacacgtacaaaggagtggaaatgttggggcacacgttccaatgtaaatccaacggatattgtgagggagcttttgaatatttggcctgaggtctgcaagttatgtgactcctcaaacaccagtcctctatattctgctgcagttcaagatcacttggatgtggtggatgctatcttggatgtcgatgtcagttccatgttcatagttaggaaaaacggcaaaacttcactgcacaatgctgctaggtatggtgtccatcgtattgtaaaaacacttattgctcgggatccaggaatagtatgcatcaaagataaaaaaggtcaaactgcactgcatatggcggttaaaggacagtgtacttcagttgtggaggagatattactagctgatccttctattttgaatgagcgagataagaagggtaatacagctcttcacatggctacaaggaaatgccgttcacaggttaaatttacattctattga

SEQ ID NO: 13958 - DNA, 1332 bp, Glycine max
  Peptide Sequence Number=SeqID_130736
ggaggattgataggattagcagctgcaactgttgggttgacttctgaagcagctcagcatcttgagcaaattgtgccccctgtgttaaattcattctctgaccaagatagcagagttcgttattatgcttgcgaagcactttataacatagccaaggttgtgagaggggattttattatttttttcaaccagatctttgatgccttatgcaagctttctgcagactcagatgccaatgtacaaagtgctgctcacctcttagataggcttgtgaaggatattgtgaccgaaagtgatcagttcagtattgaagaattcataccactgctgagggagcgcatgaatgtgttgaatccatatgtccgtcagtttttggtaggatggattactgtattggatagtgtcccagatattgatatgctggggtttcttcctgattttcttgatggcttatttaatatgttgagtgattcgagtcatgagatacgtcaacaagctgattcagctctttcagagtttcttcaagagattaaaaactccccaagctgtgcttcattttcaactactactttgacacaaaagcaaagttttttgttcatttatcattttctgactcgagcagtgctactcttgaagtctgtagattatggtcgcatggctgaaatcctggtacagagggcaggttctccagatgaattcactaggctaacagctatcacatggataaatgagtttgtcaagcttggtggagaccagcttgttccatattatgctgacattcttggagccattttgccttgtatagcagataaagaagagaaaattagagttgttgctcgtgaaaccaatgaagagctacgtgccctcaaagcagatccagctgaagcgtttgatgtaggagcaatcctctccattgccaggaggcaattatctagtgaactggaggctactcgaatcgaagctttgcactggatatcaacccttttaaacaaatatcgtaccgaggttttggaatttctgaatgacatatttgacaccctgctcaaggcactttcagatccatctgatgaggttgttcttctagttcttgatgttcatgcatgcattgcaaaagatcctcagcactttcggcaacttgttgtcttcctagtgcacaatttccgggtagacaattcccttttggagaagcgtggtgctttgataattcgtcgactttgtgtgcttttgaatgctgagagagtctaccgtgaactttctacaatactagaagcggaatctgacttggattttgcatcaattatggttcagctgtataaaaaactttttgaataa

SEQ ID NO: 13959 - DNA, 729 bp, Glycine max
  Peptide Sequence Number=SeqID_130737
atggagtttcctgaacaacatactctgctccagtattatactggtcctgatggcaggggcactgtagatgacattagtaggagattgagagatggttgtccaagctactataaggagtctgattacaaattcttcctagccgtggaagccctggagagatctgctatgaccatagatgccgaggacaaggagaatcttgcaagggaagcatttaattccttaagtaaagttccagagtctgtggacctacgaactgtttgcaaacgttttgaggatttaaggttttatgaagctgtagtgcgcttacctctacaaaaggcacaggctcttgaccctgcaggcgatgcttataatgatgatattgatgcaactgtcagagagcaagcacttgctcagcgggagctgtgttatgaaataattatcagtgctttgcggtctctgaaaggtgacaacttacagagggaatttgggactcctattaaatcaactgcttcacaatctgctcttgatccagcctctcggaaaaaatatatatgtcaaattgttcagctgggtgtccaatcacctgacagaattttccatgagtatctttaccaggctatgattgatttaggtcttgagaatgaattgctagagtatggaggtcctgatctgttgccatttttgcaaagtgctggtcgtaattctatacacgaggttgtttattatctctttctccccaataactaa

SEQ ID NO: 13960 - DNA, 390 bp, Glycine max
  Peptide Sequence Number=SeqID_130738
atggcgacgatgacgagcttgattggtctcatcaataagatccaacgagcctgcaccgttttgggagatcacggtggcgagggcttgtcgctctgggaggctcttccctctgtcgccgtcgtcggtggacagagttcagggaaatcgtcggtgctagaaagtgttgtcgggagagattttctgcctcgtggatctggtgaatctttctctctttcttactatgttctgctctcgtttgttattttacgagatctatttatcaatgtagttcataaggagctactcctaatatatatagatgtacaagaaatgatgccatgcttgctagtggttactgagtgtgaaatgaaacaccattatccaaaagtggttactgttgttgtttggtaa

SEQ ID NO: 13961 - DNA, 1527 bp, Glycine max
  Peptide Sequence Number=SeqID_130739
atggcagctcagtttgcagctgaagccactcttcgaagggtccatgctgctcagaaggatgatgacatgcctcctatagaggccattcttgctcctctggaggctgaacttaagcttgcgcggcaagagatagcaaaacttcaagatgataacaaagctttagaccgtctcaccaaatctaaagaagcagcacttattgaagctgagaagactgtacagattgccttggctaaggcctccatggtggatgatctccaaaataaaaatcaagagctaattaaacagattgagatttgccagtatgccagacataataatgtaatttctgacatttggtttcatcatcacctctcccaggaagaaaataaaattttggacaaaatgcatagactgaaggtggcagaggttgaaaagcttacccaaaccgtgagagaactagaagaggctgtccttgcaggtggtgcagctgcaaatgctgtgagagattatcaacggaaatttcaagaaatgaatgaagaaagaaaaactcttgaccgggagttagctcgtgccaaggtaacagcaaacagagtagctgtagtggttgcaaatgaatggaaagatgctaatgacaaagtgatgcctgtgaaacaatggcttgaagaacgacgattcttgcagggagagatgcagcaacttcgggacaagcttgctataactgagcgaactgcaaagtctgaagcacagttaaaagaaaaatatcaattaaggcttaaagtgctacaggagagtttgagagaaacttctaacagtattaatcgcggcacctcagagggaagatgtgttagcaatgggccttctcgacgtcaatccctaggtggagctgataacatctcaaaactaacatctaatgggtttttgaagagatcaccgtccactcaaattaggtcttctgtgtcttcaagcacagttttgaagcatgctaaaggcacatctaaatcatttgatggtggtacaaggtcattagaaaggagtaaaattcttctaaatggaaaacctccaagttactcattcaaccagtcttccgaaggaaccaaagtcagggaagaaaaagataaatggaaaggaaattcagatgataaaccaaatgacttcccaacagtggatacagacgatagtgttccaggagttttgtatgatttgctgcagaaagaggtcttagccttgaggaaagttggtcatgagaaagatcaaagcctaaaagataaagatgatgccattgaactaattgttgcaatggttgttatctgtcagatgctggcaaagaaagtagatacattgaccaaagccatggaagttgaggcaaagaagatgagaagagaagtagcttccatggagaaggaggtagctgcaatgcgtgttgaaaaagaacaagacacaagagcaaagcgtttcagtaatgtaaagggccctgtgaacagtgctcagcatcagcttgtttctggaaggtatatttcattaggtgtttctgttcaaggtcaattatga

SEQ ID NO: 13962 - DNA, 1581 bp, Glycine max
  Peptide Sequence Number=SeqID_130740
atgtcatcgccaaactccgcccgtcagccccacgcgccgctccttctcccgcgccccgatgccgccgcccgcctccccgtcctggcgctcctcctcggccgccgcggccactccgtcatggtccgggagacggcggcgcgtgagctggaggagcggcgcgccgactggacctactcgaagccggtggtggcgctggacatgacgtggaacatggccttcgtcgtggtctcggcggtcatgctcgcctgcaccgtcaaggagaaccccaacacgccgatccgctggtggatctgcggctacgcgctgcagtgcctcctccacgtggccctcgtgtggctcgagtaccgtaggaggaacgacgcgcccggggacgaggattctgctgccaacctagattacgacgacgtcaacgacagcgacgaggacgatgttggaacctctgggagttcctcttccaccgggttgactgttgtctttctagcatttgatgtcttctttgctatcttttgtgttgttttggcatgcttgattggaattgccctctgttgttgtttgccctgtattattgctattctctatgctgttgcaggacaggagggtgcatcagaatcggatctcagtatacttccaaaatacagatttcaaatgttaagcaatgaggaaacacctggtgagggagggggaggatcaatgattcctatggagaccagcaatggttactcggtgaatgaacgaacactttcacctgaggatgcagaatgctgtatatgcatctcttcctatgaggatggagctgaacttcacgttctcccttgtaaccatcatttccactctacgtgcatagtgaaatggttaaagatgaatgcaacttgtcctctttgcaagtacaatattctcaagggaaatgaacaggcggagaccgtggcagtttccggatgcggctttggcggtcgtggacgcggcggcgacaggggacgagggtggcgcaggacagcagggcgccgtggcgaggaggaggagtgggtaccagtgacaaagctaggacgcctggtgaaggagggtaaaatccgtagcctggagcaaatctacctacactcgctcccaatcaaggaataccaaatcatcgacaccttcgtggggcccaccctgaaggacgaggtgatgaagatcatgcccgtccagaaactctctgttattcctgtcaggagagggtattggggtaacaagatcggaaagccccacaacgttcctttcaaggttaccggcaagtgtggttctgttaccgttcgcatggtccccgctcctcgtgggtccggaattgttgctattagggttccaaagaaggtcttgcagttcgctggaatcgatggtgtcttcacttcctcaaggggttccaccaaaaccctcggaaatttcgtcaaggctacttttgactgtttgctgaaaagctacggttttctaacactggagttctggaaggagactcggttctccaaatcaccattccaagagtacacagatctattggcaaagccaacaggaaaggccctgatcctcgaggaggaaagggtggaggcttga

SEQ ID NO: 13963 - DNA, 2937 bp, Glycine max
  Peptide Sequence Number=SeqID_130741
atggtgagaaaagtagaagaaaaagagaggaatgaacaacaactagtcctagtggtcggaaaacgaaagtgtttgcccgccactatcaatttacgaaagcccccccaaaaccctacatcgccatctgttctcacacttctcagttccattctacaccacgagactcctttctcccctctcttccgcctatttcaatttgcattatttagcgttttgtttatcgggaaagccacgaaagaacgagaaagagggcttcttcaatttcattccggaatgtcgtgggaagacgagattgtgatgcgtgatgtcacgaatgcggggcttgttgtcagcgatcgcattggtcgcgaagtttcgtctcagctcgacctcgaagaagctctagaagcttccagatacgctagccacccttattccactcacccccgagaggaaattgcgggcaaatgtggccacaattacggttgtgggctcttgaaaaaccttgactttgcagtcaaaatcacagttgcgcagtgtcatcaatggcagaaagccaaaattccaccatataaacatgtcattgcggcctatggcgctaccatagctggcctccattcacaaattgcctatggcggttggcaaaaaatctgtcatgccattccaccatggtgctgccatttaacaacactgcggctgcagactttttttaaaaccatgggtgtgtcttggccccctttagttgaggtggtgaatacctgggagttgcctcccgtgctcattgaaagatacaatgcagctggtggggaaggaactgctttttgtggaatatttcctgaaatacgaagggcatgggcatctgtggacaattcattgtttctttggcgttttgataagtgggatggccaatgtcctgaatttagtggggaagaacaagctatttgtgcagttggtcttgcaaaatcaaaacctggagtttttgttgaagctatccaatatcttttagttttagcgacacctgttgagttaattttagtaggagtatgctgctctggaggagcagatggttcagatccatttgcagaagttacattgcagccattgccagagcatacaataccttctgatggggttacaatgacttgtgtagcatgtactgataagggccgcattttcctcgctggtcgggatggccacatatatgagattctgtattcaactggttctggatggcaaaaacggtgcagaaaaatctgcatcactgctggtttaggaagtgtaatttcaagatgggttataccaaatgtattcaattttggagctgttgaccccattgttgaaatggttttcgacaacgagagacaaatattgtatgcacgaactgaagagatgaagctacaagtttatgttctaggaccaaatggtgatggcccattaaagaaagtagctgaagaaagaaatcttgtcaatcagagggatgcacattatggtgctagacaatccacagggtcaagagtctcaagtcgatctccaaagccatctattgtttgcatctcacctttatctacacttgaatccaagtggctacatcttgttgctgttttatctgatggcagaaggatgtacctatctacctctccttctagtggaagcttgactgggttcaacaccaaccaccacaagcctagctgtttaaaggttgtcactacaaggcctgctcctccttggggtgttagtggtggtctcacctttggagccatggctcttgctggtagacctcagaatgaggatctctccctgaaagttgaggcagcttattattctgctggaacccttatactttctgatgcatcaccttctaccatgccttcactccttgttttgaacagggattcaagcacgcaatcatcgccgtcaggtaatctaggaacaagtacgaggagttcccgggcattaagggagtccgtatcttccttaccagttgaaggacgaatgctttctgtggcagatgttttacctttgccagataccgcagctactgtgcaatctctatattcggaaattgagtttggtggttatgagagctctatggaatcatgtgaaagggtgtctggcaaactatgggccagaggagatcttgcaacccaacatatactaccaagaagaaggattgttgtcttcagcaccatgggcatgatggaaattgtttttaacaggccactggacattataaggcggctattggaatccaactctccacgatcagttttagaagatttcttcaatcgttttggtgcaggtgaggcagctgcaatgtgtctaatgctagctgcaagaatagtgcattctgaaaaccttatcagcaatgttattgctgagaaggcagctgaagcttttgaggacccaagagttgttggcatgccacaacttgaaggcagtaatgcattatcaaacacaagaagtgctgctggtggatttagcatgggccaggttgttcaggaggctgagcctgttttttcaggtgcacatgaagggctctgtctgtgttcgtctagattactttttcctctgtgggaacttcctgtaatggttgtaaagggaagtttaggcccttcaggcactctatctgaaaatggagtagttgtgtgcagactctctgttggggctatgcaagtccttgaacagaaactccgatctttggagaaattcttaagatctagaaggaaccagaggaggggactttatggctgtgtagcaggtttaggagatctgagtggttcgattctgtatggtaatggttcggcattaggagttggggatcgaaatatggtaaggaacttatttggtgcatattccagaaatatggagtccaatggtggcataacaactaataaacggcaaaggttgccatatagtcctgctgaattagctgccatggaggtgggcctacatttttaa

SEQ ID NO: 13964 - DNA, 1329 bp, Glycine max
  Peptide Sequence Number=SeqID_130742
atgccatcggtgacgtggggcgtgatccagggtcgcaaggagaagctcgtttcgcgagtaatcatcttcgattacctcaagggtttgggaatcatccccgacgaattgcacgacctcgagcttccctccaccgtcgacgtcatgcgcgagcgcgtcgagtttctccagaaattaggtctcaccgtcgacgacatcaacaactaccctctaatgttggggtgcagtgtcagaaaaaacatgatccccgtcttggggtacttggaaaaaattgggatcgcaaggcccaagcttggtggatttgttaagaattacccgcaggtattgcatgctagtgtcattgttgagcttgctcctgttgttaagttccttagggggcttgatgtggagaaagatgatattggctatgtgttgcaaaagtaccctgaacttcttggcttcaagcttgagggtactatgagcacttcagtggcttatcttgttagtattggtgtgaaccctagagatattggtccaatggtcactcagtatccttatttattagggatgagagttgggactgtgataaagccgatgattgattacttggtcgatttagggctgccgaagaaggttttggccaggatgttggagaagagagcttatgttcttggctatgatcttgaagagactgtgaaacccaatgtggaatgtttgattagctttggtgttgggagggattgtttggcttcgattattgctcaatatccgcagattctcgggctgcctcttaaggctaagttatccacgcagcagtactttttcagtttgaagcttaaggttgaccctgaagggtttgcacgcgtggtggagaacatgccacaggtggttagtctccaccaacatgtgattatgaagccggttgagtttctccttggaaggacgataccggcacaggacgtggcaagtatggtggtcaagtgtcctcagttggtggcactgagagttgagctcatgaagaacagctattacttcttcaagagtgagatggggaggcccttgcaagagcttgtggaattccctgagtattttacttatagtttggagtccaggatcaaacccagataccagaggctgaagagtaaagggataaggtgttccttgaattggatgctgaattgtagtgaccagaggtttgaagagaggttgcagggtcattacattgaaactgagagtgtaggccccagattctgtatgggagggaaattagagctaccagggaatggcctagtgtcagatgaggaagaggagagtgatgatgaactattatacagacgaactgtttctctttag

SEQ ID NO: 13965 - DNA, 474 bp, Glycine max
  Peptide Sequence Number=SeqID_130743
atgagaggacacaatcacactatctgcgtattacaaatatcaactgcaaaaaggagaaaggggggatataaagcggctacctatacaaccacacagccactcaaagaaaagctgaaggttagctccaaccgatctctctctaagcaggaaatacaaagtctgtcaggcgcataccgattccttaaacgctcttctcaccatcaatccatggccaataacataaataatggttgtcggaatgccagttacaatcttataatcaattgggggggaaaagacaaaagaaaaaataaagtaaacaaagaagggcagaagaacgatgctatgaaaacccactccttagtgcctcttcaagagacgattgtcattgcgtgctgcgtgttaatcctccccgtgccacatttctgcacaaatatagcattcccgtcattcacccaagataatggagaaatcagaaagtcagaaacaatgtaa

SEQ ID NO: 13966 - DNA, 1899 bp, Glycine max
  Peptide Sequence Number=SeqID_130744
atggccatgccaaaagagaaagaggatgttcagaacagtgggaagagattgaaatgtacgaggaatgaagaagaagaaaaagaacaatatgaacaagttgaagctgatgaagaagaagaagaagaagaagacagtgagcttcctctaaagctaggattgttcttctacccaacaatacccacttcctttgttgtatctgatgctcttgaacccgattttcccatcatatatgtcaacaaggtctttgaaatcgccactggatatcgtgctgacgaggccctcggtcgcaactgtcggttcttgcagtatagagatcgtcgagctcagaggcggcaccctttggtggatcctgttgttgtgtctgagattagaagatgtcttgaggaaggtgttgagttccaaggtgaacttctgaatttcagaaaggatggcactcctttggtgaacagagtgagacttacactaattcatgatgatgacgggactgtgacacacgtaataggtatccaactcttttccgaggcaaatatagatctgaaccgtgtctcatatccagtcttcaaagagacttgcaatcaagattttgacaagaatggtaaatatactcctaagagtggacaatcattgtacagtcagcaccaagagatgtgcagcattcttcagctttctgatgaagtcttggctcacaacattttgtcacgcttgacacccagggatgttgcatccattgggtctgtatgcaggagggtccgtcaattaacaaagaatgagcatgtcaggaagatggtatgtcaaaatgcatggggcaaagaagtgacgggcacattggaactgatgaccaagaagatgggatggggtcgcctgactcgggaacttaccactcttgaagctgtttgttggagaaaactgacagttggaggtgcagtggagccttcacgctgcaatttcagtgcttgtgctgcaggaaaccgacttgtattgtttggaggtgaaggagtggatatgcaacctatggatgacacttttgttctaaatcttgatgctaaaaatccagaatggcgcagggttagtgtgaaatcatccccacccggaaggtggggccacacgctctcgtgtttaaatggttcttggttggtggtttttggtgggtgtggtaggcaaggattgctcaatgatgtgtttgtgcttgatttggatgctcaacagccaacatggagggaggtttgtggtggaaccccaccacttcctagatcatggcacagctcttgcacaattgaagggtccaaattggttgtctccggcgggtgcacagacaccggggtacttcttagtgacacgtatttactggacctcacaacagataatccaatatggagagaaattccaacttcatgggctcctccttctcggttgggccactcactctcagtctatgggaggacaaagattctcatgtttggtggacttgccaagagtggacacttgcggctacgatcaggtgaggcttatacaattgacttagaagatgaacaaccacaatggaggcaactagaatatagcgcattcacgggtttagccagtcaaagtgctgttgttcctcctcctaggctggatcatgttgctgtcagcatgccttgtgggaggatcattatatttggaggttccattgctggtcttcactcaccatctcagctctttctgttggacccttctgaagagaaaccatcctggaggatcctcaatgttccagggcaaccacctaaatttgcttggggtcatagcacttgtgtggttggagggactagggtgttggtgttgggtggacacactggggaggaatggatactgaatgagttgcacgagttatgcttggcaagtcgacatgactctgacctgtga

SEQ ID NO: 13967 - DNA, 270 bp, Glycine max
  Peptide Sequence Number=SeqID_130745
atgagaaagaaatacacggtccagcttggcgagaacgagctcgtccttaaggaactggatttattgaaagacgacgcaaatgtttataagttgattgggccagtacttgttaagcaagatttggccgaggccaatgcaaatgtccgcaagagaatcgaatacatctcagctgaattgcaaagggataccagtttacactttgcttttacttggaaactatgtgtgagtgtgagtttgaccatcatggctctcctcaagaggatgaagtag

SEQ ID NO: 13968 - DNA, 1179 bp, Glycine max
  Peptide Sequence Number=SeqID_130746
atggttattggtattgttacacggaggccactagtgctgcaacttcacaagacggaagaagggacacatgagtatgctgagtttcttcacataccgagaaggagattcaccgactttgctgctgtgaggaaggaaatagcagatgaaacagatcgtataactgggaagacaaagcaaatttctaacattccaattcatctcagcatttattctccaaatgttgtgaacttaacccttatagatcttcctgggttaacgaaggttgcagtagagggacaacaggagagtattgttcaagatattgaaaatatggtccgttcttatgttgagaagccaaactgcattatcttagctatctctcctgcaaatcaagatattgccacttcagatgccataaaaatcgccagagaagttgacccttcaggtgaaagaacatttggtgtcgttaccaaacttgatcttatggataaaggaactaatgcagttgatgttctcgagggaaggcaatacaggctgcagcatccatgggttggaattgtgaaccgttcacaagctgatattaatagaaacgtagacatgatcgctgctcgtaggaaggagcgggaatattttgagacaagtcctgaatatggacatttggcgcataaaatgggctcagaatatcttgctaagcttctatcccagcatttggagcaagttatcaggcagaagatacctagcatcattgccttaataaataagacaattgacgagcttaatgcagagttggaccgtattggcaggccaattgctgtggactcaggggcccaactttacactattttagagatgtgtcgtgcatttgacaaagtgtttagagaacacctggatggaggacgtcctggtggggaccggatatatggagtttttgatcaccaattaccggctgctttaaaaaagctcccttttgatcgccatctttctttaaaaaatgtccagagagttgtcactgaagctgatgggtatcagccccatctgattgctccagagcagggttatagaagactcattgaagggtcaattggctatttcaaaggcccagctgaagcctccgtggatgctgtaatcttcttgactttattacattttgttttaatctgtcattctgttccttggtctgatgaaattaccagatattga

SEQ ID NO: 13969 - DNA, 594 bp, Glycine max
  Peptide Sequence Number=SeqID_130747
atggacaacatcatccactctaattgggcaaattggagggataagactgacatctcatccttctattttacaagattcccagaagatgcaactaaaaaggatatatggtaccagttcaaaaagtgggggatgactaaagctgtatgtcaacattccaaaatacgggagagagatgacaagaaacatagaacacatagcagaagacaaagtacagggggtggtggcaacaaacaccagaaattccgggcaaaggtggacacacgaggacgcgtttcacgtacacgaaggatcacactcatcggtccagctagatatcccgatggacgagaagaaatggttcagcgatgcttggacgaactttcgtgggatgaaggagtcgacattgtgccgaagtacctaggggatgatatggtactgttacttggcctcactgatgccagagtagaacagatgaccaagcaggaaaccatgaacggatcctccctgtttcatttgctggagaaatggaatccgaagctgcgaacaagatacaggttggtctgggttcaatgttggggtatcccgttaatagcgtgggacatggcgcaaatctag

SEQ ID NO: 13970 - DNA, 110 bp, Glycine max
  Peptide Sequence Number=SeqID_130748
atggggcatcgatttttagccccgccagggattgggatggaaaaatctgtatcctgttccattgccatgcctactttaatagtcgtggctctgctattcaagagaacagg

SEQ ID NO: 13971 - DNA, 144 bp, Glycine max
  Peptide Sequence Number=SeqID_130749
atggctcagtctcggtacttgtttccaatatcatgctttcagatgggtcttcttagtgaagctgaagcagcactgtgtcccgctaatgagcctagcctagaggttccaaatggtgcagctggtcattatctaacaggttgctaa

SEQ ID NO: 13972 - DNA, 765 bp, Glycine max
  Peptide Sequence Number=SeqID_130750
atgctacgatatgcttatgcagagctagaggaatctcgtggagcaattcaggctgcaaagaaaatatacgaaagtgttatgggagatggtgacagtgctaccacactttctcatattcaattcattcgttttctaagaagaactgaaggtgttgaagctgctaggaagtactttctggatgctcgcaagtccccaagctgtacatatcatgtttatgttgcttatgctacaatggcattttgtcttgacaaggatccaaagatggctcataatgtttttgaagcaggactaaaacgctttatgcacgagcctcctcatggattccatttggtcttctgtcgtgtcgtgttgtctgtgacaatggctattgtggccactgtgcttcttgtgtttgtggcctggctcgtggggatcttggtgaaatcggggaatgttgctcgaaaaagagagctggaaaacacatcagccttagaagggggattgagaataaaagaaaagcagaaatggaatctgcaggcgaaaagagccaaaaacagtcaaacagcgaaatctctggcggcagcggtgatggtggctgattacatggtggcggcacgtggcgctctgatggcgctagagaaaaagctgggcttgactggcaaggaggagacgaatccagtggtgctagctgtgacaacttctgctcagcggaatatggttcaccggataagagcactcgctggaaaacagaaagagttttccggaagaagggcaatgagtggaatg

SEQ ID NO: 13973 - DNA, 1674 bp, Glycine max
  Peptide Sequence Number=SeqID_130751
atggcaaccgcggcattcaaatccaccaccaagagaatccccgtcggagcttcctccgccgacgactccgcctcctcctcctccctccttcaccgccgctcccggagcctcagccgtcccgcccgcccctccttcccctcccgcaacgacgacgacagcggcggcgatcgccgaactccgagaggcaggttcgtcaacactgtccgcggctccggcttcccggagatcagcctcgacgatctcgccatcgagttcttcgagtccgccaatcgcggccgcttcggctcgagaacgtccgagtccgaggccagtcccgccgacgccggcgccgctgcgtcgcagcggcgagggaggtcggtttcgaggaaaatctccggcgtaggcgatgatagaagaagcagtattggcggtggcggcggggtaagaccgttctccgatgcgaattcgagaaggaggagatcggtatcggtggttcggtaccaaattagcgattctgagagtgacctggaccgttctcagaattctaaaagtcgttcaaatctgaaaaagactgatgttggaaacaagctaatgcacaaacctgtcgcttcagatcaaagaccagtgctaagaaagtccctaagccagaaggatttaagggcatatgatggttactctagtcattcttcagttctcactgatgatgaaggaacaagtgctcactctaataaaatgggaattgggaaactacgatcagtttatgcacataaaaaggtggcacttactgacacagataaaggatcccacaaagcaaagcaaaaagaattaaggcatatggaaactgagcaggctgtggtgaaaccaaggacctccactttatccgcagttgattgcttgttatcaaacaactctgatgctattcaggctgtttcttcaatgagaaggagttatgaaactgaactggagaagtcagagaagcggaaacaagaattattagctgaaatggtgtttgaggagcagcgaggcagagaactttctaagattgttaatgaattggttccttctaaggaggacaatcctatacaaaatccatcaagagccaggaagagaagtaatgacagaagccgaatgtctatgcgcttgactgaggaggctgagaaatatattgaggattttatttcaaatgttgaagatacagatatttcatcagttgatggtgaaaggagtgatgcaagctcatccattggaggactaataaaaccagaaacatttaatagtcctccagtgccaagatctcttcctgttttgacggatggggttacattgccatggttgcaatgggagacaaataatgatgcttctcctatgacaagccagaataaggcacgtatgacgatcactccaaaaactgaaaatatcaaagtgcaagatcaaggtaacaattctataagcagtcgtggaagctggagcccggattaccttcaggagtatgttggaaaggatgtatacagtaaattaggagaaggttatggttacccagaccagtcattctcagctaaatccaaaggattgaggtatgatatggatgattacctcaaagttaaaagcaatgaagatttgttgattgagagttggaagcaacggaggagaattaattcaggcagtctcttattgtgtagcctaagattattttag

SEQ ID NO: 13974 - DNA, 884 bp, Glycine max
  Peptide Sequence Number=SeqID_130752
gatttggcttgacttcagatcaaaacaaaggggatcctggtaattcagaaactggaaaggattcaacaaatgtgggaggccaagttgaggagagttcccagagtaggcctgttgctactgagccagaaagccatcaagagggggagagtgctgcatctaagaggcaagtctctcccgaaaagctctaccgtgcagctttattaaggagccgttttgctgacaccatacttaaagctcaagagaaagcacttgaaaaggatgaaaagcgagatcctgaaaaacttaggattgagcgagaagatcttgaaaggcggcagaaagaagagaaagctcggttgcaggcggaggcaaaggctgcagaagaggctcagaggaaagctgaagcagaagctgcagctgaagccaaaaggaaaagggaactggaaagagaagcagcccgccaggctttgcaaaagatggagaaaactgttgatatcaatgagaacagtcaatttttggaagatctagaaatgcttagtgctgtacatgatgaacacctgccaagtttcaaagaagagacaagcacagatcaacctcaagatggattgggtgggatcaagctacagggaaatcccttggaacagctagggttgtacatgaaggatgaggatgaggaggaggatgaggaggaagaggatgaactgcctccgagtggtgctgtaggaccatcaaatgatgccttagtgcgtgagttgcaaagatttggggcatcaaggatgtgtgatgatggggtgggacgtgtaaccctaaggattagagcacgtggctatgaatcaagatgtgtcgggcacccaaatgcaaaccaaagggtggtggctggtgtggctttgggaaaagggaaatga

SEQ ID NO: 13975 - DNA, 990 bp, Glycine max
  Peptide Sequence Number=SeqID_130753
atgcaagtcctgcaaacctcttatctcttcactttccctaaacccctaaacccttccccttctcatttccaccaccgtcttccgccacgccctccgccattcttccaccgccgccccctcaccattcccaaatccttcagctccgacgagttcccggtggacgagaccttcctggagaacttcggccccaaggacaaagaaaccgaggacgaagcccgccgccgcaactggatcgagcgcgggtgggccccatgggaggaaatcctcactccggaggccgatttcgcgcgcaagagcctcaacgaaggcgaggaggttcccctccgctccccggaagccatcgaagcgttcaaaatgctaaaccctaactaccgcaagaagaaaagggaggaaatgggactcaccgaggaagagttcttcgcgaagcagttcgagatcaagggcgagattccggagcctctcgtgacgacgtgggcggggccgctggtggtgcgcctcgtgccgccacgcgattggccgcctcgtgggtggcgcgtggaccaggaggagctcgcgttcatccgcgaggcgcataaggtgcaggcgaggagggtgaggctggaggaggtggagagcggagtgaggactgacactgatgacgtgggcttggataggtatagggtgtttctcaagcagtataaggaatgggtcgaggctaacaaggataggttggaagaggagtcttataagcaagaccaagattattaccccggtagaaggaaaagagggaaggactacaaggagggcatgtacgagcttccgttctattatcctggccaacgtgactgtggaagacctcctgttcctaggaaagatccaggagacaaaccagaggaagaacctctattgtctaatcatccatatgtcgagaagggagggtttcccaagtgcttaggtgcaccagagttggttgtcgatatctcaaaaaggactattcgtggagagttttga

SEQ ID NO: 13976 - DNA, 969 bp, Glycine max
  Peptide Sequence Number=SeqID_130754
atggggaaatctagaaaatactccaaaggttatgctactggctttgttcctgattttcggcatgctgttgagactattgatgaatcagaagggctgggtagcttgggaagggttgatatggaactgacggctttggcagattcttgtgcaccaaaaaggaaacgccctggcttgaatacctgtggtggtgattatgctggtagtttcaatgtaccatttcgacatttctcattatccgcgatgtcaggttttgagcgaaaggatttgaaagtgaggttaacttgggaacttgaacaagtaagggaatttcagaagaaaattgatggtatgaactcaagtgttgttggaggattgtctctcttcagtgacataaggggctgcagtgcagggcagaagaggcctaagctggagagccagcatagtacaatggaagtatcagtgccacctggtaagaaaaggcccgtaccaggacataatggtcccaagtcaaagaaaagtatgtctgagcgtcttgaacatgcaaaacctgctgcgccagtgacttcatatgctatgttgatgaaatcgtgtgagaatgtactaaaccgattgatgtctcatcaatttgcttgggtttttaacgatccagttgatgttgttaaattgaacattccagattatttcactgtcatcaagcatccaatggatttgggtactgtgaagaagagaataacctctggcgaatattcaaatcccatggattttgctgctgatgtgcggctgactttcgataatgcaatgttttataatccagcaggcaatgatgtacacatcatggccgagacccttagtaaattttttgaaacaaggtggaaggccatagagaagaaaattcctgttattgattgtgttgcgtccgagccttcaagacctactcgtgttgaaacagaaatttctgaccgagttcctcccacaaaaaagagaaaataa

SEQ ID NO: 13977 - DNA, 294 bp, Glycine max
  Peptide Sequence Number=SeqID_130755
atggcttgtggtggccaccggtggtcgtgggtggtggaggaaaagtttctagggtgcgagcttgtctcgctaagcggaagtcacacttttggcactaagtgtgacttttcgcgcttagcgcaattcctctcagcgtcatcactaatgcgccaaaaccactcacacccagtgtcgctgccaatgccaccactcacgtccattgtccttgagtgggcacttaaaggtatgccttgtcttcgagttagcaaccatggtgccaaagagtgtgttgagaacagggtcatttgggattaa

SEQ ID NO: 13978 - DNA, 204 bp, Glycine max
  Peptide Sequence Number=SeqID_130756
atgaggggagttgcttgtgcacgacagagtgacctagatactcgttgcctacttttcctaagtgatagtgtcgtgcagacacacttaggttatttccttgatgaatggtaccacattgcttttgagagtcgagttggtacatgtgataatcgtgaacttttgtttcatgggagcaaacaaacagcagtagagtacatgaagtga

SEQ ID NO: 13979 - DNA, 870 bp, Glycine max
  Peptide Sequence Number=SeqID_130757
atgctacaatatgctgacaatactatctttgtgggtgaagcaattgctacagatgttttcacaattaaggctatgcttagggcctttgaacttgcttctggtttgagggtgaacttctacaagagttgttgtggggctctaggggtggttaggagagaggtggaaaggtttgcggccatgttgaattgtagattgttgtccttcccatttgtatacctaggcatttccattggggctattcctaggaaaatagaaatgtgggagcctatcatccaaaagttctctaagaagctagctctttgggagcagaaattcatttcttttgcggggagagcttgcttggtggaatcttttccacaccaagagagggggctgtggatggaggtgttagagtctaaatatgaaggttggagagggctcttgagtgagggagaaaataattgggaacctatacggtggaaggatcaagaaggggacaaaacaaggttttggcatgatgattgggtggatgataagaaattaataaatttattccctagacttttcattttatccgaacaaaaagatgatttagtaatcaatatgagaagatggtttggaggtgggaattcaagtggcgtagagaatgctttgtgtgggagaattcaaagctcgggtacggatgtttggctatggaggaagggcagcatatgcggaaacttcactacaaatactgcatataaatggatatctagcataaacagaccgcaagagaagctggacatttattctcggctatggcactccaaaatacctataaaggcattatttttcatttggaagcttctcaaaaaccgtttggcccaggatgagatgtattgccctttctga

SEQ ID NO: 13980 - DNA, 762 bp, Glycine max
  Peptide Sequence Number=SeqID_130758
atgagtgaaatagagaaggtgcaagagcagatgaaggccgacatggaggccatgaaagagcaaatggccacaatgatggaagccatgatgagtatgaaaaaaatgatggaggtcaatgcgactacagttgtttccgcaagtaccgccatagaagtggacccaactcgcccatctagcctcaatcaagtaagtcctccagtctcgatgacatttttcccaccatatgacttgcctcccaactatacaccacccaatgttgcacacgctcctgatgaggatgtcgataactctactcctatactcattgagaatcaacaaccccaatttgatcatgcacatgtctctcaacccatagaggagacacatgaagcaccccgagaccacaatctagtcgacttcgaacctcacctcggatatgccactgaggggcaagcagttggtggaagagtccctcttgctatggtggaaaggagaaaatttgatcatatagaggaaaggttgagggccattgaaggaggcagagattatgcttttgctgacatgacagagttatgcctagtgcctgacgtcatcatcccaccgaagttcaaggtgccgaatttcgatacgaaagtcttactggggcagcttgatgtaagctccattggagcttgtaggcctaggatcttcttcatcaatggattcctttgcttcttggaagatgaatggcagcggaatggagaaggaagagagagaggagacgccacttcaaggagaagatga

SEQ ID NO: 13981 - DNA, 876 bp, Glycine max
  Peptide Sequence Number=SeqID_130759
atgggggagggatgttgtacgcagccttacccttgcatatgcaaagaggctgtttccggatttgaacccatgaccaacaagtcaccaaggcacaactttaccgctgcaccagggctcaccctcacccaagacactataatacaagagtatatttgtggcactgaagtcactagaccctgtcaccctgaacacaaagccaacccacgtggtggaatgctatggtctgtcggagtcccagttgttgttatagtgggcttcataagggcattaatagatgctacatcttctgacagcagtcttgaggaagagtcaggtgttagaatggtggctttatttgaccatgaggaagttggatctaactctgcccaaggagctggctctcctgttatgctaaatgctgtgactagggttaccaattccttcagctccaatcccaaccttctggagaaagcagcacaattaagctaccttgtatctgccgacatggcacatgcactacacccaaattacatggacaagcatgaagcaaaccatcagcccaaactacatggaggacttgtcattaaaaccaatgcaagccaacgctatgcaaccaatgttgtcacatccttcatattcagggagatagcatcaaaacataaacttcccgttcaggactttgtggtgcgcaatgacatgtcatgtggttcaaccattggtcctattcttgctagtggcgtaggtattcgcactgttgatgtaggtgcaccgcagttgtcaatgcatagcatacgagaaatttgtgctgttgatgatgtgaagtattcatatgagcacttcaaggcattttaccaagaattctctcatgttgatggtaagatggtcgtggatatatag

SEQ ID NO: 13982 - DNA, 130 bp, Glycine max
  Peptide Sequence Number=SeqID_130760
atggacgaagaccagtggatgtgtgatagtatgatgtctgaagaagttgatatgaatgttgaaattgaggagcatgctggcattaaagtagaacacgttgattgctctgatgcctttaatacttctctag

SEQ ID NO: 13983 - DNA, 357 bp, Glycine max
  Peptide Sequence Number=SeqID_130761
atgaactatcaatacggaaagcccttttgcggcaaggaacgtagaacagagcaggcatgcatgatggaagaagagcggggaaattaccagcggcgccagccaagccgcgccgatggaggagtgaagacgttgtttgtgatgagagctgaaccatattggtggctcggcgagccgcgacagtccacgccgccatgcttcggtgctgaagctgaactaaacggattaatggagattgcagttgccagacgaatagaaaatgcgacaaagttgctatttttatgtaccagaaggatcggttcccttccggcagtaaaaattatttttagtacaatacaacgtacgtctagcatgttttaa

SEQ ID NO: 13984 - DNA, 345 bp, Glycine max
  Peptide Sequence Number=SeqID_130762
atgctgatgctgttggctttatggtcttccattgaggatcggagctatgcttcagcagctatccacgaccatttcatcgtcaaatttgagcacggtggaaacaacgccattgaggtagaagtcatagatgagggggaggttgtgcttgagaagcttcccgaagatggagaaggcaagagcgaccttgccgacgtggaagaagcagttgatgaggatggtgagggtgatgtggcaaggggcggcgtgagactccttttgggtgcagaggaaaatcgcggcggggaagcacttcaccttcgcgagggaggtgaggactcgattgagcgcaaggggagtgcgagttga

SEQ ID NO: 13985 - DNA, 615 bp, Glycine max
  Peptide Sequence Number=SeqID_130763
atgaagcatcgtccacctgggtcaggaaaaggcacccagtcaccaagcataagagatgagtactgcttgtgccacttagctactagtgacatgttaagagcagctgtgacagctaaaaccccttctggtattaaggctaaagaagctatggataatatgaagcaatttagaaaccatcatgtcaaaaagcttgatgagatactggaaaagcagggaaataaagttgataaggtactcaattttgcaatttatgatgctatccttgaggagcggattactggccactggatatgcccatccactggcaaaacttaccatacaaaatttgctcctccaaaggtccctggggttgatgatatggtgatttctttgggtgcactgctggttgaagttgctgttactggtgaacctcttattcaacgcaaggatgaccctgcaactgttcttaagtcaagactagaggcgttccacaagcaaactgaaccagttattgattactactcaaagaagggcattgttgcttatctcccgctgagaaacctccctaagaggttgttttgtacctttgttaaggcggattttgacattaatgaaattggtggtgtggacttttga

SEQ ID NO: 13986 - DNA, 2250 bp, Glycine max
  Peptide Sequence Number=SeqID_130764
atgaaatctaaaggtgcaggttgcagtgctcagttgcaatcctctcagactcaagttcttctccaactgaaaaagcacttggagtacccaaaacagttggaaatatggagagatcgttggacagatctttgctctatttcttctcctgggcaagtgaatgtcacatgcaaggacaattttgtcactgagctcacaatcttgggtgatgataagccaacaacaaagggtagagattttgatgggtttgccattccaaatcaaacactatcagagagcttctccatggactctcttgtggccactctggcaaggttaaccagcctgagagtccttaaccttgtctctttgggcatgtggggaccactccctgatagaattcacagactctatgcacttgaacatttggacttgagttccaattatctttatggatcaatccctccaaagatttgcacaatggagaaccttcaaactcttagattggttgataacttcttcaatggtaccatcccaagcttgttcaattcatcaagccacctcacagttcttagtttgaagagtaacaggttgaagggtccatttccaccttcaatccttagtgtcaccactttaactgaaattgacatgtcaagcaatcaaatatcaggtagcttggaagatttgagtgtcttgagtagcttggaggaactagatttaagggaaaacaggttagagtctaaactacctgcaatgccaaaagggttgataagtctttacctcagcagaaactccttctcaggtgaaattcccaagcactatggtcaactaaataggcttgagaagcttgatgtttccttcaattcactcacaggcactgctccttctgaacttttttctttgccaaatattagttacttgaatttggcatccaacatgttgaatggaccactccaaaaccacctaagatgtagcagccaacttagatttgttgacatatcatacaatagatttgtggggggcttgccttcttcactgaacactactaaatcagaaaaaatagttgttaagagtgatggaaactgtttatctgggagtgtgcagcatcagcatgcagtatcctactgcacagaagctcatgtgaagaagaaatcatacagagttggaatttttgttggactcattgtgggaattcttttcatcattgtggttttggctttgaccataattataacttgtaaaaggtatttcccttggggggtgtcagagcagcacctattgcataaaacagttcaagatagcagctatgcagcagggctctcctctgagcttgtcacaaatgcaaggtatgtttctgaagctgaaaagttaggcagagaggacctccccacatgtaggtcatattccttggaagagctaaaggaagccacaaataactttgacaactctacttttatgggtgaaaatatatatgggaagctttacagaggaaaattggagagtggaatacaggttgtaataaggtccctgcctttgtcaaaaaagtattcaatcaggaatttcaaactgaggttggatttgcttgcaaagcttcgtcaccctcatttggtatccctcctggggcactgcattgatggtgttgtaggagagaataatgaggcaaatgtctttctcatttatgaatatgtgtcaaatgggactttccagacttatctctctggagatagtccaggcaaggttttcaattggtcagagcgattgtctgtactaattaatgttgctaaggctgttcacttcctacacactggcatgatacctggtttcttcaaaaatcgacttaagaccaacaatatcttgctgaatgagaattggatggcaaagttgagtgactatggattatccattatatcagaagagactgatgcatgtggggtaaaaggagaaagttctgattcatggcaaatgaaaatgttagaggatgatgtttatagctttggattcatactactcgaggcacttgttggaccttcattatcagctaaaagagaagcaaatgtgctgaatgtaatggcatctttcaatagtcaagatggttggaaacaggttgtggacccagttttgcaagctacatgttctaaagagtctctattagttgtgatttccataacaaacaaatgtatatcttctgagtcatggagccgaccatccattgaagatgtcctttggaaccttcaatatgcatctcaaattcagggaacagctgatgggggataa

SEQ ID NO: 13987 - DNA, 700 bp, Glycine max
  Peptide Sequence Number=SeqID_130765
atggccaatggacccttaagcaaatggttctatgaacaatgtgagtcaccactctcttggaagcaacgacttgaaatttgcattggggctgctaaagggcttcactatctccacactagttcagttgaaggcataatccatagagatgtgaaaactgccaacattctcctggacgagaattttgtggccaaagtagcagattttggtatatcaaagaaagggtcttctcttgatgagagccttgtggtcactagtgtgaagggcacttttggttacatagatcctgagtacttcagaacaagccatctaactgagaaatcagatgtgtactcatttggggtggttctaatagaagtaatctctggtaggcctgctttagaccatggtcttcccacagagaaaattaatgtagcaacatgggcaatgaattctgaagtaaagggtcagttacatcagatcatggacccaaatatagttggcaaagcgagagtttcttctcttaacaaggtttgggaggtggctaaaaggtgcctggctgagaataggatcaatagaccaccaattggttttgtcttgtgttgtttggaagatgctttgcaccttgaactcagcaacatagctgacgaggaaaattcatttttaaattgtgaaatgcaagataatgtcagaagtgaaagtgagctagttgccgtgttaccaa

SEQ ID NO: 13988 - DNA, 234 bp, Glycine max
  Peptide Sequence Number=SeqID_130766
atgaagaaaaatataaaggaaaaggaagttggtgttagccgtgtggttagggaaggttacactagggaagagaaattagaggaagataacagtttggtagggagggagatgatgaggggacagcacatgcccttggatcacggtctacatcagaacggatttcggaggaaaactcctcaaaccacaaaatctaaagtagcaaaaatcatctttatcatacaaattaatttgtaa

SEQ ID NO: 13989 - DNA, 903 bp, Glycine max
  Peptide Sequence Number=SeqID_130767
atggcatatattggtgccaacctagatgatggtgcgacagttggcatcagagatgcagagcatgaagaggaagggataaaggctcccgtcactaaatccgcaatcatgaagctcgataccaccggtctcgaatcgtttcccacactgcttgcgcctcaaaacgacgtcgttggagaactctccgccgctccatccttcgaccttccgaattccaacgatttcgatgggtttgtgaaagaagctattcagatggtgaagcccgcgaagggtactacgactcttgcttttatatttaaggagggtgttatggtagctgctgattctcgagctagcatgggaggatatatatcatcgcagtctgtgaagaagattattgaaattaatccgtatatgcttgggacaatggctggaggtgctgctgattgtcagttttggcacaggaatcttgggatcaagtgtcgtttgcacgagttggcaaataaaaggagaatttcagtgacaggagcctcaaagctacttgccaatattttatactcttatcgtggaatggggttatctgttggtaccatgattgctggatgggatgagacgggtcctggtctatattatgttgatagtgaaggaggagacttaaaggcactagattctctgttggatctggttcaccatatgcttatggtgtattggacagcggttgaggaagctgctgaacttgctcgacgagcaatttatcacgcaacatttcgtgatggggccagtggtggagttgctagcgtttactatgtgggtccaaatggatggaagaaattgtccggtgatgatgttggggaacttcattaccattactacccagttaccccaagcaccgtggaacaagaaatggttgaggcaactggagcttga

SEQ ID NO: 13990 - DNA, 513 bp, Glycine max
  Peptide Sequence Number=SeqID_130768
atgcagttcgtgaatcaatggaagaactccaacaccatcaaccatcagcaacaatcaagtccagaaacaaccatgctcactacatggtccccaccatcgagaaatcaagtcgaatgtaatgtagatgcagccatatttgaagatgtcaaacagtttggagctggcttgtgtttaagagatgaaaagggcaatttcctcaaagcatttactgccacaactactggagttccaacacctagagaagcagaggcttgggcacttcaccaagccataaactggactcaccatcttggtatgcaaaatgtgatttttgaacttgattgcaaactggtagtagataacatggtcaacaacaagaagggctctacggaattccatgccattcttcatagatgtagagcaattctttctaattccccaaactcaaggatgagttttgaaaagaggcaagcaaatctaataactcataacctagcaagggcttcaagattttatgttaactcatgtttttaa

SEQ ID NO: 13991 - DNA, 272 bp, Glycine max
  Peptide Sequence Number=SeqID_130769
atgggaaggaattgtattgggtgttcacctgggattgcagagagtgaagcggaaagtgtggttggtttgggacggagggagagtgtgcgaagagagagtgagagagatgtgagagcggacattccgactcggaaaagcgaaaaccctttgcagtttgaagggttttacaagttggaaggagctccaccaagaagcagaagcatagcgggaaatggagttttgttcattcgtttcgtgaaatatctttcttatcgagttctctattacggaac

SEQ ID NO: 13992 - DNA, 1283 bp, Glycine max
  Peptide Sequence Number=SeqID_130770
ttggttcttctgttggggctatggctgccattgctttagctggtttgtgttattgctgccttgggagattcaaatcaaagtctactcaacagggccattcttggctgcctttacccttatatggaaactctcagaccatgacaaaaatgtcaacaacttcacagaagagtgcaactgcaagcatcatttctttagcttcatcaaatctcggacggttgttcaccttccaagagatccttgatgcaaccaacaaatttgatgagaagctgcttcttggtgttggtggttttggcagggtttataaagggactcttgaagatgggaccaatgtggctgttaaaagggggaaccccagatctgaacaaggtcttgctgaattccgaacagaaattgagatgttatccaagcttcgccatcgccatcttgtgtccctcattggctattgcgatgagagatcagaaatgattcttgtttatgaatacatggctaatggacctctcaggagtcatttgtatggaactgacttaccacctctatcatggaagcagcggcttgaaatttgcatcggagcagcaagaggccttcattatctccacacaggagcatctcaaagcataattcaccgcgatgtaaagacaactaacatcctcttagatgataactttgttgctaaggttgctgactttggcctctccaaaactggtcctgctcttgatcagactcatgtgagcactgctgttaaaggtagtttcggttatcttgatcctgaatacttcagaaggcaacagcttacagagaaatcagatgtttattcatttggagtagttttgatggaagttttatgcacaagaccagccttgaaccccgtccttccaagggagcaggttaacatagctgagtgggcaatgagctggcagaagaaaggaatgcttgatcaaatcatggatcagaatctggcggggaaagtcaatcctgcttctcttaagaagtttggggagacagctgagaagtgcttggccgagtatggggtggatcggccgtctatgggcgatgtcttgtggaatcttgaatatgctttgcagcttcaggagacctcatcagcactcatggaacctgaagataacagcacaaaccacattactggaattcagttaacacgtcttgagccttttgataacactgttagtatgattgatgggggcaactttttcacagatgatgatgcagaagatgctgcaacaagtgcagtgttctcacaattggtaaatcctcgcggcagatga

SEQ ID NO: 13993 - DNA, 441 bp, Glycine max
  Peptide Sequence Number=SeqID_130771
atggctgtctcaagaagcaatggcttaatatttgtcatgttttttgcaatctttgtaatgcatattaatgcagaaactcaaacctgcaccaaccgtaggagtccatgttttctcaagaaaatacaatgcgctgctgaatgtccttcaaagtcaccaactaacctaaaagccaaagtctgctatcccttatgcaacactcaatgcaaaaattgtaaccaaactgcaatggccctggatctgcatgcttggacccccactttgttggtgcagatggaggtgctgttcaaattctatggtttatcttcgagattgaaggagttcttggcaggacttatcagccagttttcagaatccagcaaagccaggtgtggcaatgctagtgtaagaggggaagataatatagaccacattacttatttcatccgcagaaatatcacatga

SEQ ID NO: 13994 - DNA, 2544 bp, Glycine max
  Peptide Sequence Number=SeqID_130772
atgtttcagaaaaatgttgctaagatatgggattggttgatgaatgatggtgagttgataattggtgtgtatggaatgggaggagtggggaaaactagtatgctaatgcacatacataatatgcttttaacaagagtcaccaactttgatagtgtgttttgggtgactctctcacagtcatttagcattcacaaattgcagtgtgatgtagccaaaatagttgggctagatatttcaaaagaaagtgatgaaaggaaaagagcagcaagattatcatggacattgatgagaaggaaaagatgtgtactttttttggatgatgtgtggagttattttccactagagaaggtgggaattcctgtgagggaagggctaaagttggttttgacaagtcgttcattagaagtgtgtcgaaggatgaattgtcaaaacaatgtcaaagtggagcctcttgctaaggaagaagcatggaccttgtttctagataaccttggacaacagactactctttctccagaagtaacaaaggttgctaggtctgtcgcaaaagaatgtgctggtttaccccttgcaattattacaatggccaggagcatgaggggagtggaagaaatttgtgagtggcggcatgctctggaagaactaagaaacacagaaattaggctggaagaaatggaaatggaggtactccgtgtgttgcaatttagctatgatcacttaaatgataacatgctacaaaagtgcttcttatgttgtgcattatatcctgaagactttgaaatagacagggatgttttgatagaaagttttgttgatgagggactggtgaatggaatgaaaagtttggaggctatgtttgatgaaggacaaaccatactgaataagcttgaaaacagttgtcttttggggaaagtggaaaattatgttggtggaaaaaaatgcatggggttacaggatgccagcagtcatatagctatcagcatgatgaaaaggggatgccaatgtgtggcaccaatagataatgtggaaggctattatgtgggaagtcaattggtgaaaatgcatgatttggtgagggctatggctattaatgttataaaggtgaactaccattttcttgtgaaggctgggttgcaattgactgagattccagatgaagtagaatggaacgaagacctggagaaggtttctctgatgtgtaattggatacatgaaattccaacaggcatatcacctaggtgtcctaaacttagaaccttgatcttgaagcataatgaatccctgacaagtatctcagattctttttttgttcacatgtcttcactccaagttcttgatttgtccttcacagacattgaggttttgccaaaatctgtggctgacttgaataccctcactgctttgttgctaacatcttgtaagaggttgaagcacatgccttcgctagcaaagctgcagaccttaataagattggacctatcttttactgcgatcacagaaatacctcaagatttggaaacgttggtcaaccttaaatggcttaatctttatgcaaaaaatttggtgtcaacaggaaaagaaatagcaaaattgattcacctgcagtttctgattcttcattggtggtccagaaagataaaagtgaaagtagaacacatatcatgcctgggaaagttggaaacatttgctggtaacttatacaacatgcagcatttcaatgcctatgtgaaaacaatgcatgaatatggacctagaagttaccttcttcagttagacagtgaagagtctcctggtaaatctccatggtacttttttgctgaagtttgtttcagcaaggatgtgatcatttcaaactgcaaaatcagaacaggagtaacaccccttatgctcccttcagacattcaacgcttgaaggttgaaagatgtcatgacataagaagcttatgtgatattttgtcattaaaaaatgccacttctttgaagcgctgtgagattgctgactgtgatggccaagagtacttgttttctttatgttgctcttcctcctgctgcacctctcttcacaacatagaatctgtggaactctataacctgaaaaacttgcacactctttgcaaggaaaacgaagctgtggctcaaacccttccacctccaggagcttttacttgtctcaagtatttttgcatctaccattgtcccattatcaagaagttgctgacaccaggattgctagcctatctacagaacttggaagagataattgttcataattgcaagtcaatggaggaaataatttcagtagatggcatagattatgaaagctctggtggtaacaaatattgtgtggctaatagagatgctgttaaagtcacacatccaaagttagtatcattatcattgaagcacctaccagaactcaggagcatatgtagaggactaatgatatgcgagtctctacaaaactttaggatctttaaatgccctaaactaataaggctccctgaaactgctaccccagttcagactttgtacgattgtttctga

SEQ ID NO: 13995 - DNA, 360 bp, Glycine max
  Peptide Sequence Number=SeqID_130773
gcaactttcaataagcctacaccaacttctttggaagtcaccttagttggggcattgaggactaaggtggacaatcttggtgtagatgtcatggtagcattatacgaaactggtttggttactgattgccctagaggggaaaacaaaggtcgtgttctatccaatgactatgttgtcagaaaacttgaaaagctctgcactgtcaaagactaccctgctaagaagacaatgtcaggaactgctactttttccttatgggatacattcaacagcagcaggtgtggcatggcagtctttgttcaaaacagctctcatcaaatttttggttcacagaattttcagctgccagatgatttgtga

SEQ ID NO: 13996 - DNA, 825 bp, Glycine max
  Peptide Sequence Number=SeqID_130774
atggccgtcgccgtcgccggccgccagaagccgagctccgacgcgagcctcttcacgctctgccccttctggagctcgcgcaacgctactcaaaggtccaccaaaacggtgtcgtccgtcgccaggtcgctgctccgtccgcgccggaaactccgcctcgatccttccagttacctctattttccatatgaaccgggaaagcaggtgaggagcgcggttcggttgaaaaacactagcaagtctcacgttgctttcaagttccaaacgacggcgccaaagagttgttacatgcggcctccgggtggtactcttgctccgggagaaagtttgattgcaacggtgtttaagtttgtggagcaacctgaaaacaatgagaagttgtcggatcagaagcacaaggtgaagttcaaaatcatgagtctcaaagtgaaggaaggagtggactatgtacctgagctgacaaaacttggtatcacagggaagagtttaggtctacagatttgcaagttgggtagactaaattttgatgaacaaaaggatctagtgacaatggaacgaatattgagggttgtctttatagatccagaacggcaaagttctgtaagtcaaacttctttgcaaattgtcctggttcaggtctacggggttttggaaaaactgaaaagacaattggctgaagctgatgccgcagttgaagctcggaagaagcctcccgtggaggcaggtcctcgggttgctgccgaagggcttgtaattgatgaatggaaagagagaagggagaagtacttggcccggcaacaagttcaagcagtagattcagtgtaa

SEQ ID NO: 13997 - DNA, 327 bp, Glycine max
  Peptide Sequence Number=SeqID_130775
atgggaggaaataaggaagaacagttggcgtgtcccaggaagccggtagaagacagtccccgagaagaggaagcacgcaggatcgaaaagaaacaacatgacaggcacctcaacacgacagggagggagcagtgctttcacgaaagtggaagtgttgactttgaaagtagccacaagatgtcaaggaggtgcaaaaagcaattggaccagggtagtgcaaatgataagtggcctgccatagttacaaaacaaaccacaaacggtcaacaacagcacaacgcggatctggagaaagttagaagagacaaaaatggtagcaatgactag

SEQ ID NO: 13998 - DNA, 225 bp, Glycine max
  Peptide Sequence Number=SeqID_130776
atggagatcggatctatttcagcaccaaggggaactatgggccagaatattggattcaaaatatggtggctggaggaacaaggaggaggacacagctcatctatttttcaactgcagcaaaaccctccctatatggtgggaatctttgtcttggataaacatctcaggtgcttccccgcaaaatccgagacagcatttccttcaacatgcacacgggctggatga

SEQ ID NO: 13999 - DNA, 462 bp, Glycine max
  Peptide Sequence Number=SeqID_130777
atggcaaaaacttgcctaaggtggattggtcttgaagatcaacagaggttccatggtttgacacagacaaattacaaagaattgaatgtattgtacgagaagtacaagaatcaaggatttgaaatcttggcatttccgtgcaaccagtttgctggacaggaaccaggaaacaatgaagaaattcaggaagtagtttgcacaaggttcaaggctgaatttcctatctttgataaggttgaagtcaatgggaagaatgcagtgccactttacaagtttttaaaggagaagaaagggggaatatttggcgatggtatcaagtggaacttcacaaagttcttagtaaacaaagaagggaaggttgtggacagatatgcacctaccacctcacctctgaaaatcgaggacataggcaatctgtccggtgtcttcgaaggacaagtagcaatatgtatcatcaattaa

SEQ ID NO: 14000 - DNA, 1392 bp, Glycine max
  Peptide Sequence Number=SeqID_130778
atggcttcctcaatattcagaagcctccaagttcaccccttcatgctttatccaacaacattcctcagacgaagaaatggggtttttcatttgacgaccaaagccacacaatcccaaacagacacccaacagaggcaacctcagacaaaggtttcatcaagcaacagcacacagtccaaaaagctcgacaaaattccaaaagactatgaagccatcattggcattgaaacacatgttcagctctcgactctgaccaaagccttttgtggttgcccttacagttatgggtcttcacccaacagcagcatttgccccatttgcatgggcttgcctggtgctttgcctgttctgaactcaaagataattgattttgctgtcaagttgggccttgctcttaattgcaacttggctttcaaatccaagtttgacaggaagcagtatttctaccccgatcttccaaaagggtatcagatttctcagtttgatgtgccaattgccactgctggctttcttgatgtggatattcctgttgagtttggtggggggcacaagaggtttggcattacaagggttcacatggaagaggatgcagggaagctcctacatgcagagaatggaaattactcacaggtcgatctaaatagggcaggggtgcctttgcttgagatagtttctgagcctgatatgagaaatggtattgaagcagcagaatatgcagcagaattacagaggttggtgcggtatttgggagtgagcaatggcaatatgcaagaaggttctcttcgttgtgatgtaaatgtatcaatacgacctattgggcaatcaaagtttgggacaaagagaacaattacaatgaggaaaaaggaagggcttgctgattatcgatattttccagaaccagaccttccagcagtaatcctttctcaagaatatgttgatggtataaaaaattctttaccagagcttccagaaattaagcggagaagatatgagcagatgggcttaagcatgcaagatgttcttttcctggctaatgataaaaatcaaattgtcagtctaaaatacaaactcataaaagctgactatgaactaactacatgtttgcaaattacagggtgcaaccagattgcagaattttttgatgcaactcttgcaaaaggtgctgactcaaagctggttgccaactggataatgagtgatattgctgccttcatgaaaaatgaaaagttgaccataaatgagataaagcttacacctgaagagttgtctgagttgatagcttccattaaaggtggaaccattagtggcaagattgggaaggagatactatttgagctattagccaagggtggaactgtgaaggaactcatacaaaaaaaggacttggttcag

SEQ ID NO: 14001 - DNA, 1566 bp, Glycine max
  Peptide Sequence Number=SeqID_130779
atgggggtaacatgtgggacagaacgtgacaaaatcattgataggataagggccatggagaaaccaattaggagaatggttaagaaagagcaaatagacttgttatgcattcaggagactaagatggagcaaattgagaagacgatgtgtcaagcactgtgggggaactctgaagtcagctggaaaatgcaacctgcatccaatacagcagggggggtgtggattcaggaggcacagaaagttcatatagtcagcatttattcaccatgcgatattcataacaagagagctttatgggacactgttaggcagatgaaaaattcaaaccctggaggtctatggtgcatattgggagatttcaacaatatcagaactccatcagaaagactgggtgcttgtcagaggggggtggatgacaggaatatcaaggagtttaatgaatggattgcggatttggaggtagaagaagtgccaagcgtggggagaaaatttacttggttcagaccgaatgggtcagccaagagtaagctagacaaaatttttgtatctgctgactggttcactaaatggcctgaaagtacacaattcattttggataggaacttctcggatcactgcccctttctgctcaaatctaaacatgtcgactggggacccaaacctttcaagatcctcgattgttggcttcaagataggtcattcaggaaaattgttcaggaatgttgggcaaacaatcagcaaaggggatggggggggggggggggggttgtgcttaaagagaagataaaacgactcaaggggaggttgaaggcagctatctccccaagaattgctgatccggaaaaagctacaggaggggatttatggatagttgcccaatcacatgagtctttactgaggcagaagagcattggacagcaacaaaatgatatattgatggggcgcttccatgaggatgaaataaagagggctatatgggactgtggaagtgagaaaagtccttgtccagatgggctaaattttaagttcattaacgagttctggcaagtgattgatccacaaaatcttaatgaatacagacctatttcgctaataggttgtatgtacaagattgtggctaagatattagcaaaaagattgaagaaggtgctaccagccataatagatgaaagacagtctgctttcatagggggcaaacatttgttgcacagcgtgatcatagcgaatgaagcggttgaggaaggaaaaaggtctgcttctatttcagtattggtgaatggaagcccctcgtctgaattcatcccacaaagaggactcagacaaggggatccactagcgccccttttgtttaatattgttgctgaagctttaaacggattgatgagagaagcagtgcagaagaatatattcaggggattcttagtgggaacaaacaatgtggaagtcagcatcttacaatatgctgacgacacaatatttttcggtgaggcatcaatggaaaacgtcaaggcaatcaaagacattttgaggagttttgaactcgtatcaggcctcaaaattaattaa

SEQ ID NO: 14002 - DNA, 465 bp, Glycine max
  Peptide Sequence Number=SeqID_130780
atggatgaacgagcagacattgcatctggccctgtgtggatggagtacatagcctttctaaagtcattgccggctataaatgctcaagaagaatcacaccggatgactacaatgaggaaagtctatcagaaggctattgttactcccactcatcacattgaacaactttggaaggactatgaaaattttgaaaattctgttagccgtcagttgttgttctttgttggtattagattagaatattttaaaggcatgcaatttgacgataagagtcagttgacaattacaactgtaactgctcatagcttcatttcgatcctcgtttcttctttcatggcttccgcttccatccctcctccccctcctccgccagtgaacggtggaactccgcttggttctgtgcttgaaagggtaatagggaaaattgagaaaaggaaaacagcaactcaagaacttcccctttga

SEQ ID NO: 14003 - DNA, 375 bp, Glycine max
  Peptide Sequence Number=SeqID_130781
atggacaaacccagtggaggtgacaagtataatgttgaaaccgcggaaatcttggcaaacgaggctcagcatttgcccgtcgcggaggccacacccatatacgagcagcttctgctattgtttccaactgcagccaagttttggaggcaatatgtggaggcacatatggctgcaaataatgatgatgctacaaaacagatttttagtcggtgcttgttgaattgtcttcagattcctctatggtatattgtttgcattatcttgtttatggcattggctgctgggggtagggaaggggaagtttctgggaagagaatgggctacaagctcactgcttgtcgtgtagctgtatttctgttcgatcaaccaaaatga

SEQ ID NO: 14004 - DNA, 180 bp, Glycine max
  Peptide Sequence Number=SeqID_130782
atggatgaagtcaagcggtgttacattcgttttattagaaaggtaaatgacaagaagggcatggagggtcaagaagagacaagaaaagcttttgattttatgcttaactatgttgcaatagagactttggtgaaaagaagattgattagaggccctagtgggaattggaatagtggataa

SEQ ID NO: 14005 - DNA, 585 bp, Glycine max
  Peptide Sequence Number=SeqID_130783
atgagtggtgctcacaaggatgttggtgacacagaggacacgccaatatggtcagaagaaatcaatgatggccgtttctttgaagcaatcaatgggaagaaattttaccatgtatgtacagcaccagtgaaatacgaccctagatggagctctgacaaagatgtggcctttattgtcacaggagcacaacttcatgtgaagaaacatgaatcaaggagtgtccttcatttgaggctgttgttctctaaggtgtctaattgtgcagttgtaaaatcaagttggacacagggctcctctgggttatcccagaggtctggcattttctcagtcataagcacatcaatttctggtaaagaccagaaccagaaaaaaccggttgtggttttggattcaagtgtatttccaacaggacctccagtgcctgtgcaaacacaaaagctgttgaaatttatagacacatcacagttgtgtaaaggtccacaagatagtcctggccattggttgatcacgggggcaaggttggtcttggacaagagaaagatatgcttatgggctaagttctcattgttaaatactggttcatga

SEQ ID NO: 14006 - DNA, 174 bp, Glycine max
  Peptide Sequence Number=SeqID_130784
atgggaagatgcagacagcagagagctcatgacggagcaacggcctcaggagacgacgccggagattgtgcgagggcggagaacacaaacatcagaagcagtgatgctcgtcatatcatcaccacggaaaaggggaatgaggaagatcggcgaaagaaaataaggggatattga

SEQ ID NO: 14007 - DNA, 758 bp, Glycine max
  Peptide Sequence Number=SeqID_130785
atggaagattttcaaagatcatttttgagccggctattgactatgcatcctaacggtgaaaattttatcagattcattgagaacttcgggacacacatccttgtggggcttggcattggtggcaaagatttagtgttggtcaagcaagacgtgtcttccaacttggatccatcagagctcaagaagcacttggatgagcttggaaatcaaatattcaatgggacatgcaattttcttccaaaatccaaagaacaaaaatataaggcgccacaagcttttgatgtctttggtccacaaattgttgccttcgatagctctacatccgtttgtgcaaaagatggaattacggtgatatgtgcaaaaaggggaggggatacccaagtgagagaccatagtgaatggcttctgacagttccaaagaagccagatgctgttgattttagcttcattcccatcacttctcttcttaaaggtactccaggcaaaggcttcctatcccatgccatcaacctctaccttcgatataagcctccaatgtcagatttgccttactttcttgactaccaatctcacaagctttgggctcccattcacaatgatcttccactcagtccagccacaaatagaactaatctttcgccttctcttagtttcgacttgatgggtcccaaactttatgtaaacacctcaaaggtaacagttggtaaaaggccaatcacagggatgcgcttgtttcttgagggcatgaaatgcaacag

SEQ ID NO: 14008 - DNA, 225 bp, Glycine max
  Peptide Sequence Number=SeqID_130786
atggaggctgaggaagggttccaaggtctaaagagtgagggaattaagagaaagaagaggaaacgatgtcgaggtgctaccgaatcgcgaccgcgatcattccttactacgtttcttgttctgcgttcttcatgcgaccgtcgggcccccccttgttatattgcacattcatcttctccatttatcattggcgatctcgtttttctttgtaaagttcaatcttaa

SEQ ID NO: 14009 - DNA, 384 bp, Glycine max
  Peptide Sequence Number=SeqID_130787
atgcgcttctcaagtttaattcaagacaaaaatccaagaatacaagatgcaaacatcaagaagatctctagtgttttaggaagggaattccaaattgaaactgcaaaaggtttggccaagaaatttaagcaaaaatgtctttttcaagagatttactctctgcgggggcacaaaaaggccaagacagatgggccaaagcgtttgtctccaaggaagaaaatgagcaaaattgccaccaatgtttattggagaaaaacgttagaaaaaccaaaaagaagaaggtttgcggattttgaaaatgagggttcgggagttggttacgcacgggaaagcttattaaccttcaatcccttaaagataagttgtggtactaacgatctgtaa

SEQ ID NO: 14010 - DNA, 211 bp, Glycine max
  Peptide Sequence Number=SeqID_130788
tctctagccacacgcacgtccaggggcaacatctctttaacgttgaaacgactagaggaagaaatgcagaattgaggttgaaggggagtggaaaaggtggagagcttgggggagatgatggtattccagagatggtggggtttggaggaagagttgcgggtgccatagaggtgccgagagagggcaggttgaggacggtgctggatttgag

SEQ ID NO: 14011 - DNA, 249 bp, Glycine max
  Peptide Sequence Number=SeqID_130789
atgtgtagaacgagtaatttctgtttgaacaatcttggaagtcaaaactcaggagtgcagtgttgcttgccaatgtcagaattcacaagcagttctcctcaaatttcagccagcctgcatcaattagaccttgcagcttatgtttcagggtcctacaatgctcaatggaatgtcccggaaatcctccatgataagaacatgttgtattcgagtcgtatcctcagaaaaatggaggttgaggaaccttag

SEQ ID NO: 14012 - DNA, 2052 bp, Glycine max
  Peptide Sequence Number=SeqID_130790
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggatcccagttggagcggtggaggagcgacatcgaagcttccctattggactcgcaagtgttggagaggttggcctccattgataccacaagcatggaccgatttgggcccttcatttattgagcacgttgccgccaatcccttggaggcccaacaccaagagagagaaattgagaagtgcactgctgcttctgaggaagttcatccctcaacagctgctgaggaagtgcatccctcaacagctgccgaggtccaaaaggttaggagggaatgcgattctgtggagttgcaatatttgtctaaggattctctacttaattcgttggaagtgaatgagacaccgattgaagaacagagtagagatgcagatgtaccttgcccgcatgttattaataacaatgaccctgatctgatggaaaaggatctaacttctgtccctcgtaatgattaccataggccaagtttaatggaaagaaatagtaccactcctatttctgagtggaatgattcgatagacggcttggagggtggaacatctgatcatgcaattagatgtcatttgcctagccccaaggggacaaaagtttctccattgacaaagtataaaccaacaaaaattacaaggagtagaaaaacgaaaagatggagtcagttggaagaggagactcgaaagactgctgtagacaagtttggcaggggaaaatggaagttaatgctagattctaacaaagatatattcaaagagagaactgaagttgatttgaatgacaagtggagaagcatgacaaggatccgaatgtccctccaagaaaacggcccctccatcgccgtcgtgggcgtcaccggcgccgtcggccaggagttcctctccgtcctctccgaccgcgacttcccctacagctccatcaaaatgctcgcgtccaagcgctccgctgggcgccgcatcacctttgaggacagggactacgtcgtggaggagctgacggcggagagcttcgatggcgtcgacatcgcgctcttcagcgccggcggctccattagcaagtacttcggccccatcgccgtcgatcggggaacggtggtcgtcgacaacagctccgcgtttcggatggacgagaatgtcccattggtaattcccgaagtgaacccggaagcaatgcaaaacatcaaagccggaactggaaagggcgcactcattgctaaccctaattgctccaccattatatgcttgatggctgctacccctcttcatcgacgtgccaaggctgctagtggtgcgggtgctgctgcaatggaagagcttcagctgcaaactcgtgaggtgttggaaggaaaaccgcccacttgtaaaatatttaaccgacagtatgcttttaatctattctcgcataatgcgtctgttctttcaaatggatataatgaagaagaaatgaaaatggtcaaggagaccaggaaaatctggaataataaggacgttaaagtaactgccacatgcatacgagttcctgtcatgcgagctcatgctgagagtgtgaatcttcaatttgaaacaccccttgatgaggacactgcaagagatattctgaagaatgctccaggtgtagtggttattgatgatcgtgaatccaatcattttcctactccattggaagtttcaaacaaggatgatgttgctgttggtaggattcgccaggacctatctcaggatgggaaccaagggttggacatctttgtatgtggggatcaaattcgcaagggagctgcacttaacgcaatccagattgctgagatgttgctatga

SEQ ID NO: 14013 - DNA, 1503 bp, Glycine max
  Peptide Sequence Number=SeqID_130791
atgggcgtgtcttcaaattcaaaggaatcgatggaactatgcatatttgatttgaggagaggccaacacgaaggccaagagctcgataagatcctcttcttcttccccgccggtttgcccttctcaaagcaactctccgtcattggcctcagcgaaggactcatcactttcactagaatcttctctccagactctgcttgcgaggtcatcgaagctgaaaggcattctcatgttttctacgaggccgaacccgatatctggatagtcattgtggtcgagaaatgcaatgattctgaacctatatggagggttgatgcattaagaaaacttctcaaggaaattcactcactttttttcatgtttcatggatctattagagcaatgctggagaaagaacccggtggaggactgacaagacggcatttgtatacctttatcatggattatctgagggattttctcgtggggaaaaagttcattttaccatcattccgtgattgcttaaaggaacgtggaactgtgcagatgctgacgataggtcgtgaggctgcaattgaggttcagtcccttgtcagggtgcttgaatcttcagctggaaacactccctggttgactccccatgctctatcttctggaacaagttcctggtcctacttactgaaaggaagtgctgcatccaatgttgtcactgagtctaacatggcccatccaagcactatgtctgaaagtttttatggctcatctgatatatcctctggtgaagataaccactatcatgttgtgaggcccttacagagtgacaaatggtctaaaggaaaagatggttatcttgtcactgatttatggggtgcagaagttggtacgtgggtgtttgccactcctacagtttggcttcaacagacagaagagaaaatgtatctctgtgtttatcagcatagaagccttactttgatgcttctgattcctgtatcatccattcctaatggggagcaaggtgtgtcggcagtgaggcagcaagttattgaaaatgcatcacttaaaatattgaaagttgaagagaaactatcgaaaggatggggtggagagaatgcatatcatgttagtgggtaccgctacttattagtagatggtgatagaaatgtatccagggcttctccagaaacaaaagttacaactttaacaaaggagtccttacttgctatgaataagcttaggcaagaggtggagtcggagaagagtagagcaaaactggatagccgtaattgtgaaaaagatttagagatgtgcattagagcaaaaaataatgcatgggttatttctcgagtcacaagagggaaggagctttacatggttctagagaaagccaatgaaacccttctatatgcttcagatgctgctgagaagtttagcgacagatactcatccgcagattatgaggagtttggcaataataacaaattccccctaccaaactttgcaaatctgagcatccctaatccctaa

SEQ ID NO: 14014 - DNA, 303 bp, Glycine max
  Peptide Sequence Number=SeqID_130792
atgggctttcagggagtggaactacaacgtgccagcaaacatttcatggctttcggcggaggcatgagattttgggttggaacgaacttcactaaggtggcgacccatcaaaggaggaaacatcctccaaactccgggtttatagtttccaaatggttttcacgtccagatcatggaagaagatctgaggaaacagcaggaaccagaatataccattacaaattagaaaccaaaactccgcaagagagactcatatatggtagaaatttaggtttgacatttttaagaaacacaaggcgatga

SEQ ID NO: 14015 - DNA, 1968 bp, Glycine max
  Peptide Sequence Number=SeqID_130793
atggcattgcgttccgctatcaccctaataatcatcttcatactttcttccttctatgtcgtcggaattcaaatcatctccaaatcgaagctggagaagtgcgagaagaactccaactccgacgacaatctcaactgtactaccaaaatcgtactcaacatggctgttcccagtggctcgagtggcggagaggcatcgattgttgcggaattggtggaagtggaggaaaattcaagcaggaagatgcagacattgcgtattcctcctgtcataacggtcaacaaaacttctgcatatgccttgtatcagttaacatacatacgagatgttccttataaacctgaagagtattatgttaagacacgcaaatgcgagccagatgctggtgcaaatgtcgtgaagacatgtgaaaggcaagccatactgcgagatgaagagggtcatattatcgagtacactcagccaatatgttgtccatgtgggccccagcggcggatgccttcatcatgtggaaacttttgtaagtgctttgatgttgcaacattctttgacaaattgacaaaaggaaaggccaacactgcacattgtgtgcgtttccctggtgattggtttcatgtttttggcattgggcggcgaacattgggatttagtgttcgaatacaggtgaagagtggaactaaagtttcggaagtggttgtgggtcctgaaaatagaacagtgatctctgatgataaatttttgagggttaatcttattggagattttgttgggtacacaaatataccatcttttgaggatttctatctggtcgtaccaaggcagggcagccctgcgcaaccacaggatttggggagaaacatttctatgtggatgttgcttgagagagtgagatttaccttagatggtattgaatgtaacaaaattggtgtcagctatgaagcttttaatcaacaaccaaacttttgcgcttctcccttttggacctgcttgcataatcaattgtggaattttcgggagagtgcagggagttattctttctccataggaattacagaggttcttaatacaaaccttgtgctagaattaagtgcgaatgatgtagagtatgtttatcaaaggagcccaggaaagataataagtgttagtgtccctacatttgaagccctaactcaatttggtgttgctacaatcacaactaagaataccggtgaggtggaagcgtcatatagtttgacgtttaattgctccagggatatcaccctgatggaggagcaatttttaataatgaagccaaatgaggttacaacccaatcttgcaaaatctacccaagcactgatcaggcttcaaaatatttttgtgccgccgtattaaaggattctgcttataatgaagttgatagagctgaatgtcaatttgctactacagcaactgttcttgacaatgacacgcagggtatgccttttcaaccaccagaggccagtataaacagtttctttgattctatcgaaagcatatggaataaaatatggacaagcataacagaatttatcactggaaaaactttgcttgtggtattatggcttttgcaccagaaaggtctatttgatcctttgtatgactggtgggaggatatcttaggcgctgatgaacaaatcatcatggataaacgtaaattcaaaattgacaaggggcatcaccatattcatgataacaaacatcataagcaagaacataggcactctaactatagtgctgaaaataggcgaaggaccacttatgagcatatgcacaagcattctgaaaggaactccgattattttgatgatttacaccatgttcataaagaaatgcacaagtatgggcataaaaaacagaatatggataatgtgcagcatattgttgaccatcctgtacatcacaaacacagaaagaaacgggatagctcaaagggggagttaaagagatga

SEQ ID NO: 14016 - DNA, 839 bp, Glycine max
  Peptide Sequence Number=SeqID_130794
atggtgaagggagctcaatggtggtgcgatactttgacttcttgtgagatctttgaaaaagagcataggtggttccaatccgggttagggagaggagtgcgaggtggaaataatgtgagcttttgggaagcaaagtggttaggagacaaaaaaagcaagaacattagggaggctggtgattggtgtcgtggagtgtggtcatggcatttctcatggagacaattgtggttgcaatgggaaatcctcattgtgcaacaaatggatgaggccttgaagggttgggagccaaaggtgggtggaaaagatggatgggtgtggaaaaataatgctgcaaaaatcttcattgttaaagaggtttatgcatcattaattacagataggtttggagatgtttgttccttctttaaccaaatatggaatttacctgttccgtcaaaggttaaaggcttgttgtggagggtgggacataagattcaaactaaagataacttgaggagaatgatcatactacaagatggaactagtcttaattgggttttctacaatctaggcatggaatttgcaaagtacttgttgtttgaatgctgcttttgtcatcaaatttggcaaagatgctatgtatggctagggaaaataagggtgctacatgtggagggtaaggaacatttttctcaacatttcagaattttacctggggcaaaggctagatgtgtggaggggactgtgtcagttgaagtgatatggtcgttgtggaagcatcagaaccatatcatcttcaacgaagcaagtctagacgctagggagttgttagattctattaaatatcaagcttggagctg

SEQ ID NO: 14017 - DNA, 240 bp, Glycine max
  Peptide Sequence Number=SeqID_130795
gctgctgctgtatcagaaggtagacctgctccagcattaagtggaagtggagatatccgatctttaaacatggaagatttcaaatatgctcatcaacaggtatgtgcaagtgtttcatctgaatccataaatatgaccgagcttcaacaatggaacgaactatacggtgaaggtggttcaagactttgtgccggcctcataacgcttgcagggcttgaggccgagctgtttcgtctataa

SEQ ID NO: 14018 - DNA, 1254 bp, Glycine max
  Peptide Sequence Number=SeqID_130796
atggcaagtagcagcatggttccattccaagttccaatgctcaacaagagcaaccatgacaattggagcatcaagatgaaagctctccttagtgcacaagatgtttgggagatagtagagaaaggtcacaccgagccgaagaatgagggtagtctctctcaaactcaaaggcatagtttgagagactcgagaaagagagacaagaagcctctctatctaatctatcaaggattagataacgatgcttttgagatgctttcaagaaggtttcgaaagcaaagtcggcgaaagaagcttcaaacctcgtataagggagcaaatccagccaacaagaacgaggtcgtggtggagatcaaggaagaagacgagattggaggccctatgacgacaacaacaacttccaaaaaggaagctcaacaaagagctcctagcaaaaatagagttgaagagaagacaaactatgttgaagaaaaaagtaaagaaggagacactttattgatgactagcacgggtaatgaaaggagtgaaggcaatagatgtcgcaatgtagcattaggagatgaatccaaggtagaagtgaaaggaaaaggattagagttgctcttcaagaaggaaatggtgagagagttatcttgcaatgttggaaagcaattcaagaaaagctttccaaaggaatctaacttgagagctaaaaagttgttggaactcatacatacagatggtggtccgatcaagacaagctcacttgataagaagtctttggaagcattgctcgtgtgcacaataccgaatgagaaaagaagcaagttggatggcaaaagcgagaaatacgtcttcatcgattatgactccaattctaaaggctacaagctctacaatcctaattcagggaagacaatcataaatggcatagagaaatcatggatagaacttgcaagagaggagcctactaacccaccaattccaccaaaagcaaatactcaagaatacgaaatctcaaaagaatgcagaaccctaaaggagaagttgaaagatataaggcaagattggtgcaaaaactacaatcaaagaactagtattgactatgatgaggtatttgctcctattgctcgcctagaaaataccttggagaagaagtctacattgaacaacctcaaggctacaaagtcaaagaaaaagaagacaaggattgaaagtcaagaaagacaacttcacccggctaagaagattggagtaacaaaatcaagtttatga

SEQ ID NO: 14019 - DNA, 297 bp, Glycine max
  Peptide Sequence Number=SeqID_130797
atggttacgattaatagatcaaaagtaagagaagggtatcaagtaaaacgtggaaaaagctttaagtgcgaagtagaaggaattctagaatctgctatcgggcttacagctcccctgaaaacaaagaggggaatgagcaacaatttgaaggttgtacattcaggaactaaagaattcaaaatagctagtaataagagggatttgtttttgggattttctgagcaccaagagcggctacacaagaagcttgcacttgaggagggaaggatatttgcagctaatgaacaactttcttaa

SEQ ID NO: 14020 - DNA, 324 bp, Glycine max
  Peptide Sequence Number=SeqID_130798
atgacctccgttgtgaccttcaatacttgccgcaagcttgtcatggacattccctctattgcttcaagctgcctttgggcattgtgcattaaccgcaacccgaacggtgcactacagtcttgtctaatggtaatggcgagtttcagaaatgctgcaatcaatgtcttcagagtgatcaattccaaaaaagccaccatcactgctttcacaaacccccttcacactctcaggctattatatagaagcaaacaacgagggttcctggaactggatttggtcctcggaaaatgggttgaggccggacaacattcactccttggatga

SEQ ID NO: 14021 - DNA, 585 bp, Glycine max
  Peptide Sequence Number=SeqID_130799
atggatgatttggtgctagagaatatttgtgaccgtgtgaagtcccttgtattcactaagggagaaacaataacgaaagaaggagacccagttcaaagaatgctatttgtagtaaggggtcaccttcaaagtagccaagtactccgagacggagtgaagagtttctgcatgttagggccggggaacttcagtggagacgagctgctctcatggtgtctgagaaggccattcatagagcgtcttccaccgtcttcatgcacgttggtgacactggaaacgacagaggcgtttgggcttgaggcacaggacgtgaagtacgtgacgcaacatttcaggtacacattcgtgaatgagaaggtgaagaggagtgccaggtattactcgccagcttggagaacttgggctgcggtggccattcagttggcttggaggaggtaccagcatcgtttgactttgacttctttgtcctttataaggccccgcaggcctctctctaggtctacttccatggaagaggataggcttcgtttatatacggctatgttaacctcccccaagcctaatcaagatgactttgacttctga

SEQ ID NO: 14022 - DNA, 306 bp, Glycine max
  Peptide Sequence Number=SeqID_130800
atgatttatctttatttcaccatgctagaaggcaaggcagtgattggggagacagacatgcttcaaaccatgcagcaggatgcactgaatttggcatcaaaagcattggatttctttgatgtcacagaggccactgacatagcccgcttcatcaagaaggcaagtaaatacttacaaagccctagtgttgaatttgataggacgcatggacctggttggcaatgcattgtaggcactgattttgcttggctatcttgctctttaggggttctcctcctccataggtacaggaaaatcacttcttag

SEQ ID NO: 14023 - DNA, 465 bp, Glycine max
  Peptide Sequence Number=SeqID_130801
atggcgccgcgtctcttgtcatgcttccgcaacaagcacgccggcgggtgcagccaccacgacgagggatgcggcgcatcatcggaggagtcggcggcgggggcgagggaagcagcaggagaggggccggtgctggtggagatgttcacgtcgcaggggtgcgcaacgtcgccggcggcggacctggtactgtcacggctggggaggggggacttccagctggaggtgccggtggtgctattagcattccatgtagactattgggactacgtgggctggaaggacccatttgggtccagccagtggaccgttaggcagaaggcctatgttgaggcccttgggcttgacacgcttttcactccacaggttgtggtccaaggtcaggcccatctcgaaggaaatgacgataatgccctcatctctgccattacctctgcgcctaggttccctgctcccaccttccag

SEQ ID NO: 14024 - DNA, 405 bp, Glycine max
  Peptide Sequence Number=SeqID_130802
atggctcacactaatgctatgaattctattccaccaaatcgaattccaatgagggaggaagaggttaaccggttcaaggagttacaagagatctttgacaaattcttcaagttgttgtttggtgtcattgccttcaagatctcaccaatgggagaagctttattcatagcccaccccaatgtgatgatgcttttggttttgatgattgtgctctacttctcactgtggctgctgggaacaatgcttccaaagaatactagcatcatgtcatgggttggcatttttgctttgactgcttattattgttatcaagtgctttatgcattggttgttagtgcaatttcagatacaatcaaccaactgattgatggttactggacccagagtacaaggctaccggtttag

SEQ ID NO: 14025 - DNA, 102 bp, Glycine max
  Peptide Sequence Number=SeqID_130803
atggcagtcacactctacgaccttagctcttcctctgggttgaagaaacttgatgagtaccttctcccacgcagttacatcaccggtattaggaatgcataa

SEQ ID NO: 14026 - DNA, 1233 bp, Glycine max
  Peptide Sequence Number=SeqID_130804
atggccacctctgaccaccctgtccaggaatcacgtttctcacgcatgcactacttctccactgacgacgaccaagacgaggatgacgacgacaccgacctcgacttcgtcgacgacagcaatgtcagccctgctgaagaggaggaacccaaaaaatccgacattctcggcggcgagaatttcaatcgccgcagggaatttcgggtggtgctggacccgcgaggcaagtgggttcaggaatggaacagggtgttcctcctcgtgtgcgccaccgggttgttcgtggacccgctgttcttctacgcgctgtcgataagcgacacgtgtatgtgcctcttcgtggatgggtggctcgtcatcaccgtcactgcgctccgctgcatgacggacgcgttgcacgtgtggaacatgtggttggagttcaagatggcgaaacgttcttcttcttttatcggaagggacactaacgcctcaggtggcggcggcggaggcggaggcggctatgctcttcgctacctcaaggccaaacggggcttcttctttgacctctttgtcatcctccctattccccaggctgcaggggcatgttggtacttgctagggttacaaagagcagcaaagtgcctagaagagcaatgtgcaaaaacaactggttgtggattgagaacactgtgttgcaaagagcctatatactatggaggcattaacattgtaagagacaaaacaaggttgttatgggcacagaacagggaagctaggtctacttgcttggacagtgctgataactacgactatggtgtatatgaatggtctgtacaactcgtcacaaatgatagccgattggaaaagatacttttccctatcttctggggcctaatgactctaagcacttttgggaacctagagagcacaccagagcgactagaagtgatttttaacattattgtgttgactagtggcctccttctggtgactatgctgattggcaacatcaaggtgtttttgcattccacaacatcaaagaagcaagcgatgctattgaggatgaggaacattgaatggtggatgagcaaaaggcgattgccacaagggttccggcagcgcgtgaggaactatgagcggatgcgttgggctgccacgcgcggggttgatgaatgccagatgattaaaaatctccctgagggactaagaagggacatcaagtaccatctttgtttggatttggtgagacag

SEQ ID NO: 14027 - DNA, 347 bp, Glycine max
  Peptide Sequence Number=SeqID_130805
gtaccaagctacaaaggatgatcttactgtttatgcagctttgccaactgctccatcagatgaatatggaaatgtttccaggtggtacaagcacattgatgctttgttgagaatctctggtgttactggcgagggatctggtgttattgttgagggatctctagttgcagagcctgttgcaactccccctgctgcagacacaaaggcaagtgttttcctaatggctgctgttgctgaggatgacgatgatgatgatgtggatttgttcggtgaagagacagaagaagagaagaaggcagcagaggaacgggcagctgcagtgaaggcatctacaaaaaaaaaagagt

SEQ ID NO: 14028 - DNA, 1602 bp, Glycine max
  Peptide Sequence Number=SeqID_130806
atgaataatcaagccaagaatattgctacatcatctttgtttggtcattctggaatggccccacaaccacaaccacaccatcctaaccccattcagcaatggaaccatccaaaccctttactctctcagtcacagtcacaccctcaaacccaattccatggtctgtttcagttttcagagccccaaagtcaggtctttgcacaagctcagtatgcacaggctcaattgcagtctcaggctgcacgtgctcatccacaagtacctcaaactcagccttttgctcacttgcataatgtaaaaactaatactgctaatggtgtatcaagtctgggcaccggaagtgctaagcgagcaaccctaaagcccccgttgaggtctcacaattcgttgaatatgaaccaatccacgccgtttaaggccacgaagttgaccccagctgttctgcaaaagaagcaaatacctgaaaaggtggctgcgcttttgcctgagtctgctctttacactcagttgcttgattttgaggctcaggtggatgcttctttggccaggagaaagattgatatacaggagactaagctgcctcctcatgttcagaaaactcttcgtgtttatgtgtttaataccttctcaaatcatgctaaaatggatgctgataatagaaaggctgatgatgaatcttggtggtctctcaagataattggaaggatattggaagatggtgtggattccatgtcaggaatttcacagggatcgagcccttcgtacccgaagttctctgcatttttcaagaaaattaccatactcttggatcaaagcctttatcctgataatcatgtcactgtgtgggatagtgctcgttcccctacccaacaggatggttttgaggtgaagaggaaaggaaacaaagaatttactgcagtgattgcaatagaaatgaattatacacctgacaagtttatggtttcaccaccactgtctaaacttttagggattgaggtagagactcgcccaagaataatagctactctttctaactacgtgaagtccaggaagctacagatcccaaatgacccttcattcttcatatgtgatccttctctacaaatggtgtttggggaagagaagatggatttcaccatggtttctcagaagttagcacagcatttgacacaaccacaacctatacatatggagcataacatcaagctttctggacattctccagctgtatctgcatgttatgatatacaggttgatgtgccttttccactggaaaaggatatgtctacattcttggcaggctttgagagtcaaaaagagattgaagcttatgacgaggcgattcgcacctccttaaagaagatccaggagcatcatagaagacgagctttctttcttagctttagtcagtctccagcggagtttattgatactttgattgcttctcagagcaaagatttaaaacttgttgctggagatgccagccataatgttcaaaaggaacttccttctgaattcttcaatcaaccatgggttgaggatgctgtcattcgttacttgaaccgcaaatctgcaggaagtgatgctcatggacacaactga

SEQ ID NO: 14029 - DNA, 459 bp, Glycine max
  Peptide Sequence Number=SeqID_130807
atgatgacaaaaagcaaagctcaaaagtcaagaacacttcatgataacaaagatgatgatctcaagaatcaaagaatgagttcaagaacacttcaaggttcaagaggaaatttgatttcaagaatcaagaatcaagtttcaagattcaagttccaagaatcaagatcaagattcaagactaaagattcaagaatcaagagaagactcaatcaagataagttgttcaaagagaacaagggagggcacatcccttgtggatctttgcttgtaaaaggatttttacaagacactgctctacaggttgctcttgactatgcttgtgggtatggaggtgcagactactcagcaatacaaccaggagcaagctgttataatccaaacactgtccgcgatcatgcttcatatgcattcaatgactactaccagaagaatccaacacctatcagcttaaaagcatga

SEQ ID NO: 14030 - DNA, 243 bp, Glycine max
  Peptide Sequence Number=SeqID_130808
atgggaacatctttggaagtgtcacgagcgaggtcaggttctgaggagaggtgtatttcgtcttcagattcaggaaaaggttttgtgaagggggcaacattggtgttgttgcaattgcgggttaacaacttcgagtggaagaggttgctgagggtgcatagctttcttacggtgggggcacacatctacagtggttcacgaaatgacacatttagggaagatattgcagaagtgacgatttga

SEQ ID NO: 14031 - DNA, 687 bp, Glycine max
  Peptide Sequence Number=SeqID_130809
atggcgaccctcattcctccccctcctccccctcctcctcctcctgccgccgccgccgaccccaaggtcgattacttgaacctcccatgtccaattcccttcgaagagctccatcgcgaagctatgatgtctttgaagccagatctttttgagggcatgcgttttgatttcaccaagatgctcaatcagaagttctccctcaatcacagcgtgttgatgggacctactgaggttccttctcagtccacggagactattaagattccaactgctcactatgagtttggctcaaccttcattgatcaccctaggttgttgctctgggggagaattttgactgatgggaggctcaatgccagagtcaagtgtgatttgtccgaaaatctcacttttaaagccaatgctcagtatgtggtttatggtgttcccttatcccttcccattcccatgctcgttttctgttgtgcttcccttgcctcttttactcaccataattcgttttcttgtctgcttgtacagctcacaaatgagccgcatatgtctcatgcgatgatcaactttgattacaagggaaaagactatagaacccaatttcaacttggtaatggagccttgctaggagcaagttatattcagttgctggttaggttctgtcagttgtatatagctgtacaagagaatgcctaa

SEQ ID NO: 14032 - DNA, 588 bp, Glycine max
  Peptide Sequence Number=SeqID_130810
atggcgcagccggcggcggcagcagcagcaacaggagcagcagtaatcgagcaagtgcagtgcttcgggcggaagaagacagcggtggcagtgacctactgcaagcgtggtcgaggcctcatcaagatcaatggctgcccgatcgagctggtggagccggagatcctccgtttcaaggccttcgagccaatcctcctcctcggccgccaccgcttcgccggcgtggacatgcgcatcagagtcaagggcggcggtcacacctcccagatctacgccatcaggcagagcatagccaaggccctcgttgcttactaccagaagtacgtagacgagcagtccaagaaggagatcaaggacatcctcgtcaggtacgaccgcaccctcctcgtcgccgatccccgccgctgcgagcccaagaagttcggcggtcgcggtgctcgcgccagtgcttctattgcggtgaagcacttcgtgcttctatacaatgaagcaatctggtgctttgattattgtgacgctgctcagaaccatggtcgtggatgcaacatattaggacaatatttgttgcagtggtcagggttaggttaa

SEQ ID NO: 14033 - DNA, 1020 bp, Glycine max
  Peptide Sequence Number=SeqID_130811
atggcaagccctggcacagcggtaaagttgtgccttggtgaccagttgatcattggtttgaatctggaaacaggctctttgcatatgcaaaggctttatataatattgagattttcatccaggcttatcaagaagtcaatttcttcagcatatgatgttattcgtcagacacatcttcaaaatcctggatcgtccacgggaggcagcactgatgttatggatgtagataactcttcaggatacagttctttcatagatcttccaaaggaactttttcagatgcttgcttgtactggaccttatctctatcgtgatactgtactgttgcagaaggtttgtagggtgttgagaggttattacctttctgctcttgagcttgtaagtcatggcaatggtgtcttgaatcctcaattacaagttcctggaaatcctcacctacatcttaaggaggcaaggctaagggtggaggatgctttaggagcatgtctactaccatctctgcagttaattcctgccaatccagctgttggccaggaaatttgggaactgttgagtcttcttccttatgaggtgcgatatcgtttgtatggtgaatgggaaaaagatgatgagcgcattcctatgctcttatctgcaagacaaactgccaagttggacactagacgtattttgaaacggctggcaaaggaaaatttgaagcagctgggtcggatggttgcaaagttagctcatgccaaccctatgactgtccttcgaacaattgttcatcagattgaggcttatagagacatgattactcctgtagtggatgcatttaagtacttaactcagcttgagtatgatatattggaatatgttgtgattgagcgtttggcgcttggtggacgtgataagttaaaggatgatggccttaatttgtcagattggcttcaatctcttgcttcattttggggccacctgttgcagatcaaccttagcaaatgcaggattactggacatagcagcattttatgtccctga

SEQ ID NO: 14034 - DNA, 2661 bp, Glycine max
  Peptide Sequence Number=SeqID_130812
atgttgccttcgaaagcatggaatagcttatctcctgatctttatgctacgttttggggtcttacattatatgatctgtatgttccaaaaaatcgttatgagtcagaaatagccaaattgcatgctaatcttaaatctttggaggagctttctgacaattcaagctcagcaatcacgaagaggaagaaagaaaaagaaagaattcaagaatctcttgatcgtctgatcagtgaactgcataaacatgaagagaatgttgcatctgttcgtagacggctttctcatgaaaaagacaaatggttaagttcctgtcctgacaccttaaagatcaacatggagtttcttcagcgctgtatatttccacgctgtactttcagtatgcccgatgcagtttattgtgctatgttcgtacacacgcttcattcccttggaacccccttttttaacacagtcaaccacatagatgttctgatttgtaagaccctacaaccaatgatatgctgctgcactgaatacgaggcaggcaggcttggcaggtttctgtatgagactttgaagattgcttactattggaagtgtctagaatctactgagtacatggaaattagaaatgctcttataatgttgacaaaaatttctagtgttttccctgttactcggaagagtgggatcaaccttgaaaagcgggtagctaagattaaaagtgatgaaagagaggatcttaaggtgttggcgactggtgttgcagcagcattggctgctaggaagccttcttgggttactgatgaagaatttggtatgggttatcttgagttgaaacctgcaccatctgtgactaaatcttcagctggaaactcagcaactgtacaaagtgggataaatctcaatgtttcacaaactgaatctgccagtggaaaacatgtggactctggaaacatagtcaaagatcaggcaatgagaacaaaaactgcagatggcaggtctgagagaactgaaagcattacagtgacaaaatctgatactggccacataaaactcaagagtagttcaatggtgaatggattggatgctcaatcatccttggccccgtcttctgtacaatctgggacgtcaaaatctatggaaaacccaaagcaagtggaagaatccataaatagagcatcagatgaacatgggacaagaactactgagttaagaacttcggctaaacgttcggtgcctgctggttcactatcaaagccctcaaaacaagatcctgtaaaagaggatggtagatctggaaaacctgttgctagaacttctggttcctcgagcagtgacaaggaactacaaacccatgcattggagggaagatacactggaactaccaatgtaccttcttcaaatggtaacaccatctcaggttctacaaaaggttcaaatccaccagtcaagatttcattggatggccctggtaatgaatccaaggcagaggttggagttgccaagtcttctgatattagagcttctatggtgaaggatgatggaaatgatattactgacaacccaagaggagcctcttctcgcgtagttcattcccctaggtatgaaaacacaggagtcacttcaaagtctaatgataaagttcagaagagagctagttctgctgaagaaccagacagactaggtaaacgacggaaaggggatgtggagctaagagattttgaaactgaagttagattctctgaaagagagaagatgatggatcctagatttgctgatgacaaatcgggaccagaggaacatggtctgtacagggcaggtgataagccattggaaagggcaaaagacaaaggcaacgaaagatatgaaagggatcacagggaaagaatggaccgtctggataagtctcgtggtgatgactttgttgcagaaaaacctagggataggtcaattgaaagatatggaagagaacgatctgttgagagaatgcaagagaggggtagtgataggagttttaatagactccctgagaaagctaaggatgaaagaaacaaggatgatagaaataaattacgatacaatgatgcatcagtagaaaaatctcatggtgatgatcgcttccatggtcaaagcttgcctccaccaccccctttacctcctaatgtggttcctcaatctgtaggagctggtaggcgtgatgaagatgttgatagaaggtatggagctacaaggcactctcagagactttctccaaggcatgaagaaaaagaacggagacggtctgaagagactgtggtttctcaggatgatgccaaacgccgaaaagaagacgattttcgagatcgaaaacgtgaggaaattaaggtggaagagagggagcgggaaagagagaaagcaaacattctgaaggaagagttggatttaaatgccgcatccaagagacgtaaacccaagagggagcatttaccaactggtgaacctggtgagtactcacctgtggcccatccaccttcttccgctggtattggcatgtcactagcatatgatggaagggatagaggagacagaaagggacccatcatgcagcatccaagttacgtagatgaatcaagtctcaggatccacggtaaagaggtggccagcaagttgaatcgccgtgattcagatccgtatccttaa

SEQ ID NO: 14035 - DNA, 747 bp, Glycine max
  Peptide Sequence Number=SeqID_130813
gaagaatttttgggggaggctgagttgatcaaaattaaggctcaggaattgaagggtaaagaggtcagagttaatacccgaattctctatcagcaaaccaaattcaaccttctcagagaagagagtgagggctatgcaaagctggttactcttctttgtcgggactctgaagcacctactcaaaaatcatctgcagcaacaattggcattattaagtcattaattggccattttgatttggatccaaatcgcgttttcgatattgttctcgagtgttttgaactgcagcctgatgatgatgtgtttatagaattgattcctatttttccaaagtctcatgcttcacagattcttggatttaagtttcaatattatcaacgcatggaagtcaacagtcctgttccatttgggctctatagacttacagccttgctggtgaagcaagattttattgatcttgatagcatatatgctcatctacttcccagggatgatgaggcatttgagcattacaatactttctcttccaagcgccttgatgaggctaataaaattggaagaataaaccttgctgcaactggaaaagatctaatggatgatgagaaacagggggatgtcactatagatctctttgctgctatagacatggaaacagacgcgattgaagagcgaacaactgagcttcagagcagtcagactttgggcttgcttactggctttctttcagtggatgattggtatgcttga

SEQ ID NO: 14036 - DNA, 909 bp, Glycine max
  Peptide Sequence Number=SeqID_130814
ctccatccgccgtttgtggacaacttcctcgtaccaaagatcaaacacacagccaccaactacttgtgttcttgggactccatttttaaggctacaacaaatcatctttcactcttcccttctcatctcaatctcatagacgacaaagaaagaaagcaagaacatgtacatgagctatgcaaagattgcttcagcaacttcactcttcgatttgggacctcgcgttgctggcgtgttgcactcaagtgtctcattcttcttcaccgtttgcttcgctctgtccccggaaacagcgccctctggactgagatcttatggacacgttccaaagccttgatttctctcaacccttgccatttcaaggatgattcctccttctcctaccaagaagaagaagaagccaatatggctgaaatgggtcgagtgcttgaaatgttaccgcaactgcagagccttatagatagggtgatggagtgttaccctgtgggagtggcagcgccaagtttcattgtgcagggtgccatgaaactcataattcgtgacagcttcgtttgctacacaaagttcagaagagaaatagtggcggttttggacaatctacttgagatgccgtacaggaactgcatagctgctttcaatatatacaagaaagcagcagcgcaaacaaatgagctttatgagtggtgcaaggcaaagggtttgtgtgaaggacaagtagagctgagaagagacgttgttcacatcaaaggtgaagaggagaagcctttgattgaactagaattcctgttctatcatcgggaatttgatatggaacaacatagctttgatgcaaacgaagggcactatcacgagaatgcaaatgacacatggagaatggcagtttacaaccccttttctgagccgtattaa

SEQ ID NO: 14037 - DNA, 114 bp, Glycine max
  Peptide Sequence Number=SeqID_130815
atggtagtttgcgggctagtgcaatgcagacattgtccttatgttcttgaggctatgacagctttagcagaacttgggtctactgcaaaggacatcatttcattcattcctcag

SEQ ID NO: 14038 - DNA, 483 bp, Glycine max
  Peptide Sequence Number=SeqID_130816
atggctgaaaattttgatgctgaggttgttggcattgacctctccataaatatgatttctcttgctattgaacgtgctattggactgaactacgctgttgaatttgattgtgcggattgctataaaagaacatatcctgagaatacatttgatgtaatatacactcgggacaccatgttgcacgtcaaaatgcttgaggatgctggatttgatgatatcattgctgagagtcgaactgatcagtttgtgaaaatgctacagcaggagttagatgcccttgagaacaagaaggacgattttattcgtgacttcagcaagctggattcattgctttcaggaagattacaattagattgtggaaagatggaaggcaaagcatatatacctggggtgcgtatagagagcagatgtggggcttgttcattgccaagaaaaattgaaatgctttattgctatcatatgccttgttctagctatatttag

SEQ ID NO: 14039 - DNA, 642 bp, Glycine max
  Peptide Sequence Number=SeqID_130817
atgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaaggtgaacccgacgtccccatctggcctcaagcaaatgaatcatccaacctcaaatatggtaggcaaagatttgggaagtacggatgaccccatgatgtgcaaattcaaaacaagcacgccttcccgccatatggtttgcctcccaaactatacaccacccaatgtggtgtacattcccaatgaggatgtcaataactccactcccatactcattaagagccaacaacctcaatctgatcatgcacatgtctctcgacccatggaggagacacatgaaattccccaccacgatctagccaacttcgagccttgcctcagatatgctgctgaagggcaagcagttggtggtatacccctgcaaaacactttggagggccctcaatatcatccacaaccacaaccctcacgttccacagcggttaaaaaccctcatgactatggcaggaatgggaaagttggatcatctagaggaaaggctcagggccattga

SEQ ID NO: 14040 - DNA, 432 bp, Glycine max
  Peptide Sequence Number=SeqID_130818
atgctggatatatattctttagagaatcttgtttccaccaatctggagattcaaagagaaaatacaaccctactcactacagggaacccagattttacacaaagatggaaccttttcttgatggagatggaaccttttcttgatggagatggaacctttatattcaataaagtatttaaagagtgccatatgagcgataatactgggagttcctgtaaatgcattggagcttatgttcgaaacaagaagaaccaaaaccaggatagagttgaatacagctacaagagtattttacggtctgaacggatgtatggcccaggctttgtgagcactggtggacttgaaacaacaaaggaatttgtgacaaaactgggactaaagcctggtcagaaagttctggatgtttggttgtggtggtgttgggggaggtga

SEQ ID NO: 14041 - DNA, 384 bp, Glycine max
  Peptide Sequence Number=SeqID_130819
atggttagagcgttgcctacgacacatggtcgaccaataggcgaccaagtccaaagccaaagtaggacacacctagttgctcatgatcctgggaatttaaataaaacaagcacaagctcggaaggtagtcctacctcacaaaatatatatgacatcccctttatccttgagccactggccagacccagacatatatcatgtccagccgttctacaagccttgagccaaaatcccaactcaccacaaaccttgacccagggtgagaatgtcaatccttgccctcagaagaaaacaaagaaaagacagttcccgatcaaagaatcggaagaaagcaaaaagagaaaattcccaatcaaagagtgggagaaagcaaaaacacaaaag

SEQ ID NO: 14042 - DNA, 1446 bp, Glycine max
  Peptide Sequence Number=SeqID_130820
atgaattcctcctccatttatattcttgtctttctccacctttggttatgtagcttaccttgcagagagagtgtgtgcatcccaagtgagcgtgagacacttttgaagtttaagaataatctgaatgatccttccaataggctttggtcttggaatcataataataccaactgttgccactggtatggagtcctctgccacaacgtcacttcccatcttcttcagcttcacctcaacacttcaccttctgctttcgagtatgactactataatggattctaccatagattcgatgaggaagcttatcggagatggagctttggtggagagataagtccttgtttggctgatttaaagcatttgaattacttggacttgagcggcaatagatttcttggagaaggtatgtcaattccttctttccttgggacaatcacttccttgactcaccttaacctctctgatactggattctatgggaagattcctcctcagattgggaatctctcagatttggtgtatcttgacctgagttctgttgttgccaacggatcagtaccctctcagatcgggaatctctctaagcttcgatatcttgacttgagcgacaattattttgaaggtatggcaaatccttctttcctttgtgcaatgacctccttgactcacctcgacctctctaatgctggattcatggggaagattctatctcagatttggaatctctccaatttggtgtatcttgacctgacgtatgccgccaatggaacaattccatctcagattgggaatctctccaatttggtgtatcttggccttggaggtgattctgatgtcgaagctctgtttgctgaaaatgtagaatggctatcaagtatgtggaagcttgaatatcttgatttgagtaatgcaaacctatccaaagcatttcattggctacacactctccaatctcttccttctttgacccacctatatttgtatcaatgcacactccctcactataatgaaccatccttgctcaacttatcatctctgcaaactctccatctttccttcactcgttattcccctgccatttcttttgtccccaagtggatattcaaattgaagaaacttgtttctcttcaattactggataatggcatccaaggtccgattcctggtggtatccgaaacctcacacttcttcaaaatcttgacttgtctttcaattcattctcatcttctatacctgatgccttgggaaatttgacttctcttgttgaacttgatttatcaggtaatcaacttgaaggaaacattccaacttctttgggtaatttgacttctcttgttgaaattgatttgtcatatagtcaacttgaaggaaacattccaacttctttgggtaatctctgcaacttaagggtgatagatttatcatatctcaaactcaaccaacag

SEQ ID NO: 14043 - DNA, 162 bp, Glycine max
  Peptide Sequence Number=SeqID_130821
atggtggaaataaaactaacaatgatcgacatggttctagagaaagctagcaataacataattgcaacaattatcctaacagaaaaagcatattcccgacaggatcatccaagggcccaatcccgcaatgccaactcagcaatcctgctcctattatgttag

SEQ ID NO: 14044 - DNA, 381 bp, Glycine max
  Peptide Sequence Number=SeqID_130822
atggattcaaatgcttgtctaccacacttgctagtgtttgcaataacattggtattggttagtcatgcaatgggagattcagctcaagacaaacagagatgtgcagaatccttgacaggtgttgcaacgtgtctgccatatttgggtggtgacacgaaagcacgcacagcagattgttgcagtggtctcacacaagccatgaagaccaacaagaagtgtgtctgcgttattctcaaagacagggatgatcctgatcttggcttaaagattaacatgacaattgctgctggtctcccttctctttgcaaaacacctgataatttctcacagtgttctggggggaattctggtttcgaggaccagggcctccaaaaggggtaa

SEQ ID NO: 14045 - DNA, 168 bp, Glycine max
  Peptide Sequence Number=SeqID_130823
atgacgatgatgatgggcatgatgatgaccatgaaggggatggttttgatttggactgtagctatgccaatgtacaaacattttatgttgtgtggtcgtcttccatcaacatgccatcgtacacgcttcttcaaagttgattgtctgttacaaaataccataagctga

SEQ ID NO: 14046 - DNA, 4563 bp, Glycine max
  Peptide Sequence Number=SeqID_130824
atgacgcacccttcgtcctctgataaaattgaagaactcctcgttcgcctcaccacacagcaacttactctctccagcaaaatcgatgacttcatctctcacattacccctcttttttcccctgcttcccacatgccttcatcccttccacgcccttttcctgttcctgcacaacaccatcgcctcaaattagatgttccacgttttgatggaacggacgcccttggttggatctttaagatcaaccagtacttcgagtatcatgggaccccggagtacgaccgattaacgattgcgtcattttatatggaaggaagggccttagcatggtttcagtggatgaccagtaatggtcaattcacttcgtggcctgttttccttcaagcattacaaaatcgatttgcaccatcacaatatgaggaccctacgggtactctttgcaaactcatgcaaaagggatcagtggcttcttacctctctgagtttgaggatttagcaaatcgtgtcgtgggaattccgccggccttcctcctcagctgcttcatttccgggctgactcctgagatccgccgtgaggttcaggcccaccaacccctcactctttcacaggcggccggcctcgcgcgcctccaggaggaaaagctgggtgaccttcgaccaccaccgtccaccatgcgttctcgccctccctcactttcttcttcctccttctcaccacgcccgcaacccctttcacccctttttccttcaccgtcagccatacgaccgccacctcctcaaccttcccccacccaacctttcaaacgcctgacctctgaagagattgccagccgccgtgagcgcggcctttgctttagctgcgatgagaagtaccacagaggtcaccgctgtgcctctagggtatttctcttcatcgcggaaggtgacgctgctcctgacccaccacatatagccccacttgacccgaccctcgaacccgaccctgacccaactgaagcccatgacccgcatccggcccaacttagtttaaactccatggccggtcacttagcgcccgaaacgctgcgtttcgtggcttccattgctgacgttgaagtggtgctcctggtggacggagggagcacccacaacttcattcagcaacagctggtcgagaagttgggccttccctccatttccaccaccccgttgcgcgttatggtcggaaatgggcaacaattgagttgtagttgcatgtgccaagctattgccatcaacattcagaacaatacatttatagtggatttgtatatccttcccatatccggagctaacgtagtacttggggtccaatggttaaaagccttgggacccgtgcttaccgattacaacacactttcgatgcaatttttttcagacggccgcatcattaagctacagggtgacttagatgccaaacttcacctcctcactccggtccagcttcgtcggctcagtcgaacacaaggtgatgctctgttttatcacattaccttgctatctaattcgaccccttccctgccacaggagttccctgccccaattcaggacttgctgctccgattcgaggctctcttcaccactccttctaccctaccgccggctcgagctaccgaccaccacatccacttgatccctcaggcaactccggtcaacgttcgaccgtatcgctacccccactatcagaaacaagaaatcgagcaacaggttgatgctatgctacagaaaggtctcattcagcccagcaccagtccgttttcttctccggtcctcctggttaagaaacacgacggctcttggcggttctgcgtcgactacagagccttgaatgcgcttaccatacgggatcgttttccaattccaacgattgatgagctccttgacgaattaggcggcgcctgttatttttccaagttggatttgctccaaggttaccatcagattcgtatgaatcctgaggacattccgaaaactgcatttcgtactcaccatggccattacgaattcaaagtaatgccatttggtttatgtaatgctccatcatcgttccaggcaaccatgaattcgatttttcagccttacttgcggcgtttcattatcgtcttcttcgacgatattctcatttatagcacttccatggatgctcatctgcaacacctggaaatcaccttcaaggtactactgacacatcaatttgccttaaaactttctaagtgtacctttgcacagagacaggtcgagtacttaggccacttggtctccttcaatggcgtggaacctcttaccgacaagattgaagctgtccgtcaatggccttccccgcgcaccaccaaagctcttcgtagcttcctcggattagctgggttttacagaagattcatcaagggctatgctacgattgctgcccccttggtcaaagctaccacattggatccctttcaatggactgatgttactcaggctgcatttgaccaattgaagctcgctctatcctccgcaccggtgttagctctcccggattttcaccttcccttcaccattgagactgacgcctctggggtgggcttgggtgctgtgctctctcagaagggacaccccattgcctatttcagtaaaccctttagtgccaaaatgctccgatcatcaacgtatgtccgtgaattgtacgctattacggccgccgtcaaaaaatggaggcaatatttgctcggacaccgttttgtcattctgaccgaccaccggagcttgaaggagcttctcacccaggtggtccagacacccgagcagcacatgtatctcgccaggctcatgggctacgattacgaaatccattatcggtccggtgctagcaatcaggctgctgatgctctctcccgtgttccagaccctgattcttcccttgctctcatgctttcggttccatgcttgaccttcatggacgaactccgttctcagctcgaccaacattctgactatgtgcatcgtcgacaggacattgctaatcatcccgccaaacaccctgggttctctgtggttaacaatcttattttgcaccgtcaccgcatatggttaccacgtgatattcctattattcctaccctcctcattgaatttcatgcgacccccactaggggccactctggcattgccaagacgattgctcgtgtttctgagaacttctattggtctggtttgcgtgaggatgtcgcgacctttgtggccaactgccgtgactgtcagtccactaaatacgaaacaaagaagctcgctggtcttctttgccctctcccggttcctcatcgtccatgggaggacctgtccttagattttattgttgggctgccgccgtacaaaggtcacacaatcatattggtggtcgtggatcgtttttctaaaggggttcatctggggatgcttcctactgcgcacactgctttcatggtggccacattattcctggacatggtggtcaaaattcatggtgttccccggagcttggtctccgatcgagaccctctgtttcttagcaagttttggcaggagcttttccggcgcagtggcactcacttgcgtatgagttctgcgtatcacccccagagtgatgggcagactgaggttattaatcgtattatcgagcaatacttacgctcgttcgttcatcggcgccctcgtatttggggccgtctccttccatgggcggagtggtcgcacaacacttcctggaactccgcgaccggggccactccatatgaggtcacctttggccggaagccatttaacttcccggagtaccttgccggtgactctaacattgatgctgtagataccctgctttgtgaccgggaggaaaccttcctcatgattcgtaagaaattactaaaggcccagattttaatgaaggagaaagctgacaaacaccgccgtgatgtagttttctcgccgggacaatgggtcttacttcgcctgcgccctcaccgtcaaacgtctgcccgggaaaatcccaccatctcgggaaagttggcaaaacgttactatgggccatttcaggttctcgaggccattggcaaggttgcctatcgattacagttaccacctgatgctaagatacatcccatcttccatgtctccatgttaaaaccattcaagggtgatcctaacgaccctgttgctaatccactgccgatttcttttcatgacgatcacccccttgtccaacccgctgcgatccttgcttctcgaccatcatctgtttctgggtgggacgtccttgttcaatggcatgggctctcccctgatgagacttcctgggaggattggtcaaccttatgccgggattatcaccttgaggacaaggtgctttcccaagggcccaggggtgatacagggggaaacatagcagagggagacaatcaacagaatgaggtgcaacaagcaatgcagattaacaaccagcaggataaggtgcaacaagcaatttcagaaaacaaagagcagaggcccaagagaagggtagagagaccaacgtacctcaaagattacatctga

SEQ ID NO: 14047 - DNA, 618 bp, Glycine max
  Peptide Sequence Number=SeqID_130825
atggagcaaacgatatggggtcatttgccggtgctggtaagggcaaattcaaaagaatctattgaatacattcttcaggccctttggagaactcgaaaaactggtcttggcactaccgaccgatgcatcatccaagaaatgctccagctccaaaatgaatctgatctcgacccaaacactagcaaggaggatattccgaagctgttccccagtgaggttctgcctgaattgcaaaaactgttgacacttttgttgcacaagtttcagcgagagtggcaggaagatgtgatgaaagatcagaatattgtgcctcgattaaaggcgatgacatggaatatggcaaatctcgataaagaatcagcagaccctgcagctgttatcaatttgaagcttcaaaatgatggtcaatttcactcgggagagcaagatgtgaagttcaagttggctacagattctatagatatgatgctgaaagccatgcactgtattagagaccagttttctactgtgggaccatgttgtgtcatgttaactaagaaaatagaggaggaaatgaaacggatgcttgctatgttgatggtctttgcttacaatagagacaaatttgcactttactag

SEQ ID NO: 14048 - DNA, 207 bp, Glycine max
  Peptide Sequence Number=SeqID_130826
atggtgggactggttggagaaagcatagatagcacacatgatctaactttcacgggatttggaaatggttacatctcagaggaaattaatgtagatttggataaggtcctgaaggtgtgtggaggagttggtgaaacacaaatccttttcctttccttcacagtcccactaaaaagagatgaatatattcgaccttcggtttggtag

SEQ ID NO: 14049 - DNA, 601 bp, Glycine max
  Peptide Sequence Number=SeqID_130827
atggctggtgtgctctgcgactccgatgctcgtgttgtgagggtcattgagtatagttgccactacagtgcgatgcctatgtttgaaaaaactcaaaaccgtcgtcttagccgcatgtcgaactccggcgacgcaaatgtaaccacagaagagcaagaagcagaggctgagcagcaatcggaagaatgggagacgatggcacgagcgtggctctgctccttcccggagcccaaggaggtgagcatggccgaagtcgaagcctggatcgactccaacctcgcctccctccccgaaggcctccgatccatgccccgccccgatctctgccacagactcatctcctttcagaattgcatgagactccccaatcaggaaagggaagtgaatcagctcgatcttccgcacgcacgatttcagcgaaccgatcagtggattccggtttattcgtggttggagactctggacaaggaagatgtggttaaatccaaggagatttctgactggttaactgataaccctaagggtgtagaacagcctgataaagactcatcattgaaggttcagaaggatgtggcaatgaagcacccagccccacctccat

SEQ ID NO: 14050 - DNA, 315 bp, Glycine max
  Peptide Sequence Number=SeqID_130828
atggtgccaaggatcaagtgtgagccactaccaagaaacaagcttctaagcccaataattttccatgagggccgtttagttcaaaggccaacacctctaatggcactcttgaccttcctatggatgccaattggcataatcctctccatcctaagggtctatctcaacatccctctgccagaaagacttgcttggtacaactacaagcttcttggaataagggtcattaggaagggtatccctccacccccagcaaagaagggccaaagtggagtcctatttgtatgcaaccacaggacagttttagaccctgtg

SEQ ID NO: 14051 - DNA, 2694 bp, Glycine max
  Peptide Sequence Number=SeqID_130829
atggtgaagcatgcacagctgggttttgaaggttctttcattttttatcttgttttggttctttctttccttgttatctcaactaggtgtcaagatgcagaggtaatgggaatattgaagatcatgattaatgcccccattagcttccaatggacaaacccagatgtatgcaaatggagacatgttacatgtgattcatctaaacgtgtgacagctattcagattgggagccagaacctacaaggctctctccctaaagagcttgtcaagttaacatcattggaacgttttgagtgccaattcaatagtctcacagggccattcccctatctctcaaaatccttgcaaaagttggtaatccatgacaacaagttcagcttcattcccaatgatttcttcaaaggtatgagccatttgcaagaagtgagaattgatgacaaccctttctctcaatggcacattcatgacactctcagggattgtgttgcactccatactttcagtgcacaaagtgttggccttgtgggcaccatcccaaacttttttggcaaagatggtccatttccaggtttggttctcttggctttatctgataattttctagaaggtgcattgcctacaagcctatcggatagttcaatagagaaccttttggtcaatggacaaaatagcttatctaaacttaatggcacccttgttgtgttacaaaacatgaagtctttgaggcaaatttgggctaacggaaattcattcactggtcctatacctgacttgtcacatcatgatcaactttctgatgtgaatttaagggataaccagttaactggtgttgtgccaccctctttaatctctcttccaagtttgaagtttgtgaacttaaccaataattttcttcaaggatcctctcccattttcaaatatggggtaggagttgacaatagcatggataaagggaaaaaccaatattgtacagacgtgccagggcaaccttgtagtccgcttgtaaattctttattatctattgttgagcctatgggttatcctcttaagtttgctcaaaattggcaaggagatgatccatgtgccaataaatggacaggtataatttgctctgggggaaacatttcagttatcaactttcaaaacatgggtttgtctggcactatttgtccatgttttgccaaatttacatctgtgacaaagttgcttcttgctaacaatggtttcattggtaccataccaaatgaacttactagtttgcctcttttgcaagagttggatgtttccaataatcatttatatggcaaagtgccactatttcgtaaagatgtggttcttaaattagctgggaatcctgatattggtaaggataaaccaactagctcaagtttcatcgacaatggtagcaatcataatactgcaataattattggtattgtggtagttgctgttattatacttattagcggggttttaatacttgttaagttcaagagaaagtgggagcatgagaggaaaactcaaaatccacctgtaattatggtaccttctcgccgttatggggatggaactactagtgcattattaagtcctatgggtagtgtttaccaggtggaagatcataacatgttaatttcagttcaagttttgagaaatgttaccaacaattttagtgaaaaaaacatattggggaaaggggggtttggcactgtatacaaaggagagttacatgatgggacaaagattgcagtgaaaaggatgcaatcagcaggattagtggatgagaaaggattgagtgagtttacagccgaaattgcagtgcttactaaggttcggcatataaatttggtttcacttttgggattttgcttggatggaagtgaaagacttcttgtgtatgaacacatgcctcaaggtgctttaagtaaacatttgattaattggaaaagtgaagggctaaaaccacttgaatggaaaacaaggcttggtattgccttagatgttgctagaggtgttgaatatcttcatggtttggcacaacaaatttttatccatagggatctcaaaccatccaacatcttgcttggagatgatatgcgcgccaaagtatcagactttggattagttcgacttgctcctgaaggaaaaacctcatttcaaactaaacttgcaggaacttttggatacatggcaccagagtacgcagccactggacgacttacaacaaaggttgatgtatatagttttggagtgatccttatggagatgataactggaaggaaagcacttgatgacaaccaaccagaagagaacgtccaccttgttacatggtttcgtaagatgttattgaacaaaaattcatttcaaacaaccattgacccaacaattgaagttgatgcggaaaccttagtcaatattaacattgttgctgagttagcagggcattgttgtgcgagggagccttatcaacgtcctgatatgagtcatgtagtcaatgtgttatcacctcttgttgaggtgtggaagccttcagaaacaaatgttgacgacatatatggaattgactatgatatgacattaccagaagcactccaaaggtggaaagattttgaaggaagtagcaccaccctagaattaacatctccttcttcatcagtgcttcttaatggaaacaacacaaagtcaagcacataa

SEQ ID NO: 14052 - DNA, 799 bp, Glycine max
  Peptide Sequence Number=SeqID_130830
attatttcagcccgatattatttttgtcgagaaagattcatgggtttgtgtagaggatgggatcttcaatgtgtggcaactggactggaaacagaatcggcatatatttaagatacctcagatgatacttcttgcgaccaacatcggtaatgatgaatttgataaagctaaagctgcaggtttcagcgatactgtgatcatgaagcccctaagagctagcatggtggctgcttgtcttcagcaagttctgggaacggggaagaagaggcaacacgggaaagacatgaatcctaatggttccacttttgtaagaagccttctttgcgggaaaaaaatcttagtggttgatgacaatgtggtaaaccggagggtagctgcaggtgcattaaaaaattttggagctgatgtgacgtgtgcagaaagtggcaaaactgctcttgaaatgctgcagttgcctcacaattttgatgcttgcttcatggatattcaaatgccagaaatggacgggtttgaagcaactaggcaaattcggatgatggagacaaaggcaaatgagcagcagatgaatggtgaatgtggtgaaggaaatggatggaaagacaagaagtaccatatacctatattggccatgacagctgatgtgattcacgcaacatacgatgagtgcgtgaaatgtgggatggacggatatgtctcaaagccttttgaggaagagaatctgtatcaagcagttgcaaagtttttcaaccccaagcctacctcaatacaacaaaatgccagaactggaaaagcaacttaa

SEQ ID NO: 14053 - DNA, 312 bp, Glycine max
  Peptide Sequence Number=SeqID_130831
atggtggtggtagccacgtggctatgggagaagcaatatgaagcgacatttaaccagtacggtgcagttcctgttagcaaggatccaattcagaaggaaaaggagactaatggagacaccactggaattgccgttgacggaggtggtgttgctggcagtacacaagtgatagcagaagaagattatgatcatagaagaaccaccaccaccaccaccaccaccaccgctgtggacaaccatccccataagaaaggaataatagagaaaattaaggagaagcttcctgggacacatcaccacaacaacaaatag

SEQ ID NO: 14054 - DNA, 2133 bp, Glycine max
  Peptide Sequence Number=SeqID_130832
atgggtcttggtttgaagatgaagagcctgaggcaccatcccatggccttgaagatacatgagcaagcggggagcaaaagaaagtacactttcattcaggcacatagggcctggcttcccaagtttttgatgctgtggatccttctcatggctctaattggctgtttcatctttagtaaaatggatgctgacactaaagtcagaaggaaagaggtgctgggtagcctctgcgatcaaagggctagaatgctgcaagatcaatttagtgttagtgtcaaccatgtccatgcccttgccatccttgtttcaaccttccattactacagaaccccttctgccattgaccaggaaacctttgcagagtatacagccaggacagcatttgaacggccattactcagtggggtagcctatgcacaaagagtagttaactcagagagggaaacatttgagaagcaacatggttgggttataaagacaatggaaagagagccttcactggttagagatgagtatgcaccggtgatatttgtgcaagaaactctctcttacctcgaatctattgatatgatgtccggggaggaggaccgagaaaatattttgagggctagggccactgggaaagctgttctcactagtccttttaggctgttggggtctcatcatcttggtgtggttttaacatttcctgtttataaatctaagctccctccaaagccaacaatggaagagcgaattaaagcaactgcaggatatgttggaggatcctttgacgttgagtccctcgtggagaatttacttggtcaacttgctggtcaccaagcaattttggtgaacgtatatgatatcacaaactctactgaccacttaatcatgtatggcaaccaaaacgaagaaggtgatatgtctcttgtccatgaaatgggttatattttatatggtgctggaaatcacattgtcaaagtagaggatgattttcatcaaatggaggaattaaaagtgcgagcagaagcagctcatgttgccaagtcacagtttctagctactgtctctcatgaaattagaacacccatgaatggcattttaggaatgcttggtctgcttctaaagacagaattgagttcaactcaacgtgattatgcccagactgctcaagcatgtgggaaggctctgatagcattaataaatgaggtacttgaccgggctaaaattgaagctggcaagttagagctggaagctgttccatttgacattcgttccatacttgatgatgtcctttctcttttttctgaaaagtctcggaacaaaggtttagagctggcggtgtttgtttctgataaagttccagatattgttatgggagatcctgggagattcagacaaatagtaacaaatcttgttggcaactctgttaaattcactgagcgaggacatgtatttgtgaaagtccatctatctgaaaatagaatgtccacgatgaatggaaaaattgagaaatttctaaacggaggattggacgaacctgtgcatatgtctggtggttataattccaaaactttaagtggatatgaagcagctgatgagcggaacagctgggacaattttaagcatctaattgccgatgaagaatttttctatgatgcttctgttaaaagggtggcaagcgaatcttatgagcaagtcaccttgatggtcagtgtggaggacactggaattggaattcctttctcagcccaagataggattttcatgcctttcgtgcaggcagacagctcaacctctcgacattatggtggtactggcattggcttgagtatcagtaagtgcctggtcgaactaatgggtggtgagataagtttcataagccaaccgcaggttgggagcacattttcatttactgcagattttggaacaattaagaaaaatgcaataactgacatgaagaaacataatttggaagatctgccttccaattttagagggcttaaagccatagtggttgatggaaaacctgttagagcagcagtgactagataccatctgaagagactagggatacaggctaaagttgcaaatagcttcaataaggctgtttctttatgtgggaaaaatggttgtttgacctcggggtaa

SEQ ID NO: 14055 - DNA, 396 bp, Glycine max
  Peptide Sequence Number=SeqID_130833
atgaatcttgacttccgcattacagaatatgaccctattgaaacttggaaggagaagttgaagagtttcaaaggaagtttgaaggactggaaccggctacattttggcaatattcataaaaaaattgctagaattttgaagaatgtgaatgagttggataaaaaggaggaagagggtggattgtccgtggaagagttagaagcaaggaaggatatgcaagaagatttttggaggaatgtggtgtttagtgaatccatatatattcaaacaaaaatcatgattcaaggaagagtatgcaagaagatttttgaaggaatgagaaaaaacttgactagaggcgtggatgtggatggtatgcggaaggaggagtcattgattgtcaaagaagaggcatga

SEQ ID NO: 14056 - DNA, 801 bp, Glycine max
  Peptide Sequence Number=SeqID_130834
atgaaattgaagtctaagaaaggatggaaatctattgtaccacttcgtttgaaaggaaaatcagcaacccattttttgttatttcgcaaagtcaattctgctggctatggacctggcaaaacaccagtttatctgaatgtgtatgacatgacacccatgaatggttatgtgtattgggctggtcttggtatccatcactctggtgtagaagttcatggtgtagaatacgcgtttggagctcatgactacccaacaagtggtgtttttgaggttgaacctcaccaatgcccaggcttcaagttcaggaagtcaatattcataggaaccacatctttggattctactcaggttagggagttcatggaacgccagtcagcaagatacaacggtgacacatatcacttaattgtcaagaactgtaaccacttctgcaaagacatctgttacaagctgacggggaaatcgattccaaaatgggtaaatcgactggccagactagtgtgtttggatggaggaaatggagaaaaggaaagggaatgtaaggttttcttgcaacatgagtttgggagaaaggttacttcactgatcgagactttcaacttccatcaggcattgacattagggaagccatctgctaatcaagtgtccttctgttcaatttgcaattgcattcttcctgtgaaaagagaaggcttcgaagtgaaaagagaaggcttcgaagtggcttcaattgcttgtcctcaatctcaaagcgtcaaaaacacctttccacatcttcactgtttctacagtcacccataa

SEQ ID NO: 14057 - DNA, 795 bp, Glycine max
  Peptide Sequence Number=SeqID_130835
atggattctcccttactagaaaacattgacaactctactactaatgttgaggagaagaagacactgaactctgttgttaagaaattaaattcgggccctgctatcctcacctctatatgtcagtactcatttggtgcactcactcaaacatttgctggcctagttggtgaccttgaacttgcagcagtttctgttgaaaattctgttgttgctggcctcgcctttggagtcatgcttaaactatctgttatgggcgagaggaagaagatggaatgtcttggttcgagatcaagtctcatttcgcgtgctctcctgttcctaatacaccactctctctctctcttcaacacgcgcttcagcactgcccttatctcttcccaaaccttatctcttcatttctcattaaccccaccaatcctctaccacaaagctgctactttgtttccttctttcttcatctttgcatcatggccaaaggttctcaatcctccacttcaacagccacgcgaccaacaccagcaggcatggctccccgcagtttcaccgccgccactgccggcatgtgccgtcgccactaccagcatgcaccaccgccgtctcggcagcagaaacagctctaccagcaccgtcattggaggcggcaacaacaacatcctgaggttctacacggacgatgccccggggctgaagatttcgccgacggtggtgctcgtgatgagcttctgcttcatcggcttcaccgcgctccacgtgttcggcaaactctaccgctccaaatctggtggcgccgtttga

SEQ ID NO: 14058 - DNA, 345 bp, Glycine max
  Peptide Sequence Number=SeqID_130836
atgttttacaagtgggaagatgagaacaaaggcgttgatgaatttgagattgaagtgagtaaagatctccacgaccttacatctgatagcacaaaaacaatgttttacaaagtcgctttcccgagtaactatgaagaaggaaaagagattttttatttactagaacaacattaccatcttgtctcccttgcaaacagaagtgtctatcttcctgggttcagttccgcatgtctcgttggaccaactgatgaaatcgacatggctcgaatatcttgtcacggaccaatgttgttgatgactgcgacacctcaatatggcatgcaaattatctttaggagattatga

SEQ ID NO: 14059 - DNA, 1503 bp, Glycine max
  Peptide Sequence Number=SeqID_130837
atggcttcttcttctcgccactcccctcaattcacccccattctagaggagcgtgaatttgacgacttgagtggccatgacattataagccactccagaagctcccaccctccaacccccattgtccacaagcacactaaatccaatcacaacaaccacaagaaaaagagatcagattccgaggaagatggctccgtctcttgcaacaagtgcagacctcactcccgcgacaaaatcttcatccttcccttggatcactcctccaccaacaactctcacaaaccctcttccttactcgccagccccaacggtattttcaggtcccttgtttccaagctcacccgcaagagtcccatgtcttcttcttcatcccaagaccctctcccaccctccagagaggaacaatggaaaatggcagtcgccgaactctctcacaagctgctccacgccaccagaaaaagagacgaggctcttctagaagcttctagactcatgcactccatgagcgagttggagaagaagctcaacaagctcgaactctattgccacaccttgaaatctggcctcgaacaatgcaccaacaacaacattactacttcccctacttcccttttcaaatctcaaaccctcgaacaggacaccgtgattcaacacttcttggtctcggtgtcggaagcaagatcaagtgtgaggcttttgtctcgttccttaaccatgcaactgaggcacatgggaagcaaggtgtacgagaaagtctccttccttctccaaccatacgacataaaaatatccttctccaagagtccaacaagaagcttacttttctacctagaagcactcttgaacagaaccttctacgaggacttcgaaacaatagggttccagaagaacgcgtgcaacatgatactgaacccaaaggagcgatgcgaggcgagttacgagtcattcaacatggttcacgggctgacgtgggaggaggtgctgagcaaaggaacgaggcacttcagcgaggagttcagcaggttttgcgacaggaagatgagcgagatagtggcgatgttgggctggaaccgggcctggcccgaggcactcttgcaggccttctttggggcctcaaagagcgtgtggaaggtgcacttgttggccaactcgctgcacccgagtctgccgatatttagagtggagaaaggagtaaggtttgattcggtttacatggaggatatgggtggtggtggtggtgacaaggccacttccaacttggtccctgctctggtcagaataatgcttgcgccaggcttttatgtctatggcagtgcagtcaagtgtaaggtcctttgcagtattaagcaatgttggtgctgctgcatgcttgggttgggatggttccatggtggtggtactactatatcgagattttgggtcaaaggatcaatttctacaattatgggatcaattcaatctgcacgtgtggttatgacagttgaatccatgaaaaatgcataa

SEQ ID NO: 14060 - DNA, 306 bp, Glycine max
  Peptide Sequence Number=SeqID_130838
atggcgaaaccagcatggcctgtttcgccagtcctgattgcaaaacctgttgaaggcctgccacctctgacacctacgtttgctctgaacgcctacctcacctatattgccagtcaaaatggcgaaaacatctctaccacctctttcgctagtggcagtggcgaaaacaccacgtgtccgcgtcacttgcgttttgccagtggagtggcgaaaccagcaccacatcactcaagtcccaggcctgtttcgccagcatgcatggcgagtcacgtgtgtcgccagcatgcatggtggagccctttgtag

SEQ ID NO: 14061 - DNA, 294 bp, Glycine max
  Peptide Sequence Number=SeqID_130839
atgtctctgcctgaaaaaattgtgtctctcttcttctccattggctcaatcttcaacaaagctgaacattgtgtagacacacgtggaaaggccattctaacggaaggttgggcggaaatggattctctgcattcacacattccggttacgatcaactgcatacatgaatgccggaatttcccaactgctgaaaatacagatcttggttggactgacttaagggaattttatgaactgaggaatttgttggataaacaattttccggggtttcattccatgctcccttggcatga

SEQ ID NO: 14062 - DNA, 345 bp, Glycine max
  Peptide Sequence Number=SeqID_130840
atggagttggagctgtggaagcaggtgtcaagtcgcatcctcaatggaagtgggaactttggaagaatcagccatagcaacgagagcgccaaagtgatacgagtgcacaggggtaatatggttttcgaggaccaggacctccaaagaagagagaaggaaggcactagcaacaatcacgcaacatcatctctcaggattgcaggatcttcaggatcaatctttagacgtaatctttcaggtaagtgggcttcgaaaccttcttctttgtgctacttgctattcgcacctctggctctgtttgcactgcttgttttgcaccgctttctgctacttgcaccttcgtaa

SEQ ID NO: 14063 - DNA, 357 bp, Glycine max
  Peptide Sequence Number=SeqID_130841
atgtctgaacgagcggatatggattatgaaaatgcagaatcatgtggcgcgaatgaaccacatgttgattgttcggatgcgttcaagacttctcagatgtttgagtgccgagaggatgttttgcggtgggctcgatccgtggctcatgaaaatagatttgtggtagtgattttaaggtcggacacaaacacaggtagtagaggaaggagtacgtttgtgttaattggttgtgaaaggagtggcgagtataagtgtaggaaaaagaatttatcagaagagacactgagactaggaaatgtgggtgtcccttcaagctttattgcaagccagtggttggaggagaaggctggatggtga

SEQ ID NO: 14064 - DNA, 786 bp, Glycine max
  Peptide Sequence Number=SeqID_130842
acaaacacaacaacacctacagtggcagaacacatcaaatggagaaggcccagaaaccaattcaaccaccaccatcatcaccatcaccaccccatttcagaaacagatccaaaccctcaaatcccttccataatccaatccactaggtgcaagtccaccatttcctccctgctcctctccactttctccaacaacacctccaataatgccactgcccacagcaagaaaaaaagcaacttttctgcatcaaccttcagagggttgggctgcactgctggctcgtcgcagcaggtgtcggtgccggcggtgattcgctcctccgccgattggcaagggaagaaaacaagaaaaaagaagcacaagagaagcaacagaagcagcaagaacaagactttccatggtggggttctggaaggttccaatccagagtgcgtggattttcaagatgtttggtgtggccctggaattgggttctcaacagatgctgctgctgctgcctctgttgattgtgttgtggccaggaagaatgtctcttctgcaagagggaaaattgatgtggataagatcactcacagggagcgatcatcgtatgtgggaaggcgcactgaaaccttcacttttctggacagtactgatcctgacattttcacaccacgctctgcctctgactcttatggaactgcaacatactatcgtcatgttagagatccttcctctgatggttttgctgaggttgcctctaatatacatgacttgcatgtgcttgctgtggctaccaagttataa

SEQ ID NO: 14065 - DNA, 827 bp, Glycine max
  Peptide Sequence Number=SeqID_130843
gactacacgtcctcgccttgagaggactacacgtcctcaccatcagagggctgcacgccctcacctctagaggactacatgtcctcgccttgagagggctacacgccatcaccttgggactacacgtcctcaccatcagagggctgcacgccctcacctctagaggactacatgtcctcgccttgagagggctacacaccctcaccttgggactatacgtcctcaccatcagagggctgcacgccctcacctctagaggactacatgtcctcgccttgagagggctacacgccctcaccttggagggctacacgccctcaccttgggtactagttaccctcaccgttgagaggactacacgtcctcgccttgagaggactacacgtcctttccatcagagggttgcacgccctcacctccagaggactacatgtcctcgccttgagaggactacacgtcctcgccaacaaagggctgcattccctcaccttgaagaggactacacatcctcgccaacagagggctgcacgcccctcacctccaaaggactacacgtcctcaccgtcaaagggtcatgtgccttcacctttgtagggctacacaccctcacctttagaggactacgcgtcctcactttcaggaccagtagtttccttttaacggttcctgggccaccccctaatattggagggcgaccaactgtgcaagcacaactagagagggaggctatcacacagctactatgcataccggggcaagatttcacctgtgccgttgcaaagagacgagtgcggatcatgcgcaccaacatgaccactcttacatag

SEQ ID NO: 14066 - DNA, 1365 bp, Glycine max
  Peptide Sequence Number=SeqID_130844
atgccgctggcgtttgcgctgcacttaccggcggaatccgcgctgatcctgctggcaacggtgtacatcggctgcgaatatggcgggcgcatctcgtcgattctgctcaacgtgccgggggatgccggcgcgatcatgaccgcgctggatggctatccgatggcgcagcagggcaaagccggcgtggcgctgtcgatctcggcggtcagctcattcatcggctcaaccatcgccatcatcggcatcattctgtttgcgccaatgctcgccaactggtcgctggcgtttggtccggcagagtacttcgcgctgatggtgttcgcgattgcctgtctcggcagcatgatgagccacaaccccctgaagtcgtttcttgctgcgctgatcggcctcggcatggcgacggtgggcgttgatgccaacaccggcgtctatcgctttaccttcgacagcgtgcatctctcggacggcattcagtttgtggtggtggtcatcggcctgttctcggtgagcgaaattctgctgatgctggaatccaccagcagcggccagaaaatggtgcgcgccagcggccgcatgctgttcaatatgaaagaggcggcgcaggctaccggcgcaacgctgcgctcctcgttcattggcttctttgtcggcgtgctgccaggtgccggtgccaccatcgccagcgccattgcctatatgagtgagaagaaaatcagcggcagcgatcagtttggcaagggcgacattcgcggcgtggcagcgccggaagcggcgaacaacgcctcagcctgcggatcgtttatcccgatgctgacgctgggtattcccggctccggcaccacggcggtgatggtcggcgcgctgacgctgtataacatcacgcccggtccggcgatgtttaccgaacagccggacatcgtatgggggctgatcgccgcgctgctgatcggtaacgtgatgctgctgatcatgaacatcccgatgatcaacatctttgcacgcatgctgaccattccgctgtggttcctggtaccggcaattgccgcgatttcggcggtgggcgtgtatgcggtgcacagcactacgtttgacctgctgctgatggtcgggctgggcattttcggctatatcctgcgtaagatggatttcccgatgtcgccgctgattctcggctttgtgctgggcgaaatgctggagcagaacctgcgccgcgcgctgtcaatcagcaacggcaacctgccaattctgtgggaaagcctgatctgtaaagtgctgctggtgctggctgtcgccgtgctggtggtgccgccgctgtggaagcgctggcgtcgcaagcgcatgaagctggccgccgccgaataa

SEQ ID NO: 14067 - DNA, 2274 bp, Glycine max
  Peptide Sequence Number=SeqID_130845
atgaaagaatttgagaagagaaaagcttcaaggaatagtcagacaaagggttcaagaagaaccgaaaggagagagaataaattgcatcaagataattcttccaaaacattgaatgaaaaaggaactgaatctaagacaccccaggatagtagaccaactgcaaataattttataagtgattcaaacgcggcctcagagaattcagaaacttatgaaaatgtgattatacattatgtggatgatgtcaacaggtcggaggaggcacttgccgagatgaaagttaatgaaacagttgctaatgaaaacaaaaatgaagtggctgatgatcgttccagtgatttggagaaagagcaaaaggaagggaatgaagaagtctcggatactgagacagtaaaggattcagtatcttcccaaggtgattctttcaccaatgaggatgaaagaacagaaaaagctttaaaagatcctaaaagcaaggttaaagtgaatccttcagaaagcaatcgtggatcaaaggagagatctgatagaaaaacaaataaatttcaatcaaaggtatcaaatagcaatcaaaagaaacctatgaactcaaataaagggcactccaaagttacaaacaaaaatacttcctcagctaattccaagaccgtgaaagttcctgtaaatgtatcatcggaatctcctgaaggtgttgatgaaaaacctgttcaagaggtcaaggaacttgttaatgatgaatcctccaatggtgctcagagtgtaggaagtgaagatgaaagtcgtgaaacagttaatgatgaagaaaatgatgagcacgaggataatgcagctgcggaattaaaaattgaagaaatggaattacgaattgaaaagcttgaagaggagcttagagaagttgctgctcttgaagtgtcactttattctattgcaccagagcatggcagctcaacacacaaggtgcacacacctgctcggcgcctttctaggctctatatacatgcctgtaagcattggacccagaaaaggcgagccacgattgccaagaatactgtttctggtcttgttttggttgccaagtcttgtggtaatgatgtttcaaggttaactttctggttctcaaataccattgtgctgagagagataatttcacaagcttttgggaattcctgtcaagctagtccccttaaaaggttggtcgagtcaaatgccgctggcaagagaaatgatgggaagtctatggcactgaaatggaaaggtagctccaatggtaaaccaggaaatggttttatgcctctggttgaagattggcaagagacaggaacctttacatttgctttggaaagagtagaatcgtggatcttttctcggatagtggagtcagtgtggtggcaggctttgacaccctacatgcattctccagttggggactcttcaaataaacccattgggaagctgatgggacctgctcttggtgatcacaatcaagggaacttttccatcaatctgtggagaaatgctttccaagatgcttttcaacgactctgtcctgttcgagcaggagggcacgaatgtggttgtttgcctgtattggccagaatggtcatggaacaatgcatagctagactagatgttgccatgttcaatgctcttcttcgggagtcggcccttgagatcccgactgatcctatatcagaccctattgtgaattcgaaggttttgccaattccagcaggagatttaagctttgggtctggtgcacagctaaaaaattctgtgccttgtggtattgatcttgttcttgtggcaatgtccaaagttggcaattggtctagatggcttactgacatgtttggcatggatgctgaagattgtctgcaagaagatcaggagaacagtgagaatgatgaaaagcaaggtggagacggtgaacctaaatcttttgttctccttaatgacttgagtgaccttctgatgctacctaaagacatgcttatagatagaaatatcagacaggaggtgtgtccaaccatcattctttcattgattatacgggttctctgtaacttcactccggatgagttctgtccagatcctgttccaggaactgtcttggaggccctgaatgcggagactattatagagcgaagattgtcagcagaatctgcaagaagctttccctatgtggctgcacctgttgtgtatatggctccctcttctgctaatgtggcagagaaagttgcagagactgaaggaaagtctcacttggcaagaaat

SEQ ID NO: 14068 - DNA, 126 bp, Glycine max
  Peptide Sequence Number=SeqID_130846
atggaggggaactacgccattaaactgtggaagagattctggaaaggagcagacatcaaaaagtacttgaacatgctgcttcacccaccaagatatactgcaagatacacagaaaaggagtgttag

SEQ ID NO: 14069 - DNA, 393 bp, Glycine max
  Peptide Sequence Number=SeqID_130847
atgagagagattttaatgaaaggagagagagagagagagaggaaggagaggattttcttatttgatttggttgaaggagagggtaagggagagtctcctagcgtgtttgcttacaaagatttttctactgcgaaatgggaagcaagtgttggtatgagcatccacgacaacaattcccttggactattcggtgaaacgcagaagaggaagcagcaaggtcatatatatgatattgaaagcataaggtttagagggtacaacgccattaccaacttcaatatcaggttgttttacaacattgaggccattttgaaaggacaaactgaacctggaaagaggtccaaatatattctcaaactcaagtggttaaaagactctgtacgatggatttag

SEQ ID NO: 14070 - DNA, 648 bp, Glycine max
  Peptide Sequence Number=SeqID_130848
atgatgcttaccagaacgcaggagcgtggctgctgcttgacctacgactacgtcatcgacgatgtcaccgatctgctcggcgagaaggacttggattcgatctccgtactgagagggttgctcgtttcgcggcccgcggattcgagcttttcgcacaagaacgcgctgcaccgctgcgtggaacacgccaagctatggcttgctcaggatagagagcatatggggttcgtgagcagtttcttggggatttttggttttgccgttggaatacctcttggcctcttagttgggttctttctctttgtctactcagaaaccaaacatgtcaaggaccctgttgttaggccaatcagtgaattaggcccaaatgctctgcaagaacttctgcccgagattcctctctgggtttatgatgacgacgatgatgatgttattgtgttattgatattatttttgcatgttattcagaagcacgactcaaccgatattatatttgctgaatacattgggaagtatcagatcaaagcgattgattttgatgagttaagccttggtactcttcctcctagtgtctgtggaaaaattggaagctttcccccaaaaacacagaaatatgcacatttccgaatgaagattgaagactactag

SEQ ID NO: 14071 - DNA, 387 bp, Glycine max
  Peptide Sequence Number=SeqID_130849
atgcagttttctagagataaaaggagcattcttgctgttggggatatttcggagattatccctgacaaagttgcagatattgttgttctagaggagcccgagcacttgacatggtatcaccatgggaaaagatggaagactaaattcaggctagttatagggataattcatacgaattatttggagtatgtgaagagagaaaagaatggaaccatgcaagcatttttgctgaaaggaatttctcacaaggcaaatttctacatcggttgtcctaataaccgatgtagaatgtcaaaattcaacatcgatcatttaaccgtcgttgtgtttcaacgactccgggttacaacgacgcgtgataaccgatgtagaaagtctcttttctag

SEQ ID NO: 14072 - DNA, 387 bp, Glycine max
  Peptide Sequence Number=SeqID_130850
atgcctgtaggatggatcacaagcgcggaaatttattttgaggtgcaaaatactgtggaggatgatgggagacaaataccagaggtgcttcttctaaatcataaggagtttagagcaatgggcagaatcaaaacgattacgggtcaagattggttaactctttatagaatcataatgggtcctcgaacaataccctcgccaaatttctctgaggggaatcaattcagaaatgcttccttgatggcagacgtagctggtgtgactgttattactgaggatgagctagactcaagtactctagccattgcaattgaaaagattaacaagttcaagcattctttgaccccaaccatctttcaccgtttctgcctgaaaagtgagacctaa

SEQ ID NO: 14073 - DNA, 201 bp, Glycine max
  Peptide Sequence Number=SeqID_130851
atgtggcaagaatatgaaggagatcagtggggtcctgatccaaggagaaagaggactgcaaagggtcgtcctgtttcaactcgcattctgagatggacgaagacaaaaatgaacgagcaagtagaaaaaaatgtggactttgccggcaacatgaaaaggaagaagggaagtcggggtgcaaaacccgacttccgtgaatga

SEQ ID NO: 14074 - DNA, 258 bp, Glycine max
  Peptide Sequence Number=SeqID_130852
atggagaaactcaaggatttaatcaagcaagttgcacctacaggtgttccccctaatggaattcacggatcacagttggttagacgattgttctttcgacaaccaggtcattctaagtattccaaaaatttgattgaatatgacataacagaatggaaaaatgatgaagacgtgctaaaggtgttagcacaatccaactattggaaacgattctgcacaatagaaatttgggctatttttagcaaaccagtaatctaa

SEQ ID NO: 14075 - DNA, 1877 bp, Glycine max
  Peptide Sequence Number=SeqID_130853
gggaaaatggagaaaccaaacgcaatcaaggtgaaggaaaacgcaccaagactgagacgagaccatggccggagacgcgacatgcaactgtaatggagacgcgagatgcgaccatggccggaaacgcaaccatggccggagacgagaccatggttggagacccgaccatgtgcttcattgttgacgccaacgaagaatgtggtcatggaggagaggaagaagatagagagaaagagaggaagaagatagagaggaggagagggggaagcttctggagtgaaaattttcaaaatccaccgcaatatgttatgtgtccaccaccacctcctaccaatgaaaattctcaaaatccaccacagtatattatgtatccaccacccccacacatgtggtatatgcatccttcatccaatgtagagccacctactagtggtagttctcaaaatccacaaatttatagtcaaccatcaactcccaccaacttaaacacgtgttataggccttctttatccaatattgtgctccctagcaatgaaattgaatcactcgtcggtgtagacggtattcaactagatgaaggagatgaaaattcaggtggaaaaaaagtcgtaccgcattctcggtcacggaagatgatccatcctctagttcaaaagtttaatgggtgctacaaacaagcagataaacataggagaagtggaagttcagagaaagatgtcttggctgatgctcatatgatttactcacaagatataggtaaaaaatttgaggttgagcatggttggttgttgttgaaagatcaaccaaaatttgattcagaatttatgtcaaagtgttcaaaaagaacaaaggtttctacttcaggaaattacttgtcgtcttctaacccagagacacccattgaagtcgaagaatatgatacgctatcgccaatgtctcgcccaattggacaaaaagcagcaaaaaggaaaaacaaaggaaaagaatgtcctaatactctcgatttatctagcatagaaagtgtaatgaaggacaaaaatatgaacacatcaaaacttattcaattaaaggaggcacaggaaaagcgtctgcaagaacaggaacgacgtatggagtatgaaatcctcatgaaggatacttccaacatgtctgaacaacaacacaaagaccacgaaaaagccaacaacaactacatggcaacaccactaggcgtagccaaagaagaagagtggtacatcataatcgtgaagaaggtcatcatcgattgttcaatgactatttttcagaaaatcttgtgtacacagagattcaatttcggagaaggcttatctccattgcagaagtgcacaactgctattcgtatattggcttatggatcacctactgacaatgtcgatgaatacgttcgaattggtgaaaccactgcagtggaatgcttggagcgatttgtattaggcatctgtaccatatttgggaataaatacttgaggagaccaaataatgaagacatcgaacgcctactacaaatgggagcgacacgtggatttccagatggcatttatccagactttgtcacgtttgtgaagaccatctcaatgccacaaggagaaaaacgaaaattatttgcacaacgacaagaatcggcaagaaaggatgtagaacgagcttttggagtgctccaatctcgattcgcaattatacgtggcccgtcacgtttttgggatgctagtaaaatgaagaatatcatctatgcatgcatcatattgcataacatgattgttgaggatgaacccatgagcaagaggctccaagaggattgggctagagctgctgaagaaagccctaggattctcatgaacctcggggtagatttctga

SEQ ID NO: 14076 - DNA, 390 bp, Glycine max
  Peptide Sequence Number=SeqID_130854
atgagtacccagagaataagagggagggatgagtaccaagaggctgagcatgattttgagaacatgtccatcttctctgcaagtgatttgagaggggaagtgaatctacatttcccaaaaccatgtaagaggctcaaggcgctcttagagaggcaaattgaagagaggaaggagagtatggaggccaagcctccttggaaaagaaaaccggaatggagaaggaagagagagaggagacgccacttcaaggagaagatgagtctagaagaagctcaccaccataggaggccatggataagagcttggaggaagaaggagatgaatgaagggaaggggagagaagagcacgaaattttatgctctaaaagagctctgaaatctgaagtttaa

SEQ ID NO: 14077 - DNA, 636 bp, Glycine max
  Peptide Sequence Number=SeqID_130855
atgaagatcgccaaacagttggtaatcgcgatgcagaatatcggcgcaccggctgaattgatgtttctcatcggctcgtacggcgatacgcaaagtgacgaggacatcctggaaatgctagagcaattcaacgagcgcggaacgtatgtccacgaagttatctcaccagcatttcgttgggaacccggaaatgctgagctgatggaaatggccctcgcagcgctgacggctaggccaaagggattcattgaatctaaagctaacggaactgattgctttattctgaaaggattttatctgaatgggctggttgaaggtgacgaactctacaccgccccgccagcgccggtgcttcgggtgccggatgagatgcaccacaagcaatccccacatggcgaaagctctttatgggctatggggtggaatgaatgcctggcagaggtgaagcgcctcaacacccaaccttcaccaccggaggcatacgagatagcgagggagctgctggcgctgcgtaatgcgttcagtgtgccggattgctgggaaatcgccgggcaaatattcgccactgaggaagaggctctcagctacggcttcataggcaagccagagccgctctacagcaagccagaggcctga

SEQ ID NO: 14078 - DNA, 240 bp, Glycine max
  Peptide Sequence Number=SeqID_130856
atgcagtcccagttgcaatcacagatccattcacagggacttgcactgccactggagcctgaggttggtgttgaggaggttaaagatgtagaggctcttgttcctgtacccactactgaggttattttagtggtgcaggcacttaacaccttccttgcttggctgacacatctcgtgaagcgtttatcagaacaggcgactgtgtctccagcaaaacttgcagatggaccggatccttag

SEQ ID NO: 14079 - DNA, 396 bp, Glycine max
  Peptide Sequence Number=SeqID_130857
atggatgagaagacaaagaaaaaactggaggaagttgctcaatccagaagcactaacatcgtgattgaccctccttcacccatcagacgacacgtcaaatggaagatgacccacataaagaaaattggtcagatgatgtctgaggcagcaaagcaaattgctgacaagattgatttattggaggagcaggcgtcacagggttcctttatcgcccatatatgtcaggatgtactggctattgccattgggctaccagaacaccccggtcgtgtgcgtgttgccggagctggtgtgacgatcaagcaatactttggattggctccaaggacctcctgcacgtcttcctctagggctcgcgaagagctagagcagctgactcaacaaatcaaggactag

SEQ ID NO: 14080 - DNA, 396 bp, Glycine max
  Peptide Sequence Number=SeqID_130858
atgtataacgggtcaggattttgcccggaccgctgcagggaggcgggtgcggatcatgcgcaccaatatgaccaccttgacacagacgtggatgacgttgctgctcagcaatgtatgccacccaccaggcaccctctagacctggataagtctaatagggccttggggtttccaacgttgatcacgggcctctgccagtcattcggggttcccgtcatacctagtaaggtgatccggccgccgatcacccgagccttcattgagaagtattgcacgcctaggcaagcgcagggtgatgcaccacaagccgcagacgcaccgccgccacctcatcaggctgatcccgctgggtcattaggcatggagcggtatctacagcacttggttcgccaatag

SEQ ID NO: 14081 - DNA, 135 bp, Glycine max
  Peptide Sequence Number=SeqID_130859
atgcaggcccccgagctctatgctgagagtggcataacaatctttgcattacaattgggagcaaagaacaagcccatgtatggtgcaggaagaagcatgcaagatatgctagattctggaacaggattgcctcta

SEQ ID NO: 14082 - DNA, 312 bp, Glycine max
  Peptide Sequence Number=SeqID_130860
atgttgatcctaagtgaatattggactcctaaaactgtggtaaacaatccaagtgagttcaacatacatagggaggttgaaagtaagcccaaggcaatcaatataccatgcttaaagaaacaaatcgctggtgctggcagcttggacatacaaacttttctcaaatttcaattgaaaattactgtgaaaacaagtgccaaagctagagggaattggaaaggaggattggtgccatcccttgaagaatttgagtcaagaagcaaggggtcaaccaccttaagagatattggactaagaagcactccaaattga

SEQ ID NO: 14083 - DNA, 330 bp, Glycine max
  Peptide Sequence Number=SeqID_130861
atggttggaattcctcagagcttccgttttcaatttcgagcgtgtcgatatattacgggactcaatcagatatcggagttaaaagttattgtggtttgcatttgctacgagcttctgttttcaatttcaagcatctcgatatattacgggactcaatcggacaaccgacggaatgaagaaaggaagagagagaggagatgccacttcaaggagaagatgagtctagaagaagctcaccaccataggaggccatggataagagcttggaggaagaaggagatgaatgaagggagacggagtgaagagcacgaaattttgtgctccaaatga

SEQ ID NO: 14084 - DNA, 294 bp, Glycine max
  Peptide Sequence Number=SeqID_130862
atgccaacttcagcacctacttcacgccgtacttcatccccttattttgttgtgcgcgtggagggagatgatggaagagttggtgggcgaaggggaggaagaggcgggtgtcgtagagccggaggaaggcagaggagacgaaggggttacgaaggaaggaggacttggcggcatggatgtggagggagttggcgaggagggttgagggtggtgcaagacttgagggtgagggagaggaggagtctatggaagcttctagggcacagaggaggtcggagtgtgcaaagaaactaa

SEQ ID NO: 14085 - DNA, 512 bp, Glycine max
  Peptide Sequence Number=SeqID_130863
tcttacggatagcaaatgagactctttggcaatctcggttggaagaagctgacatctctaggaaaggtgcagtcatacggatagcaaatgagactgttttgcagtctttgccggaagacgctgatattctcgagaaagtcttacggataggaaatgagacttattcccagtctcggccggaagatgctgacatctctggcaaaggtgcagaagaagctgacatctctgggaaaggtgtgggtgacgattctcgaccagaagatgcttacatctccagggaaggtgcagatgagaactctcggccgaaagatgctgacatctacgggaaaggtgcagctgacatctcttggaaagctgcagatgacgatgttagtcactccatgctatcgggctttgagtcttaccaagagcaaatgagactttttcgcaatgtcggccgaaagacgcttacatcttcgggaaagtctcgactagaagacgcttacatctctagggaaggtgcagatgacaac

SEQ ID NO: 14086 - DNA, 489 bp, Glycine max
  Peptide Sequence Number=SeqID_130864
atgtcgtattttatctttcaagtcttctactttaacaagcagacaacatggatccttgataacacccacaacgacacagtaatggttaactgcttgcataacttgattaaccagttctctaagtccagcatatttcccacgaaggttctttcgttcttacgccgctctctcatccgtggtcgccctctccttcaaccgcagtcttacgccgccgtttcgttcttacgccgccctctccttcaaccgcaatctcttggaaacaaaaccccccatcacacagtgtctcccaacgccacgaagaagaggaaaagccacaaagaaagttatatcaagggcactgatacttttccttttgggactgttacttcaaggaacccgatatttttttctcgactgcaggctgaagtgactcagcggttgactagtgcaaaagagtcatcaagtaaacctggattgcagagtcatgaggatcttgcaaagaaacttcag

SEQ ID NO: 14087 - DNA, 126 bp, Glycine max
  Peptide Sequence Number=SeqID_130865
atgtggcaggccaatacttcattcccgccaacatatctggacaacagaaataacccagtgtatactgggtgctccctaaccgctggaaatcccatcacatgcaaggaaatatctggaagaatgtga

SEQ ID NO: 14088 - DNA, 489 bp, Glycine max
  Peptide Sequence Number=SeqID_130866
atgactgaccacgtagattttgtcgttgcgcaatgggccagcgccatgccggagctggacgcttcttccatggcgatttttggccgtatgctgcgcctgatgaagcttctggcgaaaaagcgcgctgaggcgctggcgccctttggttttcgcgacggcgaatttgatgtgctggcgacgctgcggcgtgccggcgcaccttaccgcctgtcgcccacgcagctctacaaatcgctgctggtcacctccggtgccatgaccaaccggcttaaccggctggaagaagagggcttgattgcgcgtgttgccgatgccgatgataagcgcagcacgctagtgatgctgacgccggccgggctggcgaagattgatcaggcgctgcaggtgcatacgcaaacgcagaacgcgctgctggccacgctggacgatcggcagcagcagcagcttgccgccctgctgcgtcagctgttgcagacagccgaacagtaa

SEQ ID NO: 14089 - DNA, 350 bp, Glycine max
  Peptide Sequence Number=SeqID_130867
atggagatagaatgtgaatcgtaccttacctgctattggcatgtttgctttactggtttttgtggtggcgctgaatttgcgtccggtgatggcggccatcggaccgctgttcctgcaactgcagcacgatgcagggctcagtgccacgcagctgagcctgctgacgacgctgccggtcattatgatggggctggcggcgctggccggaccgctgctgctgcgcaggctggtgccaccatgctaaccgccagcgcgctgctggcgggctgcggcatcgggctgattcaggcgctgatgcccgcgctcatcaagcgtcacttcgcctcgcgtgcctatacgctaatggcact

SEQ ID NO: 14090 - DNA, 294 bp, Glycine max
  Peptide Sequence Number=SeqID_130868
atgtggttgcagacacggaagcacagcccaatttgcaacaaagacgaacttagctactactacatagcacatggattcatatccacatataatgagcatttgaagcctacaatgggggacatagagctttgtcaattgttccttttcaatgaagaattcaagtatgtaagagtgaggcaagatgagaagatggggctagcaaagcttttggactatgttccaatccccatcaaggaaagtctagaagagcctagtgccaagatcaatgttttgttgcaagcatacatttcataa

SEQ ID NO: 14091 - DNA, 543 bp, Glycine max
  Peptide Sequence Number=SeqID_130869
atgggatcaagtcaaaagccttcgcttaaaaagaggttttatcaagttcaaattcagagcttagaggtcaccagtttacgaaagttggggcaattaatgggtcaacttcaacggcaagccttccgcaaagcctatggaattagaccgccaaaggcaagtcgaaaatggggtggtcggaataccgagaaaatatttggagcgatcgacgtttttctcgcctatcataaccacaaggaaagtccggttgtcgctatgctagccgacctatatgacaccttcgaccgaagatgtgaagaaagcaatgcaaggattgtttgctgtactccagctctctatgtggggctggtttcacacctttttctccaagaaggtaggcccgtctatccgctacaaggttaccgctcgtgcgtcgaaaaaggaaaggcgaattgggaccaactcttggctagcatgggggggcgtctgttaattggttccctcgctagaaggaaggaagaatcaagattctatcttcatgcgaaggatgtccaaatgttaccttga

SEQ ID NO: 14092 - DNA, 231 bp, Glycine max
  Peptide Sequence Number=SeqID_130870
gttagctcgcctgggcaagcaacccctgcacaaaatgggttaaaaaggggaagggggaaggtttctgcaccaaaaactcttcccccacccccctcattcaaaaagaaagctatgggaatcaccaattttgcagctcctaggtcaccatttttcacgtttttgattccatttttctctattattcatctccaacaagggatggccttaggcctagggtgcattctgaggtga

SEQ ID NO: 14093 - DNA, 1311 bp, Glycine max
  Peptide Sequence Number=SeqID_130871
ggtggcgctcttcggtttgttgatcgcgccgttggccgggttgacgcgccattttccgctactgggcaaaattggcatttccggaaccggcctggcgccggcgctaatcgcactggtgctatatgcgttattgccgctggtacgcggggtggtgaccgggctgcaacaggtaccacgcgaggcgctggaaagcgcaaccgcaatgggaatgaacggctcccagcgttttcgccaggttcagttaccgttggcgctgccggtcctgttgcgcagcctgcgggtggtcagcgtacagactgtcggtatggcggtggtagcggcgttgataggcgcgggcggcttcggcgctttggtgtttcaggggctgctcagcagcgcgctggatttggtgctgctgggcgtcattccgacgattgcgttggcggtagtcgtggatgccgtgagaaacgcatgattgagttcgacggggtgaataaagcctttgccgggcaacccgcggtgaaagatctcaacctgcatctgcgcgagggggcgttttcggtgctgattggtacttccggctccggaaaatcaaccaccctgaagatgattaaccaactggtggaacaggatagcggagtgatacgcttcgccggcgaggatatccgtcgacagccattgctggcgctgcgccgccgtatggggtacgccattcagtcaattggcctgtttccacactggacggtggcgcaaaatatcgccaccgtgccgcagttgcaaaagtggccgcgcgcaaaaattaccgagcgggttgatgaattgatggcgttattaggcctggagcctctactacgcgatcgctacccgcatcagctttccgggggccagcagcagcgcgtcggcgtggcgcgggcgctggcggccaacccggaggtgctgttaatggatgagccgttcggcgcgctggatccggtgacccgcgaagcgctgcagcaggagatgttgcgcattcatcgtctgtttgggcgcacgattgtgctcgtcacccatgatatcgatgaagcgctacgcctggcggatcatctggtgctgatggacggcggcgaagtggtgcagcagggagagccgttacagatgttgctggagccaaagaacgcctttgtcgaaaccttctttggccgcagtgaactaggggttcggctgctctcgctacgcggcgtcggggattatttacgccgggatgagcggctggcgggcgatgcgctaaacgtctcaatgacgttgcgcgaggccttgtcgcagtttgtcgctcaccgtcgcgacgttttgccg

SEQ ID NO: 14094 - DNA, 261 bp, Glycine max
  Peptide Sequence Number=SeqID_130872
atgtcaggatttacacacgattctcctcaaatttcagccagcccgcatcaattagaccttgcaccttacgcttcagagccctaccatgctcaatggaacgccccggggcttctccgtgacaagcacacgttgcgtttgagtcgtatttctcggagaaatggaggctttctcgctgcaaaattcacttcttggttggtgtttttggtttgttctaaaggtggtgttcgtcattggaagtgcggtagacagactttgtggtag

SEQ ID NO: 14095 - DNA, 243 bp, Glycine max
  Peptide Sequence Number=SeqID_130873
atggtcgacgacaacgatgacactgctggtgtgcttcacgatgacactgctggtgtgattcacgacgacaaccaacttagagagacaaagcttaagggcacaacagtactcagttcaacgacgatgcctattaaacccgttgttgacatcattttcggtaaaaacgtcattgaaataaagcgcatatttactaaaatgccaccgcctgttaaacaacaacgtttttcggaccaccgtccttga

SEQ ID NO: 14096 - DNA, 1224 bp, Glycine max
  Peptide Sequence Number=SeqID_130874
atggagatgtgtaacctagttcgttcagccttcacaactggcacctttcctcctcagctagtagagactcttgttgtgccgatgcctaaagtggataaccccacttccatgaaagagcaaaaggcctctgagggctattggaaacctattaaagtctcagatggtggtccggaaatatctcacttgttttttgtagatgattacttacttttcaccaaagcatcttgttcccaagtcagattagtgaaggaggtgttggatgctttccacaaggcgtttggtcttaaggtgaatgtgcaaaagcctcgtttctttacatctattatccatttccatcacacaatagatttggctaagtacttggggttccccttactcaagggtcgtaccaagactcttaatcaagcagggagagtgacgctagctagtgcaattttaacaactatccctacttacaccatgcaaaatctttggctctcggaagcaaacattgctctcctaggggaacacatttggtcccttcatcatcatgaagataagctttgggtccgtgtgttaaaggataaatgcatgatgtgtcttatggtgttaagcggtgaggtgtggggagttggaagagtcttttcttcacatggtaagagactgctcgagagcaagactgagacaactacatggacctcacaaacttctggtggcttgcgcatattggtttatatggtgagccgcaataaggaggctctcaaaagtaaggaatggacactctggtacacagttaaccaaatcaaaaagactcaagcaatcatcactacgcacacaacgacaacaccagcatcaacttcttcgatgagagagatcacatggagtctgccttcgacgaatgcaattaagctcaacttggatggcagctctctgggtaacccaggaccttccggctatggcgtccttttacaaaattctcaaggggaatggcttcaaggattcaaaggcttctggggacatgctactaatctctatgcaaaattcatagctctgttaaagggagtgcaactagcttgggacaggggagatcgacacgtcatatgcaagaattcaaaactaggaattggactacctctttcgtccacactcttcgcgaaaggaactagtgtgcagacatgcttgccaagatgggatcctcagagcatgaccctatggctattcttgagtcttgcccgcaacagttag

SEQ ID NO: 14097 - DNA, 861 bp, Glycine max
  Peptide Sequence Number=SeqID_130875
atgcacagattagattatactgtctccacggatttgattttgcataaaaatcgcatttggttgcccaatggaattcaattcatccagacactgcttattgaattccatagtactcccactggcggtcacatgggcgtcaagaagactctggcacgtttaagggaaaacttcacttgggccaatatgcaaaatgatgttcgccagtttgttgctgcctgtcttgattgtcaacatactaaatatgaagctaagaaatcggcaggattactctatcccttaccagttccttcacagttgtgggaggacctttctatggacttcattgttggccttccgccttatcggggcaatacaaccattttggtggtcgttgacaagttttcaaaaggggtccatttgggccttttgtcgccatcttacatagcactgattgttgcatcgcttttcatggaaattgttggtcaggtagcctacaagctacaactgccagagggctctcgcatccacccagttttccattgttctgcactaaaaccttaccaccaaccttcttcgagctcagacagtccaatagctctaccaccccatgacattgacaacaaacccatcattgcaccacttgtgttcctgggcacacggtgggaacaggaccagggcaagcaacgattgaaggtgttggtgcaatgggaagggctgcacctagatgacacaacatgggaacattgggctagcctacaaaacacctatcaccttgaggacaaggtgttgctagatgggctgggggatgataggcccagtactgagattgcgaagggcagtagtgggagaccaaaaagaagaaccactattccaaccccctga

SEQ ID NO: 14098 - DNA, 1113 bp, Glycine max
  Peptide Sequence Number=SeqID_130876
atgaatggcagcggctccggtaacgagccaccggacgacggaggaggcagtaatgtttcttttcacggcaagaaattggcaagcatcgagtatgaagatggtaacccattcaagcctatggttcacattgaagatttggtattcgaaggtttgtgcgcaccatggcaagacgctctagttgtcaaacttttggggaaacacattgcttatcccttcttgaaaggcaaactgacgcgcatgtggaaactcaggcctggtttcgacatgctcaacattgggaatggttatttccatgctcaaactgtcagaagtttgatctcgaggaagaccgtcagaaggtcatggatggttcttgaccacaacttgacagtccaaacttggacaccagacttcatctctccaacaacaaagattgagaagactatggtttggattcacttctcaggtttgaacctgttctattatgacgaaagtgtttttctggcactcgctgcatcagttgggaaaccaattcgggcatatatcaatacaaaggatgtaagggctccatcggatttgttcatcctgtgggtgttacggtcatttgacacgggaatgcccctcaacagcgacaacaccagagtctccagcagtgaatcccaaaccttccatgttggaagtgatgtcacaacaacaagtccaatcgccgacgacaatgtcgccagggagcaaggtgcagcccttcccattgcaccaacaccttcaatcgttgcttgccctggtcctgttcccaccgtgtgcccaggaacacaagtgaacaatggaaaactgggtggatgcgagagccctctggcagttgtagcttgtaggctacctgacctattcaagaaagaatctgaaaggggccataaaaacgctggtgaaaacaacctccctatgactgagaatatcatctacagttgccatattagaagttcttgtcaggtattgaggaatacttggtggtttccgcccaaacgttattttgaatggggagacactcgtagccgaatgcacagaggtgttataacaccattcgaccggcatcaggaacttgccctaggactttggtttggtgtgtacaaaggctcatag

SEQ ID NO: 14099 - DNA, 915 bp, Glycine max
  Peptide Sequence Number=SeqID_130877
atggctctcaaggccgtccatgtcaccgacgtcccttccctcgacctcgtcccggagaatgcctctctcgccctctgctcctcccgcttccccaacgggttggagatgtgtcggagtgggttagagatcccaaagttcgtcgtgatcggacacagaggtaacggcatgaacgttctgcagtcttccgatcgaagaatgagagccatcaaggaaaatacaatcatgtccttcaacgccgccgccactttccctctcgatttcatcgaatttgacgttcaggtgacgagagatgactgcccagtcattttccacgacgacttgatcctcacagaagagaatggtactgtgtttgggaagagaataacggagctgagtctgtctgagtttctttcttatgggcctcagagagaagatgaaaaggagggaaatgttttgcttagaaaaaaagatgggaagataatgcaatgggacgttgaacaagatgatccgctatgcactcttcaagaggcttttgtcaaggtggaacccactttgggttttaacattgagttgaaattcgatgaccacattgtttatgagcaagattatctcgtccatgttcttcagaccatcttaaaggttgtgtttgattatgccaaggacaggcctattatcttctcaacattccagccagatgcagcaatgctaatccggaaattgcaaaccaactaccctgttagtgtctttgtgacaaatggaggatgtgatatctacgaagatgtgaggaggaactcattggaggaggccatgaagctctgtttggagaatggattggaaggaattgtctctgagattaaaggaatattcagatatcctggagcagtaacccagatcaaggagtccaagctttctctcctttcttactggaaaattaaa

SEQ ID NO: 14100 - DNA, 402 bp, Glycine max
  Peptide Sequence Number=SeqID_130878
agaaacgaggatatgggctacgtaggagttacatgagctcagttggaggtgggcaacaggggatggtgggtttatgcgcgatttgtggatgtggaaaacttgttgtgcaccatcgcccgaccgccactagtaccacatgtgatggagtggtacctggagatatgtcgcgggggtcaggagaccttggggatgtcaggcgagctcctggcagtcaacagataaaaggaacaaagaccacaaagcaaggaggcttgtggtggctggccagctgtgaatcttgtgtgatatatgggttgtggcctctggtaatcgattaccaagggcttgaaaacgaggttgtggaggcctctggtaatcgattaccagtctgtgtaatcgattacacagaggaatgggtcactg

SEQ ID NO: 14101 - DNA, 255 bp, Glycine max
  Peptide Sequence Number=SeqID_130879
atggaggagttgattaacaaaacacctctctctcccaaaaatatttccaacgtcatcacatcggcgtggcggctcctcaacagaatctcatccccgcaccctattactgtcattctactcccacgaacagggttcgcgatcatcacagttactcaccatccatattcaacaattactcatcatccatattcaacaattactcatcatccatccatggatccaatcaagactgcacaaaattatggatgcacctga

SEQ ID NO: 14102 - DNA, 186 bp, Glycine max
  Peptide Sequence Number=SeqID_130880
atgatggaagatgatgacgcagcgattgaggtgaggaaccatgtttccccagagccagaggtggaggacgccggagtgagattaaagaagcagccggacctcatcgatcatttggatacactaggagacattctcaggggacacaaattccaattcctaataataaccttgcatatttatgtttga

SEQ ID NO: 14103 - DNA, 225 bp, Glycine max
  Peptide Sequence Number=SeqID_130881
atgacattgctacttagcaacattctgcccagcgaccgcaacgccaatctccccctgcaaaagtatcagttggtctgtgtcgtcccgacatggggatcgcacccacaagacacccagtggacccggaaaagtccaacagggccctggggtttccagctctggttacgggcctctatcagtcctacaggatgcccgtacccccccggcaaggttatgtcatcataa

SEQ ID NO: 14104 - DNA, 381 bp, Glycine max
  Peptide Sequence Number=SeqID_130882
ggatcgcacccacaagacacccagtggacccggaaaagtccaacagggccctggggtttccagctctggttacgggcctctatcagtcctacagggtgcccgtacccccccggcaaggttatgtcatcatagggatcgcacctgcaagacacccagtggacccgaagaagtccaacagagtcttggagttgtcaagctctaattacgggtctctatcagttctacggaggcgaaacaccacagcagcattgggatggccggtagcgggcaatagacacaccgccaccacctctagagttaacctcagctcatccgcaaaaaggttagagcgttgcctacgacacatggccgaccagcaggcgaccaaatccaaagccaaag

SEQ ID NO: 14105 - DNA, 415 bp, Glycine max
  Peptide Sequence Number=SeqID_130883
atgacaatcttggtgaaaactaatcaagttgttgagatacaagaaccaaaacaatcacaacttgaggtggagtttttaggaggagtaacaaactctagggaagttcccattcagaatgaaagggaaccaacagctaaatcaaaatcagaaagtctcacaaactatatgctagcaacggataaagagaaaaaacaggccaaacctactcaaagatatggttttgcaaagcttattgcatttgctctcaatttagctaaagatattgagcaacatgagccattgacttatgttggagccatgaaaagtagccagaaaagggaatggatgcaagccatggtggaggagatccaatcactagaatcaaaccaaacttgggagttggttgataggcctaggaacaactgggtggtagcat

SEQ ID NO: 14106 - DNA, 357 bp, Glycine max
  Peptide Sequence Number=SeqID_130884
atggctagtgtttgtacccatttaaggttgggtatgtgttcttgcactttcagttgcgccccaagctttggttcttcttcttccacgaagaaaaggaagctttccaacaaagccaatgttggttcaagaaataagaagttcaagaatgatgatgatgatgaggtttggaagatcaagaaagtgttggaaaagagcaatattgggaccatgcgcaggttgatactaaggagagagatggaagaggagtttgtgttgcctgtgttgggggatgatgctgattcaagagatgggtttcttcaagaagttatgtattcattggcaattggattaaagattttgttgcaagaagggatttaa

SEQ ID NO: 14107 - DNA, 180 bp, Glycine max
  Peptide Sequence Number=SeqID_130885
atggttggagcattctcgcaaaacattgtgaccctgactggtctccctatgatcttacttagtgagagtgacctgacaaacccatggtgtgctaggaatgtgacaactcactccctgcgtgttgttgtgtttggatcctgtgatgatcttgaacttgtgttcgggggagcagatgaatag

SEQ ID NO: 14108 - DNA, 381 bp, Glycine max
  Peptide Sequence Number=SeqID_130886
atggacaacataagattcaccgcacctttcagagttcaaaagaaccttctccaagttccttttacctatcacaggcaatggctgcacaactaccccaaatacgttttattccactacgatggcgagatacatttcattagggtaagaacactcggtactaaatgtttttttgctgatggcttgaatgattttagaagggcacacaacctccacgaaagcgtgattctacgtttggtcgccggtgacaaaaacaccactttcaccgttcatattgacggacttgcacaccaccactctaacctaaaacccatcatttatagaaggagatacatctttactgttgatatcacagatgatatgctacaacagaacctaccttta

SEQ ID NO: 14109 - DNA, 972 bp, Glycine max
  Peptide Sequence Number=SeqID_130887
atgacgcttcagccgcaggcgctgcggcggatcatgagtaacttaatcgataatgggctgaaatacgccgaaaaggtggaaatcagcctgagttacccgccgaatggcgatgttatcattcacgttgttgatgacggccccggcatcccggaaggagagctcaccgccgtactgcagccgttctatcgcctcgagcagtcacgtaatcgcgataccggcggtaccggtttggggctggcaatcgccgcccagctcgccgggcagatgcagggaagtttgaccctgcacaacctgcaacagggcggtcttgaggcgcggataaatccatatactaaaccgccgtttcacggacatatccgccatacagtcgcctgttgtaatgctgacgttgccacttcggcaacgttgcgaaggagaatgatcatggctgttgtaattgcatttttggccggtatgttgacgctgctcagcccctgcaccttaccggtgatcccgctggtgtttgccagcgtaagcgggcgtaaggggcaactgatcctgttgttgttcggtatggggttgatgtttaccgctgtatcgctgctggccacggcggcagggggatggttagtcaatctgactatcgtcgggcgttggctggcgctgggctttttggtcgttgtggctatcagtttgctgtcaacacgcgttgcaggctggctcggatcgccagcggttgcgttgggtaatcaacttaaccaacagagctatcgttatggcagtgggctcgcttcagtattcgccggactggcgattggactactttgggcgccgtgcgcgggaccgcggatgcgcgctgatgttgctgctattggggtggttcggcgcgcggctgatttcccgtttgcgcggtggtcaggcgataagtgggcggttacgccaactggctggcgtggcaatgttggccgcagtggcattaatcgccagcggtag

SEQ ID NO: 14110 - DNA, 299 bp, Glycine max
  Peptide Sequence Number=SeqID_130888
ggaaagaagtagaacaagccattgacgtggatcaacaacaacaacaacaacatggtaataaggcaaaagggctgttgtgtttgaagcaccctgatgatgaaacaagccctgatagcaacaatagcaataatggtagcagaaagaaactgaagctcacaaaggaccaatcagccagcagtgaagatattttcaagctgcatagcactcttaaccccgtatttatttttctttacccttccttcctcacaattttgctacaaatctggatgctaattgttaattttatggaaattaattaa

SEQ ID NO: 14111 - DNA, 886 bp, Glycine max
  Peptide Sequence Number=SeqID_130889
ggaagcattgatgtggcaattgtgaaggaattctatacaaatctatatgtccttgaggacaagtctcccaagcaagttagagttcaagggcacctgataaaatttgatgctaattccctcaacacctttttggagactccaatggtcgtggagaaaggggagagcttgccctcttactccaggtttgctagactgaggcctgatcctcaggagcttgcaacccagctgtgtatccctcgtaggggatttgttcttgatgccgaggttctgctgtggaagctcttgaggaaagatcttaccaccctggcccaaacctggagtgttctatcttattctaacttggccccgacatcccatacttcttatcttaatctggatagggccaagttagtctacgggcttgtaatgaagatgaacatgaacttaggatcacttatttctagtcagatttcattcattgctcagtccaactcctcgcggcttagatttccagccctgattactgccttgtgcaaggcccgaggagtcacctcagattctcttaccttcgagacactgagcccatccattaatttggcttatattaagaagaattgctggaacctggatgaaccttcggtcacttttccagggacccaaaaatccaggactagaagatttgaggccccatctttgtcagctgcctctgttccccctacccctgctccctttacttttgctctcccttcaacaccagcagctccagttcttccagagcctacatcagagctagctcctgatcatgcagagtttgcagaatgtggtctagtagcggcaagttataagcgtggaggagtttgttcagaaggtggcctagcaggagtccaaccttctcctttgggagggg

SEQ ID NO: 14112 - DNA, 291 bp, Glycine max
  Peptide Sequence Number=SeqID_130890
atggtagaaatcatagggagtcttaaggaagagtggaggagagaggtagaagaggataataggcgcagtttagagataatgaaaaatgatttaaaagaggtgattaaaattaagttatcccaaatggcctccccaaactcacccccagtagaagcgccagaccctcaagtattagttgttgaggagggtacacggctagtggccttgggtaaggtgtttgataatgccacctcaattcacaatgtcccttacgcagatgatgtcctgagggtcaatgttataacaatttaa

SEQ ID NO: 14113 - DNA, 198 bp, Glycine max
  Peptide Sequence Number=SeqID_130891
atgggaggtagcatcatttatcaacactttgtgacttgctttgctttacgagatgcacaaaaacaaggggaacagttgattattcctaatggcttgttattagttgctcatgaacctagcttcgtcaacactgcacttggaccacacattagaggaaatacattgagggcatactccatagggaaatttcctaattag

SEQ ID NO: 14114 - DNA, 339 bp, Glycine max
  Peptide Sequence Number=SeqID_130892
atggataactttctcacccgcgatgccatccgcacgctgttctctcaggccatgtcggccatgtaccagcaggaggtgccgcagtatggcaccctgacgcagctggttaccgccgttaacgaacgcaccttagaagcgcagccggcgctgaaaaaccgtctggccgccgccgatgagctgagccgcctcggcgtggagcgtcacggtgccattcgcgtcggcactgccgcagagctcagcacgctgcggcagatgtttgccgtgatggggatggagccggtgggctattacgatctgtcacaggcgggcgtgccggtgcactcaactgcctttcgcccg

SEQ ID NO: 14115 - DNA, 471 bp, Glycine max
  Peptide Sequence Number=SeqID_130893
atgtctgtcaccgaagcggcaatcgtcaccgccatgtatcagccgggcggcaccgttggctcactgtttgccggctggctgatggaccgcatcaacgccaatctggcgctggccattatttacttttgcggcggcatcgccatcgtggcgctcgggttttccccggcgcaggtcgggttgatgagcgccatcgccttctgcagcggcttctgttttaacggtgccaacaccggcatgaatgcactctcggccagttactatcccactcatgcccgcgcgaccggctccagctggatgcacggcgttggccgcatcggcgcgatcatcagcgccttcgtcggcgctgagctgctgtccctcggctggtcgtttagccagatctttctgctgctggcgttgccggcggcgctgaccacgctgatgctggtactgaaatgtctctttggtgaccagccgcgcgccaccgagtga

SEQ ID NO: 14116 - DNA, 1653 bp, Glycine max
  Peptide Sequence Number=SeqID_130894
atgacgccggcagttccaaataatggaactgtcgcggcgaactatcgtcgggcgttatttccggcatgcggcaggaaatattcagggataccaagcatgaaatcaaataatccgctaaaagaggtcggcacgctgttggtcatggcgctgctttcggtggtgggggcgatcatcggcgttcagctgatcactacgctgggcgtgacgcccaacacctcgatcatcggtgcgctgatcgccatgctgctggcacgcattccgctgcaaatgtttcaacgctaccgctcggtgcacacccagaacctggcgcagacggtgatctcctccgccaccttcggcgcggccaactgtctgctgatgccgattgcggtgccttacgtgatggggcaaccgcagcttattctgccgatgttctgcggcgtggcggcggcgatgctgctcgacgcctatctgctttatcgcctgttcgataccaaagtgttccccgccgccaatgcctggccgccgggcgtcgccgccgcggaggcgattaaagccggcgatcgcggcggcaagcaggcctggcttctggtggtgggcgtaggggtgggcatcgccggatcaatgctcaagatccccatggcggccttcggcaccgcctttatcggcaatatctgggcgctgagcatgttcggcgtcgggctattgctgcgggcctacgccgagccggtggccggtttcgatattaatgcccattttattccgcacggcgtgatggttggcgccggcctggtggcgctgatccaggtcgcgcaggtgatccgcagccgccgcgccgatagcgccggttatacccaaccggacagcgcggtaagcaaagcgctcggcctgggggcggtcggctacatcgccatcgccgcgtttttggctctggtcggcgggctgtttagcgagatgtcgctgccgatgctggcgctgttcgtgatttacgcggcgttcgccgctttcgttcatgagctgatcgtcggtatcgccgccatgcactccggctggtttccggcgttcgcggtggcgttgatcaccctgatcgtcggtatcctgatcggtttcccaccgctggcgctgtgcatcctgaccggctttaccgccgccaccgggccggccttcgccgacatgggctttgacttgaaagccggcttcatcctgcgcggctacggcgaggatctgcggcaggaactgctggggcgccgcattcagctgtttgcggcgctgatcgccttcctcatcgccattccggtggtttacctctcttaccacagctatttcctgcaggacctgatcccgccggtcgcgcgcgtttacgccaagaccatcgaggccggtgcgcagccgggcatcgcctggagccttttgatctgggcgatccccggcgccgtggtgcagctgatcggcggccccaagcgccagctcggcgtgctgctggcaaccggcctgctgatcaacaacgccttggctgggtgggcggtgctggtgggcatcgcgttgcgcgtggcgatcctgcgccgttggggcgatcgcggccgcacgccgatggagatcatggcggccgggtttatcgccggcgacgcgctctacaacttcttcagctcgattttttccagcaagggcaaatag

SEQ ID NO: 14117 - DNA, 441 bp, Glycine max
  Peptide Sequence Number=SeqID_130895
atggtgatgcgcatgttccccggccgccactttttgcaggtggtcaccccggcgggctaccgttcaccggcggcggaaacctcggttggtcgggcgatactggcgcgtgaaagcgacgagcaggttcgggcgcgttacgccggcggttaccgggcggcttcgcccaatgcgccgcaaacgctggatgcgctgctgcagaagttgcagcaggtgaggcgccagggctggtcgctggcgcgcaatgaaactttgaacggcatcagttcgctggcgaccgcgctggtgaacaagcacggcagcgagacggtggggctgtgtctgtccttcccttcgcagggcgaggaacagccgtttgttccggaagttctggccgaattaaccgcagtcagccgccaactggcggaaaaatatggcgatgattattggcagcagatcaactaa

SEQ ID NO: 14118 - DNA, 1038 bp, Glycine max
  Peptide Sequence Number=SeqID_130896
atgagcaatcagagtgtgatccccggcgatatcgacgcgctttcccggcagttcgacgaagggcgccacctgcggctcggtggttggctggtgctgttggggtttggcggtttcctgctgtgggggctgttggcgccgctggataagggcgtgccggtctccggcagcgtggtggtggccggcaaccgcaaggcggtacagcacccgagcggcggcgtggtgtcgcaaattcaggtgcatgagggcgaccgggtcagcgccgggcaggtgctgctgctgatggataccgtcgacagccgcacccagcgcgatgcgctgcgcagccagcagttgaacaacgccgcacagcgggcgcggctgcaggccgagcgcgacggcctgcaggcgatcgctttcccggcattgctgcaggcgcggcgggaggagccggaggtgatgtcgttgatgctgctgcaacagcagcttttcaccagccgccgcgcggcgttgcagagcgagctggcggcgatcgcggagagcatcgccggatcgcaggcgatgctggaagggatccggcagtcttacgccagcaagcagcggcaaaaggccatgttgcaggagcagctgagcggcatgcgcaagctggcggcgcaagggtatgtagcgcgcaatcggctgctggatctggaagggcagtatgcgcagatcgacggccaggcgtccgaagacaccggcaatatcggccgcctggggcgccagatcctggagctgaagctgcgggcgatccagcggcgggaagagtatcaaaaagaggtcagcagccaattggccgaggtgcggatgaagttggacgagctggataaccgcctggccaaggcggaggccgatctgggtcatacgcaggtgaaagcgccggtggcgggcaccgtggtggggctgagcgtgttcaccgaaggcggcgtgatcggcgccggtcagcagctgatggagatcgtgcccagcgatcgggggctgcaggtggaggcgcgtattccggtcgagctgatcgacaaggtgcag

SEQ ID NO: 14119 - DNA, 345 bp, Glycine max
  Peptide Sequence Number=SeqID_130897
atgtggttgagcatgatccgccctcacctccctacagcggttcaggcgaagtcttgcccaggtgtgcacatcaattgggcaatggcctcctcgtcgaaaccgtcagcctgggacccaccggccccttacccacgagcgcatgtcgtggactccttctttggtgggctagacgttggcatagaattccatgactatatcttggtcgaacttagccatgggggtcacgagtggtgcccaatgcctgtgagctacctcctcctggaacactccggaattggtgtccgtcaaactctggggcggtgctggggccttcttcagtggcatcctttctggacctctttgtag

SEQ ID NO: 14120 - DNA, 333 bp, Glycine max
  Peptide Sequence Number=SeqID_130898
atggccttaggcctaggttgtggtccgaagcatttgggcaagccacattgccctcgttcccttgctattcatccccaaaagtgcgcccaccaagtgctcgatttggtttgtgcatatatggttgccatttttgaatgtgtggacggcttgcgggagttagggagatggctccaaagaagctttctacaaagaggtccagaaaggatgccactgaagaaggccccagcaccgccccagagtttgacggacaccaattccggagtgctaagcaccaacagcgcttcgagaccatcaggggatagtcattcctcagagagaggcgagtctagctga

SEQ ID NO: 14121 - DNA, 105 bp, Glycine max
  Peptide Sequence Number=SeqID_130899
atggcttactttcccgatgtttgttttattattgagagaataattaatctgtgtagagctattatgagaatgcacaatatggtggcatatgaggctgcccaatga

SEQ ID NO: 14122 - DNA, 180 bp, Glycine max
  Peptide Sequence Number=SeqID_130900
atgcaacatgtgactagccagcaggcggctaatcacaagggtcagcaccagcagagccaggaccccagtcctttcccgtggcctacccccgagcagttcggggccacagtggcatggcctggagatgagcccgatttgcagacaggggcaggggtcctcggagacgaggttgaagcttag

SEQ ID NO: 14123 - DNA, 504 bp, Glycine max
  Peptide Sequence Number=SeqID_130901
tctgaaggcgaggttaagcatagaagaaagaagagaatggctagagacagcgtcctaacacgcgtggcgaccggagccgccgttggcggtgctatcggcggcgcagttagtgtgaattttggaactggtgtgttgcatgcaggtgctgtttatgggacttacgatgcaattaggtataaggcaccttccaattcacccttgacttcttccttcaacccattcaggaaataccctaagatattcaggacctgtaccattcaaggggctttggtagagctcacattgctccttctatccttccttgagagaagttgtgaggcccattgtcatagggaaaatgtaaagcttagcaagttatttgagaagcgtccttgttcttcatctttgcctaacaacatgattctgagcacagacttccctcttggcattgatgtacagggtgtatgcatccctatgattggaggcttagtgaatgctgtcaacaacagtgcccttctaggttga

SEQ ID NO: 14124 - DNA, 153 bp, Glycine max
  Peptide Sequence Number=SeqID_130902
atgaagggtggaggttgcgcagcagcttgcccaggcgagctgacaaaccatcgcaatgcaatagtacggaaatactctagaagcggtaaagttcatcacaatgagatgacaaaaattgaaagcgataacatagagtttaggtctatcacatga

SEQ ID NO: 14125 - DNA, 168 bp, Glycine max
  Peptide Sequence Number=SeqID_130903
atgaacaaaaatgaaaaagaaatgagcgagaaaagtgttgcctacaataaggattggaagaggaaattagtgcattgcttgaaggaagattttttagtcttggaggttaaccatcctaggagcaccattggatttgaagcaaccatagcctcaccaaattttgagtga

SEQ ID NO: 14126 - DNA, 243 bp, Glycine max
  Peptide Sequence Number=SeqID_130904
atggtgggcattgctactgatcaaaggattatggcttgtgaaatggatgtcaatttcctcaaacgtcttgctcgaattagtagaatggtggactctggttcaagatcacagtttaaccttgcttggtactacctacttttgcacttgaaattcaaccatgtaaacatcttacctgcctctcccattataagctccttgatgttgattggagtacaaaatacgaacaaaaatgattttggttga

SEQ ID NO: 14127 - DNA, 240 bp, Glycine max
  Peptide Sequence Number=SeqID_130905
atgaatattgattattataagcagggcattgatgaacttatcggtgaattcattgagaccattgaaaacataaagaacatacaaaaagataaggaactgatagtagatgttgtggagaaggttgctaatgactggcatgtccagaaacaaacaggattgggggacgatggatatgagaaggagttcgagcaattacttctagagcagcaaccacatgatagagattctaaccaagtttga

SEQ ID NO: 14128 - DNA, 2286 bp, Glycine max
  Peptide Sequence Number=SeqID_130906
atgacgataaaacctgttgttcgtgtttcggaggggaagctggtggtgaaggagcgaacgattttgaccggaatgccggagaacgtggtggagacatcgacggtggaaggaatgtttctcggagtggatttcgagaaggaagacagtaggcaggtggtttcgttgggaacgttgaaggacgtccggttcatggcgtgcttccggttcaagctgtggtggatggcccagaaaatgggagatcgaggaagggacattccgttggagactcaatttctgttggtggaaaccaaagatgggtcccacctggagtcagataacgacaaaaaccagaaccagatcgtgtacacagtctttctacctctcgtggaaggctcattcagagcgtgcctccagggtgactccaacgaccaactccagctctgcctcgagagtggcgacgtcgacattaaaacgtcgtcgttcacccacgctctcttcatcagcgccggcaccgacccattcgccaccattcaccacgcattccgttcagttcggaaccacctcaagactttccgcctccgccacgagaagaaactccctggcatcgtggattgcttcggctggtgcacttgggatgctttctaccaggaagtcactcaggaaggagtcgaggccggaattcagtccctcgcaggcggcggcacgccgccgaagttcgtcatcatcgacgacggctggcagtcggtgggcggtgacgacaagaactcaaattcgttgcagaggctaactggaataaaagagaacgcgaagttccagaagaaggaggagccagaattagggattaagaacatcgtggagatagcgaagaagaagcattcagtgaaaaacgtgtacgtatggcacgcgatcacgggttactggggaggggttcgtccaggggtgaaggaaatggaagagtacggctccgtaatgaagtacccgaacgtgtcgagtggagtaacagagaacgagcccacgtggaaagtggacccgttagcggttcaggggttgggcctggtgaacccgaagaaggtgttcacgttttacgaccaattacacagttatctggcgtccgcgggtgtcgacggcgttaaggtggacgtgcaatgcatcttagagactctgggtgcaggactcggtggaagggtggaactcacgaggaattaccatcaggcccttgacgcttcgatttctagaaacttccctgacaatgggtgcatcgcctgcatgagccacaacacggacgcgctctactgctccaaacagacggcggtggtgagggcttccgatgatttctacccgcgtgatccggtgtcgcacactatccacgtggcgtccgtggcgtacaatagcgttttccttggggagattatgttgccggattgggatatgtttcactcccttcaccctgctgcggagtaccacgcttccgctagggccatcagcggtgggcccatctacgtcagcgacgcgccggggaagcataactttgatctgctcaagaaactggtcttgcccgatgggtcgattttacgggcccgtctaccaggaaggcccactaaggattgcttgttcaccgacccggcccgcgatggagttagtctgctgaaaatatggaatatgaacaagttgggtggggtgttgggggtttataactgtcaaggtgctgcctggagtgctactgagaggaagaatgcgtttcatagtacggactattctggtggtgatgccatcactggatatgtgagggcttgtgatgttcacctcattgcggaggctgctgatgacgcccatgattggaacggtgattgtgcgctctactctcaccactccgggcagctgattgttcttcctcacaatgtggcgctgccggtgtcccttaaggtgttggagcacgaggtgtatgctgttgcgcctattaagaaggttttgggtggtggctacagctttgcgcctcttggacttgtgaacatgttcaatgctggtgctgctgttgaagggctggtcttcgaggaggatgggttggttcgtttggagatcaaagggtgtggtaagtttggggcttattcttctgccagaccaacaaagtgtttgctgggaaaccatgagctgctggatttcgattacgatgctgattcaggcttgctcaccttcaacatagatcatttgccccaagagggacactgggatagaatagacaaggagagggttttcaacaatttccactttgtaagatttcacgagctacctgttatggaatttcgatag

SEQ ID NO: 14129 - DNA, 2553 bp, Glycine max
  Peptide Sequence Number=SeqID_130907
atgtcagaagagatccaagaaatccatagtttaatttattcagatgacaagttcaacaaatcctcgggctattcagcactctttcaatttcagcaacattcttgcgccaaccctttttcgcttcaatccctcgctcactcctctcaatccataatctcttccatcgtctccgacatttccaacgaccacgatgaagaaatatccacacaagccttgaagtgtttgggcttcatgctttatcatccctccgtcgtgtccatccttcgaggggtatggtgcttgtctgtccaacagttaggtgcatcgtttcttgatactcactttccttctttgttacgggcaattgttcatgccctagacaatcctatgggttctttgtccacaacatttgaagctacccaggctgtaatgaagctttctggtcaactaagtgagcaaatgaaaggatcatcccatatatgggctcctccaatatacaggagacttatcagcacagataagagggggagggatgcctcagaaaggtgcctgttgaagatcagatccacagtcattcctccttctctggatctctctaaggttattgtcaaagatatgaagataaaattgctcaatgggatgaaggatttgctagataatggtatgaagattcaagctattcatgcatggggatggtttgtccgaatgcttggatcctatgcttcaaggaatagacatttagttaatgatatgctgaaaattcctgaacgtacatttacagatcttgaccctcaaattcaaattgctacacaggttgcttgggaaggtcttattgatgctcttgttcactgtccaacatttgtttctgagaaaagtaaatcagctgaggagaattctctcgagaaacagcattcattaggaaggaaaaaatgtgatgatcaagcaaatgggtttttaaaaagcataaagctaataatgactccactgattggcatcatgtccagtaaatgtgatatatctgttcattcatcctgcttgaacacgtggtgttatttgctacataagcttgatatctctatcaatgaaccatcagtgataaaaatggttttagagcctatacttaaagcaatatttcagaatggacctaatagcaatagcatctgcttatggaacttgggccttgatctgcttagtgatagcatttcacagaagtgtatggatgtcttctaccagtcaactggcccgggagtcaaactggatgtggaaagtccatctaccgattatgatggtattatgcagtgtttgaactcattactaaagttcatcaagaaagtatgtgaagatttatgctcagatgtcgatgaaaattatgatgtttattgtacttccattcagtttatagatgctaccacaaaggagttaggtccttctatcttgggatctcctctgtacaagttttctttagatttaaagtacattgaggacatgcaatcagttgatcataagaaacatctaaaatttctgggtgttggttgtatttcttatatggataaggtttctccattgatttatttgatagcactgtacttccatatgatggttcagttaacaaagaaatcccatcaatcagaccacatttcacaagggatgtgtgaatattttaaatttatattttgttcaagtgatctcctggaaaatctcctcaccagtattgacttgttgtacagacacgttcgaccaatttacttaagcatatggatatcattagctcaaagtctgaactattgtgtatctgatgcaaactgcaagtcactacaggaagccttgtccgacagcactgtatattcttccatatgccatcttttaatttaccccatcgtggcacattctgaagttccaagaatgaccttgtcaaacaatagtgcctctttggataaatatcctgtatcacaagaaagaaagaggggttttgaactggttattcaaacctggaaatcactttatggatctcttagtgctttaggctttggatgctcatcagccaccaatttctctggggatctgtgcatgttgttaagcaactgccttgatgaaaatggtggcatggttgagagtggcactgatttggagtcagcatgcaaggatgtggatcatggcatccttcatttatctggcaatttcttgatatgcattctagagcagattcagactttggaattagtttctgagttggacagaagtaaatttgactgtgatagcaaaatattgtgctgcataaagaactgcttaaaatttgttgccaagtatatgaatttattgaggataaagatggttagagacccactgcctggttttgttgggacctcaaggctgtattctgcactggcatgctctattagttgccttcactggaagcaagatattcttcattttctcgagcctgtaatcttccatgtacttgactgcagaatgtttcctgcccactgcttcaatggctatcaaatatgggaatgcaggatgaaagaacaaacgaccaacttcaacttctgtggacagaaattcttagctgcttaa

SEQ ID NO: 14130 - DNA, 426 bp, Glycine max
  Peptide Sequence Number=SeqID_130908
atgggtaaagtagaggaggttcaagagcagatgaagtccgacatggaggccatgaaagagaaaatggccacaatgatggaggccatgatgagcatgaagaagataatggaagccaatgcggttgcagttgccgctaccagtgctattgctaagtacgaatggccccatgatgtgcaaattcaaaacaagcacgccttcccgccatatggctcgcctcccaaggaggatgtcaataactcctctcccatactcattgaaagccaacaacctcaatctgatcatgcacatgtctctcaacccatgggggagacacatgaaatgccccaccacaatctagccgacttcgagccttacctcggatatgccactgaagggaaaggctcagggccattaaaagaggctgagattatgcctttactgacatag

SEQ ID NO: 14131 - DNA, 463 bp, Glycine max
  Peptide Sequence Number=SeqID_130909
gcttttcttgaggccttaccaggttacatgggatgccaccgtgtttggggtctttaatccatacttcccgctctacataaagcacgaagacctctccgaaattgcatacggtggtcaatgtctcagcatatcagtgttacagttgtggattctgcatttgactgaaacaagtatgcgagcggggagttctgatatctatggattcctcgagccacagtctattcagaggtttgggcaatcgcagtttgagactgaaagttacataaagagttggatgcagagttcaaaacgcgatgtctaccttggagcctacctgaatgggccaaacaactaccttaaggggataattaacagtctaaatcaaaggctccagctaggtggattatcatcaagtgtaatagacaaaaaggaagtactgagtgcggctattatgtcatgcactagatgtccaccatcattttag

SEQ ID NO: 14132 - DNA, 263 bp, Glycine max
  Peptide Sequence Number=SeqID_130910
gccatcaaaatgtggcattggacaataagacaggagattcaactatgctgaagatgggagatttagctaaagttgtgatcaaacaagacatgaagggaataaggcataaatatgggtttaacaacaatgaacgtgagaaggcacagaagaaaagggtggtggatgatgaaactgtcgataaacatcagctggatgaacaccaagagcggctacgcaagaagtttgcacttgaggagggaaggatatttgcagctaatgaacaa

SEQ ID NO: 14133 - DNA, 234 bp, Glycine max
  Peptide Sequence Number=SeqID_130911
atgtttgcttattcaactctcaccggaatgtgggtgcaagccattggtctgtttgctcaagcgacctgtgctcctgagttcggacttccaagaccgttcaatcagagattactcgtcttgcacgttggtggggttgccgaatcctctacaacaagagacccatggtctcttaatccctttttagaaataagaagaagagaagaagaggcctctcgtaaaagaggtagattgtaa

SEQ ID NO: 14134 - DNA, 252 bp, Glycine max
  Peptide Sequence Number=SeqID_130912
atggcaaaagtttatgctctttggaatacgaagaattgctttgaggtgtatagggtcattcaaaataagttgcattggataaacaaaggaaaacagtgggttattgccaatggtagacaagtgatattttggaaaggttatatggaaactgaggagttagtcaagggaaatgacataagtgtaacatatgcaaaggcatatgctcatggtaacttcacatctctcatgcctgtagagaggccaaacaagtag

SEQ ID NO: 14135 - DNA, 138 bp, Glycine max
  Peptide Sequence Number=SeqID_130913
atggctggctatatgcttgcaattgctgttgggatggatagaggtacaaggtttcattttcaattattaaaggtctacaaaggtgtgcaatcatgtgggacaaaggattggtatgcttggtctcttaaggtggattaa

SEQ ID NO: 14136 - DNA, 589 bp, Glycine max
  Peptide Sequence Number=SeqID_130914
atggcatcgtgtggttggaattctgcgtgtagaggcgacggcgggcatggtgatggagggattccttgcactattgtgacttcaaccgctggggatctgtcgagtttcacagactgccaggaatttggtcatgggtatgcgatttctcggtccaatagtgacaagatactagaagatgatagtcggttgtcgatcttgtggggtgatggaaagtatggcagaagcagtagggaaaatagtggaggaccctttgatgatgccctagcatattcctctcatccacattctgatttcgggaacgcttgggatcaacaccacttgaaagaccagcacaataagatggatggtgtcaatgggttcagaatagacccaagaagtgatagagagaactctctggatgactggaagccacttaaatggacccgctttggaagcttgtcatctcgtggctcaaattcccgtgaagtgaaggccaagttgctacctaaaagtgtggctgctaatgagtcacattcaggggaagctgctgtttgtgaaacatcttctgtgccattcgaggatacaacttccagaaaaaagcctaggctgg

SEQ ID NO: 14137 - DNA, 645 bp, Glycine max
  Peptide Sequence Number=SeqID_130915
atgtggcttagagttctaaataacttaaggttttgggatagttggtttcatgattccaaatgcatttcttcacatacaggctcagaggtacaagaagctgcagattgcttgggtgctgactgtgtgcctcgatatgttgagatgaagcacatggaattggcttatagggatatcaatcatattggtcataacttagttaaaggaagtacatggaagttggcttatatggaagcacatggaactcccagcaattttcgacagcggtttccgccatcgtcggcaagactggaccataagaagctacgcttcacggtgtttacctcgatggtggacgcgctaacctcctcaacgaccgttgctcttcgcggatgcttcctcacagcaccaccgcaagctacctcggcaacctcctcaacgaagaagaagaagaggcacaaagaagacgcgcaagcaatgaagaagaagacgcaagaagaagaagcaggaagaagaagaagtaggaagaagaagaagcaggaaggtgatccaaaagaagaagaagcagaagcgcaaacacaagggagagagagaggtgcacctagcagcactcacaaagaaacacaggccactaaggacccaaagacaagaacaaagacttctaaatag

SEQ ID NO: 14138 - DNA, 514 bp, Glycine max
  Peptide Sequence Number=SeqID_130916
atggctacaccacccaactcacctcctcctccttccgagtcagcaacaccttcttcactgtctacgtcgaagaagacaagtaaaacaacacgacttagattgttggctactagaccagttggggtgggaagaccaatggttaatgttgatcttgtcactaggaatgtcgatggtccccacagaaagaagttaagtacatatttggggattgtcgctcacgataagttgatgaaggagaagcaaaagaaacacttggaggaagcaacccaatttgggagcactgaaacagtcgttgatcctccatctcccattagacgacatgtgaagcagaagatggcccgcacaaagaaaactggccaaatgacatttcaagcagcaaaggaaatcgcagacaaaattatttatcattttcctttgttagtgggaagctttgtcgcccatggacgtcaggatgtactgactgctgccattgggcggccagagcaccttgatcgtgtccgtgctgttggagctg

SEQ ID NO: 14139 - DNA, 830 bp, Glycine max
  Peptide Sequence Number=SeqID_130917
atgtgtaacacttgtcgtacttgggcccttttgggagaggctggctcttgtgttgcttgtgcctcttgtccgacttatgtgaactgtccgcaaacttgtcgggccgtagggcgaggagcatggaatgcaacactacctccgggtcatgcggtgagatctactagttgtgtactacgcattgaagcatttgacaaagcgtttgatgagggtgttaaagctgtctatggacctaggtgggagtccaatgttcgcctaagtctggaagccatccaaatgcttatctggatctatggtcccatcatatcgctcgaggttgagaggtttccaccccacagatatgtcaacctccataagacagttgatgaagggatgccgacgagtagtccgccctattggacggtgcacccttcagctgattgttgtcagcctttagctttcgtagctcttcctcatgccatcgctccatctccgcaatgcagttttggggttgctgaaaagtatgtgtctgtcatggctgctggtggaaggttggagccttcgaaaggggctcacgacacatcaggggggacatggccaaattgggctcttggacttcacacgtcggctttgagatgggcctttgtcaagagggcaggaggggaaacctgcaaaataaaggactctgacactcaagtgcacaggcgtgttgctcatgtgttgaagtgtgtgttagatgtgttacgggttcaatggaacttggtatttataggattgaagcttagctgtgggttcttgtttgtaggggcaattatagcctttgtggataattcccagcttttagataatagctg

SEQ ID NO: 14140 - DNA, 600 bp, Glycine max
  Peptide Sequence Number=SeqID_130918
atggagcctgccaagccttaccctacagcgactgaaggcactcaagtcatgagcatagacaaaaggtctccatatcaagccctaaccgttttccaaccaagcctggacgatgaatttgatatagatctgcaagatgacacctctgacagagacccaaaacccattgtcaacctgcagcttagacctaaaccagtatgcagctcagtagggacctcactaatcatgagcattggcacatcaccaatgtgctacacaaaattgtggatttgtttgcttggcagctatctgacatgtaaggaatccatcctaggggcatgccctaaagatgcataccctctacctagcatcaacatgctagtcgatggagcgtccgggttccaggttttgcgaaagcctgaactcgcaggaaggaagtacaaacctcgtggcccgatgaaggcacaattcatggctgacattttagcagaattctctggaaacgacacaaccaccccagactggtggaacctttacgttgacagtgcgtctaatgtaaaaggaagcagagcagggatcatcctcgaaggccctaacaatatcaccctagagcaaagcccttaa

SEQ ID NO: 14141 - DNA, 940 bp, Glycine max
  Peptide Sequence Number=SeqID_130919
gaaggttgagatataccacacggagttcgatgacttcaagacagagttggagaggcgtaatcttcacaaacgcctcatcaacttggctgatgggactattgatcttgctttggtgaaggaattttatgctaacctctacagctctgaagacccttcaccaaagcaagccagagttagaggccacttggtgaagatagacggtgatagcctcatcacatttctagagactcttgtagtcctagaggaggggaagacattacccatctactctaggccatccagggaggattctcaggaaggatctgactaccttggcctaggtgtagagtgttctctcttacaccaacttggcccctacatctcatacatcagaccttactgtggacagagccaggttgatctttggcctggggttgtatttgacaacctcacatttgagcgcctgagcccagccattaacctggcctacatcagaaagaattgttggaacattaatgatctaacagttgctttctggggggctaggagggcgatggtgaggccacctgatatgccatcttcttctacagctccagcacctactctagcatctacttctgcagctcctttagttccagctcatgttgactcgcagcgctttgaagctatgcttcaaagtggtagctcctccaggatccatcctatcagcggagatgcttccttcgagaccaccattccagagccattcactcttcatcctgaggcaggggaagaacaagcaagaccagagactgttgctactcctaagagatcactggagggcacatcagagcctcctactccagtagaaggcctctcctcaccacagcctacagttgacccttccattcctgtacttgacataccagaggaccagaccacaccagtcctagcactgaacacctctcctctagctacttaa

SEQ ID NO: 14142 - DNA, 351 bp, Glycine max
  Peptide Sequence Number=SeqID_130920
atgggagaagagcggcgtaaagtcgtcaaagaagaagtcggaaagttcctccatgccaacctcatcagagaggtcaagttttccacctggctcgccaatgtcgtcatggtcaaaaaggccaacgacaaatggcaaatatgcaccaactacactgatctaaaaagggcatgccccaaagacgtgtatcctatccccaacatccacagcttcctggatgcctacttcggatacaaccagatcagaatgcatcctccagacgaggagaaaagggcattcatcactgaagaggccaacttttgctacaaggtcatgccattcgacctcaaaaatgctggcgcgacataccaatga

SEQ ID NO: 14143 - DNA, 553 bp, Glycine max
  Peptide Sequence Number=SeqID_130921
gtgcttgtttgaggtcttgggtgttattctgccattgaccgtgtttcagtgtgctctgctggagcacttgaatgtggcccattcccagcttcacccaaatatgtctaagaagctattcgacttttcctcaaatgtctttctccatttcaaggaccattttttcaaggtcttggctactgatgtcatggccgatggcatgccattgatgttcaatagggacggggatccctgcttcccattctactggcaatgtgatcctaccatgttcaagtcgtatgatgaggatctgttgacccttgttgggggtgatcctctcgctaccttggctagtaagtgcctaatcttatccatgttggttattggaggtgggtcatctgtgaagcaggttggtcctgctgctaaggttgctcccagcgctccttcctttgttttggctaagaggaagaagaatgatgctacagggtcgttgggccgcaaggagtctaaggcctctataagccttcgtgccttgagacaggcggcgaggttgatgcccattgcgggtcacctctag

SEQ ID NO: 14144 - DNA, 690 bp, Glycine max
  Peptide Sequence Number=SeqID_130922
atggcttgcaagatggaaggcattacgacggagacggacgagcttgcgaaggtggtcgttgatttagaggcccgacttaaggattcagagtccagactagaggagtccaagttgcgggctgctagggagagggataaaagtaaggagcttgaggaggagttgctcttttacaagaagaaggtcatggaggagcatgaaaatggcttcaacaaggccatcaggcaggccgagttctttggtaaggacctagacttgggtctctttgaccttttcaaggatgtgaagggctgtgttctgcttgacgaggaggaaattgttgcagaggaggaggttgttgatgatgagcaaggtgctgaggagaagcaagaccttatcgatgtaaaggtcttgtcacccatttggtggggctttcttctgctttgtggagcttctcagctgatgctggtgaggagtatgtttgacttgcccctggtcttgtcaaatggtaaagtggtagttcgtgttgttcaacttggacctttgatggtggtcatcgtagttgctgcgagtgagcagaccaaggggaaagggctcgccaaaggtgaacttggggtttgccgagccttagacctgggatgtgtttgccctgggttttgtcaagcccgtggagctacatcgaggcttaccaaggatgagtcttggattttgtga

SEQ ID NO: 14145 - DNA, 692 bp, Glycine max
  Peptide Sequence Number=SeqID_130923
atggactgggaggttatttctattggtagttcctcgtcgaaggatactcactgtggtgcctccaacaatgagtcctcctattcagagatggtgagggcttcacgcaagacaggtagttgtagtggagatgtcagggtgtctccccacgtgcgacgtagcaatagcgttgggtcgctgtcatctacccttgccatcactggctatgagtgggggagggatgaagttctgaaatataagtcctctctcacctctacgaggagtgttgctactcttcaatgccaagtgaagctggcaagccctgaggactcctgcaagtgtcaattcaaggacttgggtctcattctccccttgaccgctttccagtgtgctctgcttggacacttcaatgtggcttcttctcagcttcacccaaatagttggtcaatggtgaaagctttcgaaatcttgtgccctttcttcaacattcggccctgtgtgtcggtcttattgtttttcttccagatgaaattaactggcaagatttgttgggtctccttgaacaatgtgtcaaagaagctgtctgagtttgattcaaatatctttttctactctaatgtcttagctactaatattgtagctgatggtttgccactattgttcaacagggaaggggagccccacttcctattctactggcagtctgaccctactag

SEQ ID NO: 14146 - DNA, 600 bp, Glycine max
  Peptide Sequence Number=SeqID_130924
atggccgcgggcctggtgttcctcaccgtctcgctgatccaactgtgggccgggatggggttggcgtggcagtcactgcaatccgggcggatcgccgctgatcggttgcaggccatcgtcgagcaggcgacgacggtggaggatccggcagcgccacagccggtaccgcaggccgcgcgcgtgcactgggatgacgtgcatttccagtggccaggcgcggtgcgaccggtgctgtccggcctgcggcagacgttggcgcctggggaacgcatcgccatccgtggcgacagcggcagtggcaagaccacgctgtccagcctgcagctgcggctgtgggatccgcagcaggggcgaatcacctatggtggcatcgacctgcgtgatttcagccaggccgactggcatcggcagctggcctggttgccgcagaacgcgccggtgttcgccggcaccgtggacgagaacctgcgcctgggggatcccgatgccagcgacgccgccttgcctcgacgtggataccgcacgtgcgctgctgcaggacctttccgggttgctggacgggcgcagcctgttgatgatcacccacgacgacctgcctga

SEQ ID NO: 14147 - DNA, 366 bp, Glycine max
  Peptide Sequence Number=SeqID_130925
atggaggccaacaatgaatttatcatagtcatgcatgccgacagagactatattgtgttgcctcatcagtgttttcgtcaatggagacacgagttgggtcctctcattttcatcaatgggattaaaggaggtgttttcacttgtttgttggacaatcagggagatcgtgctcgtttaacacatggaattaatgacaatagactgttctatgatgcagttgaaagtgttgtaatgcatttaacttacatgggtaacaattgcttcatatttattctaacaatacatgtagatgaaaatgagaaaaatgatggaaatcaaatgatgcatgcaaggttatcaaaatcgagagtctacgtagacttgtga

SEQ ID NO: 14148 - DNA, 160 bp, Glycine max
  Peptide Sequence Number=SeqID_130926
tgatcaatgggttcccatgaaccctaagagaataaaggtcattcctgagtggcccactccaccaagtgtaagaaaaatttggggattccatgacttaacaaacttttacaaaaaggtgttgagaaaaaaagcccagattttcaagaacctcgggatttga

SEQ ID NO: 14149 - DNA, 267 bp, Glycine max
  Peptide Sequence Number=SeqID_130927
atgcaagtgggatcagcaactttcattatcagagtaatcaagcacagcggaattggtagtgccgacagcaaaattctgcaagttgcaagtcgtttccaggatgttaagacatctcttgtgacatcagctttctgctccctctgtctccatgctcttctatcagctactagccttttccaggatgtcaaggcatctcttgtgacatcagctttctgctccccctgtctccatgctctagctgcagcatcttctatcagctactcgtaa

SEQ ID NO: 14150 - DNA, 524 bp, Glycine max
  Peptide Sequence Number=SeqID_130928
ggcgtccgggacatgcggtcatgggtaaggggccagtggattccttttgatgcagacgccctcagccagttcctgggagacccgctagtgttagaggagggccaagagtgcgagtatagtcagagaaggaaccgggccgatggatttgacgaggaggcaattgcccagctgttatgcataccgggtcaggattttgcccggaccgctgctgggagacgggtgcggatcatgcgcaccagcatgaccaccttgactcagatgcaccctctagacctagataagtctaacaaggccctggggtttccagcgttgatcacgggtctctgccagtcattcagggttcccgtcacacctagtaaggtgattcgaccgccgatcacccgggccttcattgagaaatattgcacgcctagacaggcgcagggtgatgcaccgcagcccgcagacgcactgccaccacctcatcaggctgatccagctgggtcatttggcatggagcagtatctacaacacccgggactaac

SEQ ID NO: 14151 - DNA, 456 bp, Glycine max
  Peptide Sequence Number=SeqID_130929
atgaggggagcaccgacggaagagagcctctctcctttccttgtgagagatttcggtgcgcaaagtttcaaggttatacaaagagtacataaggcgtgggaaggcccgttaaggaaagataaagaagttaagggcatccgtaatagcatcatcggtggttatcatgaatggctgaaagttcgtacgcgagggttagattggctctccaagttgaaaattatcaaagaggagagcttcgaagctccagaagaggatgaagaagttcaagctctaaaaacagaactaggaaaagcaagacttgccaaagaaaaattcaggttggtcgctacatacgtccggaaaaagtgtgtcgggttacaagaagaaaatgcagctaccgcaagagcccttgaacaagaaaccaagagggctcgcaaggaagagcatggccgtgacaaatttcgtggagctttatga

SEQ ID NO: 14152 - DNA, 132 bp, Glycine max
  Peptide Sequence Number=SeqID_130930
atggtggaaaggggaaacttcgatcatatagaagaaaggatgagggtcattgaaggaggcggagactatccttttgctgacatggtggaactgtgcctagtgcccaacgtcatcattcttccgaagttcaag

SEQ ID NO: 14153 - DNA, 1171 bp, Glycine max
  Peptide Sequence Number=SeqID_130931
gaaaccctagaattcaaacccggcgccgccgtccgaatcggccgcgtcgttaaaggcaacactctcccaatcaaggacctcggaatctcctccaagcacctcacgatctcaacggaatccaacaaatggaccctccgcgatttggattcctcaaacggcaccgttttggacggatcccaaatccctccccacacccccttcacgcttcaacatgactccattataaagatcggagaactcacatccatccacgtcatcttcgtccctcgcgaacaacaacaacaacaacaagaactcgcggttctgccgcgacggaaccccacgcgccgcggtcggaccgaaccggctccaactgaatcggttccgccacgcggacgcggtagacctagggatttgaagagtaaggttcagattcagattcagagcgttgaggaaaatgatgcgagtgtggtggacgcggaatctgagcgcgtgggtccgtcttctagggtagcgaggaagacgaacagaggaaggagcgtggttaaggaggattggagtgttgttgttgagaatttggatgctccggagggtaagactcagagcgttgaggagaagaacgcgagtgtggtggaggcggaaggtgagggcgtcagtccgcctgctagggtaacgaggaaggtgaacagaggaaggagtgtggttagggtttgcgacgatgatgatgttccggtggagaaggtagaggagcagaagagtacgaggaatttgagtctgattgagatttctgattccagcgttgggaattcggatgctccgttggtagaggagccgaagaagacgcgcatgacgcgaaattcgaagaaggtgcctggggtgactactgggaatgtggagaagaagacgaagaggggtgttgctgaaaagagagaattggaggaagaaggcgaagatttgaatggtgtgaaggagacttgtgatggaagaaaagaggggaatttgcctaatttgaaacggagaaggaggggtgctaccgagaaaagagaattggagaaagagggtgaagatgggaatgttgtgaaagaggcttgtgatgggagagaagaggggaatttgaatggagatgataggaattggcatgatttgaaagggagagagagggaattggagaaggagggtgtagatgggaata

SEQ ID NO: 14154 - DNA, 213 bp, Glycine max
  Peptide Sequence Number=SeqID_130932
atgacaggagaagagttggtcgataccagaccaagtccaaggccaaaggtaagcaaagacttaggggcaagtacgagtaggtactgggcccatgatcgacaggtcatcgtcctacgtccggctcaagacgttaaagaagcgctaccaggaggtagcctagtaccttttaaatttctgcttgttagttattcacctatgtttcttaagtcatag

SEQ ID NO: 14155 - DNA, 258 bp, Glycine max
  Peptide Sequence Number=SeqID_130933
atggagtcttatctagagggattggatttatgggaagctgcggaagaggattatattgttcatctgctgcctgaaaaccccatcatagcccaaattaaaaatcacaaggaaaggaaaacaaagaaagcaaatgtgagagttcatccagagagatttacaaaggagagactagggaggactaagcagagcaagtctaaggttggtttgaaaatgctggaaagtgttgaagatgccagagaagagtgggtgtttgtctag

SEQ ID NO: 14156 - DNA, 531 bp, Glycine max
  Peptide Sequence Number=SeqID_130934
atgaaactcttcaaacatattttgaacatttatgagacaaatactagtaacttgtcaaggcaaaaggctgacttggcaggcgagtttgatccactgttactgaatgggatgtatgatcaaggggctgtgaggcaacatgtgagcacaactcagctgagtggtgggagtgctagtagtgtggcactgcctggactcgggaagagcgccaacccggttctggctttgcctgctccgaatggaactgttcaagctgtagggccgcaggatccgtttgcagcatcactgatggtgccgccgccttcatacgtgcaaatagcagacatggagaggaagcaacatttgcttgtgcaggaacaacagctgtggcagcagtatgggagggatgggatgcaagggcaattgggcttgtctagagttgctggtgctcctggttactatgctcctgccccgcaacctgtgatgccttatggaatgccacaatttggaggcattgggcaacctggaggctattaccctgcaccttattattga

SEQ ID NO: 14157 - DNA, 255 bp, Glycine max
  Peptide Sequence Number=SeqID_130935
atgaatgatatgatgagcatggatgcatcttattcaattacagagacaactaaggataaagacaataaatctgaagctcaaattaaacatcaggggtttcatcaagttcagtgtactaacttagaccaaacgatgctcaatgaaagtgataatctggcacaggatgacaccattgatgaaggatggcaggaggttgttcccaaaggtcgttcactcactgcccacaagtcagcttcatcaacgagccccacataa

SEQ ID NO: 14158 - DNA, 279 bp, Glycine max
  Peptide Sequence Number=SeqID_130936
atgaaaaggctgacgtgtaccggctatcttatttggcaagcagtggacctggatttgctctactttaagctgcaagaaaagctaacttcaaaggtactttcagtgaaatatcagcaggatttacaaccgagagacaagtacttgccccagtctgtggcagagcagtttcagaaaggaaatccagcacaaatccagcttaaattgatagaaggagctggtcatatgccacaagaggactggcctgagaaagttgttgatgctttcagaatgttcttctga

SEQ ID NO: 14159 - DNA, 237 bp, Glycine max
  Peptide Sequence Number=SeqID_130937
atgtgggatcgacacaggcttaaaggagcactcaaaccgggtgtatttatccccaaggtctatactccgaagagtctgtcaggacctctccttcctgattcaatggatcccatcataatattcattgctcatttaccggttagggtttcgctgttttacgagaatgcttcaaccatgtgggatcgacacatgcttcaaagagcactcaaatcgggtgtatctacccccaaggtctag

SEQ ID NO: 14160 - DNA, 321 bp, Glycine max
  Peptide Sequence Number=SeqID_130938
atgaataatgcctgtcagaccctaattaggggtttagccactcatggccgactttacaatgagaggggtgaaagaaagacgataaaaagagagaagagagatattattacgcggacatacggttcaaacttgtggacatatatatatcgtacgaagcaggatattgccattcttggaaaaccaatgatgtgtcaggcgtttaagagggcattcaccaatttcctgcaatggaaaatgatgctggagcaactagcaatagtttgtatggggattttgaaccttactgaaaatgggttacaaaggaaggacaacagactctga

SEQ ID NO: 14161 - DNA, 1677 bp, Glycine max
  Peptide Sequence Number=SeqID_130939
atggccacctgtgggtgtagcatgatactccgtgagcaaggtggagattatcagaagtccccaagtgacgagtgtattctggatgattgtcaagctggcggcgaagttcttccaaaaaggttaaggatggcacaaacaggatcatggacaaggatgggtcttgctcaggtggttggtaataatggcgaagcggtggccaagaaggtactggctccatttatttaccttcgtcgtgatcgcaaacagtcctcatacatacatcaaggcacgaaggagcttcgggatgaagggtttgcggaaaaaggaaaggggggcctgtttaagctatttgaaagctatctaagcttgagtcgtccaccagaatggctcaacgggggtgaccttgaccaagggagctactgtggtcgcatagcttctaatgaacctgcgatagaatccatgagcctcaaaggagccgctatatatgaggatgtcatcgaagaagacgatgatgaagtgacggaggtgaatgtggtggacggtgtccctggccaaaggggagggtctttggtggctgaagaggtatttgagtatgaaaacactgcaatgtggaagtataaagcatcgttctgtgttggccattacccaccatcactcgtaatggtgccgtttcccgacaaggtaagcccaattgaggacgagttgttgtttaatgaaattatgggtgctcccaccgtcggccagaagaatcagatggtgcccgatgtcaattgggttgctaggtacatgtcagggtttccaggcggcataacccatgctcacagcgtgaggttatcttgtctggtgtcaggcgcttcaatgttggtggtggcggtcgaggagacgaagataagagtgtcgataatggtgtggtgcgaagtggagttggagggggttgcaaagtgcgtgatagcggcgtctatcgatggtccaaagtcaaaggctagtgagcctgcacttcccgacggatctccgacgctcttcgtattgggatggggcaaagcgggtttgcagggcttggaggaaaacaggtcaggaggtaaattgataattgcttgtcatcctttgaaaccaagcaagggccctaccctccatgtagaacgaggcaatggtgagacggtcttgcttcggagtgccatggggtggtgttgccgtagaagacgaaagcaacagagaaacacgatgaaggagctcatcaatcttcaaagtcatggaatgcatggatttgctgaggacaacgagagcatcactgatagaccctcttatgtgaaactggcttcgagggccagaacctccagaatttcaaggaagaagaagaaagataaagacaagcatcaagcaagattgctctatgattctaggaagattgctctaccccatttcccctcaaacatagtggttgaggactatgtgcctacagtttttgacaacttcaatgcaaatgtggtgattgatggaagcacagttaatctaggattatgggacactgctggtaagtactttctgaagatgtttccatcaatgtcattgaaacatgatcctaatccttctggggagctgctactaatgcagaaactagaggaagttggaagctctatcaagagaattcaatctttatttgaggagcaacaatctaacataacagagtccatagattga

SEQ ID NO: 14162 - DNA, 243 bp, Glycine max
  Peptide Sequence Number=SeqID_130940
atgacaaaagcaagctacagtaaaataaaacgagggcagagtagagaggggaggcaaggaagtagtgaccaaggagtgcataggagagatgaaggtgtatctcaaacaccctatgctactgtatcttttttccttctgtttagtcttgtaatccattgtagatctatctgtgtttctgctaatatgacactggcaccagggattataatgagatgttacagtacataccttttttctgtgtga

SEQ ID NO: 14163 - DNA, 348 bp, Glycine max
  Peptide Sequence Number=SeqID_130941
atgcatgttgccgatattcctaaaacaaccttccgaacacaccatggtcattatgagttcaaagtaatgtcatttggtggagtaccttgggcatcttgtctctcagaaggaagtggaactagtagcttcgaaggtggccgccattcatcaatggccagtccctcgttcgaccagagcagtgtggagcttcttgggcctcactggattctatcgcagggtaggaatgggcgcggtcctatctcaacagggacaccccctttcctttttccgcaaacccttcatcccgaagctccttcgtgccttgatgtatgtatgaggactgtttgcgatcacgacgaaggtaaataa

SEQ ID NO: 14164 - DNA, 666 bp, Glycine max
  Peptide Sequence Number=SeqID_130942
atggctgctgctgtcaaccaaacaaaagctgaaagaaatgttatcaagagttggccatcaaaggagaagaggaaggaattgaaaagcttattgttgcatccctctgtttgggagagtgagtccctgccggaggaagtttgttttttattggcaaatgtccctgccgaaatctttgagcttgaaaagagtgagaaggcaagaatgaagcatatggaacatgagaaaaaactaaaagaggatgaacagaaacaactgagtatgaaaaggctcaagcagtctcagaaaatggaagagaatggaaaatttcacatagaagcttttgctgttggagctgcacagagtgaggaagggatgaaaggcttaaacaatgctcttgagcatgaagataatggaaagggacttaaacaacactttgaactggaaatgaatgacaaaataactaaagtgacttttgagaagggggaaaatgaagcatgtgaaagagatcaaggtaaagagaaacttagtgagatttgtggtgggtatagaaaaggaaacagactaaaagatgtgggtgatggaatggggggaagcagttgtgtatatatgatgtgtggatggtctctccaaccaatgtcagaggatgctgaaagatcaagctcatgcatgcctaatagaccctgctaa

SEQ ID NO: 14165 - DNA, 4437 bp, Glycine max
  Peptide Sequence Number=SeqID_130943
atggcggatcacaccacccgcaaaaccactaccgacaaattagaagaagccatcacgcgtttatccacctgccaatccactctcaccgacaagtacgtggagctttccgacaaggttgatacaatccttgatcaccttcgtctgaaagagactacccagaacccacctccgcccaactcacagttcaaccagcgtaaccctgtcaagctagatatcccaagatacgacggccgcgacccgttaggctggattttcaagatatctcagctattcaagtatcaaaacacaccagaagaggagcgcataacggtcgcctcgttctacctcgacggcgtcgctctaagctggtatcaatggatgtttcgtaacggatttatcatgtcatggtctgggttcttgcaagcactggaatccaggtttgcaccaacgttttatgatgacccgaaaggagccttattcaagcttactcagcgtggcaatgtcaatgagtatctaaccgaatttgagcgcttagctaaccaggtaattggacttccaccccccttcttgctaagttgtttcatttcaggacttatgccggagatacgatgggaggtactcgcgcttcaacctatctcactcccacaagcaattgcacttgccaaattacaagaagataagcttagagatcgaagcgtggccacacatcccaaccttccgccatcatcttctacttctcgctccaacagtctcgcgcagtcatcgtccttcccaccatcatcttcacaccagaggtccaaaccaccctttgttcaaagtacacctgaagaaatggccttccgacgagagaaaggcttatgctacaattgtgatgacaaatggaatccgggtcatcgctgcaagggaggaattttgttgcttatcaccgacaaccccgtaacggaggaagaaactcatgaagcaagccttgactccatgaccactagcgaagaggtcctactagaccagtcacagctaatatcggatgatcctcaccctcacatcagcctccatgccctatcgggacttccttcctcagacacctttcgcttatccgggatcatcaaacatgcgcgtatcacagtccttattgacagtggaagtacgcataacttcctacaacccaggatagctcagtttctccacttgcctacccagaaaacaagtcctctccaagtacacgtaggaaatggctcagtgcttgattgcaatcaggtttgccctaacacccaactatccatacaaggcaactccttcgacgtcacatttcacttgcttctgataagcggtgcagacgcggtcttgggtattgcatggctgaaacaacttgggcctataattactgactacacctccttcgtcatgcgcttcaaccatttgggccaagcagtagaattacatgctgatattgctattgggccagaagccgcatcaacgacccaagtaaaacgccttatccggacaggctccacctcggccctactccacttacgaatattacccacccatcaaaccaaacctcccacaactcatcttcttcaccccatttccgccatcaacaccttgcttagccgttaccagaaattatttcagaccccaaaccaccttccaccaccacgagatgtagtccactgtatcaacatccacccagccacagctccggtgaacgtacgaccgtaccggtacccacactttcagaaaacagaaattgaaaagcaagtgtcaaacctcctctccgcaggactcatacgcccaagtacaagcccatactcatcaccagtattgcttgttaagaagaaggatggtacatggagactttgtgtggactttcgatccctaaacgcagtcacggtacgtgaccgttttccgatacccaccatcgatgaattactagatgagcttggtcaagcttcatggttctctaagttagacttgcgtcaaggattccaccagatccttatgcacgagcttgacatagagaagactgtgttctgcgctcatcacgggcactacgagtacctcgtgatgcccttcgggttgtgcaacgccccctcgacgttccaagcagccatgaacagcctgctcacacctttcctttgccgatttgccaccgtcttctttgatgacatactagtctatagtgactcgttgccctctcacatcctacacctcgaagccattcttcagacattacttcaagggcaatattacttgaagcaggccaaatggcatatagtttccggcaaaggggtcgaacctgagccttctaaggtacgtgatatactagactggcccaaaccaacaactgtcaaggatcttcatgcattcttagggcttatgggtttttaccggaagttcataagaaattacgctgccatcgcagcaccccttaccaccttgctttgcaaagatgcctttgaatggtccctcacatctcaagctgctttcgacgcactcaaatcagctgtgaccacaacaccagtcctagccttacctaacttcgcggagccctttgtcgtagagacagatgcttccggcatcgccatgggagcagtcctaacacaacgaggccacccactagcttttttcagtaagctttttggtccacgcatgacccatgcttccacatatatcagggagcttcacgccatcgttgctgcagttagaaaatggcgacaatatcttctaggaagatccttcaccatcttaacgaaccacaagagtctaagagaactcatgactcaaataatacagacaccagaacagcattactacctttccaagctactaggcttcgattataacatccagtataaggcaggagctaccaataaagttgctgatgccctctcacagattccatctactacgggccaactgatgatattatccattccccacctcgacttcattgatgagcttcgacaaacacttcagcaaagcccagaattccaaggccgtatctggttgaaccgcggcaacccttacattcccgctatcctactcgaaaaccatgccacgcccttgggtggccatttaggggttgccaagaccactcaccgtttggaatccaacttcttttggtcaggactccgacaagataccaagcgctttgttaaggaatgtaagatatgccaacaaacaaaatcaactacacgccgtctggcaggcctcctgcaacctctaccaattccggcaggtatatgggaggacctttcgatggatttcatcacccacctcccatcatctcacggattcacggtaatcctcgtcatcgtggaccgttactcgaagggggtccatctcggcgcgttaccaacaggcttctcggcgtttaaagtcacgtttcttttcctcgagctcgtctgcaaacaccacaggtttcctcgcagcattgtctctgaccgagacccagtgttcttgagttccttctggaaagaactctttcgtctccccggcacacggttgcgcatgagcacggtgtactatccgcaaaccgatggccaaaccgaggtcatgaactgtgtattagagcaatacttgcggtcattcattcactcccagcaaaccagttggtatcgttacctggcacttgcagaatggtcatacaatacgtctctccactccaactccggcctcacaccattcgaagtgatatatggcaaatctcctccggccatacctcattacattccaggcatgacgacgaacaaagcagttgactccctggttcaaacgagacaacgcatccatactaagctacaacacagactactaaaggcacaagaggcaatgaagcgctacgtcgatactaaacgcgaggacatcacatttaccccaagacaatgggtttacgttaaacttaaacccttccggcaacattccatcaccggcacgaaccactcgaagctgtccaaacgatacttcggaccattccaggtcacagctcgcattggtgaagtagcttacaaactacagctcttggaggactctcgtatccatccggtcttccactactccctattacgacctcatcacggtccaccaccgtccgtttcgacaccatggcctcttcaagttgtgagccaatgcccggtcccacgaccactttgcatcctggactccaaacttgatacttccacgtcacctccaactcaactcgttctcacacagtgggtcggccaaccaccggaggataccacgtgggagccatggctggacctccaggagacataccaccttgaggacaaggtggtttctggaggagggggtattgatagtagcagagaccctcgaggagaggatagcaacagcgactcacacgagcctagcccacagatgaatagggacgaacctgaaccagcaagacccgcgaggatagcccataagcctacatacttgaacgattacgtaacatag

SEQ ID NO: 14166 - DNA, 730 bp, Glycine max
  Peptide Sequence Number=SeqID_130944
atggccaaatccacattagatcaactcttctaccaggggcctcccatgagaagaagcggggtggttgtcaaagcgtttgatggatcaagaaagtctgttatcggggaggttgatttgcccattacaattgggccgtttgttttccaaattacattccaggtgatggatatccaagccgcatacagttgccttttgggtaggccgtggatccatgaagctggggccgtgacatccaccttgcatcaaaagctgaagtttgtcagaaatggaagattgatcactgtgagcggggaggaagccttgttggttagtcatttgtcagctttttcctttattggtgctgatgaaacagaaggaacctctttccaaggcctgactgtagagggtaaaaagccagagaaaaatgaagtatcttttgctacttggaagagcgcacagaaagtggtgcaggaaggaacaggtgtaggatggggaaaagttgtgcagttgctagagagtaaaaaccgtgaaggactgggatttgcttcttctgcaggatccgcaacgaacagtgttggatcaagctccattactagcaccttttgtagcgccgggttcatcaacgactcgccagaagccaatgctgtcttggaagatgttcctgaagagatagtacttgcatttgttacacctggaaaacttgttcgcaactgggacgcggttgacatcccttcagtagttcatgcatcaa

SEQ ID NO: 14167 - DNA, 745 bp, Glycine max
  Peptide Sequence Number=SeqID_130945
gaagctattaccggagaggaatgtggtagtttattacactgagttcgacaagttcaaggaggaactcgagagaagacactgggatgagaagttgactgattttgccgatggctgtatagacattgctattgtgaaggaattttacatgaacctctatgaccccaaggataaatcaccgaagcaggtgagggtgagaggtcatctagtgaaatttgataaggatactttgaacacattcttgaagacccctgtagttctggaagagggggaaaatttgtgtacttattccatgtttgcactcctgagacctaatcctcaggagttggctgctaagctctgtatcccagggagaggattcaagctaaatgctgatgggcagtctttgaagatactgaggaagaacatgaccactttagctcggacatggagcgttctttccttttctaacctgattcctacctcccacacatctgatgtcaccttggacagagccaagttgatttatggcatcattatgaagatggatatgaatgcggggtacctcatctcccaccagatctctctgattgcacaacatgatacatccagacttggattccctgccttgatcatagttctatgcaaggccataagagtccaatcagattctagatccctagagaacttcagccaggagcccaaccttctccttctggagggggtggggcctccgcagcccaggaacctgagccagagcagccaatag

SEQ ID NO: 14168 - DNA, 264 bp, Glycine max
  Peptide Sequence Number=SeqID_130946
ggtacatcctttgtggcacaagtagagggtagatctacttgggttgttatactgagaacaagaaagggtacatctgttgtggatcagttcaagtggagggattatcaccttgaggacaaggtgatcttacaagggccgaaggatgatgggaaaccagaagcagcattaggtgtaatagctacagagtcgaaaagtagggtgcaaaaagaagaaaaacccaaaaggaagactttgaaaccatcttacctcaatgactatgtttga

SEQ ID NO: 14169 - DNA, 177 bp, Glycine max
  Peptide Sequence Number=SeqID_130947
atggaaatgtacccacttacttggattggtcttgaaatgaagcaaagaagatgcagacaagcagtacacacgcagcagaaatacacactttctcaaggttcacagaggcagaagctaaagcatgcccatgtgacgtttgagtttaaaacccaagcgcttagcctagcctcacgctaa

SEQ ID NO: 14170 - DNA, 264 bp, Glycine max
  Peptide Sequence Number=SeqID_130948
atgacagaaaccgtttgtacggataaccacttgggtatctcttcacatcacctgacttcacaagtcaggatgacaaacaccaattgtacagataatcgcttgggtatctccgtacgtcacctgacttcatgggtcaggatgacagaaggcgcggaagacgaaaagacgatgttcgtctctgcatgctaccggactctgagtctgacggatagcgaaagagtgtttatacggataaccacttgggtatctccgcctgccacctaa

SEQ ID NO: 14171 - DNA, 204 bp, Glycine max
  Peptide Sequence Number=SeqID_130949
gaggcttcctggttatggaaagttaaaatcctctgttggatcttccttgtagctttttattctagtatgcctttaccttgttcacgtagatgcatgccttttttagggtcattcaatagcggaaactggtctgattctgatgaccttgataggacagggctaagttgtcgtactatcacaaggaattggggtgcgataatttag

SEQ ID NO: 14172 - DNA, 300 bp, Glycine max
  Peptide Sequence Number=SeqID_130950
ataatcaatgtgtatgcccagcaatacgagagtggaggagcgttttggccagatgtccacggtcgagtagttatgggcttgattatatctcaaattcttcttatgggattgttaactacaagaggtacagataagtcgactctagtgcttattgcacaacccatcttgacattctggttccacagatattgcaaaggtcgcttcgaatctgcatttgtaaaatttccacttagaggttggttaagcaatttagaagtatgcatacatatgtgggtcgggagatatctgttgttagagtaa

SEQ ID NO: 14173 - DNA, 294 bp, Glycine max
  Peptide Sequence Number=SeqID_130951
atgggcgaaatcacgtgcaaaatccggactggcgggctgcgagagatcgagctggaacggaaaatccgtcaggatgcagacgtcgctacaggtggacagcgtcagcgtgccggccagcgtgccctgcggggcagaatcgagcacgatgggcagcgtaacgttgcctttgtagccatgcgtggtgaggccgctgacgtcaaagcgcgctggcactggccacgaccagcgggcgttgacatccggcgtttgccagcggatttccggcgcgacgccgccttcgcccggcgagcgcca

SEQ ID NO: 14174 - DNA, 1058 bp, Glycine max
  Peptide Sequence Number=SeqID_130952
atggggaagatcccggctgacagcgggctgaccgatcagcttgatgccagcttcgttgatggcacgctgcaaatccgggcgcagcgtcagcagggctggcagcagccggaactgttctttgattatccgcagggcagcatgctggcggcgccgcaaatcagcgtgcagggcgagatgctgaccgcccgcgtggcagtaaccgatgaatggggcgaggccgcgccggacctgcgcggtaaagcgctgtcgctggttatcgctgacgccgccgctgttttctccctctgccggaaacgccacgctgtggtcggtagtgctgctggcgctgctcggcgggctgattctcaacctgatgccctgtgtgctgccggtgctggcgatcaaactgagcagtctggtgcagcagcagggacagacgcaacgccagacgcgtcagcagtttctcgcgtccagcgccggcattctgttctctttcctgctgctggcgctgctgatgactgtgctacggctaagcggtcaggcgctgggctggggcattcagttccagagcagcggctttctgctggtgatggtgctggtgatgttcctgttcagcgccagtctgttcgatctgctgcatttccgcctgccttccggcctgaccacccggctggcgacgcacggcggtgccggtctggcagggcattttggccagggggcctttgccacgctgctggcgacgccgtgcagcgcaccgtttcttggcaccgctgtcgcctatgcgctgaccgcgccgctgccgcagctgtggctgctgtttgtcgcgctcggcgtcggcatgagtctgccgtggctgctggttgcggccctgccgggcatggcgcgctgcctgccgcgtccggggcgctggatgctgcatctgcgcacgctgctggggctgctgatgctgctggcgacgctgtggctggtgacgctgctgattccccactggggcagcactgtcaccattctgctggcggccatcctgctgctggcgctgatgggctggctaatcgcacgccgcgcgctgccgcaggcag

SEQ ID NO: 14175 - DNA, 309 bp, Glycine max
  Peptide Sequence Number=SeqID_130953
atggctgagaagacaaagaaaaaattggaggaagtcgctcagtccggaagcactaagggtgtcattaaccctccatctcccatcagacgacacgtggagtggaaaatggccctcaccaagaaaacaaagcagatgacgtctgaggccgcaaaggaaattgctgagaagattgcgtcacagggttcgtttgtcccccatggacgtcaggatgtcgtaactgctgccattgggcgaccagaacaccctggccgtatgcgtgctgctggagccgatgtcactatcaagcaatactttggatcggctccatga

SEQ ID NO: 14176 - DNA, 274 bp, Glycine max
  Peptide Sequence Number=SeqID_130954
gattgatggggacccggtgttgagagaaacgaggatatgggctacgtgggagtacgtgagctcagttggaggtgggcaaccggggatgagtggtacctggagatatgtcgcgggggtcaggagaccttggggacgtcaggcgagctcctggcagtcaacagataaaaggaaaacaagaccacaaagcaaggaggcttgtggtggctggccagctgaggctaagatggtctctggtaatcgattaccaaggggtgtaatcgattaccaggcttga

SEQ ID NO: 14177 - DNA, 330 bp, Glycine max
  Peptide Sequence Number=SeqID_130955
atggagcattttctcgagcaagtagcctggcctgaagcacaactcccattggtgagagtcaatgaggctgctctgcctgagcccacacatgtgcaggttgatccagagccagctgacccacaatctccagtggtgaatccaccatcttctcctgagcgtgaagtagttcccccatctccacttctgattgtcatctttgatgcatcatcagatgaagcggctgcccctccagattcaccagctggagaaacagctgacccttctacttccccagttggaggaattgttgatctttcttattcgtcatctggagaagcaagctctcactga

SEQ ID NO: 14178 - DNA, 1405 bp, Glycine max
  Peptide Sequence Number=SeqID_130956
catctcgctgaccgcgaacaaggcgatcaccaccaccacgaaatcgatgccatcggccaggtgcacggagtcgaaggtatagcggtatacgcccgagttcgcatccacgccgatcaccgagatcgacaggccgatcatcgccgccagcacacccttgatgggctgcttgccgagcaggctggtgaggcagcagaaggcgaagatcatcagcacgaagtactcggccggcccgaacgccaatgcccatttcgccagcagcggcgccagcaggataatgcccaccaccgacacgatggcgccgaagaacgccgaccatgccgacaacgacagggccacgttggccaggccctggcgcgccagcggatagccgtccagcgtggtcatgatggcgctggcctcgcccggcacgttcagcaggatcgaggtgatgcggccgccgtattccgcgccgacgtacaccgccgccagcaggatcagcgcggtctcgggcggcaggttcatggcgaaggcaatcgggatcagcatcgccacgccgttgatcggccccaggcccggcagcacgccgaccatggtgccgaaaaacgaaccgatcgcggccaccaggatgaccacgtccagcaccttgtcgaacagcacgtagaagaaagcgctcatgacgatgccgccaatcgcacacttgacccagccgccgccgaacaggcggccgacgaagaccgtcatcaacgcggtggcgatgatgaaacccagccactggaacaggaacgcatacgcggcggcgaacaccaccatcaacgcgatgcggccgttggcgccggcggggttcggctcgaccgcgttgccgcccttgtaggccaggcgcagaccgcacaggccgatgatcagcgccagcagcaacgggaaggcgcgcgggcccaccggttcataggcgaacggcgcttcgatgccccaccccgcccaggtcatgaaggccgccagcgcaagcgccgcgatgcccaggattcgatcgttcatgatcagctttccgttggtagaaggaccgggcggcgcaagcccgccccggcctccggctgggagccggcggcgcaagtcggccagttcggcgtattgcttgacctgctgcttcacgtaggcatcgaggtcggcgccggtcttgttgaaggggaacagtccctgctgttcgcgcagcttggcgaactcgggcgccgcggcgacgcgattgaaggcgttgacccagaactggtagtcggcatcggacaccttgggaccgacgtagaagccgcggatgatgggccagacgatgtcgtagccctgctctttcgcggtgggcaccgtgcccagcttgcccggcaggcgctggtcgttgaagaccgccagcacgcggatgggagcgccgccttcgagcatg

SEQ ID NO: 14179 - DNA, 171 bp, Glycine max
  Peptide Sequence Number=SeqID_130957
atgactaatgcaaactgtccgcaagaatcattgcattcagtctcaaacgggaatctaagttgtttgtatagaatattacattctatagaagcaagcttcatgatgatgaatcaagttgattcaagaagttttgataatgacaaagatgatgacaaaaagcccaaagaatga

SEQ ID NO: 14180 - DNA, 237 bp, Glycine max
  Peptide Sequence Number=SeqID_130958
atgggtgactcagatatgtgcggcttgtacatcaaagcaaatcctacctgcctgggtgccctggggagagtttatgagggatccactgttgttcataacactcttttgttgcctggccaagtaaaggtgggtgtggaggaggttaaagatccagatgctccagttcctatacccactgatgaggtttccttagtggggcaggcaattcataccttcctttcctggccgacacatcag

SEQ ID NO: 14181 - DNA, 201 bp, Glycine max
  Peptide Sequence Number=SeqID_130959
atgcttggctcaagtgagcctacagagtttgaatctcaatctgtgtctgttaccggggatcatgacccttttctcaggattccattgacaccaactaagcgtgtatcttctgatgagttggataatgagcgaaaaaactttcagatttcacctgctgaagtttcctcgaacaaattagccaagcattctcagcctgaatga

SEQ ID NO: 14182 - DNA, 183 bp, Glycine max
  Peptide Sequence Number=SeqID_130960
atggcctttgtggataactgggtggtgggtaaggagatgggttgttattggctgagtaatgacattgttggacccactttgatcctttcgttggtgaagaccatatcatcaaagcttgaaggaattaatgaagcattgggcttgaatctagaattgggcttggacttgaagagggcagtctaa

SEQ ID NO: 14183 - DNA, 261 bp, Glycine max
  Peptide Sequence Number=SeqID_130961
atgaccataatttgtctccgcatgtcatcgggctcaccgcctctggatgacaaaaggcgcagaatgaccataatttgtctctgcgtgccatcagacacgattgtctccgaatggcgaaaaggtgtgcggaatgaccataatttttctccgcatgtcacaagacctcagggtcagtatgacagaagggcacagaatgaccataatttgtctctgcgtaccatcggacacgatcgtatcgggatggcaaaaggtgcagaatga

SEQ ID NO: 14184 - DNA, 720 bp, Glycine max
  Peptide Sequence Number=SeqID_130962
atgatcgaaagttttcaacaacaacaacaaatgtcagttctagagttgtacgtagaaaaggatgttgctggtggttctatgtttcatgctgcaaattctgttacgtcatgtggacgtaatgtatctcattatgagtcggaactgccaaaaaatataagcaatttacatgttgatgaagatgatgatgatgatgatgatgattatcttgcatctaactcatacgttgaagagtctttcgatgaagatgatagtgatgatggaatatctcatacagacgatgaagtcactgacatcgttgaaccagtttcaattgttcacccaagcgaaggtgtaccagaaattcaaaatccattttggaatgatgctagccattataataatatcaactggagtcatccggacgaggaggacatttgtggtctagacatgccaacgacttttaatgttggacaagaattatatgttggcatggattttgacagtaaagatgcagtcaaaaatgcactcaaacaatatgtgatgaagggttgtgaaggagactctggaattggttgctgcatcccaaattgtctcaatactctgtccggttggtgccactcaataacttggaaacaaattagtggcaccaccgcgtaccacgcgagacttccgactaaacaaacgggaggcaacagtgatataacggttgatgggtacgactcccacacaaactgcatataa

SEQ ID NO: 14185 - DNA, 684 bp, Glycine max
  Peptide Sequence Number=SeqID_130963
atgaacgatttaacagatatcattgacaacgctttacaaaaaggttataccgtagcctgggcgactgacgtatcagaaaaaggtttctcttggaaaaatggcgtagcctatgtaccagaaaaacctttcgaagaaatgactgaccaagaaaagtcaaccatgtttgttggtcctaaaccagagttaaaagtaacagaagaagaaagacaaaaagcttttgacaactggcaaactacagatgaccacgggatgcatattgtaggtcttgtaaaagatcagaacggaaaagagtactacatcgttaaaaactcttggggcacaacaaatgactaccacggatacttatatgcatcaaaagaatttgcccaaactaagggggtgaaatttgtagatgggttgagttggaaacaagttaaggagcgagcacaagccgagaacaagtttattttcgtggagctatttgcaacctggtgtggtccctgtcaatatatgagcaatgaaatctttcctttagaacagagtccgacaatgccaatatcaaaaaatggtatgccgatgcgcgtgcgatttccaatgaatacaatattcaatcctttcccacatttcttatctttaatcccgatgggcaagtggtacaccggattgtcggagcaagtgatgccccagaattcctcggtcatgtga

SEQ ID NO: 14186 - DNA, 704 bp, Glycine max
  Peptide Sequence Number=SeqID_130964
gtctccatggaggccattgcctccctcgagccttgaggtgcttcacctttggggacttctaattaacacccacggtggaagagttggaagagatcctgggattccctctgggaggaaggaaaccgaattggaccgcgggaagcaagtcgaaaatggggtggttggagtaccaaggaaatgtttggaagcaaaggcgagagtcttggcaagtcaaaacgaatgggccccattcatggacatcctggcactcttgatcttcggggtggtcctctttccaaatgtggatgggttggtggatcgggcagcaattgatgtttttctcgccttttacgaccgcaaggaaagcccggttgttgctatcttagccgatctatatgacacattcgatcgaagatgtgagaagaacaatgcaaggatcgttttctgtacaccggctttctacgtatggttggtttcacacttctttcgccaagagatgagacacgtttgcccgctagaaggccactgctcatgcatcgagaaaaaaaaggcaaactgggaccgactcttagcaagcaaagaaggagcgtctgtcaattggttcccccgatggaaggaaggaagaaccgggattcttatttcatgcgggaaatttccaaatgttcccttgatggggacgaggggttgcatcaattacaatatcgtcctcgccataagacaacttg

SEQ ID NO: 14187 - DNA, 933 bp, Glycine max
  Peptide Sequence Number=SeqID_130965
atggttaaagtcttttgcacggggcgttatccttgcttcagcgcgcggtacagcggcgacgccggtaaaaacagttcagttaacagcagcggtttgccggacaggcgcagccgcgagcggcgtccccacaggtcatcaatctggcccggatcgataaaatcgcggctcagcgtcgaggaggaaaacagcatctgttccgggccgttcagcgtgctctccggcaccacggtacggccaatcagccagggctcattgtcaccgcacagcacgatttcacgcagccagaaacgcgtgtcggcaggcaaaaacgccgcttcctgcggcatctcatcggcggtaatgaacgcttcccgcagcagttgtacagtaacctgctggcagtgctgctcaaagcggcgcgtcattgagtcttcttccagcagccagtcaagcagcggcggtgaaagtaacggggaagaggctggcagccagtgcagtgcgcgtaactggcgcagcgcgtcatgcgacatcaggacatctccgcgtgacacatctgcttgtgccacgctggcgtcgcgggaggaattactcgcgtttcaggcggttactgttggccagccacagcgtcaccaccagaatcaaaatggccgccgagtagcacaatgtatcgaaaggatttttatggtcgacaatgatcagacgaataatcgccgtgatcccgatatagacgaagtagcgcagcggaaagtgataaccggactgaaagtacttcacaatcagcgcgataaactcgaaatagagaaagtagatcacaatgccttcgatcagcaaatacgaggacgcctgctcaccggtgctgaacagcacattcgccaggtgaatggtctctttaccgagaaacaccaccagaataacggccagaatcaccaggccaatgttcagtacccactgtaa

SEQ ID NO: 14188 - DNA, 432 bp, Glycine max
  Peptide Sequence Number=SeqID_130966
atgcgtattgataaaccgattggcacgctgctgctgctgtggccgacgctgtgggcactgtggctgtccggcatggcgattccgccgctgtcggtgctgctggtgttcgtcctcggcgtatttgtgatgcgcgcggcgggctgcgtgattaatgattacgccgaccgtaacgtcgacggccacgtgaaacgcaccgccgcgcgaccgttagccagcggtgcagtgacggagaaagaggcgaagctgctgttcgccggcctcggtctgctggcgttcctgctggtgctgactatgaaccgcatgaccattctgctgtcatttggcgggctggcgctggcgtgggtttatccctttatgaagcgctatacccatctgccgcaggtggtgctgggcgcagcgtttggctgggcgattccgatgggctgggcggcg

SEQ ID NO: 14189 - DNA, 238 bp, Glycine max
  Peptide Sequence Number=SeqID_130967
atggccagaacacgaggtttaggtcgtgccataggtagatttgtaggccgagatagagctgctgacgaggatgctggcgatgttcccgagaggcgtaggcctactgcctcagcccgtaggctacgcgttcatcagatgactacggagggacgtgatatggctgaggacgtcgctgacctgactgatgatgtccctgagcagcctacggaggcacctgagatgcgtgcggacgcacagg

SEQ ID NO: 14190 - DNA, 300 bp, Glycine max
  Peptide Sequence Number=SeqID_130968
atggagcagaattttgcacaagtgcagaaaaatgcttgtgtgtggttggctgtggaaagtctagtgcagaatgagttctggatgtttgctagtatatcccaacggtcaaaatgcaggcttatacactatagacttccacttgagaggattgatggggacccggtgttgagagaaacgaggatatgggctacgtgggagtacgtgagctcagttggaggtgggcaacaggggatggtgggtttatgcgcgcattgtggatgtgaaaagcttgttgtgcaccatcgcccgaccgtcacctag

SEQ ID NO: 14191 - DNA, 204 bp, Glycine max
  Peptide Sequence Number=SeqID_130969
atggatggcggctgggcaaaggcatttgcgggggttccagactggaaggttggaggaccccataaaacgtcgctaggcaatgacattcagggggctccgaaaaataggggaggaatggaaagttggcgaacagtgctaggcaatgacattcgcggggttcccagacttgaaggtggaggactcatgaatagcgctaggcaatga

SEQ ID NO: 14192 - DNA, 708 bp, Glycine max
  Peptide Sequence Number=SeqID_130970
atgcatagggtaagaagttatccagcttcagtgagcaattccttcaaggcgtcaaaactattgattaatgatcctatattggaaattcaggaatttaaagataggcttttagatttaggtgttgaggtgagtcgagtttcgctacctggcgatcaagcaagctcacaagttccagggggaagtcagctatcatcaaaggattcgtttctttcaaaggccgaagccaaaactattttagaaatcaatgccatttctgaggacgttgtttgtgttacggtggggactattagcaaaatagtcatggataaccattcatggtgttatccagcctgtgctcaatgtcataggaaaactgacatccaaacaggaccattcacatgtggatgtggcaaggataatgatcagcctgttctaaggtatagagttgaaatcatggttacccaaaacaatgagagtggcaaatttttgctctgggactgtgaatatgctgaattcattggtcaaacagctgatgatgtgaatagggtcaagattgaagatggtgatcttgatttgaatgcttcccctcaagcacttgacaaattgttgggtcatgtgcttgcttttaaggccaggattcaatcaagattcaaaaatgcagttgtacttagatactcaaaagacctggatttgatcaatgcagttctggagatgctgcctgatagtgag

SEQ ID NO: 14193 - DNA, 896 bp, Glycine max
  Peptide Sequence Number=SeqID_130971
gcctggttggataccagcctaatttggtttcaagacaattcggcctctcgcaaattcgtcctaaaagcttgttcgaagatcctcaagacgtcataagaggggccaatctttcggaaaagaccttcaagaagtttttgaagatttctcttgatgaaaactataacctgcatccttttgagttcaaccactcccacttctgcactatggggtttgttacctggtgggaaagatattactcgacccgttcggttggagacactactaacatgatctccaggcttgagagtggctttgtgcaaccaacggtcgagaatattcgctcaagccttcaagctcgaggcaaagcacctatgacgaagaggagtgctgaaacgcctcgagctgacatgagacccaagaaacccactggggaagaagaggagagacctcttataagaaaaagaaagttacctacgacttcgaccaagtttgctgaacaaacagaggcaggcaattcccaggctcaaatgcctaagaagaaaaagaaagtgaagcaggtcgagcctgaaccttctgtggctgtcgagggtggtgagccagccaagaagaaaaagaaaaagaccaagtcttcaaaagaacaaggtgaccatcaacctgttgacgtccaaccaccttcgaccgatattgacggcactgaggtaaaagctgctccttctattgctgagatgggcaaccctgtcgagcaaccgaactcaccacgagaacaacctaccgtcgaggtgcaacaaaatgtttctgcagaagaaataccctcatgtgcgcgaacatctcccgctcctgaggcggatgcagtgaatgttgaggaatggggtgaaggtcaaggcattggatccagtagtcctcatggttgggcagag

SEQ ID NO: 14194 - DNA, 321 bp, Glycine max
  Peptide Sequence Number=SeqID_130972
atggcatacaaagaccgtaatggtcgctcgcttaccttgtttcgacactatcaaagtccccttatcatccagagacaagcaagtccgatggtatgcggggacaatgatggtcagacgaacatagtcatctgcttcccttgtcgagagactcaatgtctgttgaccaaagctactgaagtctcccctgctatcccgagacaagcgagtcccatagcatacggaggtcgtcacgattatccattttattactttcaaggcaccaaagcttttgctgatgcacctgatgtcttttatgctctttcttttgacaggttttgctga

SEQ ID NO: 14195 - DNA, 201 bp, Glycine max
  Peptide Sequence Number=SeqID_130973
atggaagaattgcaacacttgaactcttccgccctcatggtgaagcacaagattatctttttattgcaactgaaagatacaaattttgtgttcttcaatgggattccgagacgagtgagcttgttacacggtatgtgtgaggaagcacctattctttcctttggagtggatttacttatgtccactattgtttttgtatag

SEQ ID NO: 14196 - DNA, 246 bp, Glycine max
  Peptide Sequence Number=SeqID_130974
atgactaaagcacgtcaaaagggggtacggaaagtaaatgaaagcacaccgaagaacgatgaagaacgaatgaagaacgtcgaagaacggttgaaaaccttcgcgaaatcacccacggaaacgttacggaagcgcctcagcttggattttcatcacggaaccaattttttttcactaattttaagtgattctgaattaccaggagggctgaacgaaatttctcttcacttctccccctatttataa

SEQ ID NO: 14197 - DNA, 339 bp, Glycine max
  Peptide Sequence Number=SeqID_130975
atggagtttacgaatgaagccaaactcatggccaaactccagcacacgaacttgataaagcttctagggttctgcatccagagagatgaaagaatattgatctatgagtacatgcctaacaagagcttagacttctacctatttgtttggcttttgttttatcttctgtcaagtgaattttcaaattttaaaacttttggtctttggtatatgtttatgaaaacatctatctttccggtggatatgtggggtccagagtatgaagctggaaaagtgaaaaacgggttcttgcagagtgggtatgttcttgtgaaatcaagaatgcaaagactcttgtga

SEQ ID NO: 14198 - DNA, 564 bp, Glycine max
  Peptide Sequence Number=SeqID_130976
atgaaaaggggtgaaatatcagattggaatataatagtgcgtcaaaattatgagttggccgaagaatgtgttgaagttaatttctttggtgcagaaagagtaactgaagctcttcttccactgcttcaactgtccacttcacccaggattgtcaatgtatcatctagaataggagtattgaagaatataccaaatgagtgggcaagaggagtgtttggtgacattgaaaagctcacaaacaaaaagcttcatgtggtgcttagggagtttcttaaagattacaaagaaggatcattggaatccaagaactggccacctgttctttcaggttacaccatgtcaaaaacagccttaaattcctacacaaggatgctggctaagaagttccctcgttttcgcataaattgcttgtgccctgactttgtcaaaacagatataaaccataatgttggctttttaaccattgatgaaggtgctgagtgtcctgccaggcttgcattgttgccagataatggtccttctggtctctttttcttaagggaggaagtactttcttttgtttga

SEQ ID NO: 14199 - DNA, 216 bp, Glycine max
  Peptide Sequence Number=SeqID_130977
atgacggaagcatgtcaaaagggggtacggaaagtaaatgaaacgagaataaaagtacacgaaacaaatggggaccaccacgggaaaataggggaggagcttgccaccaagctcgcccaggcgagctttgtggaggaagaatctggaaggcccaagtgggcctgctttcagaatgttacggaaactcacggattgcgcaataacacttccttttga

SEQ ID NO: 14200 - DNA, 588 bp, Glycine max
  Peptide Sequence Number=SeqID_130978
atggaggcaatgaaagagcaaatggccacaatgatggaagctatgatgagtatgacaaaaatgatggaggttaacacgactatagttgttgctgcaagtactaccatagaagtggacccgactcacccacctggcttcaatcaagtaaatcatccagcctcagatatggtaggtcagggaggcaaagcattgggaagtgtgagcagcccttattttgtgcaggttcagaacaagcattccttcccaccatatggcttgcctcctaactatacaccacccaatgttgcacacgcttccgatgagaatgtcgacagctccactcccatactcattgtgagccaacaacccctatctggtcaggcacaagtccctcaacccatgggggagacacatgaagtaccccgagaccatactctagccgactccaagccttgcctcggatatgccactgaggggcagacgtttggaggcatacccctgccaaacactttgggggccctcagtatcacccacaaccacaacccttacattttacggtgggaagagtgcctcctgctatgtcggatagggagaacattgatcagataa

SEQ ID NO: 14201 - DNA, 503 bp, Glycine max
  Peptide Sequence Number=SeqID_130979
atggataggttgacgaccatgatgaatgcactcctgtcagcccagaactctcaagctgccgccgctgctgtagagcagcctttggtgagcacaaccccgctatctacagtgacttctccacccctctttctgcctccaggttgtacatggggaatgccacctccggtctgtggaagcccccaacccgccgtatctgaagttccacttcctttcgctcagcagtcagcaccggttccgcaacccggtacctctttccctcaagctgcaatgacctattcagcaccactgatccacactattcaacaagaggttgagccaattttccaagctgaaaatgttgtagccttcgacaagatggaagaactccaagaaagatttgatggtatgcaaagagaagtcgaagccctccgaggaagagatctgttcgggaaggacgcctgtgaattatgcttggtcccaaatgttactatccctcacaagttcaaggtgccagacttcgagaa

SEQ ID NO: 14202 - DNA, 228 bp, Glycine max
  Peptide Sequence Number=SeqID_130980
atgaccacaagcctttggattatggaccgggccgggtattttagtcaaatccacttcaatctccgtttaaaccctgccactccgttttttctcttcttctcgtgcttcggcggaaatcggcttagctcttcgaccggtggtgagggtgaaggttttatgttttatctggaggatgatttgaatcttgtgatttgtgaagcacgtagtcaattgctgaatacgatgtga

SEQ ID NO: 14203 - DNA, 243 bp, Glycine max
  Peptide Sequence Number=SeqID_130981
atgggtatggagtatcagaagatccatgcttgccctaatgattacatactgtacagacatgagttagaagaaatacacaaatgccctcggtgtggggtaccactgtataaagtgaaggatgatgacgaatgtagtagtgatgacaactcaaagaaaggcccccgacaaaggtggtgtggtatcttccgatcattccaaggtttaagtgactgtttgctaatggagatgacgcaaaagacctga

SEQ ID NO: 14204 - DNA, 360 bp, Glycine max
  Peptide Sequence Number=SeqID_130982
atgggagaagaagcaaaaaggtatgcagtagtgacaggagctaacaagggaattggctatgggatatgcaagaaattggctttgaatggagttgtggtagtgctaacagctagaaatgagaaaaggggtttggatgcggtggaaagattgaaagagtttggtctttcagaccttctagtttttcatcaacttgatgtcactgaccctcccagtgttgcttctttgacacagttcatcaaaacccgatttggaagacttgacatcttggtgaacaatgcaggtgtccccggaggaatagtaaatggggagaatgttcttagaagatttactttctaccattgtggtgatcacgacaactga

SEQ ID NO: 14205 - DNA, 567 bp, Glycine max
  Peptide Sequence Number=SeqID_130983
cagattgtgatgtggaagagggatttaagagttaatcacgccagaaacgcggccgggttttctgcggttatggtaatcgacctactctcaaaagaatccacgcagggacagatgcgagcggcacgcaggatagcgtttgctggcgcagctggctctcaagcctggaggcagaaaatggagatgttgtcaggagccgaaatggtcgtccgttcgttaatcgatcagggcgttaagcaggtattcggttatccgggcggtgcggtgctcgatatttatgatgcgctgcaaacggtcggtggtattgaccacgtgcttgtgcgccacgagcagggcgccgtacatatggcggatggcctggcgcgcgcgaccggcgaagtcggcgtggtgctggtcacctcaggtcctggcgccaccaacgctatcaccggtattgcgaccgcttatatggattccattccgctggtgatcctctccggtcaggtgccgtcctcgctgattggctatgacgccttccaggagtgcgacatggtggggatttcgcgtccggtggtgaagcacagcttcctg

SEQ ID NO: 14206 - DNA, 297 bp, Glycine max
  Peptide Sequence Number=SeqID_130984
atggcacgcagcgtgtccgctccgtgcccctattcaagggacctatatgggagagaactaactaggcatttagtgataacccccaagtccccagtggagtcgccaactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgacaggttcgggagttgtatttacgcacggggaaggtgttag

SEQ ID NO: 14207 - DNA, 390 bp, Glycine max
  Peptide Sequence Number=SeqID_130985
atggactcagaaaggttccaagttagtatactaggtgacggcttccccagtaaggctctcttggaagaaatgcatcagcagtttttcatctttcgcgtatgcccccatcttccgacagtacatcttcaggtggttcttggggcaagcagcccccttgtacttatcgaaatcaaacaccttgaatttcggaggtgtcataccctaatttcgtccggggacctttgctcgatgacgtgcgaccattctttggtcctcgtgaggcccatttgggccctccagaagattcctccagaaggcggttgcttctggaggaagcaaccctgctcgcctgggcgagctgagctcgcctgggcgagctgggcggcaaccacctcccctattttgctataa

SEQ ID NO: 14208 - DNA, 441 bp, Glycine max
  Peptide Sequence Number=SeqID_130986
atggaatcccgagatttaccgtcgtcgtccccgtcgtccaccgccaaccgcgacgcctcctccgccaccgatgccgaggacggcgttttcaccgtcgctgtagcgctcgccaaagacgccgcgttgcatttccagtcaggcaagtttgccgagtgcgtcgaggtcttgaaccagctattgcagaagaagcaaggcgatccaaagctagtgagcacttgcaggtgcagtgtagcgtctgtggctgtagatttgaatgtgcatcggttgttcagctggttttggatgtctatgcaaaggcattggcgctgtgtgatgtgtggaactagtaggaatgttggacgtaaggagaaatttgttggacttgtagaagaaactgctgctgtggatctaacatggaaatttgactgccaaaaggggttttcagctcatttttctggataa

SEQ ID NO: 14209 - DNA, 1020 bp, Glycine max
  Peptide Sequence Number=SeqID_130987
aaaaaagactatgacattgcccttgttggggcctttagaagggaaaaggacaaagagatggaattacaggcactaagagatgaaattcaagcgtccatgaagctggtgagacaaagagaagatgagatacaaagtttgaagatgagactacgttttcgagaagctggaataaaaagattagaaacagttgcttctgagaagatctcagctgagacacacttgctaaaagaaaaagaggagcacttgaaggaaattgaggtcttgcgggcccaggaggatcggaataatgaagcaactagatttgctatggaaaatttgcagctaaaagaagaaattagaaggcatgttttattgatacagctaaaatacttttttgttgctttttttttattcatgtgcatgcaaaagttaaagtcattttgtatggaaggtgaacgagaacagatgagtgaacaaatcatggtattggaaaacaagttgttggaagcactagattggaaatttatgcatgaaacagatctgaaaaaaaattctgatttgatgatcgaagatgtacataatgatggtaatctcatctccaaacaggctatacaaaaccagcctttgggttggggagggtatgctctaaaatgcaaacttcagaacctaaaacatagactaaaatcctggagtagagatatctgtggagatctaggcagcaaggtgaagcaaactcagaataggtcactgcaaggaaggcatagtattttttatatgtacggaagacttaatgccccacgacactttgggaatgataatagaaattatttgccatcatctgtgtttatggaacaaacaccttatgaaatcagtgctcatggctcttcaagattacacccgacagcactcttcaatagtaaaatgatgataagatcaagttcagggtgggacaaagatttatataattgtcagtcgtatcaacgtagtttctgcagtcctaacctcactgggcacgcgaagtttgatgctgaggcaccttga

SEQ ID NO: 14210 - DNA, 498 bp, Glycine max
  Peptide Sequence Number=SeqID_130988
atgtttgttcaccggaacaatgcaaacacagctacattggctgaagttgcggagacattacagtatatagtgtcaccacatgggaggaacacatggacagttgataatctcgtgccttatgtggagaagataacgattttatccaaagagcaagtgagaatcattgagcccgtgtcacatggtccagcatcagagcgtcaatttccagcacaagagtttcacattcttcagtcaaatgttgaaactcagggtataggcagacgaagggaggctgttgaagcagaagaatattcgcaacaaatggtggaccgtggccatggaatgtattacacgccaccaacattttctcagtatccttcacagatgtatcaatatcctttcgaaggtcatcacattgatacttttgcaagcgaacattcgttcggtggtgttgcggaaacacatcctcatttttcatggccgactatgaccccttcacagcaacatgatgtcccaatt

SEQ ID NO: 14211 - DNA, 429 bp, Glycine max
  Peptide Sequence Number=SeqID_130989
ttggccaaaagaggaccctcgccattgacatttgacgacaaggacatggaaatgccaatcattctagaccatggagatctcttattgttaaaagctttcataaacaaaaaagaagtatgtcagttgttggttgacattggtagctatgcggatatcatgttttacgatttctttaggaacctcagtatacaacagctagagttgcttctttacatcgaggatctcttaggtttctctggccatcataatgagatatgtaaagtttcacgtaaccttcgggaaggcatcagtaaccaaaaccatcgccatcatgttcattatggtgaagctataatcatcctacaacatgatattgggcagaccaaccttgaatgccctgaaagctgtgattttgacatttcgtctagccatgaagttcctcagcaatga

SEQ ID NO: 14212 - DNA, 510 bp, Glycine max
  Peptide Sequence Number=SeqID_130990
atggatgctttgacttcgttcctcaaagaaaatgctgatatattttcatggaagccgatcaacatgccagatattgatccacacctcttctatcacaagttggtagtaaacccctctgtaaaactctattgcctaaaagatttatacctattcccagacctagacaagttggtaggcagatcttttggctaccaatatttgagctttatggatgcctattcagggtacaatcaaatactgttacaccttgaaagacagataggtcagaacctagaagtctatgtcgatgacatgatagtcaagagcaacaccccagagcaacacatagtggatctagcagaaacctttgctcagttgcaaaaatacaacatgcgcttgaacactaagaaatatgtctttggggtgtctgtaggcaaattcctgggttacatgtcggaaagagtgattgaactaaatcctgacaaatgttggactatactagaaatacagagtccaaatgttgtcaaatga

SEQ ID NO: 14213 - DNA, 426 bp, Glycine max
  Peptide Sequence Number=SeqID_130991
atgcacaaaaatgagagagatggagaatggaagaatggtctcaagcagcagcttcacaaagctggacctatagtaatatcaaggttcatgatcatctcagctgcatttattattcaggcagtgaagaatgttgttgccactagcaggaccatggtttgcactatataccaaccaagcatcgacatatttgagactgacatcctgcctgaaaatactggaattgctaaaagcattgaagctgcaggatccacgatgtcggatacaatgtccaggacatcctgcccgaaaatactagagttgctaaaagcattgaagctgcaggatccacgatgtcggatacgatgtccaggacatctggcccgaaaatactggacatataaatctgttatatctttaacagattattgtgcagttagcaagagataa

SEQ ID NO: 14214 - DNA, 426 bp, Glycine max
  Peptide Sequence Number=SeqID_130992
atgggtatggagtatcagcagattcatgcttgccccaatgattgcatactgtacaggcatgaattccaagaaatgtccaaatgccctatctgtgggacttcacggtacaaagtgaaggatgaagaggaaaacaattttgatgaaaactcaaacaaaggccctccagcgaaggttttgtggtatcttccaatcattccaaggtctaagcgtctttttgctaacgaggacgacgtaaaagaccttacatggcatgcaaatggaaggatttctgatggaatggtccatcatccgactgattgctcacagtggaacaagattgatggtttgtatctggatttcaggaaagagccaagaaatcttagacttggactagccaatgatggaatgaatccatatggcaccttaagcactcaacatagttcatga

SEQ ID NO: 14215 - DNA, 657 bp, Glycine max
  Peptide Sequence Number=SeqID_130993
atggatttctggcacttaactagtttagagggagcacgtgtaaccaggaggaggagacttgccacaagtcacaaggagctgaagggcaagtgggacataaatgttgaggttgagaagcttcagtttaagagtggtgcaaagacacaccgcagcttcaacctcaacaagcccttgaagcacggggcagcactggttcgcaacagggtcacccaaaccaatgtgaaccaaccctccaagaagatccacacaggcaccaagtttgagcgtgtcaatggggcacgtagcctgcgcaggagactttggtggtgggcatggagtgttccctcccttccctggtgtggttggtgggttaataattggaattggagggagaatacctgggggcttcactattggtggaagaacaacgggaggaacattaatgggagggatggtgactggtggcttaacaacgggtgttttgggtgtctttggtgttttaccaggcttgtgctttttggggggtttgccacagtagccacaaccgagaatgggagtggcggaagagagaaagatcatgcagaggaagagattaagtgtgtgtgtgtgtgcctccgaggtgaaagaaaagggagcctggcccgtgaaagtacaggcttaggttgcttaaccggttaa

SEQ ID NO: 14216 - DNA, 222 bp, Glycine max
  Peptide Sequence Number=SeqID_130994
atgttgctaaatagcaacgtcatccatatccatgtaagagtggtcatgttggtgcgcatgatccgcactcgtctttttgcagcggcatgggtgaaatcttgccccggtatgcatactagatgtgtgatagcctccctctctggatgtgctcgcatagttggtcgccctccaatatcagggggtggcccaggaactgataaaaggaaactactagccccttaa

SEQ ID NO: 14217 - DNA, 509 bp, Glycine max
  Peptide Sequence Number=SeqID_130995
atgccaatctccccctgcagatggattgcgcccacaagacacccagtggacccgaagaagtccaacagggccctggggtttccagctttggttatgggcctctgtcagtcctacagggtgcccgtccccccagcgaggtcatgccatcgtgacatagggatcgcgcccaccagacacccagtggacccgaagaagtccaacagggccctggggtttccacctctggttacgggcctctgtcagtcctacagggtgcctgttcccccagcgaggtcatgccatcgtgacatagggatcgcgtccgcaagacatccagtggacccgaagaagtccaacagggtcttggagttgccaagctctaattacgagtctctcaaggtcatcaggccccctactaatcgagccttcatcaagaagtactgcgtccccaggcaggcgcagggcgaaacaccacagcagcctggggatggccgacagcgggcaacagacgcaccgccatcacctctaga

SEQ ID NO: 14218 - DNA, 667 bp, Glycine max
  Peptide Sequence Number=SeqID_130996
ggtgtgcatggttgtaacggtttcccgcagaggtcgttgtttccggagaacgactctcccggaaaacgcgataagctgttagggatggagccgttgaggcgattattggagacagtaaagttaactaactttaatgtaatgctggggaggttgccggagaaggaattgttttctaggaagaggcctgttagacgagtgaggttgttgagagagaatgggattgcgccggagaagttgttggaggagagttcgaggcgagtcaagcgagtagaggttgcggagggaggtgaggttggcgaagtcggcggggatggggcccacgagggcgttggagcggaggctgaggacacggaggcgcgtgaggcgggagattgtgttgggggggatggggcccacaaggccagcgccggggaggtggagggaagtaacgaaggagcggttcgagtcgcactggactccgaaccaggtgcaggccgaaccggaggtgttccattggacccggttcgcgtgcgggtcggctccgcgttgactcgctcactcggctgcacaagagctacgaagatcaagatcataaacataatgtggaaatggaatgccatttggaaacgacgtcgtttggcgatgttttttcttgtgttggttgctagtgttgtagtggcggggaagg

SEQ ID NO: 14219 - DNA, 270 bp, Glycine max
  Peptide Sequence Number=SeqID_130997
atggggttgaggagcggaatcgtcttaagcgatggtcaaatgccgggccgaatccaaagacagagacaaatcgaggtaaacggtaacgcggccacagtttgctgcgcaatgtcgtttcctgctgtcgcaacctacccttcggcgggagggcgacgcgtgacttgcgggtgcgtcttccaagaaaggaatgcgcacggagtcgccaccaacgtttatttgaggaaaacgtcggaaaaactagaaaagatgagatctacgaactttaagtga

SEQ ID NO: 14220 - DNA, 1428 bp, Glycine max
  Peptide Sequence Number=SeqID_130998
atgaaacgaccccaaggaagaggtttggagttggcaagaaaacacatagcttcatgcatttcagagattgattacattcggaaatcttcagaatttcttagagctaatgctcatggaatgtctgaacaaaacatagacaatacaactgcatctggttgtcaaccaattggctttgatgctagtttaaactgtagattatctgccccaacaccaccccggtcaatcaaaattctttctttggaaaaggccctcgaatatttcatgaaactccttcaagacctggacgttatatgttcatactcattggacccatcattggaagctgctttactctttgtgattaaattccagaaatctcaacctgatttggttgctagagcccatcttcaggacgggaaactctatggtcgggatcctatgttttctatgatcactagagctgctggattacctgaagtcacagagaatcatgacattcagaaaaatgaatttatggtgcaactaggacagttggtgataaatttactcaaaattctttgtacaaatgctgcatggcaaaggcgtaagctagggaaaatgttacaagactggcgtgtcacctatgtacagctggagatggcttttaaaggagagtttgcagaagcctcaaaaacttcaaacaataagaaaatatgtttcaaaatataccaacacattctcgcatgggtagaagagcaaacttattggatagcttttcgatttctcaatttgggatttgaattggagctctactctgtccatgactattgcatggtatactggtatatttatgttgtgttgatcaagcttgcagagaagaaacatctccggatggcaatgagcagtgactctgctaagaagaagacaaagaaaaaaagggattcttttaaggatggggaaatggattatcagatcccggcagctgttttgtttcttcaaagccaaatatatcttgctgaaggtctaagcatgatgtttgctgctttgaggaatgagcgcagaatagttccactgcaaagccctttcaacacagaacatgagatatttattcagcaattcgagcttttacagaaagcttgcgttcctgatcacatctcatatgtgacattcaaggagtcaactatgcatgctaatttctctagacaggtttttacttgtttgtttccccttcagaccctagccatctgtgatcacttcaaggaagctcagaagatagcaaaagaggtgaaaagtagttttgccaatgaccctgacacgatggccgagctgcgtagagtagagcaagtagcagaacgcaacagcattgcattgaatgtttgtcgggcaggagcccttgatccaaagttgaagactttttttacattctgtcatcatcctttctatgctactgctattgtgaagagatcctga

SEQ ID NO: 14221 - DNA, 638 bp, Glycine max
  Peptide Sequence Number=SeqID_130999
atggaccgggacgagattcttcagtattcgcaggctgtttgtcaggggctgaaagacgatgatgatggcttgcggcgggaggtgctggctcatgcaggaagtcgctggtcactgggtatcgtcaacacgcttggcgtttatggcagactgcgtcacgccgaaattggaaggcgtatgcacggcgtgactcagcgcatgctgacgcatacattacgacagcttgagcgtgacggactggttatccgccatgatttcagtgaaatcccgccacgagtcgaatacgagctgtccgatacagattatcatgatctcgctggttatgttcatggggcgaaaattattcatttcgctttgaccagagcccccatagacaatatcaatgatgtggtttatgagacagtgaaaaaaacgcgatctgtcagacaattacacatgtcatttctggttcctcgtaccaaaattttgaaaccagctatcatctattttcctgggggaggatttatgacagcggagcacaataaatttatggaaatgcgcatggctttagcggaggctggctttgttgttgcagcggcagaatacaggacaattccggatactttccctgcaccaatgatagatgctaaagcagcggtaag

SEQ ID NO: 14222 - DNA, 123 bp, Glycine max
  Peptide Sequence Number=SeqID_131000
atggaggagtttgagactcaggtagcctgccccggagaccagccctcttcttctagagggggtggggcctttgtagcccaagagcctgacactgaggagccaccagcactagcaccaacacca

SEQ ID NO: 14223 - DNA, 225 bp, Glycine max
  Peptide Sequence Number=SeqID_131001
atggatgctctggagcatggagtgaagcatctgcgaggagctagaagtggtatatgtagaggtgctgggggaataactggaattagagtggatgaagagggaggtacggtagaagaaaaaggtgttggtgcatctgatgctaaagtggatggggcctcagatctcttacgcctggccttcctgggtcctctgaaagttactgttggatcatcaagattccaatag

SEQ ID NO: 14224 - DNA, 519 bp, Glycine max
  Peptide Sequence Number=SeqID_131002
atggtaaatggtaatgtagttttgagaatgcaatttgcagatggaaatggaggcatgaaggctggttcgtgcccaaatcgtgcggaatcaccatctatgaacacaacatcaagatcactagttctagtgaatttctttagagatcttcctgatgtaactaaatcttgcaaggacaattctgctcctttgcttagcatggtcaatacatgctatgaagcagctggcaaacgttggcctaatttcattgctgttgatttctacaagagaagcgatggaggaggagccccagatgcaatagatgttgctaatggtcatctagtgtgcgggtgtgaaaacatggcctcctgcaaggctaatatgacatttggagtgtgtcagctacctgaggctgaagccactcctccccgtgcagcagcagcagcacgtgacactagctttggtattcgaaattgcaagccagtttatttgctgtggtcttttgccaccactgtttttgggggcatgctcgtgtcattgtga

SEQ ID NO: 14225 - DNA, 1110 bp, Glycine max
  Peptide Sequence Number=SeqID_131003
atggatttttctcttccatttccaccgcctaatcctgtctcttcctcaccttctgcaacttctctaaggtacttcttcttcttcttcgctttctattcccatttttcaccttcagaatttgcattcggtgtgaagcaaaatgccttcttcacaattccgagaggtgaacatggtctttctgaatccgattgtcaaactggggaaatccaaaatgtctctatggaacacctttgccgccttcatggctggtcccttcgttccaagcctcgtcgcatttttgatgctgttatcttcagcaatgagttagacatgctagagattagatggcacgaactttctccctatgtatcaaagtttgtgatccttgagtccaatactacgtttacgggcattccaaaacgtctcttcttcgccttaaaccgggaaagattttcctttgccaaacaaaagattgtccatgacatttatcctggcagaattgcagtccctggatcgcacgaggacccatttgtgcttgagtcaaaacagcgtggggcgatgaatgcattgttacgccgtgcaggcatttccaacggtgatattcttctcatgtcagatacagatgagattccaagtcctcatacattgaaactgcttcagtggtgtgatgggattcctcccataatgcatcttgaactgaggaattacatgtactcatttgagttccctgtggactacagcagctggcgtgccactgcccacgtctatggtccccgatcacaataccggcactcacgccagacggatgtaattttctcagatgcaggatggcactgcagcttttgctttcagtatatttcagagtttgtgttcaagatgactgcctatagccatgcagaccgcgtgaaaaggaaatattttctgagtcattcaagaattcaggacattatctgcaagggagatgatctttgtgatatgctccctgaagaatactctttccaggagttgattaaaaagatggggtcaataccccggtcagcttctgcggttcatcttcctgcctacttgatagagaatgcagataaattcaagttccttcttcctggaggctgcttaagaccaccagaataa

SEQ ID NO: 14226 - DNA, 1011 bp, Glycine max
  Peptide Sequence Number=SeqID_131004
atgttgaagagattcaaggtgtggacttacaaagaaggtgagctacccttagcgcatgaagggcccatgagttcaatttatggaatcgagggacacttaatagcccaaatagacaatagaacaggcccattcttggcccgctatccagatgaggcccatgtcttcatgctacccataagtgtgacccaaatcgtgcgatacgtatacaatcctctcaccacctactctcgtgatcaattgatgcggatcaccgttgattataccaacatcatagcccacaggtacccatactggaacaggaccaaaggagcagatcatttcctagcctcttgtcatgactgggcaccagatatctcgagagaggaatcaggcagggagcttttcaagaacataataagagtgttatgtaatgccaacacgtcagaaggatttaagcctgaaaaagatgtgccaatgcctgaaatgaacttgcaaggttttaagttgagctcaccaattcctggctttgacctcaataatcgttctatacttgctttcttcgctggtggggctcatggtaggattaggaagatactactagaacattggaaagacaaagatgaagaagttcaagtgcatgaatatcttcccaaaggtgttgactatcagggcctcatgggacaaagcaagttttgtttgtgcccaagtggctatgaagtggcaagtcctcgaattgtggagtctatcaatataggatgtgttcctgtcattgtttcagattactatcaacttccctttagtgatgttcttgattggagtaaattttccttgcatattccatcaagaaggatagctgaaatcaagacaattctgaaaaatgttccacatgctaagtacttgaaactacagaagagagtgatgaaagttcaaagacattttgagttgaatcgaccggccaagccgtttgatgtgtttcatatgattcttcattcgatatggcttagacggctcaatatcaggctacaccattaa

SEQ ID NO: 14227 - DNA, 210 bp, Glycine max
  Peptide Sequence Number=SeqID_131005
atgcttaattacggtcccattggcacgttgaagattatgaagatgtggttggaattactcttgggtgctatctcgtggctgtgcccacttcccacctcaaccacaagtgcaagccgcaactcaaaggacaaagaccacacaaccttgtcgtggtcgatccagttgtgcaacaccactcagtttacgtgtggattaaagttgagagtttaa

SEQ ID NO: 14228 - DNA, 510 bp, Glycine max
  Peptide Sequence Number=SeqID_131006
atggcaaccctaaactcatcaagaacttcatcaggagaacacggtgatattcgaaaaatcctattgaatcattggaaaggcaaagataacgacatccaagttcatgaatatcttccaaagggcaaaaactacacccaattaatgggacaaagcaagttttgcttgtgccctagcgggtatgaagttgcaagccccagagtggtggaagcaattcatgcaggatgtgttcccgtgttaattagtagtagttactctccaccttttactgatgtgttgaattggagtcagttctcagtggagattcctgtggagaaaatatcagaaatcaagactatattacaaagtatttcaaggaataggtatttgagattgcacatgaatgtgctaagagttcgaagacactttatgcttaatcgacctgcaaaaccattcgatttgatgcatatgatacttcactcaatttggcttagaagattaaatcttagactgattggttccacaagctcctaa

SEQ ID NO: 14229 - DNA, 273 bp, Glycine max
  Peptide Sequence Number=SeqID_131007
atgttgaacttgcggtgtctcgcgattgtgttcgatttggacgagaagctcatcgtggcgaacacgatgaagtcattcgaggataggattgaggccctgagggggtggcttttgcgtgggtcccactcttccccaacctcttcttccccagcttctactacgttggcctttcaggtctcgggatttaggcaacggaggggccgtgatggacatcggaactgtcgtcacaaggcttccgacggtggcttacagacacctttctgttttgcataa

SEQ ID NO: 14230 - DNA, 370 bp, Glycine max
  Peptide Sequence Number=SeqID_131008
gagtcatgaagagatgttgaagagattcaaggtgtgggtgtatgaggagggagagcaaccattagtgcatgatgggccagcaaatgatatatactccattgagggtcaattcattgatgaaatagacaacgatgctaagtggagccacttcagggctgaacatcctgatcaagcacaagttttcttccttcccttcagcatagccaatgttgttcactatgtttacaagcctattcgaaagcattcggactacgaacctattcgcctccaacgcttagtggaagattatattggtgttattgccaataagtatccttattggaatagaagtgaaggggcagaccatttcttactatcatgtcacgattgg

SEQ ID NO: 14231 - DNA, 1023 bp, Glycine max
  Peptide Sequence Number=SeqID_131009
atgatgaagaggttaaaggtttgggcatacaaggaaggggagcagccattggtgcatgatgggcctgtaaacaataaatactccattgaaggccaattcatcgacgaaatggacatggctagcatgagcccattcaaggctacccatcctgaacaggcccatctcttcctacttccctacagcgtatccaaggtcattcgctatgtttacaagcccagaaggtccagatccgattatgatcctgatcgcttacaacgcttggtggcggattatatcaacattcttgcaaatagatatccttattggaacagaagcaaaggtgctgatcattttcttgtttcatgccatgattggggtccaagaatttcagatgcaaatcccgaactcttcaagtacttcatcagggcactttgcaatgccaacacttcagaaggattccagcccaacagagatgtgtccattccagaagtttatttgccttctggaaagttaggcccacctaatatgggtcaacaccctaataaccgcacaatattagccttttttgctggtggagcccatggtaagattcggaaaaagctactcaagcgttggaaaaacaaagataaagaagtgcaagttcacgagtaccttccaaagggtcaagactacacaaagttgatgggcctaagcaagttctgcttgtgccctagtggacatgaagtagcaagtcctagggtggtggaagcaatctatgcagggtgtgtcccagtaataatttgtgacaattattctttgcctttcattgatgtgcttaattggagaaaattctccatggaaattgcagttgaaagaatgccggaaattaagactattttacaaagtgtttcaaaagataagtacctggagttgtattcaaatgtgaggagggttcgaaggcattttgtgatcaacaggccagcaaagccatttgatttgatacatatgattcttcactcactttggctcagaaggctaaatttcaagctaacagcttcccattaa

SEQ ID NO: 14232 - DNA, 1047 bp, Glycine max
  Peptide Sequence Number=SeqID_131010
atgaaaagcaggagccacatggagatggtgaagagattcaaggtgtgggtgtacgaggaaggagagcaaccattagtgcattatgggccagtaaatgatatatacgccattgagggtcaattcattgatgaaatagacaatagcaagaggagccccttcaaggccaggaaccctgatgaggcacacgccttttttcttcccttaagcgtggttaatgtggttcattatgtttacaaaccttacatgtcgcaaaatgattatagccgtgaccgcctgcaacggttggtggaagattatattggagtggtggctgataagtatccttattggaacagaagcaatggtgcagatcattttctcctttcctgtcacgattgggcaccagaaatctcacatgccaatccagacctcttcaagaactttataagagttttatgcaatgccaacaattcagaaggatttcaacccaagagggacgtgtctatccctgaagtgtacttgcccgttggaaagctaggcccaccaaatctgggccaacacccaatgaaccgcaccatattagcatttttctctggtggggcccatggtgacattaggaaattgcttcttaagcactggaaggacaaagataaccatgtccaagttcatgagtaccttccaaagggtcaaaactatactgaattaatgggcctaagcaagttctgcttgtgccctagtgggtatgaggtggctagtcctagagttgtggaagcaattaatgcagggtgtgttcctgtgatcatttctgagaactattctttgcccttcagtgatgtgcttaattggagtcaattctccatacaaatttctgtagagaatatttcagacatcaagactatattacaaaatgttacacaaaaaaagtacaagaaattgcataggaatgtgaggagagttcagaggcattttgtgatgaatagaccagctaagccatttgatttgatgcacatgatacttcactcaatttggctcagaagactcaacttcagggtcatggcttcacattaa

SEQ ID NO: 14233 - DNA, 177 bp, Glycine max
  Peptide Sequence Number=SeqID_131011
atggagaaaagtaatgggagtaacatagaggctgtggagcatcgagagtacaacatggcatgtgccttaaaccttaaaagtagggcattgtattcagaaccttgcacgtcgatcaccataaacatttatttcagtgcaagcttgttcaaaaggaaaaatggcattttacttgcctga

SEQ ID NO: 14234 - DNA, 1050 bp, Glycine max
  Peptide Sequence Number=SeqID_131012
atgaactatattcagaccaaatgcgtggttaagcgcaaaggcaaagaaacagctgctgaaactgaaaccttgtgttttacaaagtccaaggataacaataacatgtgcgaccgccacagcggaaaacgctaccctttgttgtcgttttgggagctgccggaatacatgaaggacaacgaatacattctacgttattacagagctaattggcctttcaagcaagctctcttcagcctctttcgttggcataacgaaaccttaaatgtttggacgtgcccatttaattgggtttttactctttcttggattgaccctcgccaatttaatgaagcctacagtggtggatctcttggaactctttaccagggaacaacattactctttgatctaaatcatcaaacgcctttgacaatcgaacttcagtccacagcactggttatagcaagatggccattctttgttttcctaggtggttccatgttctgcctcctctctagcagcatgtgccacctcttttgttgtcactcccgtgacttgaacctgttcctgtggcgaatggactatgtaggaatagttgtcatgatcataacctcctttttccctcaaatctactatgtcttcctatgtgaacctcactggcaaatcatctaccttgctgggatcacagccatgggactattcaccatagcaacgatgctctctccgacactttcgactagcaaataccgcgcatttcgggccatgttgttctgttcaatgggacttttcggcattgtgcctgcaatccatgcatgctttgtgaattggagcaatcctagacgcaacattaccttagcatatgaaattggcatggccttgtcttacttgacaggaaccttattctatgtgacaaggatacccgaaaggtggaagcctgggtggttcgatttggcaggtcatagccatcaaatatttcatgctcttgttgttgttggggcattggcacattatgcagccactcttcaaatgctagagtggcgtgactcttttgggtgtgacacggttctatga

SEQ ID NO: 14235 - DNA, 234 bp, Glycine max
  Peptide Sequence Number=SeqID_131013
atggagtcgccatttgttgcaacctacccttcggcgaaagggcgaggcgaaaagtcaaaggtgcgtctaccaaaaaggaaaatgtgtgggagtcaccaccgacgtttatttgaggaaaatgttattagaaaaaataaagaaagctcgctcaggcgagctagagctcgcctaagcgagctgaaacttagtgttgaagcaatgagctcacccaagcagttagtttcttcaccataa

SEQ ID NO: 14236 - DNA, 1638 bp, Glycine max
  Peptide Sequence Number=SeqID_131014
atggctatcactgtgttgttcttggtgctgttgctgcaattgtggacagtttttggctctgaggttgtcctacagtcaagggattgtgactctgattgggtggcacattcgtattctagtcatggtcaggatctgttctacataaacggcaatgtagtgaacaaagttgctttctgtgaggctctccaattgtatattgcaaaggggtgtgatgtgaaggactactttggaagtgtcaaatgtgtggtggatgactcttttgtgaatttacctttaaaggcagggaggaaacttttgaaggatttgagcaatgaatccacaccacgaggagattctaatcctgtgtcatccaaagtagttgttattggtgcggggggagctttgttggtgtgttgtgctgttctttgtccttgtttctatgccaagagacgtaaagcaacttctcatgctgttctggccaaggacccaaattcaatggattcggtttcctccttcgaagcctccactaatgataagattccagccagtccacttcgggtgccacctagtccgtcaagattctcaatgtctccaaaactcactagacttaaatcgttgcatctcaatctgaaccaagttacaagagctacccaaaacttctcagaaacattacaaataggagagggaggttttggaactgtctacaaggccaagttggaagatggccgggttgtggctgtaaaacgtgcaaaaaaggaacattttgatagtttgagaacagaattcagcagtgaaattgaacttttggccaaaattgatcaccgaaacctggtgaagctactaggttatattgacaaaggaaacgaacgccttcttattacagagtttgtgccaaatggtacccttagagaacatttggatggtatgcgtggaaaaatcctagacttcaatcagcgccttgaaattgcaattgatgttgctcatggcctgacctatctgcatctgtatgcagggttattatgtgttgtttgtttaccgaaacagtctattgacccgacattatgctcaagtagtgatcattggtacctttttaacatatttcaatgcaatcaaccttatgtaaggggcatatctagtgagagagtgagagaaaagcaaattattcatcgagatgtgaaatcatccaatattcttctgacagaaagcatgcgagccaaagttgctgattttggatttgcaaggctaggaccagtgaacactgatcagacacacatttctaccaaagtgaagggaacagtcggttatttggaccctgagtatatgaaaacataccaactcactcccaagagtgacgtttattcatttggaattttgcttttagaaattgtgacaggccgccgtcctgttgagttgaagaaaactgttgaagagcgggttacactcagatgggccttcaggaagtataatgaaggaagtgtggtggaactggtggatcctctaatggaagaagctgtaaacggagatgttctgatgaaaatgtttgatttggcgtttcaatgtgcagcccccattcgaacagatagacctgacatgaaatcagtgggcgaacaattgtgggctataagggcagattacctcaagagtgcaaggagagaataa

SEQ ID NO: 14237 - DNA, 591 bp, Glycine max
  Peptide Sequence Number=SeqID_131015
atgtcagatccctatttcatcaaattgcaccttagcaaatttgctgcgaaggacgatttggaacaccttcaactgatgaaaaatgtctgcctcggatccatccctgaaatccacatggaatcgtgtgatgtaagttcgttattccattccctacaaattgaaacgttcttgttcgatttcgaaaacatgccaggttaccatctggtcggttcatgtaatgggttgcactgtggggttagcgaaataccagaaggataccgtgtttgtttctggaacaaggcgacaagggtgatatccagagaatcgccaacgctgtctttttccctgggcattggtcgtagaaaaatgtttgggtttggctatgatccgtcaagtgacaaatacaaggttgtagcaattgcattgactatgctctcacttgacgtatttgaaaagactgagatgaaagtttatggcgcgggtgacagtagttggagaaaccttaaaggttttcctgttctttggactttacctaaagttgatggagtgtatctgagtggaacccttaattgggttgttattacgggaaaagaaaccattcattctgaaatc

SEQ ID NO: 14238 - DNA, 213 bp, Glycine max
  Peptide Sequence Number=SeqID_131016
atggcattcttaggagagacttcgtcccagacgatcatgaactcgaggttggcattcatttttcgaaatggaaccgtcattcacaacgagtgtggggtttattttcaaagttctggtgcagtgcccataatacacaacagtcttcggctaaacaacaatgaagttgtggatgaaattcattaccggcgaccagtggaagatacagaacaatag

SEQ ID NO: 14239 - DNA, 198 bp, Glycine max
  Peptide Sequence Number=SeqID_131017
atggcaacgggacagcggggcgaatttggagacgggttcgagacggatattgagaatctcatccccgaccccgaactcgaatttggctatcgggaaaaacccgacctcgatcaactcaaattttcgccgtcaaaatcggagcggatccgaggcgggtcccacaggttcgggcctgttgttgtcatgcctagttgttag

SEQ ID NO: 14240 - DNA, 288 bp, Glycine max
  Peptide Sequence Number=SeqID_131018
atggagttagaaatgcaatgggatgggaacccaagtattatacttgatattaaaactcttcttggtgttgcactaccggtgcaggtaaaaaatattggatttacgggtgtttttaggttgatcttcaagccattagttgatgaatttcctggttttggagctgttagctattcattaaggcaaaagaaaaagttggattttactctaaaagtcattggtggcgacatatcagcaattcctggattatatgatgcaatagaggtttggactactcccattttctgttaa

SEQ ID NO: 14241 - DNA, 1048 bp, Glycine max
  Peptide Sequence Number=SeqID_131019
tgatttggagttgaagcccgaggggatattagaagtaaagcttgtgcaagcaaaggaattaacaaacaaggatatcattggaaaatcagatccatatgccgttgtatacatacggcctttacgcgaaagaatgaagaaaagcaaaacaattaacaatgatttgaatccgatttggaatgaacactttgaatttgttgttgaagatgtgtccactcagcacgtaactgttaaagtttatgattctgagggtttacagtcatctgaattgattggatgtgctcagctacagcttagtgaacttcaacctggtaaagtaaaggatgtttggttgaagttggtcaaggatttggagattcaaagggatacgaagaacagagggcaggtacatttggagctcttgtactgtccatttggcatggagaatagctttacaaacccatttgctcccaactactcaatgacatctttggaaaaggttcttaaaaatgcgaatggagtagagtctaatggaaatgaaaacgcagttacccaaaagaaaaaggaggttattattagaggagtcctttctgttactgtaatatctgctgaagacttgcctgcaacagatttcatggggaaatctgatccttttgttgttcttaccttgaagaaagcagaaacaaaaaacaaaaccagggttgtgaatgacagcttgaatcctgtttggaatcaaacatttgactttgttgttgaggatggattacatgatatgctaattgttgaagtttgggaccacgacacattcggaaagagtaaggggcaaaagaaggatttgagttgtagcaacaatgctcatgtggcaaatagggtaggaaggaaagggaaaatggaaatggttaagagaaagataacaagggagagaacatcaagactatatgggcagatgcatattgacgcttaccagggtaatactggaaggggaatacaaagaacgttttgtgctagatggagccaaatctggctttttgaatttgcatctcaagtggatgccgcaaccaattttccgtga

SEQ ID NO: 14242 - DNA, 567 bp, Glycine max
  Peptide Sequence Number=SeqID_131020
atggtggagagcagcattctggtgtttctaggtcttaagaatttatctttcataacagtgaaatacactcctcaatacatgtggcttaaagaagagctgaagcgagttgagagggagaagactccttggctcattgtgctcatgcacgtgccgctctacaatagtaatggagctcactatatggagggtgaaagcatgcgatctgtttttgagagctggttcatcgagtacaaagttgatgtgatctttgctggccatgtccatgcttatgaaagatcatatcgatactctaatgttgactacaacataacaggcggtaacaggtatccattacctaacaaatcagcacctgtttacataacagtcggagatggtggaaatcaagaaggtcttgcttcaaggtttttggatccacagccagaatattctgcttttcgagaagcaagctacggacattccacactggagataaaaaataggacccatgctatctaccactggaatcgcaatgatgatggcaagaaagtaccgactgactcttttgtactgcataatcagtactggtag

SEQ ID NO: 14243 - DNA, 417 bp, Glycine max
  Peptide Sequence Number=SeqID_131021
gaggatccatctctgaaacatattttggaggagatagagactggtggtcctgctgctatgatgaggtactggaatgatgaggaggttttgcggaagttgggacaaaccatgggagtttccttaataaacgtatgtttccgtgatgaaaatttaagagctgatagacaacttgagttcacccaactagacatggaaatgacctttactccttacgaggatatgttaacacttaatgaagaattgattagaaaggatgagggttgcgagtggatcgagtaccttttcggatggcaatgggccagtctgactaagagtgatgagagacaggatgagaatcacgaggggaggcttcaggacaaggaattggcagtacttcctggagagaagaagaatgatctacagaggatgagaagaaag

SEQ ID NO: 14244 - DNA, 1215 bp, Glycine max
  Peptide Sequence Number=SeqID_131022
atgccgcccggccaccagatcgccgtcgacgtcgaccgcgccgagctcttctgctgcgcgtgtcacgaccaggtctacgatcgcgacttcgacgccgccgtcgtgatcgctcagaccgccgcgtcaactctcggcggcgatcctccgccgccgatcccgtcgccacagccggagaatctccgaaagaagcgccgcgtagattaccggccttgggcgccggatctgcgcgagcgcgctctgatcggaagctgctctgtcccgatcgccggcgctggcaccgtcgccgatctttcgccggatttgccgcgcggattgcgcggattgaacaatttggggaacacgtgcttcatgaactcggtgttgcaagcgctgcttcacacgccgccgttgcggaattacttcttgagcgataggcacaatcggtatttctgccagaagaaaaacaacggtgacgttgacggtgctttgaagagaagtggcggcaacaatgggaacaagaatgcgcgaacatgcttggcttgcgatatggatgctatgttctcttctgtgttttctggagatcgtgcaccttatagccccgctaagtttttatacaggtctgtatatggtgatggcgtttggtggcagcacgcagcaaaccttgccacttatgaacaacaggatgcacatgagtttttcatttccatgcttgatggaatccatgagaaggtggagaaggagttgacaattgctcaagcaattagggctaattttcaaccacaacctgctgtcgtgatggtgttagctgctacattcctattgcatgaattcaagccaaaactgtggaacatctaccctgatgggatgcttgaagagatttacaagagcagaaagattgggttcccattttcactggacatgtctccttatctatcatcaacaattttaaggaatcgatttgggaataggatctttccttttgatggggatgagccggatgcttcagatgagttgtgttcagagtttgagttgtttgccgttgtcacgcacagtggtaagctagacgctggccattatgtcacttatctgcgattaagtaatcagtggtacaagtgtgatgatgcctgggttactcaagtagatgagaacattgtgagggctgcacagtgttacatgatgttctatgtacagaagatgctttactataaagcaactgataaacaggttgcctcatga

SEQ ID NO: 14245 - DNA, 2385 bp, Glycine max
  Peptide Sequence Number=SeqID_131023
atgaaaggtgttagagattgggttttctctcaaatactatccaaatcactggtctcgccttcaccattatctgccagtaatagtctctatgctggagaacatcggaatggagatgttaatgagcaagatcactcagctagttcagtatcatcacccattccttctgactcatcaaactcttcatacggtgatcagagtaatcagcatagttcctccttgcagctagtttcagatacagaaatctatcagtatcaacataacactaatggaagacggaaggatactttggccaaggttgaggagctccaagttaaattcttccgattgctccaacgccttggccagtcacgagaaaattttttggttgctaaggttctttatcggatgcacctggcatctttgattcgtgccaaggaatcagatctgaaaagagttaatcatagtagcagtagagctcgagcaatagcaagcgaacaggaagctaccggtatgcctcaactggatttctgctgcagaatacttgtccttggaaaaactggagttggtaaaagtgctaccataaattctatatttggtcaagcaaaaaccaccaccggtgcttttcaacctgctactaattgcatccaagaagttgtgggaaatgtcaatgggcttaacctaacatttattgatacccctggtttcctgccttcctccaccaacaatatgaaaagaaataagagggtcatgctttctataaagagattcattagaaagtcctctccagatattgttttgttctttgaacggcttgattttatcaatgctggttatgttgacttcccacttttgaaacttgtaactgaagtgtttggctcggcaatttggttcaacaccatcatagtcatgactcattcttcctctgccattcctgaaggacctgatggttatacttttaattatgagtcatatatttcttattgtactaatatagtacagcagcatatacaacaggcagtgtttgattctaaggttgaaaaccctgtacttttggtggagaaccattctcgatgcccacaaaatattatgggagagaaaattctcccaaatggacaagtttggagatctcaactcttgttattttgcatttgtaccaaagttttgggtgatgtaaattctcttctaaagtttcagaacagtgtagagctagggccattaaacagtccccgcattccttctatgccccatctcctttcgtctctcttacgccatcgacttgtatccaatctaagtgggactgatgatgaaattgaggaaatattactctctgataagaaagaagaagatgaatatgatcaacttccatccatacgagtgttgacaaaatctcagtttgaaaagttgcctgagccactaaaaaaagattatctggatgaaatggattacagggaaactctttacttaaagaagcagttgaaagaagactatcagaggcgcaaagagaaactactctcaacagataaaaagtttttgaatggtgataaccctgatgatcaacaggcacctactgaacctgttttgttaccggatatggctgttcctgcaagttttgactcagattgccatagccatagatatcgttgtcttgtttctgatgaccaattgcttgtgagacctgttcttgatctacaaggatgggatcacgatgtgggctttgatggtataaacttggagactactacagaaataaagaagaatgtatatgcctcagttgtgggacagatgaataagaacaaacaggatttcagtattcaatctgagtgtactgcagcttatgttgatccgttgggccctacttattctatgggtgttgatgttcaatcctccggtaaagatttcatttgtaccgttcatagcaacacaaagttgaaaaacataaagcacaatattgctgactgtggtgtttctttaacatcttttgttaagaagtactacgtgggtgcaaaacttgaggatactgtgtttgttgggaagagattaaaatttgttttgaatgctggccgcatggaaggtgcaggacaaatggcatatggtgggagttttgaagctaatttacgaggggaagattatcctgtaagaaatgacaatgtaagcttgacgatgacagtcctctctttcaataaagaaatggtgttgagtggaagtttacaatccgagttcaggttatctagaagctcgaaagcatctgtaagtgctaatctaaatagtcgtaaaatggggcaaatatgtataaagataagtagctcggagcatttacaaattgcctcggttgcaattctctcgatttggaaattcctatcacgtagaaaggaaactaagaacttggtgaaggaagtaatggactga

SEQ ID NO: 14246 - DNA, 792 bp, Glycine max
  Peptide Sequence Number=SeqID_131024
atgaacccaatgatgatcgaacctgcaaacattagttcttcgtcatccttcaatatcaaccccaaaattgttgaagaaagaatgggtccctaccacattcgtgtgataaatgaacaagtggtgaagcccaatcccagagatacattgagattcgatgtgactgttacccttcgacaattttcaatttatgactggcgtctgcgtctcataagaacctcaaccttgttggaaacttcaacatccataagcttccaaagcttgtttgaagataatcaagattttttactatcagtgttatccaacccagaatgttctcactacttcatcccaagaagctttgatcaaatatcacggaatattgtttccgttgttcaacgagccttggaggttcagagctccccttcttcggctgagtctgcagatttcgaatgcgaagggttccctttgactttagatattttcgtggacacgctggaagaagtagatgaaggaaggcttgcactaatagaagaggagtccatacagcaagaggtcgcaatgattccagcctccaatgaagccatacactccctgcaagcgttcacagatccactcttcctcaagactgaaaagtgtaatatttgcatggatgagttttatgctcaagagggtaatgaagatgatgtcaagttattgtcttcttcgtcaatgccatgcggtcatgtgtttcatcatcaatgcatcgtgaagtggctgcaaaccagtcacacgtgtcccttgtgtcgctaccctatgccctctgtccacgactag

SEQ ID NO: 14247 - DNA, 405 bp, Glycine max
  Peptide Sequence Number=SeqID_131025
atggatcctacaaccagagggaatttgttaaggcgatgctctacaggaccaagcgatctgattttatttgcagtgggtcatcacacatctgtaaataaaactttagaccgtcttagagtttatgtagcccatgacctaggtttggttgaccatggcaggcattcagttttgtggatcactaattttccgatgtttgagtggaatgatccagagcaaaggctagaggctcttcatcatcctttcattgcaccaaatcctgaagacatgaatgaccttgcatctgctcgtgcgttggcttatgacatggtttacaatggagtggagattgatgggggaagtctaagaatttataaatgtgatatacaacaaaaggttttggagattgttggcatctcaatggagcat

SEQ ID NO: 14248 - DNA, 837 bp, Glycine max
  Peptide Sequence Number=SeqID_131026
atgaggagatcagttagtggggtccacacgtgggaaatctgcagaccaagtaacaaaatgagacccattttggtcctttggcacactcacctacaactgggccaacggattccgttttttaaccggtcccgcacaacgtgcagacaaagatcaatgagtagtgtgtggtgtggtccaaaaatgtacgaagaaagtagttgctatgatcccgatgcaatgatggcagagggagcagaagactgcttcccccaaatggtttcagaatcagaggcagttatgtctgctacacccacacagacccacacccacaacacctttgcctactcctattcctgcggagaagatgctgcaaatgcaaatggcccaatagcgatggaacacccccaacaaaatccatacaattatagcaacacccaatttgtggaagagctttattcgaatcagcaatttacttatcacacaccaacaccagatctccttgaccttctccacttgccaaaccctattccaggagataataggacaaacgtctcctctgtgtcctatgacccttacttgcatctcaacctgcaacaacaacaacaacctaccctccgagagttgcttcctcacatgccggctctcagaaatgatttccccttcggcggtgccgctggaggggacgacatacaagacttcggaaatggattggtggacttcactcaacaagaagttgggaaaaggagaggtggaaagaggacgaagcagttcaccagcaccaccactgagagacaaaggagagtggatttgagtagtaaatttgatgctttgaaagaactcatcccaaacccctccaag

SEQ ID NO: 14249 - DNA, 283 bp, Glycine max
  Peptide Sequence Number=SeqID_131027
atggacatagactatgctataaggaaagacgaaccacctgcaatcactgatgaacgtagcctagctgacgttgcgctatatgagcggtgggagcgatctaaccggctcagcgtgatgttcattaagaccaaaatctcggctgggatacgtggttctgttgaccaacatgaaaaggtccgagacttgcttaaggccattgatgaccagttcatcacttcagataagactttagcaagtatcatgatcatgaagttctcttctcttcggttcaccagtgtgacag

SEQ ID NO: 14250 - DNA, 132 bp, Glycine max
  Peptide Sequence Number=SeqID_131028
atggcaggtctcgactctaacaaggaaggttcaccggagaaaaggcaaagcaaattgagatgggccgacagaatagaaaagttctgggtatgtactcatgatcaagtccaagcttatagtaataggctttaa

SEQ ID NO: 14251 - DNA, 141 bp, Glycine max
  Peptide Sequence Number=SeqID_131029
atggaggaggaaccttttgatggtgttttactgtcctcgatggagtttctcaagatacagtggtgcaacgttgctactgctgtaatgctcaggattcaaaatcactcaaaaccaataataattcaaacaagttatttgtaa

SEQ ID NO: 14252 - DNA, 234 bp, Glycine max
  Peptide Sequence Number=SeqID_131030
atgaagttatgtggtaggcaaagatacccaagtggttatccatataaacactctttcactatccgtaagactcaaagcatgatagcatgcagagacaatcgttgtcttctgcaccctttgtcaatcgcgaccaacgagctcgtggacacatggagatttacgtcatcctccgtgctttctgtcagccagacccgtgaaggcaggcggagataccccaagtggttattcgtataa

SEQ ID NO: 14253 - DNA, 183 bp, Glycine max
  Peptide Sequence Number=SeqID_131031
atgacagcaagcacggatgaagacgtaaatctctgcgtgtcgacgggctcgttggccgcgattgataaaggatgcagaagacgacggtatctccgtacgtcaccagacttcacgggtcgggatgagagaaagtgcggaagacaatgtaaatctcagcgtgttaatgggctcattggcttctaa

SEQ ID NO: 14254 - DNA, 552 bp, Glycine max
  Peptide Sequence Number=SeqID_131032
atgaatttgattggagaagggaaatttggagaggtatacaagggtttactgcagcatgggattcttgtagctatcaaaaaacgtcgtggacttgctagtcaggaattttttcatgaggttattcgaatgaataatgttctaattgctggtgatgaatttcaggttggatccaatggtatgcttgatgattgggaggagaatctggctgtaataactgcaaatagaaccaaagttgatgaagcaaactttgagtcatactcagatagcgcaagactctatctaattggagcaaatcactggaaatgtcctcgaacttatgctagtccagaggctatccaaaggaccgagttatatgaatattcaaaggtggttggaaactctcagtttactttgcatccatttcagccatataagcttatatatgcatttatgcttgctgaagtgggaaaggtttcagactcattgaagtactgccaagcactactgaaatccttgaaaaccggttgtgctggaaaacctagaattgtggaagcaattagcagtatctcttga

SEQ ID NO: 14255 - DNA, 411 bp, Glycine max
  Peptide Sequence Number=SeqID_131033
atgaacactccaagaccaaggatcagttcatcatcacggttcttgaattcctctccttccttgacatcgccaccatcattatgtattttgtcgccatcagaattgcacttttttcaagagagtgagcatgtcattatgcgagagaccatagtcaggactcgcagcggagcagtcttggaggtggtgttgcggtcgccaggtatgagctttgacgtgatgggagtagaaaacgaagggaagaagaagagagagaagctcaaggctatgccaccgcagatcactctccttccctctcttgctcttcgtctaatattcccattaacaacaaaggtaaatcatcaaagtggtggcggcagcaccaccgccttgtggtgggggtttgacagaggtgcggtggctgcacaagtttga

SEQ ID NO: 14256 - DNA, 2034 bp, Glycine max
  Peptide Sequence Number=SeqID_131034
atggacatgaagagagggatcatttctggtaatgctgcggcatccattagggtcagatctggcggtgaagggaaagggcgaaggagaagaaaagaaagttcaagaattcaggaattaagaacgctgggccggtggaccccaaaggaaacacaaagtattgctaggaaaagaaatccatatatcgcagccgtttatttcgggtgcttcaaccatccaacggtgcagattctgagaagcgaatttcgtaaccgcgtcgaagacaaacgagtaacaaacgtcacgtttctctccattctgttcattttcccgcaccacggatttttccttcgctacgaagatatccctctctttctttctcatagttttcagttttctgcgaaatcgccgatgctagaatcggagcttcacgatttatccgatgacgccgattacgccgcgtcgcagcaacaaggatctgctagcgtgatgttgcggagtgacagtgccaaacagagttcccctcggaacggtgctgaaattgtattttcgaaggacaatgttgcaattcatccgactcaatttgcgtctgaaagaatcagtggaagactgaaattgattaagcaaagttcgtccttgtttatggtaatcgctgcgcatagctcagaggccaggctgtctgataaagacagaaacctttataccataagggcggtgcccttcactgacatcaggtccatccggaggcataatcctgctcttgggtggcaatatgtcattgttgttctatcatcaggagtcaaagaattccttgctacaataaagcaacatgttcttcttgtgagatctgaagaagatgccaacgtattccttgtgaatgattttcagaatacactgcagaggactttgtcttccttggagatgcccagggctgttccccttgcatgtggaccttcaaatacatcagttgatgaatccattttgattgagaaccaagaaagagctgataatggtgccaatgatggaagatttagtgttaatcagttccatgggagaccaagacataaagtagatcctgctcgagacctctctattcaagttctagagaagttttctcttgtcacaagatttgcccgtgaaacaacttcacaactttttggagaaaaccagagtaatggatttagtcccattgacaggaggacccatatccagactaaccttgatcatcctaagtcttccaatgttgaggaaaatacctctgttgaaagtcctgttgtcttggattctcaggagttcgataatttatcgttagtatggggaaaaccaaggcaaccccctttgggttctgaagagcctcaagggtggtggtttaatcctacatcgactaaaggtatggcttatgaagagttcataaagtggaatgccttcttggattctgaaggacgagtcacagattcagaagctttgagaaagagagtattttatggtggacttgaccacgaattacaaaatgagagtatatcctcagcacaggctaaaagattcacaaaattcagggaaaggaaagggcttattgagaaagatgtggtgagaactgatagatcactcgctttctatgaaggcgatgataatccaaatgtaaatgttctgcgagatatcctgttgacatattcattctacaactttgatcttggttattgccagggaatgagtgatcttctatctccaatattgtttgtgatggataatgaatcagaggcattttggtgttttgttgctctaatggaacgtctcggacccaattttaatcgtgatcaaaacggcatgcattctcaactttttgcgctatctaagcaaatggacttcgacacccttttgaagtttattaatgagttaagtggtcacatcgatcttgatgcaaccctcagagatgcagaggctctatgtatatgtgccggtgagaacggtgctgctcgtataccccctggaaccccaccgtcgttgcctcatgaagatggttctttttacgcccaacaagaacaagatgaaatattgtaa

SEQ ID NO: 14257 - DNA, 333 bp, Glycine max
  Peptide Sequence Number=SeqID_131035
atggcgttgttgttaatcggagtgagcagaggatccgttgttcctcttcctcttctcccgttcgcctctctcctccaccatctcctcgagaaagttctccaagattgcggcaacgacatcgactccgctattagaagcttaaaccagttacgcttaggaggagcaccaccacctccttctcttgattctactctcatcgcatctgacactgctcctcctcaattccaaggtgaagcaaaatgtgatgcagaagttgcaggttctgatgatccagtagctggactaaattatcctacaaacggtgccgaatgggtagagctttttgttaattaa

SEQ ID NO: 14258 - DNA, 951 bp, Glycine max
  Peptide Sequence Number=SeqID_131036
atgaatatgaaagttgttgttgtgagcatggagaacgagaagaagaagtgcggttgctgggctgtcctcaaacgcggcgttagaggtgcgtgcaaaccttcttcagcttccagagactctcctaacactatccctcgtactagtctcgtttatgatgcagcaaccgagacaagatacttgaatgctagcaatagagaactatgccctccaaatgaagctcgattatcttctgataatcctgatcccccatctcaggagaataaggttccttgccagctccttcaatttacatttcaagaactaaaggctgcaactgggaatttcagacccgatagcattcttggggagggtggctttggttatgttttcaaaggttggattgaggaagatggaacggcaccggcgaaacctgggtcagggattacagtggctgtcaaaagcttgaagccagatggccttcagggccatagagaatgggtggctgaagttgactttcttggacagcttcaccatcctaaccttgtgaaacttattggttactgcattgaagatgatcagaggcttcttgtttacgagtttatgacccgtggaagtctagaaaatcatctattcagaagaactgtacctcttccgtggtccaacaggattaagattgcccttggtgcagcaaaaggattggccttcctccataatggtcccgaaccagtcatttatagagattttaaaacatctaacatcttgcttgatacggagtataatgcgaagctttcagattttggtctagcaaaagcagggcctcaaggagacaaaacacatgtttctaccagggtagttggaacttatggttatgctgctccagaatatgtcatgacaggtaagaatgtagcagtaggtagcttgaaaggacaagaaaactctttagtatccaatgcagcacaagaacttctgtaa

SEQ ID NO: 14259 - DNA, 690 bp, Glycine max
  Peptide Sequence Number=SeqID_131037
atggatctatctacactgttgctagctgttctcttcatcgcaggcctcattaatattttcttttacgtacccaccaccaagattggtgcgtggcttcaaactttcttattccccaacaacaatgcttgcaacaaaaccaaaaccaacttagttccttcttcctcttcttcaccaacgaccaaggtggagagtactggttcccaaaagaagaaggaagagcttagaaaagtgttctccactttcgacaaaaacggcgacggattcataacgaagcaggagctgagggagtccctgaggaacatcagaatcttcatgacagaacaagaggtcgatgatattgttgtcaagtacgattccaacggggacgggttgatcgattttgaagagttttgcttgttgactagtgagtgtgtaggagtggatcatgagaaagagggtgatggtgttattgaaaatgaagaggttgatttgaaggaggcttttgatgtgtttgataaagataatgatgggcttatttcggtggaggagttggctttggtgcttacttcgttgggactaagggaagggagaaagattgaagagtgcaaagagatgattaagaaggttgatatggatggagatggcatggtcaattttaacgagttcaagagaatgatgatgaatggaggaaagtttttctttaacgcataa

SEQ ID NO: 14260 - DNA, 825 bp, Glycine max
  Peptide Sequence Number=SeqID_131038
atgaacacttctgtactgaagcccggtgcaaccatcggcatcatcggcggcgggcagctcggcaggatgcttgccatggccgcagcgcggctcggcttccaaaccgtgatactggagccgcaagtcgattgcccggcagcacaggtcgccaatcgccagatcgtcgcggtctatgacgatccgaaggcgcttgcggagcttgccgcagcttccgatgtcattacctacgaattcgagaacgtgccggtgagcgccgccgaccggctggcagaaacggctctggtcctgccgccgcccgcagcgcttgaagtctcgcaggaccgctttgccgaaaagcagttcctcaatgaaagcgatatcgagacggctccctggcgcctcgtggacgatgaagaatccctgatcgcggccctgggagcgcttggcgagcgcggcatcctcaagacgcgacgtctgggctatgacggcaagggacaggtccgcctgacctcgctcgacgagagcgaagcccacaaggcgattcttgccatcaatcgcgccccggcgatcctcgaaagcttcgtcgatttcgaacgtgaagtctcggtgattgcagcacgcgaccggtctggaaacgtcgcaatcttcgatattgccgaaaacgtgcacaaggacggcattcttgccacctcgaccgttccggctgcgatttccgagaacacagcggaagctgcccgcaaagccgctacaaagcttttgaatgcgcttgattatatcggcgtgctggggctcgaattcttcgtcctgaaggacggaacgctgctggcaaacgagtttgccccgcgt

SEQ ID NO: 14261 - DNA, 648 bp, Glycine max
  Peptide Sequence Number=SeqID_131039
gttaatccgcacactcaccaggttaaaatatgtgactttggaagtgcaaaagtcttggtgaaaggcgaaccaaatatatcgtacatatgttctagatattatagagcacctgagcttatatttggagcaactgaatatactacagctattgacatttggtcagttggctgtgtattggctgagcttatgcttggacagcccttgttccccggtgagagtggagttgatcagcttgttgagatcatcaaggttctgggaactccaacaagggaagagataaagtgcatgaatcctaactacacggaatttaaattcccacagattaaagcgcatccatggcacaagatctttcacaagcgcatgcctccagaagctgttgatctggtatcaagactactacaatactcccctaacttgcggtgcactgctttagataccttgacccatcctttctttgatgaacttcgtgacccaaacactcgcttgccaaatggtcgtttccttccaccattgttcaattttaaatctcatgttctggctgatgttcttgctgcccgtgtaccagaattgaagggagtcccagttgagattttggtgaaattgattccagaacatgcgaggaagcagtgcccgtttcttggcttgtga

SEQ ID NO: 14262 - DNA, 438 bp, Glycine max
  Peptide Sequence Number=SeqID_131040
atggaatcaagcaatgtgaagaacaagtcaagtggaaaaagaaagatgtctagtgaggacacaagaagttactttgcatggaacttggaaattgagcgtgtgctagctgatgtgcttagagatcaaagaaatttgggcaataaagtcattcctaattgggatgatattgttgacctatgtgcaaaggatagagctactggactcggagcagaaaatgcattagatgtagatgatatcatgagcaaagaaacaaatgaagaggaagcaattcatagtgcgagttttgacttagagggatcaagttccgccacaagaaaaaacattcgtccaagtaagagtggagagaaagaagggatgatttcctcaatgaaagaagtagttgagtcattgaaagaatttgttgaagtgactaagaagaagatggagaacaaaaaatag

SEQ ID NO: 14263 - DNA, 579 bp, Glycine max
  Peptide Sequence Number=SeqID_131041
atgtctgtgtctttctcttcaacctcggtttcgttctcggaatcctcatttgcattccaaagacctgctccagcacatctttgctcaaattcactcaccgttgcatcgaacaactttcattcagcaacaggtggtggtcgtcttgtgctgaatgttggaggcacctgcttgtgtcgaaagtttcgtggtttgaaactgtggctacttgagagactcagcttccaattccagccaccaaagcaacctaagaatagaaaccatcacttcaggaataatttggaaaatgaaaagggatcggtttctgattcatcttcaaatcttcgtgttcctgatgataaggtcactccggtggagtctctatcgttgctgcagacaggtttgtctggtactcccgtggatgttggcagaaagccctcactttgtattgctgtcataggagccaccggtgagctggcaaagaggaagattttccctgctttgtttgccctctactacagtggctttcttcccgaggattggacatatgcgagtggtccgataacgagtagctcgacaggcttaataacaacactagcataa

SEQ ID NO: 14264 - DNA, 1251 bp, Glycine max
  Peptide Sequence Number=SeqID_131042
atgatgggttgtggcggtgcaatctcagtgtcactgctgctgctgcttctctcttgttttacagaaatagccttggctggctgcgataaggctccagtgctgttcgtcttcggcgattccaactcggacacgggtggactcgcctccggactcggtttccctataaatcctcccaatggccgcaatttctttcacagatccactggccgcttgtccgatggtcgcctcctcatcgacctactctattccaacctcggaaccttccatctcccctcctgcaccctgtcctcccttccctccgattccgaccaattcgacatcgagcagccacgggtcacggagatcgagggccaaatgccgcacctctggctagtgacgacgtgcgattacgaggttggtggtggcctgagtttgaatgcaagtttgttggtaccatacttggacgccttgtctggaacctcattcacaaatggagcaaactttgcagtggtggggtcctctactctcccaaaatatgttcctttctccctcaatatacaggtcatgcagttccggcgtttcaaagctcgctcccttgaacttgttaccgcaggtgcaagaaatttgatcaatgatgaaggcttccgtgatgcactctacttgattgatattggacaaaatgaccttgctgattcatttgccaaaaatctgtcatatgcgcaagtcatcaagaaaatcccagcagttataactgaaattgagaatgctgttaagaatttatataatgatggtgccaggaagttttgggttcacaatactgggccgttgggctgtcttccaaaaatactcgcactggctcagaagaaggatctagattcattgggatgtctttctagttataactctgcagcaagattgtttaatgaagagctgcttcattcaactcagaaactaagatctgaactgaaagatgctactttagtctatgttgatatttataccattaagtatgacctcatcacaaatgccgcgaaatatggtttctcgaatccgttgatggtatgttgcggctatggagggcctccttacaattttgacgtaagggtgacatgtggtcaacctggttatcaggtttgtgatgaaggggctcggtatgtgagttgggatggaattcatcaaactgaggctgcaaatacattgatagcttctaagatactttccatggcttattccacaccacggacaccttttgatttcttctgccaccaatga

SEQ ID NO: 14265 - DNA, 441 bp, Glycine max
  Peptide Sequence Number=SeqID_131043
atggaaggagaagaaagaaggaagagaaaaatagagaatgaagaagaaaatgaggagcagaagatggaaaagttctttgccttgataaagaggacaaaggatgttcgcgatcgtttctgtaaggagaaattaacagatactaagaagattgatggagaaagggcagctgcagtgagtactatttggaacccaaagtttcaaccagaagacttcatcgattctggagaaacggcaaagagaaataatattattaatattgtttcaggtcatgatcatgcagctgttccttcagagaaagaattgatcatagaaaagaaacaagatttacaagaagcaaccacggcaacaccagcagcagcccaagataatgaagagaaagacaaagcaattttcgttgctcttgatcatgattttgaccctaaagtggttgttgtacattga

SEQ ID NO: 14266 - DNA, 470 bp, Glycine max
  Peptide Sequence Number=SeqID_131044
gtccagacatagtaaggattgacagactgagagctctttctgattctatgggtggtggtgcatggccgttcttagttggtggagcgatttgtctggttaattccgttaacgaacgagacctcagcctgctaaatagctatgtggagatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttcgtgcgccaaggaactcaaatctgttaa

SEQ ID NO: 14267 - DNA, 318 bp, Glycine max
  Peptide Sequence Number=SeqID_131045
atgccggaagttgaaagggagcattgtcgtgcaatccgtaaagttctgcaacatgccggacgtcaaaaaagagattactgcgtaatccgtaaggtttcacgacattacggaaagaaaaacagtttcgaagcagggttgcttctggaggaagcaacccagctcggcgtgctgggcgacaacctcctccccctttttcctataaataggcgaaagggggttgttccaaatatccctaacccccttggctatgcatttcagctgttttgggtgaaaaaaattgtttccgtgaagaaaatccaagccaaggtgcttccgtaa

SEQ ID NO: 14268 - DNA, 1074 bp, Glycine max
  Peptide Sequence Number=SeqID_131046
atgtcaccgggcggcggtgcacaggacagcgacggcaacgtgctgatcggtaactttgcgctgttcggctcgaccggcggtcgtctgtttgttcagggccaggccggtgaccgtttcgccgtgcgtaactcgggcgccaccgcggtggtggaaggcgtcggcgacttctgctgtgaatacatgaccaacggcgcgattcttaacctcggcacctttggtaaaggtttcggtaacggcatgagcggcggcttcgcctatcagtacgatccgtaccgttccctggccgcgcacgccgccggtgattcggtgctgttcggctccatcgctgacgaagacgaaatggcgcaggtgcacaagcaggcagtgctgaccatgctgcactggcacctggaagccacccagtcgccgcgcgcggcgtggctgctggagaactgggaaaccgagtgtcagcacttcgtttacgtcatgccgcgctcgctgctgctgtatcaggacggcggcgagatcctgaaagcgaaaacgcgtaaggatctgctggaagagctgtccacgtcgctggccgcgcatcaggttgccaagttcaaatcagcctggcgagcgggcaaaaccatcgccgacggtgcggtaccggcctacggcgcgaccgatacgcaggagatgtttgttctgctgaataattacaccgttctgagcttcgcgcagcagctggcgctgggcaaactgccgaaaggcacagcggtggaagatgcggcagtcgagaaagcggttcgcaacctgctgatgaccgaagatttcgcgctggtcagcaagctgcagcgtcatgcccgtgcggccattgagaactacagcgatgatgagctggcaagcctgatcgccgccaagcgtatgtcggattacaaagccgcgctgacgcagcgcaacattcgctccatggacagcctggcaacctatggctggatcatttatcaggacgcctgcaaccgtgaggtgctgggccatctgcctgattttgaagagctgtttgcacgcgctgcactgccagagattgccgccgcggtcgggaaactctcctga

SEQ ID NO: 14269 - DNA, 1071 bp, Glycine max
  Peptide Sequence Number=SeqID_131047
atgaagattccttacattcctgaagacgcgccgtttaacggcgaacagaaatactggctggcggggtttctcgccggtctccactcgcgcctgctggtattagaagataagcagaccgcaccggcagcgggcgccagcgccaccacccagctgcatattctgtttggttcccagaccggtaacgccgaagcgctggcgcagaccgcagccaaagcggcgcgcgctaaaggcctggtgccggtagtgcaggcgctgggtgaagtggatctggatgtgttcgccaccatgcgtcatgtactgatcgtcacctccacctacggcgaaggcgaaatgccagacaacgcacagctgttctggcaggccatctcagccagcaccgcgccgcgtctggagcagatgcactttgccgtgctggcaatcggcgataccggctacgacggtttctgccaggccggtaagttcattgatatgcgcctggagcagctgggggcgaaacgcgtggtggatcgcatcgactgcgacatcgattacgaagagccttccagcgagtggattggcagcgccatgccacagtttgccgcgagcgcgggcagcagcggcacggtgctggagagcgcgccggaagcgccggtgatcccgggcagcaacaagcaaaatccgtacgcggcggcgctggtgaccaataagcgtctgtccggcgagcagtccgccaaagatatccgtcacttcgaatttgacctgagcgacagcggcctgaaatacgaagccggtgatgcgctgggcgtgatcccggtgaacgatgccggtctggtgagcctgctgctgagcgagctgaaagccgactacgaaaccccggtgccgggctttgaccgtaacctcggcgatctgctgacctatcagttcgagatttctgagccgtcgcgcaagctgattgagtgggtcggacagcacaccaccaaccaggaactgctgcacgtcctgcagcacgacgataaagacacgctggccaactggctgtggggcaaagatacgctggatctgctgcagctcgagctgaagcgcagcctgtcg

SEQ ID NO: 14270 - DNA, 225 bp, Glycine max
  Peptide Sequence Number=SeqID_131048
atgacaatcagaggaggagatgggggaactgcttcaagctcaggcgaaaaaggtggattcaccactggagattgtgggttagctggctctgaattcacctgcacaggaactaaagttagtgagctttggatatcctatcctacagttactgacagaggagttggagtggatgacgaagggatgtcctctgttctagctctttttcttgattccatctgtaactaa

SEQ ID NO: 14271 - DNA, 462 bp, Glycine max
  Peptide Sequence Number=SeqID_131049
atggatgaagatcaagcttgtctatttggggatgtggcattaagttcttttcgtccaaggattctcattgtttcaacgccaaattttgaatacaatgtagtactccagaagtcgaatcctccaacccaagaacaagaggaatcagacgagaaaaccctcttacagtcatgtaaatttcgtaatcatgatcacaaatttgagtggacaagagagcagttcacccaatgggcatgcgacttggctgctcggcacaattacaatgtggagtttagtggggttggtggttctgctgatgttgaacccggctatgcttcacagattgccgtgtttaaaagggattggaaacttgaagatgatgtaatcggattgccggtgtttttgaaagcagacaagcaggatagattgtggatgctaggagagaagagaaagagaatttacaggtttaggcagggcactgattag

SEQ ID NO: 14272 - DNA, 807 bp, Glycine max
  Peptide Sequence Number=SeqID_131050
cagccagaggataactttactatagaagagaattataatgagaataaggataagaatgatgttggtgacaacacggatgcagaaaaagcaaatgatgatgatgatgatgtagtggatgaccatcaagaggaagcaaagtacttaccagaggatgatggtccaacggctacagaggaacaacactacaaaggtccagtcacaaaagatgcagatgaaaagaataagcctcctacacgacatttcatccatggatatcacttgatccaaggacagatgaatcaacacaggaatctcgatggttatgacttagggttgtatgcaatatttgaaggtcactccgtgcatgctgttaagaaagcatgtaaagccatggatgatgagattttagaaagcatagctgattctcgtggaggatcaacagctgttgcagcaatactaattaatggagtaaagctactggtagtcaatgttggtgattctcgagcaatatcatgcaaaaatggtcgagcaaaaccacatactgtggatcatgaaccagagaaggaaaaagatcttattgagagtagaggaggttttgtgtctaagaaaccagttagggaatgttcccagagtggatggccaattagcaatggcatgagcatttggagatggaaaactgaaggagcacattacggcagaaccattcggaagatcgatgaagacactgaattcatcattttggcaagtgatggcctatggaaggtacgaggatattgcatgtatcttatgattactgatgaggacactttggctgaagtagagcactaa

SEQ ID NO: 14273 - DNA, 1939 bp, Glycine max
  Peptide Sequence Number=SeqID_131051
ggcttgctatgtggtggaggaagtgaaggagcttcctcaaactgaatgtccaggattgagtattccacaaatgggtccttgcctttatcgttgcacattgcagcttccagaactttctgttgtttcagggacctttaagaaaaagaaggatgcagagcaatctgcagcagagattgctatagagaagcttggcatttgtacagaggccattgatcccactccacaggaagcacaagaaagtttagtatctcgaattgcctacatattttctgaaaagtttgttgtatgtgatcatccactcagtggtcacattcgagcaactttgttgaggaaaggtgatctttgtggttccattcctatttctgtcattgctttctatgatgcaaagcttttcagcttgtgtaaatgtattaatcctgaggtggagtcaaacccatttttagttatttcatacataatgaatgccactgcaaacttacaccagtttcttgctacttctgaacgacatctctggattagaaggctgagtccatatccacaagatattatagagtcattgatgaaagaaaatggttctcaagaatgcattcaggttactgccgtacacattcctagttcagtggaacaatctattgaagcagtgactcttcatatttcttcaagagaatattaccttgatatcattgcatatgaacttggttttgaagatgcctccaatgttctgatttcaaggaatttgggaaaagcttcttctgagacaaggctgttctttactgcttcaaaatcatatctactggatctatcttctaaatttccaaatggaaaagaaaccctttatttaaagggatctctgaatgtaagggcaagttacttcgcggggcaagatataactggtgatgcaatattagcatccattggatatacacggaaatctagagatcttttctatgaggatgttacggttcggttatattacaggcaatgctcgcatctgagttgccatcaagattcacctcaagagcaaactggaggggttctcttcccagggatatactttgttgcagaatctgatgagaatgtgattgaatgtgtcaatggggattgttataagaagcagaatgatgctattcagaatgcttcattgaaagttctatcatggctgaacatgtgttttaggagtatgattctcccttttgagcagctttatgagactgcagacaactttaatattcagatctatttcaaaaacattatcagagatattttagcaggccaatcaactcacaatggtcagcttaatggaattcaatgcaataatttagttgaatcaatctatatgaattcttcatgtgacatgctgggaaatatagtgcactcgttaaagattgaaggtccatattctggtgtctgtccatccaatggatctttaccttgtataaggtattcagtttctttggctgtagagggtgagaatctgaaagaagttattgaagtttgtgatgagtttgagtttgaagtgggaattggtgctgtggtttcctatgttgaagatgttgtgatgcagatgtctgttggtcagtgcgcttatttctcttcaaacttacttactactgagttgatttttgcttcagctggtgattcagtcaaaatgctggcctcgttatcttctaaagactgttgtatggaatatgaaataagtttgatcagggttgctgaacctcctgaggaaagaatggagcaggctctttttagccctccactttcaaagcaacgagtggaatttgcagtgcaacaaattctagaatcccatgctactacgttgattgattttggatgtggttctggaagcttgttggaagcattgttaaattatccaacgtctttaaagaaaatggctggtgttgatatttcacagaagggtcttagccgtgctgcaaag

SEQ ID NO: 14274 - DNA, 1179 bp, Glycine max
  Peptide Sequence Number=SeqID_131052
atggacgacgtcgtagctttctgcactttgcttttcgtttgcttcctccattccgtgagagggattttagaccccaacgatttcctcgctctgcaatccattcggaaatcccttcacgacgttcccggttccaatttcttctcctcgtgggacttcaccgccgacccctgcaacttcgccggcgttttctgcgccgacgacaaagtcatcgcactcaacctcggcgatccgagagccggttcgcccggtctgaccggaaaactagacccttccatttccaaactctccgctctcgccgacttcaccgtcgttccaggaagaatctacggtcctctccctcagtctctctctcagttgaaaaacctccgcttcctcggcgtcagcaggaacttcatctccggcgagattcctgcaggtctaggtcagctccggaacctcaggacaatcgatctcagctacaaccaactctccggagcaattcctccgtccatcggaaaaatgccgcagctaacaaacctattcctctgccacaaccgtctctctggttcggttccttcattcgcttcggcttattccctgacccatcttgaactcaaacacaacattctctccggttcgctcgcacaggattctctccctgcttccctacagtacctctctttatcatggaaccggttcactggaccggtcgacgggctcttaacccggctcaaccggcttaacttcctggaccttagtttaaaccagttcacaggcccaatcccggcccaaatattcacattccctctcacaaacctccaactcgaaagaaaccagttctccggtccaatccaaccgtttaacgaggtgatgatccagaccgttgatctcagctacaaccggttatccggtgaggtgtcgcccatgctagcgaacgtgcagaatctgtacctgaacaacaacgggttcacggggcaggtaccgggcagcttcgtggagcggttgttagcggcgggcattcagatactgtatttgcagcacaattttctgaccggaatcgcgataagcccgacggcggagattccggtgagcagcaccctgtgtttgcagtataactgcatggtgccgccggttcagacggcgtgccccttcaacgctggcagaagaaaaataaggccacctcagcagtgtaaccgctaa

SEQ ID NO: 14275 - DNA, 1995 bp, Glycine max
  Peptide Sequence Number=SeqID_131053
atggcagatttggaaaacatgcttcttgaggcagctggaaggactagttctccggtgagcaagcggcccaagccaaagaactcaaaggccaaacgtgagggtggtgctggtgcagcattctctgatggtggaagtgactccagagatgaaaactctgatgagggtgcaggcaagaaaccacagaggtattcatcccatgttcctttgaagaagagattggacatgaacaaaagaggtaataataataatgaccgtggtggggctgagttggaggatggagttcctgatccagatagagatggtggcagcagtgaagaatctgatgttggcagcgatctctacaaggacgaagacgacaagcagaagcttgcaaatatgacagaacttgaaagagagatgattttgtctgatagagcaaccaagaaatgtgaaaaggaattcaagaaaaaaatgagagtgaagagggaaaacaaaaaagcaaatgcaaagactactactactaatactactactgcaaattcatctcatcatccttcttctgtcaaggttcgttcctcggctagacatgctgaaaggacggcttcaaagggagacgtactaagcgaattgcgcgcgaaaaggaagaagcaacaagtcttagaacctcgtgataaattgcgaaatgctttaggaacaggctcaagtagcaagcagaaacccggaatcacagcaagtccaagtagctctagtcagagtgagagtgcttttcggtcagacagcgaaagagactcgtctgatgatggtggattgggtgacagtgatgatgacaagagcatgcatgaatcgaagatgccaacatttgagaacataagggacatcaccattaggaggtcgaagcttgtgaagtggttgaatgaaccattttttgatgagttaattgttggctgttttgtgagaattggcatagggaagttagaaaatgtacctgtctataggctctgcattgtccagagagttgatgggggtgacccaaataagcattacaaggtagagaatagagtcactcacaagtacctagtttgtgtgtggggcagtgataactctgctaaaaagtttcagatggctgtagtttcagattctgcaccattagagaaagagttcagacagtgggttagagaacatgagagaacttgcagccagatgccaagtaagatgagtgtgttggagaagaaggaggccataagaagaactagcaagtatgtttattcagctgccacagtgaagcagatgctagaggagaaaaaatctgttccatctaggccactgaatgttgcagtggagaaggatcggttgaagaacctgttggaggtagcaaaaagtaagaatgatgaggcagagatggataggatcttgaaaaagcttgtggaattggaagcatctcgtagaacctgggagaatgatgccaaggctgtgaggctggctgagatgaacaggaagaacagggttgagaacttcaagatgttgtctgaacaaaaacagttcaatacaaatttgaaggctggagaggaaggcgttgatcccttttcgaggaggtggacgaggtcgaggaattactatgggaaagaagctgagaagaatgaagataaaagagaaaaggatggtgaagttagtaaggtgggagaaaaagaacaagaaaaaggaggtgttacaacaaaggttggtgttgaagtcacagaattggcattgcaagctgctgctaatgcagggaagttgattgataccaatgctcctgtagatggtggaacagaattacatatgctgcatgattttgacttgcctatctctttggccgaactcaagagttttggtggaccacagggactcaaaaatgggtttctggcaaggaaacaaaaaatagaagcaacagttgggctccaggtttctgagaaggatgggagtaggcatgctcttacattatctatcagtgactacaagagaagaagaggacttctgtga

SEQ ID NO: 14276 - DNA, 114 bp, Glycine max
  Peptide Sequence Number=SeqID_131054
atggttgacgatcaaaatagccattttaaaatggctgacatgtgcccaatgcaactagaggcaattgcttcaggtctacagtggcatagaccacaagtccccgtgatctcctga

SEQ ID NO: 14277 - DNA, 195 bp, Glycine max
  Peptide Sequence Number=SeqID_131055
atggatgtgagtcagttgcagaggaagcaccgtgaccatcaaaccgctatgcttcgcgagggatttctggaagatcagttcaatcagcttcagaaactgcaagatgagagtagtccatattttgtgatggaggttgtgaccatgttctttggtgattctgagaaacttctaaatagcatcgcactagttctgtga

SEQ ID NO: 14278 - DNA, 1959 bp, Glycine max
  Peptide Sequence Number=SeqID_131056
atgaaaccatcccctaagattctcatcggttacaagaattcatcgtttcttgcaagatgtcaccatactcttgccatgtctatgtctaactactctaactcttgtgacatcaatatttatcgcaacaccatgcagtgtccttttcacatgcgcgaattcggacgcataatgcatggtaaccaccaagtttttgggttaccctcttcgagttttggccaatcaaggtcccttagtttaagctcaacaaaacgggatgcctcttccattgccggagttgacttaaacttcaaggctcgtgacttctccggctcggtcgggacacgcgtggatgacaacaatggtgaaatggcctacgttaagggtggcatgaatgtgaagccaatagtggtggaaagtgttgaggaagagtctcggttagaagttggcgaggaagacgagaacaaggagaactcgggtggcgtaaagaatgcagatgaggctgagaacgtacaagaggaaacagaagcggagaaagaggcatggaggttattgcaggaggcacttgtgacgtattgtgactcccccgtggggacagtggcagcaaatgattcggatagcgagcaacctttgaattatgatcaggttttcattcgggattttatcccttcggctcttgctttcttgctcaagggagaaaaggacattgtcaagaactttctccttcacaccttgcaactccagagttgggagaaaacagtggactgctatagcccaggacagggcttgatgcctgctagtttcaaagttaaaacattgaaacttgatcatgaaaaaacagaagttttagatcctgattttggggagtcagctattggtcgtgttgctcctgtagattcaggattgtggtggatcatgctgctgcgggcttatgggaagattactggggactacggcttgcaagaaaggttggatgttcaaacaggcttaagaatgatccttaacttgtgtttaacggatggcttcgatatgtttccttccctgttagttactgatggatcttgcatgatagacaggaggatgggtattcatggccacccccttgagattcaagctttattttactcagctcttcgctcggcccgtgagatggttactgaagatgaaaactccaaaaatctggttggagaaattaacaacagactcagtgcactatcattccacattagagaatactattggttggatatgcgaaagataaatgagatatacaggtacaaaacagaagagtactcattggatgccacaaacaagttcaacatctatccagatcaaatccctacgtggctaatggattggattccagaggaaggaggatatctgttagggaatctgcagccagctcacatggatttcaggtttttcatgctaggaaatctttggtctattgtttcctctttgggcaccccaagacagaataatgctattttgaatctgatagatgcaaaatggggtgatctcgtgggggaaatgcctcttaagatatgttatcctgctttggagcatcatgaatggcgaataattacgggctgcgacccaaagaataccccttggtcatatcacaatggtgggtcttggccaacccttctgtggcagttcacacttgcatgcatgaaaatggagagaactgaactagcagagaaagcaattgccttggctgagaaaaggctgccacgtgattcatggccagaatattatgacacacgctcagcaagatttgttggcaaacaagcccggctttatcaaacttggactttagctggtttccttgcatctaagatgcttttgaagaatcctaaactggcttccttgttatgctgggatgaggatttggagattcttgagacatgtgtttgtttacttcataagagtggcaggatcaaatgctcccgtgatgttgctaagtctcagattctcgtgtga

SEQ ID NO: 14279 - DNA, 366 bp, Glycine max
  Peptide Sequence Number=SeqID_131057
atgaacaacttgggtcaacttaaaccgatcggatctggcggcggagcaccggtggggagaagcttcgggaacgacaccttccggcaaccagggattaactttccgagaacgcgcgccttcttctgcaccgccgttcttgaccttcttgtggtgcctctgcctctgcttcctccaccggccgaacggatttgcgagaatggcgcggctccagcgagttcggcctttggcagtggcggcgaggacgcggtctgcggcggcgcggacttggagggaggcggtagggttgctgttgcggcggagcgcgaggaggaggttggaagagtagaggcggtgttgggtatgggaagtccagggagtgagagctaa

SEQ ID NO: 14280 - DNA, 2190 bp, Glycine max
  Peptide Sequence Number=SeqID_131058
atgaaaaaaggaaaggggaagaacaacggcttattgcccaattcgttgaggattatctctctgtgcctcaaaactgtgtccaccaatgccaccaccgttgcttccaccgtgcgctccgccggtgcctccgtcgccgcttctatttcgtcttcttctgaggatcacaaagatcaggtaacctgggctggttttgatacactggagcttgatccagctaacttaaaacgtgttcttctacttggttatctgaatggatttcaagttcttgatgttgaggatgcctctggcttccgtgaactggtctcaaagcgcgatggtccagtttcttttttacagatgcagcctttcccagtaggttgtgatggccaggagggattcaggaagtcgcaccctttactgttggtggtttccggggatgacactagcaatgcaaaccagaacagtaccagtttgagtggtttaggaagggatggtaactttgagactcaaccggggaacaatgtcaactcttcaacagttgttcggttttactccttgaagtctcactgttatgttcatgttctgaggttccgttcaactgtatgtatgatcagatgcagctcaaggatagtagcggttggtcttgccacacaaatatactgctttgatgctgtgactcttgagaataagttcagtgttctcacttatcctgtttctcaattcgctggacaaggaacaactggtgttaatgttggttatggtccaatggctgtgggtccaaggtggttggcatatgcttctaacaaccccctgccctctaatttaggttgcttaagcccacaaaacttcagtgattctccaggaattagtccatcaacttctccaagcagtggtagtttagtggctcgttatgcagtggagtccagcagacatttagctgccggaataatcaaatactgtcaagagctgcttcctgatggttcctcttctcccatacaatcaaattcaggtgtgaaagtcaatagggttacaggaattgatgcagataatgcaggaatggtagtcattaaggattttgtttccagaagtatcatatcacaattcaaagctcacactagtcctatatctgcactatgttttgaccctagtgggacccttcttgtcactgcatcagtctatgggaataacattaatatatttcggataatgccgtcattcacatgcaagagttcaggcattccaagctccaattggaactcttctcatgtgcatctttataaacttcatcgtggaataacaccagctatgattcaggacatttgtttcagtaattttagtcagtggattgcaattgtctcatccaagggtacttgtcatctttttgttttgtcaccctttgggggtgatactggttttcgaattattagttctcagggtgaagaaccgttcctactccctgttttttctctgccttggtggtatactccagcttccatttcttatcagcaatctctgcctcccccagcacctgttgtcctttctgtggctagccggataaaatatagtagttttggatggcttaatactgttcacaattcttctgcaaatgtgacaggaaaagtttttgtgccatctggtgccattgctgccatctttcataattccttatctcactcgcaacagcttgttaactcaaaggcaaaacccttagaacatatattggtttatacaccttcaggtcatgtagttcaacatgaacttctggcatctgttggtttaggaacaactgataatggtttgagaaaccagtcaacttcactcttgcatatgcaagaggatgagttcagagtcaaagtcgaacctattcaatggtgggatgtatgtagaaggtcagaatggccagaaagaggggatacttgctgcaatacctttgatagacaaggaggtattgagagagttcaagagaaaataagttatagtgatgtccatggattgaattttttgggcacaagagatagggcaggggaaaagatggtaagatcttctaatgagaatatgcacgacaggtttcattggtatctgtctaatgcggaggtgcaaaggaattttggaaggttacccatatggcaaaagtctaagggctatgaatttgtagttaacaattttgcttcttcagatttgttgctattcaatgagttgtgcgggagctag

SEQ ID NO: 14281 - DNA, 213 bp, Glycine max
  Peptide Sequence Number=SeqID_131059
atgccccaaccacatgggatcaacatgggcttaaaggagcactcaaaccgagtatctttacccccaaggcctagactccgaagaatccgtttgggcctcaccttcctgattcagacactgtttatgagttatataatacccacgacctcactcttatattccaacatatttaacaaaatgcgctacagtttaacccttcaggatcctaactag

SEQ ID NO: 14282 - DNA, 636 bp, Glycine max
  Peptide Sequence Number=SeqID_131060
atgaatgaggcagaagatgcgctagctggattgcaagctgtcaaagctgcacaaatgagatgcatagctgtaaggaccacattatcagatgagactctagaaccagctggcccgacacttatccgagataacataggaagtgtttcgcttgatgatattctcagtggtggctctgttggatataataagaggatgcagggctctgaaacactaaataattttgcagagtcttcatctactgtgcttgctggagggttgcagggttctcggcaagatatactgagatttggaagtctgggaattgctatctcttgccttttcttcaccataagcaactggaagctgattgctatacagcaggcaatgcaatatgcttcccctaaagcagtttggaatcagttttttggtgttacccagccacccttggagcagaaagaagataactcaagagatgataggatccagcaatttgagaactacatatctgatctggaaagcaggatttcaaaatgtattttaggtgaaaattgtgagaagagactggggggtgtgagaagaagaggctgggggacaggcgtctggctgccctgcgctagctatagcgcctgcagcaggggcgccaccagtagtgcctga

SEQ ID NO: 14283 - DNA, 1504 bp, Glycine max
  Peptide Sequence Number=SeqID_131061
atgttgtccatgtccctccctttctattatttctacatcttttacgttgtttttctcctaaccttgaatattttcccaccagcttccctggccgcaaacaacaccctcccatgtcccctgaacataaccgtcctccgcgtggtgagcggcgggcggcggccgtcgttcgactcgggaacaaagtgccactacatcctgcaagccctccacctcctccaggccgactacctccgtcgcagcagcctcttcgttccgccgctaaacacctcggagtcctgctggaacacctttcagtccttcatcaacgaggccgaccccagcatctccgacatccgctcctcctgcggcttcagaaccgagtggatctcccagggctgcatgaacatcaccacaaaacaacaattcgaagacattgttccccgcaacgctatccaacccgtccaagatgactgcaaccaacccctcgagaacaacgccccctgcgccctctgcaccaccaagctctccagcatgctttcctacttaaccggaacaacccaaggtaacgtcaccgactgcagagcctatactcaaatctacgccgcttctctctctgatcagtacggtgtcaccgatcccggtacctccaagtgcctcttcggtctcgatttttcctcttccggctccggtggtaagcgacgaagaactattgttattgcggttgtttccgttttctgtgtggtttctttgtctgtgtttgcttccctttgggcttatttaagattcaagaagaggctagaggttgagaaaaggaagggtgctggaatatctgagttaggtttgggttctggcttggattcaattaaccagagtaccactttgattaggttcagttttgatgaaattaaaaaggctaccaggaacttctccagggataacattattggaagtgggggttatgggaatgtttataaagggatgttattggatggtagccaagttgcttttaaaaggtttaagaattgttctgttgctggggatgctagcttcactcacgaggttgaggttattgcgagtgtgaggcatgtgaatcttgttaccctaagaggctattgtactgctacgaccaatttggaaggtcaccagaggattattgtcactgatttgatggaaaacgggagtctttatgatcatttattcggttctgctaagaagaatctcacttggccaattcgtcaaaagattgctctagggaccgctagggggttggcttatttgcactatggagctcaaccttccatcatccatagggatattaaggctagtaacattcttctggaccacaattttgaagccaaggttgcggatttcgggttggcaaagttcaaccctgaggggatgactcacatgagtactagagtggctgggactatgggatatgttgctcctgagtatgctttgtatggacaattgacagagaggagtgatgtgttcagcttcggtgttgtgcttcttgagctcctga

SEQ ID NO: 14284 - DNA, 1914 bp, Glycine max
  Peptide Sequence Number=SeqID_131062
atgagttcttcgctacctcaagttgccaagaacaaagcaatgtggctgcatcctaaggttttgggttttaatcctcctgaaagatggggccactctgcttgcttctccaacgggcttatgtatgtctttgggggttgctgtgggggactgcatttttgcgatgttctcacattggaccttaacaaaatggtttggagcaagcttactaccacaggtgaaaagccagggccaagagatagccatagtgctgtttttgtggggcataaaatgatagtgtttggtggcacaaatggcttcaagaagatgaatcacattcatgtacttgatctcgttaccaaagagtgggttcgacctgagtgtaaagggactcctccttctccacgtgaaagccatactgccacacttgttggtgatgaaagaatagtgatatttggtggtagtggagaaggtcatgctaactatttaaacgatttgcatattcttgatcttcgaaccatgagttggacttcctctgagttgaaaggtgattttcctgtccctagggacagtcatagtacccttgcaattgggaacaagcttattgtgtatggtggagactccggtgatcagtatcatggcaacgttcatatgcttgatatgacaacaatgacttggtctaaattgtctattcaaggttctccaccaggagtcagggcaggtcatgctgcagtgaacattggaacaaaggcaagagttggagataaacgttactataatgacgtttggatctttgatatctgcaattttacatggactcaacttgatatagattttcaccagccacaagggcgattttctcatacagctgttgctgctggcatggatattgcaatatatggcgggtgtggtgaagatgaacgtcctctcaatgaattgttagtgttgcagcttggagcagagcatccaaatggacgttactacattcccatgtgcaaaccttttggaacttattggaatcaagaaaagaagattatcccaggagaagcagatacccactcggtacagaagttcatgaataatgtggaaacttttggacaaggagcttatgaggttgcatcagaaaaatcgccaccttatcactttgattcaggtgggttgagttttatgccttatttggataaagttcttagtagggggagaattgctgctgcaaaggtgtgggatgttaaatcagagcaagaagaaaactttcttacattgtcccttcattcgtctccatgtcaatccgatcaagaacagacaccaagtcaaaaagcaaatacattatttccatctacttgccaacacgacaatggctcaaattataagagaacttttaaaacttcacaagatcttcatttcctacgacatcaactaaaacaggaacattgccttaatgttcatgagggtagaaaaagagctcaacttcagggtgcagagcagaaaaccatggggcaaggatccattcaacacctgattggtgctgaagttggggggagagttgatgaaccctttgactcagtttccctctctcctgcagctgtgaatggaaggattttcaggggagtcatattttcacccggagcaggagttgtctcaaaagtggccaatgtcaaaccaaattgttctctaacaagttcttttccttcttcctctcaagcatttttgaactctaatcatgtgggtaattcaagggcttcccaacaagcacctattcgtttgcgtgcagagccatgtcatggttcacggcaaaccccagtggcattaccatttccaatcatgcgaggcacttcaaatgttgtttccaaagagcataaaatcaatagtgaccttcaaggggggttggttttaacacttggaggacctgctagtgcacatcctcaggtaaagcattga

SEQ ID NO: 14285 - DNA, 207 bp, Glycine max
  Peptide Sequence Number=SeqID_131063
atgacgattaagatgaccgtgaaccaaaaggtggtagtggaagcagaaattatctttcagcacaacattctgatgttggacgtgaagtatcatatttgcatggcacaagaacacaacatgaagatcgaggtcggtcgttcggggaggtttgcacacctagttttgacggtgaacttgaccacctacgaggatcacttcaatttgtaa

SEQ ID NO: 14286 - DNA, 1254 bp, Glycine max
  Peptide Sequence Number=SeqID_131064
atggctgtgatgaacacgaacacgcaggtggatcagatcagtgcaagtccatttatgggtgaacacaacacaacggtggcttacacaagttgtggaaagggtaatgttagtaaaaagggaggtatatttaacaatgtgactgaggagatcacagtcacaaacaaaaactccaaatgccactcttcgcgttccttgtcaccatcttcctcacttccccaaccctctccctctctgtcccatcatcatgtcccctcaacaccaccctcctcccttcacaaccctcctccgccacgcgctgccattacatcctccgagccattcgtattctccaatccgattacctccgccgcaccggtttattcttccctccttcgaattattccttctcgtactggaacactctccaatcttcaatcaaccaatacgacattcgctcctcttgcaacctctcttcttcctcttatgaaccagaataccactttgattaggttcacttttgatgagattaaaaaggctactagcagttttgctggtgacaacataattgggaaagggggttatgggaatgtttataaaggggtactttttgatgggactcaagttgcattgaaaaggtttaagaattgttctgttgctggggatgctagcttcactcatgaagtggagattgctctagggactgctaagggcttggcttatttgcactatggagctcaaccttccataatccatagggatattaaagctagtaacattcttctggatcacaattttgaagccaaggttgcggatttcgggctagcgaagtttaatcccgagggaatgactcatatgagcactggagtggctggaactaagggctatgttgctcctgagtatgctttgtatggacagttgacagatagaagtgacgtgttcagttttggtgttgtgcttctcgagctcttcagtgggaaaaaggctcttcatgtggaaaatgatggtcaaccctctgcactcactgaccttgcttggtcattggttaggtatggtgaaactttggatgttattgaagatggtatgccagaacttggtccaacagaagttcttgagaagtatgtgttggttgttgtacaatgttgtcatccacagttatatgctaggccaacaatggatcagggtgttaaaatgcttgagacagaagaagtggaacagccaatctcttgtattgctgggaggactgatattgatgagaaatccgtcgctagtaactag

SEQ ID NO: 14287 - DNA, 318 bp, Glycine max
  Peptide Sequence Number=SeqID_131065
atggacaatgccttcctcttgctctcgaatagccctcacagattgaacctgaagacacacgagatgaactttaacatgttgaagaacttcctcaattctcggatacaggttcttgttcttctaactaagccacacctggcaccgaagacccttttgattttcatcttgtgggtttatactttttctataggtggttctaataaggaggtgccattattgttgttacccaatgatgctcttgaagtggggactggggaggtgggaaggggaatctcaggaccatggtatgcggcgtatttccctacctcacagctatag

SEQ ID NO: 14288 - DNA, 300 bp, Glycine max
  Peptide Sequence Number=SeqID_131066
atggaacaattgcaattcatggcaggaataattaaaaaggggcttaaagggttaaaaaatttgacctttttaattttttggttcatgaatcaaaggaaataccaacttcttgtggttgagaagttgttggatcttgatgaagcaactttgcaaaaatatgtagataataatagtaataactacatgcgaagaagcaaagtgaacgtcaagggaggagaggagggttggggaggggaatgggtttgggttgaggtatgtgaggatgagaggagaggaaaggacgggagggaccaagaatga

SEQ ID NO: 14289 - DNA, 300 bp, Glycine max
  Peptide Sequence Number=SeqID_131067
atgtggtttttccaaaattctagcttcaatcttatgaaattgcaaatgggtctcgatttctcaatggtgcttgtcacaacatgcccttttgcgggcatgcgaggcgaggctcacgggtgcgctttccaaaggaggaaagatgcgcggagtcgccaccaacatttatttgtgggaaacgtcggaaaaaccgaaggaaaccggtcaaaaacgaaaattctaagttcgggagttgtatttacgtttgaggaaggtattagcagctctcacgtttgtctcaaaggacaacagcctattttttag

SEQ ID NO: 14290 - DNA, 735 bp, Glycine max
  Peptide Sequence Number=SeqID_131068
atgttggatatgttatcattccacttgagtaaggaagacctttggaatgatcctgtgcgtgttggtaagataagccgagagcatggctcgctcctgggaaaaatgaaagaggaatcattgaaagcattgcttaacatgagaagaaatgcaaaagagaaagagctagaagcattgctttctggggagcaagattcttgttcatgctacattgaggttcaagctggggctgggggtattgagagcatggactgggctgcaatgcgacgtggatataaagtaactgtagtggatgaaatgcctggtgagattacaggaatcaagcgagctaccatcaaagtagatggtgagtttgcatttggatatgccaaagcagaaataggagtgcacaggctggtaaacatatcaccttttgacagtaataagcaccggcatacttcatttgctgctgtggcagtgattccaattcctggtgatggatctacccatgtacaaattaatgaatctgatcttcgtattgaacgatttcgtgctggtggccaacatgttaacacaactgagagtgctgtaagaatagttcatattcctacaggagttactgcaacttgtcagaatgagagaccgcaacatcagaataaggcttcagcgatggctgtactacttcagtcaaagattagaccaactggagattgcacgccaggcacagttgaatgcacaacatacacaatctcttactga

SEQ ID NO: 14291 - DNA, 342 bp, Glycine max
  Peptide Sequence Number=SeqID_131069
atgacttttccaatcgccttcgtttgcgttgagaatgttccaattattgaccagaattccttggcccgtgagagcccatcagaggttgagggttcagtgctggcggcggtggcggcctcagacgtccaaaaccgaatttggagaaatgttaattatgcgactcggacgagtttgtgcagaaacaaggacaaccccttagtcctaagggattttcctaggaaacgggatatgctcgtgtcgtgtgtgacaaaacaatgcaagcttcagggtgtagcattgaagacgaccaaaatgcttactgcggcaaccaaacatagccgctttattcagggagttgcttaa

SEQ ID NO: 14292 - DNA, 564 bp, Glycine max
  Peptide Sequence Number=SeqID_131070
atggttaacccaagtactataactcccccatcctccgaagtacacacttttcataatgctattgaatcttcctctcaccaaataccaccatcctcaaacaagagtcgtggtaggccccttggatccaagaacaagccaaaaatacccctcgttattaaccaagatagcgatcttgccttgaaacccatcttcattcaagtcccgaaaaattctgatgttattgaggccgtggtccaatttgcgcgccaatgtcaagttagcatcacagtgcaaagtgcatctgggtctatcttggaagccactctctgccaaactcttcctgacacttctactttcgttgtttttggaccctttactttgatttccctcaccggaacatacattaataataactgttcttttaggatttccttttgttcaaatttaggtcaaagctttactggaattgttggaggaaagattattgcaggcgatgatgttaatgtggtggctggtatcaaaggtgctggtgaggaaagggatagtagcaagaaaccttatgcatgtcatctagatgacaagtag

SEQ ID NO: 14293 - DNA, 597 bp, Glycine max
  Peptide Sequence Number=SeqID_131071
atgggtcgcacactcacaactgcagcaacgtgtcttcttctctcattattattagtgtccctctgtgtgaccaccaccaccaacgccctaatgccatacacacgtagcagcaccctctgggacacgatgctctcatcagaggacccgttcagaatcctggaacacaccccattcagcgacattcccaccaccaccagaggagtggacactctcgccctggcacgtgcggactggaaggagacccctaccgctcacgtgatagcgctggaccttcccggcatgaagaaggaggacgtgaagatcgaggtggaggagaatcgcgtgctgcgaatcagcggcgagaggaagggagaagaagaagaggttgagggagagaagtggcacagggcggagaggactaacggaaagttctggagacagttccggttgccgctgaatgcggatttggagaaggttacggcgaggcttgaagatggggtgctgaggatcacggtggccaagttgggtgaggataagaagaggcagcctaaggttattgacattgctcagagggattctgctgctgaagatgttaaggctaccaaggctgatatgtaa

SEQ ID NO: 14294 - DNA, 570 bp, Glycine max
  Peptide Sequence Number=SeqID_131072
atgtggggcaaagcaactgaacagaaggaagaggaggaggaggaggaaaatgttggtagccaggaatcgtcaattactgagaacattcctcttttgcaaagctatataactgtaaattctacgaagaaaatagatggaaataaaatcttagagaccattttttatcacagaacagcatattgttgtgaaggtcctttggtttcattgttccctgagtggcctagttgttacccctttgcaagacagtgtatggaagattttcagcagtggttcactagatttatggcaatgaatgggaatgcatttagtaaaatttctttgttctatgccttcatcaagaagcaagtcatcagatcagacattgctaaagttattgaatgtgctgcagaaatatctgaagttgctgctggggtagtgcaggacatatatgaagaaaggggttggcaccacagcaaccaccagcaaagctctgcacagaccgaatgcattaatcaaaagatagaagaaaagaccatacaaggaaccaggggggtaaagaaccaaacccttggaagaaaggcgaagctctaa

SEQ ID NO: 14295 - DNA, 919 bp, Glycine max
  Peptide Sequence Number=SeqID_131073
atgaaagtgaaatcaactgtttttctgtcccccaagtttgaacttggaccaggatcagctaccacaaggcattattatgacattgagtttccaagaggtcacgttgcactcaagagtttcagtggtgaagtagttgatgaagcagggaaccctgtgcctctccatgaaacttatctccaccactggattgttgtgagatatactatcaacaacagagatattcttccacaatactatggccttggatccgaaacacgacgaacagacacggacgttccggatccttttgggatagttgttggtaatcctgcagaaattccacaagggtgtgatctttataatgttacaaaggatgaaaatggagagcctctaagaccagactataaaggagaggagcctctacctaagatacacggtaatgactgggacaagttcatggttcatgttaagatttatattcttcatgttacggatactataaaaccatcacatgattctagaggaatgattaatcctgagcatgattcccggataagtgaattcatcaagaaacatgttgaatcttgcagcactgaccacaaggatggtaatggatgtcttgatgtgaagagaacaagtctcccaatgaaaaagggtggttatgtcatctatggtgttgctcatcagcgttcagggttatatgctcttcaataccaagatatggaaatggaaaagaagcaggaaatgaggcaaattacaaattacattgtaggaatgagcacatgttatcctccaccaggttctgtgaagataattgatggtaaaactttcactatggaatccaactacagtagcagccctgggcacacaggcgtaatggggattttctacctattggtggcagaacaacttccacgccaacacttcaaatattctcctc

SEQ ID NO: 14296 - DNA, 1135 bp, Glycine max
  Peptide Sequence Number=SeqID_131074
tgatattgattttccaagaggtcatatagcacttaagagtttcaatgcagaggtagttgatgaagcagggaaccctgtgcctcttcatgaaacttatctccaccactgggttgttggaagatactatcaacctaaatatgtgacgacacacacaaactatgatggacataggatacttcacaactctgaccatatatttgtgaggaacagcggcatatgccagagagatattctaggacaatactatggccttggatctgaaacacgaggaacagctacggatgttcctgatccttttgggatagttgtaggtgatcatgcagaaattcctgaagggtatgaggagaagtggctggttaatatccacgccattgatacacgcggtgtagtggataagatggggtgcactgagtgtaggtgtgacctttacaatgttacaaaggatgaatatggggagtttctaaggccagattataaaggaggtttgaaatgttgctatgatcaaacacagtgcaggctgagggaaggctttgagggccctaagaggagcctctacctaagatacactgtaaagtgggttgagtgggacaagtttatagtgcctgtaaagatttatatacttgatgtcactgatactttaaaaatatcagatgattctggtgaaatgatccctgagcatgattgccgggttgagtatgaagttgaatattgcagcactggccaaaagaatggtaatggctgtcttgatgggaagagaacaagcctcccaatacaaaagggtggttatgtcatatatggggttgctcatcagcattcaggtggcactggatcaactctatatggacaggatggaagggttatatgttcctcaataccgagttatggaaagggaaaggaagcaggaaatgaagcagactacattgtaggaatgagcacatgttatcctcgaccaggttctgtaaagataattgatggtgagactttaactctagaatctaactatagcagcagccgtgagcacactggagtgatggggcttttctatctattggtggcagaacagcttccagaccaacacttcagacatacctctcgttcttcattctttatgaatataaatagtatatttcattga

SEQ ID NO: 14297 - DNA, 285 bp, Glycine max
  Peptide Sequence Number=SeqID_131075
atggggactgggacgggggacggggatgaggagggccaaacctggccccaacaccccccacccccaaattgccatccctgccactgtttaagatggacttggttttttttcacagatcttgatgagcggattttaaaacagcagcaagaagaggaagaaagaaagcgactgcgtcgagaaaagaaaaaagaaaagaaggagaaggcagttgaagaacctgaaattgatcctgatgttgctgccatgatgggatttggaggtttccggtcatccaacaagaaatga

SEQ ID NO: 14298 - DNA, 960 bp, Glycine max
  Peptide Sequence Number=SeqID_131076
atggagctccaaaccccgaacaattatggcgtaaccgaaaacccagacactcccctcttcgaagacatcgacagcacctgctccactccctacgtcagcgccccttccagtcccggccgggaatccatctccgccgccggagccggcttcttctacagtgctcctgccagcccaatgcacttcactatatccgccgcttccacttactcacactcaccctcttggtcttccttggaaaaaaactcttgttgcgattttgagttctcggcccggttcggttcgtccgggttgactggttcgggttcgatgagctcggccgacgagttgttcttgaacggtcagatccgtcccatgaagctctcgacccacttggagcggccacaagtcttagctcccttgctggatctcgaagaagaagaagaggaagaagaaaacgaggtacgaggtagagatctgaggctgcgagacaagtcactccgcagaaggaccagatccctctcacctcttaggaacacgccgttagagtggacggagaacgaggaaaaaactgacaagaaggaaaacgtgaccccttccgtttcgagcggaagtggaaggagttccaagaggtgggttttcttgagggattttctaagaagcaaaagcgagggaaggagtaataacaagttctggtccactatttccttttcccccgccgccaaggaaaagaagggaaatgggccgcagaagcccaagaaggtcgccggaaagcccactaacggcgtcgggaagaggcgcgtgccggcgtcgtcgccgcacgagttgcattataaagccaaccgtgcgcaagcggaggagttgagaagaaaaacctttttgccttataggcagggcttgcttgggtgcttgggatttagttccaaaggttatggtgccatgagtggctttgctagagccttaaaccctgtctcttccagctaa

SEQ ID NO: 14299 - DNA, 1152 bp, Glycine max
  Peptide Sequence Number=SeqID_131077
atgtggagctccaaaacgacattgatgtttggcgtcgcagccattgctctgatgatgtttctctcatctgcttcagcggacgacgtcgttgcactcacagaggaaaccttcgaaaacgaggttggcaaggatcgtgccgctctcgtcgagttttacgctccctggtgtggacactgtaaaaggcttgcaccggagtacgaacagctcggaacgacttttaagaaaacgaagtccgttttgattgccaagaaaagtgtttgtagtaaatatggggtatctggttaccctaccattcaatggtttcctaagggatctctagagcctaaaaagtatgaaggtgcacgtactgcagaagcccttgcggcgtttgtgaacattgaagcaggtacaaatgtgaagatagcttctgttccatccagtgtggtagttctctctccagataactttgatgaggttgtcttggatgaaacaaaagatgttctggtggaattctatgcaccatggtgcggtcattgcaaggcccttgcccctgtaaggctgttcttcagtccttggacttctattatagcttatggttattgtagagtttcacctgtttgtaactatgtcaagatttatgagaaggttgctgcagcatttaacctggataaagatgtagttatggccaatgttgatgctgacaagtataaagatttggctgagaaatatggtgttagtggctatcctacactgaagtttttcccaaagagcaacaaagctggtgaagattataatggtggccgtgatttggatgattttgtagcattcatcaatgagaaatgtggcacctaccgtgatgggaagggacagcttacttctaaggctggtataatagcatctctggatgacttggtgaaggagtttgtgagtgctgacagtaatgagaagaaggcagtatattcccggcttgaggaggaagttaagaagcttaaaggttcttctgccagacatggcgacctctacttaaaacttgctaagaagggtatagaaaaaggtgcagactatgcaaagaatgaaattcaacgtcttgagcgcatgcttgagaagatttattggactgtggttccactccatgggatgcgaggtcccatgtccactgacataaaaacatga

SEQ ID NO: 14300 - DNA, 549 bp, Glycine max
  Peptide Sequence Number=SeqID_131078
atgattagcttgaatcaggtcgctggggtcgacaacacattcagaagaaaatttgatcgagaagagtatctggaacgagcacgggagcgcgagagacaggaggaagaaggtcgagcgaaacctaaaggtaaaggtcctcccgtgcagaggaagcccttgaaacatagagattatgaagtggaccttgaatcccgcttgggcaagactcaggttgttacgccggttgcaccgctaagtcagcaggctggatactactgctcagtttgtgagtgtgtggtaaaggactctgcaaactacttggatcatattaatggaaagaaacatcaaagagctttaggcatgtctatgcgagtagaacgtgcttctctcgaacaggttcaggaacgatttgaagttcttaagaagcgtaaagatgttggcagcttcacagagcaaggtaaagccttggataagagaagtccacaccaagatccgccactaggcgtggcaaatagtcccatacccgtgggtatcaccccaactttgatggaaaatatccattttgatcgg

SEQ ID NO: 14301 - DNA, 414 bp, Glycine max
  Peptide Sequence Number=SeqID_131079
atggaaaagaaaaagaatgagaggtttttgcctccgccgctggatgctatgataaactgtttgatactagtttgcattcatggtccagaaggtaaaatcccatttgagactttacctaatcatgttaatgccaatagagagcagatggcaattacactaagtatgatccgctctcatagtgtttctggtgacctgcatggtgtgcagcctgatccaatagcagctgacattctgaggaaagagccagagcatgaaactttcacaagattgagaataactcctcttgaggctccgtcacctgatgaagttgaagcttatgtggttctgcaagaatgccttgaaatgagaaaaagatatgtttttagagaagttgttgctccgtgggataaagaagttatatcctgtaagaattaa

SEQ ID NO: 14302 - DNA, 308 bp, Glycine max
  Peptide Sequence Number=SeqID_131080
ataagaaggcagactatgctgtgaaggtgtctggagttgaaatatcaccaaaccctgtggtgagtggccaggcggctacctttaagatctcagcaacttctggtaaagctatttatggtggagaggtggtaattggagtttcatacgttggggtgccagtccatactgaaagaattgatctttgtgaagaagtaacctgtcctgttgctaatggcaattttctgatttctcacacccaaacattgcctgcaattactccaccgcttcctttgacatcttttaagggtcccttgagccttgacacttaa

SEQ ID NO: 14303 - DNA, 282 bp, Glycine max
  Peptide Sequence Number=SeqID_131081
atggggtgtcaaacagaaaaaataaaactaataaaacctgcgtcttcttcttcttcgcgacagcttcgtcttctccgcgagaacttctcgctgcaggccgccgttcgtgacaggtgcgtcgctgccggagctcgtcgccgccgtttgtgccggtgcgtcgctgctggaggtcgtcgcggctgcgtgtgcatgcggctgcgggtgtcgcggctgggtgtgcgtgtggggtgcgggagggacgcggctggtgcaggggaggctcgcggttgggttctctcttag

SEQ ID NO: 14304 - DNA, 2046 bp, Glycine max
  Peptide Sequence Number=SeqID_131082
atggagacggagaaaaaacgttccaagggaagcttccttagcttctttgattggaacaccaaatctcgaaagaagctggtttggaacgatcctgaggtttcaaagcaagggaaggaaaatgtggagaacttaccgaagtcacggctcactaggaaaaaagtggatgaaattggagcaagtccaagtaacattcaaagttgtgattttgacagtaccctctcaatttgtagtgatgaaggatgtgggagtaaagcccctgggttagtagcgagactcatgggtctggattcattgccagctgcagcagccactgagctctcctgtacttcattgtatggctctaaatctcatggagcttcacattgtaatgagggtgctcttcactcagtggatgactttttccctgcagactacataaacacactgcttaagccagagaagtcttctttggaagtcatggaatcaagggcacgaaaagtggaaaaccttccaataaagagatttcaaactgaaatgttgcctccaaagtcagctaaacccattccagttactcacaataaactgttgtctcctatcaagagtcctagtattctgccaccaaagaatgcagctcatgtaatggaggcagctgctaagataattgaggcaagccctcggccatattcgaggaatagaacagcattaactgagccttcatctgttcccttgagaattctcaatttgaaagagagatttgaagctgcacaatatatatccttgcctggaaagctcgagaatctgagcaattcctatcctgcaaatggcaagcttagtgagaggagcagtaatttgtataaatgcacttcagcattcaagggttcaagagttttagaaaaaaatagttcttgccattcagccagtaaaggaaaatcagtttcacttacaatacaagccaaaaacaatgctcatagtagagatacattgatttcaaatggtgataggaaatgcatgaaacagagagagaagaatgacataaagtcaaatcaactctcaaggagccagaaaccaagtacacaaaaagctatgcagcagagaccttgctcaagccggaatagcaatgtgcttgggcagaataatcaaaagcaaaatagcatggctgccaagggtaaatcaacttcaacaatagattccaataagccaacaacacgagcttcatctccagaaacttctggaataaggaagacaatgaacaagggtgctaaaactgcaaatattcaacctaaaaggtcaagcagtagggcaactgacaaccaaaagcagtttccaagatccaaagcagtgagtatttcccagaagaaaaagattagcagagatgttcatgaggcaagaggtcctgatgaagtaaataattttggaagtaagtccattaaatgcaattttacgactgatggaagttttgatcaggatgcatttaacatgaaagaaagcaaggatgttatttcatttacatttacatctcccttgaggagaagcatgcctgagtcatcatcctctactgagcaagtgatgggaaccagaaatagaattgatgtcaactctattgggcatagtgataatctttatcccaaaaaattatcattatctccgccagggcaacctatgatagatagtgatgctttaagtgtcctgttggacaaaaagctgcaagaattgacatctagaattaacttacctcaatgtaccttggccacagaagggtcttctactggtttgagatctagtgtgcaagatcaagttcccagtgtgtcaagcaacacgcctaaggaacaagacaaaagcttttgcagtgacctgtctagtgataaactggatagcatgcataactctcattattgttcaagtgatgacccagtgcttaacatgaatcagcaactgctgacatcagaagtaagtgaagatcctagctgtagcagcaacagtgaaagtggaaatgatctagtttgttggcattccactgctgttgcaggttttgaaactcccttttgtcagcgaaagttacttggatag

SEQ ID NO: 14305 - DNA, 354 bp, Glycine max
  Peptide Sequence Number=SeqID_131083
atggaggggatccaacaccattacgctcgatcctgctcctatctacacgaggtgaatgtgaagagcatgaacaacaacaacaacaaaatgtgcatgtgggttgccaggagcaccactactcctccatcagctttgtattccaatgaattagcatcatctcgagaatgttatggcccacaaatggcagtgaccaagccaaagaacacttggcggtggaatgaggctgaaagaaagagaaggcgtagagtggctaaatacaaattttacgcagcggaaggcaaactcaagcattctgtcaagaaagggtttcgctggttgaagatcaaatgcatcaagatcgttagcagcctctag

SEQ ID NO: 14306 - DNA, 300 bp, Glycine max
  Peptide Sequence Number=SeqID_131084
atgtggcatgtgaacaagcacaatggtagactagccattaacatggtgttgatggaccatacggaggttaacagatctgagattcctgataacatccatgtcataaatgaatttgctaatattatttccagcattgcgtcgcgtgatacgttagttgatgttgtcaatgttgttgctgaagttattgaacagaagtatctgctcagtgtccaaaatattaagcatgggtccaagttgtatgtcaacactgacattgcaaaaatccaacaattttgtgataagtacgatgcaagaatttaa

SEQ ID NO: 14307 - DNA, 170 bp, Glycine max
  Peptide Sequence Number=SeqID_131085
gcattggtatagcaaacttagaatgtgttgttctacccccaggcagtaggattgaggcaatcctacttgaagccactatcaaaacaatgccgccattagagcgtatagcagatgataaagttttccagaccaaggtcttgcttgtgccaccatatccatcgagaaaataa

SEQ ID NO: 14308 - DNA, 957 bp, Glycine max
  Peptide Sequence Number=SeqID_131086
atgggaatgataaggtttatgttgatgtgtcataagtatagggaagaacatttaaccatttacttcttgattttgcttgtgtcaagtcaaggggttgatgcttcaaagccctattttcaagggcagagccggaacaatagtgattccagatctcaggctcatgaagaagatatggatgttagatatgaaggagaacatttatcacaatcttttgaaggtcttgagcagaattttcatgatgacatcattaaactcaccaaagaacagaatgatgctgaagatgcagaatatgccagacacagagagcacactgaaaacgggacaaataatgagccacctggaaagacagcttcatggctgaaatgtgatgatctaaacaaaaaggtgtcaaaaagaagaattgcatttatgctcaatcctgtagtcttcctctgtaagagtaagaataagaattgggtttcactttggtttaagaccttatgggatttgttcaacagtttgtttgtttttgaagatgttaaacatacttttgaagctgtaaaactttttatagatgttacaaaaataaatgcaatcaatgctcagtatgaagaaaaactagcagcactccgagctcagcatagcagccgcagagctgaatttcttcaaagggaatcacatgctaggcaacagcagtaccagcaaatcataagggatccttaccccggtggtggcatggcaccccgagaccctcatgcaccccgagaccctcatgcaccccgagatcctcatggttacaacaatgtgaatgattcaggtgcaggtggagaagtgcaacgaggctattctgccgatcactttgatccttaccgagagagagctcgatttcttgggggtggtagagatcaaggatttgaacctagaggcccatatcctggtggccgtgtctatgacactggttcacgctactacaattga

SEQ ID NO: 14309 - DNA, 300 bp, Glycine max
  Peptide Sequence Number=SeqID_131087
atggccaatggaagtgaaaatggattcaaaactaaacgaaggcaaggcaccaaaaacctaataaacaccttcaactacacaaacccaggcaacacaacaaatacattagaggaggggatacgtaattgtcggcctctagctccagtgtcgttcacgaccaagatgaaaatgaaagtgcatttgtttttgtcgtcatgggagcaaaatggaattggtgcacaactcaatagggatactccaaacagaaggaaaatgaagcaaagaaaacgtaaaagacataaaacaataaatgcacattga

SEQ ID NO: 14310 - DNA, 1737 bp, Glycine max
  Peptide Sequence Number=SeqID_131088
atggtatcaaaaaggcaatctggtcagaggcacgaaggcaggggcaaagttccaattcaggagcaaaaacaagcatcaatcagtggccttagaaatgtgatcaacgcgctatggatgagtgataaatcttcctatttggaaaattttctgcgaagagtggtaagagaggtggtggaacaaaaaatccaggaccaagctcatctattttcaagggaaagggttggtgaggctggcatatccggagccaaacatttaaagttgtgttttattaataagctgcctgaaacaatttttacccggtctagtataataacaaaagatgaatcatttcttcaaattgcgttatttgatgttagaactgagtctgtagtaaatgatggtcctctttcctcactaaagatagagatctgtgtcctggatggagagtttggatctcatggctgtgaggattggactgaagatgagttcaattccaatattttacgcgaaagagaaggtaaagagcctctattgattggagagagatttattacgctaaaaggtggagttggttgtataactaaaattgccttctctgacaactcgagatggcaaagaagcagaaggttcaggattggagtcaaagctgtgcaaccaacttccaatggagaaaagattcaggagggtagaagtgaaccttttgtagtcaaagataacagaggagagtcctacaagaaacactaccctccatacttgaagttgaatgatgatatatggcgtttgaagaaaattgctaaggaaggaaaaatccacaagcagctctctttgcatggaattcacaacgtcaaggatctcttgcgtttttacataaccaacgaaccttcattatatgaaacgtttggaaatattccaaagaagtcatggttagtaatcactgagcatgccaaagcctgtgagatagatgattaccagctttacagctatcactcagaagaactgcaagtaggcctgctattcaattccatctacatccttgtgggagtgacattcgattggcaaaattattatttacctgatactctcaatcctagagaaaagcatttggtggaaatagtgaagcatcaggcctacaaaaatgtgtacgatttgaaattgattgaagagactaagttgaactatttaaatctagctgcatgtctaaaagcaaggcagtctgacactcaagatcaaggtctgcaacatgttaatatctcaactgcacaaggtcaatcagtaacatttccagattatagtcaaccatctatctctccttcatatactgatgaaggaatgcatgaccaccaagtttatgctgatccactgccaggcataacagagatgtcacaaaacagtcatctgttagatgaactttcctctgaaatgtacactgaagaggatagttgtgaccttaatggatcgcaatttccattcgtgcgaggtggttattcaacagagaatgaaagctcagagattcaattcatagatgattgtcctccttacacaacatgggagccagaaactggcattttatttggttctcctgttggagcagaatttagcagctattctactttcatcaattcggatgtggatatatcaagtagtggcaaaaccaaagcagtgtggtataagattcgtgttgctctcaaatgggtcatatcagtgaaaagggatgcagctgccagaaggaatggccatctattttaccataactattag

SEQ ID NO: 14311 - DNA, 657 bp, Glycine max
  Peptide Sequence Number=SeqID_131089
atgggcacgtctgatagcaattctgccatggatgacaccagaccacacttcactattccttttatcttggaatcagatgcttccagcatagctatgggtgtcatgctgattcaaattaaaattcctatcccatatcttatttcagcaaggcattttgtcgtcaactcaagcaagcatgacatatgtccgcgaacttcatgcaattacttcttcatgcaattacttccacagttcgaaaatggatatatttcctcctgggccacccctttattatcctcaccgattaccagagtaccagagtttgaaagacctcatgtcccaacacaatgttccgtttgtcagcaaacaaaatacagatctaagaagccatcaggtgatgcaatcctaccccccaaggacattagagcttacatcatcggatctacttcaaaccttacccactccatcctctttgtggaaggatttatcactggatttcattactggattaccccttctaatgacttcacttctattctagtggtcgtagacagttattccaaaggaacccatttcggtgctttgccgccctgttacactggacacaaggtagtggttctcttcttggatatggtttgcaagttacacgaatttcctcagagtttggtgtctgactga

SEQ ID NO: 14312 - DNA, 1845 bp, Glycine max
  Peptide Sequence Number=SeqID_131090
atgtcgtatcgaccttccgccaacgccaggaccgaggttcgtcggaaccgctacaaggtcgccgtggacgccgatgaaggtcgccgtcgccgagaggataccatggtggagatccgaaagagccgtagggaagagagtttgcagaagaagagacgcgagggtctccaatcgcagcagattccttcgtcacttcactctactgtaatagagaagaagttggaacaccttccagccatggttacaggtgttttcaccgatgacaataacatgcagttagaggccacaactcaatttcggaagttgctttcaattgaacgtagcccaccaattgaggaggttattcaagctggtgtagttccacgctttgttgatttcttgatgagggaagattttccacagctgcagtttgaggcagcttgggctttgacaaatatagcttctggaacatctgaaaacactaaggtgataattgatcatggtgctgtcccaatttttgtaaagctacttggttctcccagtgatgatgtccgtgaacaggctgtttgggcattaggaaatgttgctggagattcacctagatgccgtgatcttgttctcggtcatggagctttgcttcctctattggcacaattgaatgagcatgccaagctttctatgctaagaaatgctacctggacactatcgaatttctgcagggggaaaccacagcctgcttttgatcagaaattaacaaagactagtggtgaaggtagaagggaagggggagagaggtcgcaggttaaacctgcacttcctgctcttgccagtcttatccagtcaaatgatgaagaagtcctgactgatgcttgttgggcactttcatatctttctgatggtacaaatgacaaaattcaaggtgtaattgaagctggtgtttgtagccggcttgttgaccttcttttgcacccttccccttcagtgcttattcctgctcttcgtactgttggaaatattgttacaggagatgatttgcagacacaggtcatcattaaccatcaagctctcccacgtcttctgaatatcttgactaataattataaaaaaagcataaagaaggaagcatgctggaccatatcaaacatcacagctgggaacaaaaagcagattcaggatgtaattgaggctagtataattgctcctttagtccatttgcttcaaaatgctgagtttgatatcaagaaagaggctgcttgggcaatctcaaatgctacttcaggtggatctcatgaacaaatcaagttcctggtaagtcaagggtgtattaggcccttgtgtgatcttctcatatgtcctgatcctaggattgtgacagtttgtttggaagggcttgaaaacatcttgaaggtaggagaagctgagaaaaatgttagcaatactgatggtgtgaatctatatgctcaaatgattgatgatgctgaggggttggagaaaattgaaaacctccagagtcatgataacactgagatttatgaaaaggcagtgaagattcttgagacatactggatggaggaagacgacgagactatgcctccaggggatgcttctcaatcagggttcaactttggtggcactcaaccacctgcggtgccttctggagttttgactggtctatcagtaaagtcctccagtttgacagtccaacagtttgggggggttgctggaccagcgtgggtttttgaaatggctggttttacatacaccatggggacagatgggttgtggcttgatttcttagccacacaagagttatatatactagagtttgctttctgccaagtgatcattccgaatgatttggctttatag

SEQ ID NO: 14313 - DNA, 156 bp, Glycine max
  Peptide Sequence Number=SeqID_131091
atgggagtcgaggctgctttgattcaggaaacaaagattagtggggtgtctagaagtatggttagagaaatttggggtccatcagaacacgaggggatcgataaagatgctgaagctggggatgaacataagagggaaaaagaaaaggaggtttaa

SEQ ID NO: 14314 - DNA, 1122 bp, Glycine max
  Peptide Sequence Number=SeqID_131092
atggatctgaatgtgaatgagaaaaagaaatgttgcgctgattgcaaaaccaccaagacaccactctggagaggaggaccagctggacccaaggaagagaagggcttgttcgaggaagcgagaggagcagaggtggaagatgttgggggaagaggaacaggccgcggtgtgcttgatggccttgtcctctgcttagctaattgctggggtgaaaccttccacggtttcagtacaacttgtggaaacaattctagcatcaggttgcttggttctagaatttatggtcttcagggaggacagagaaagaaatggacaagacctataactacaaatacagaaggcaaggggagcaccaaatccaaaagtatcaagcatgagattttgagtgaaaccattttagcaaatgctacagcaaatgtaaataaaacacagctagatcaatcccaagaaattcaggattgtgacatacaacaagagattgctgagaataaagacttgtccagctatactgttattgtttttgatatagagaccacagggtttagcagagagaatgaaagaatcattgaaattgcacttcgagatcttcagggtggcgagaacagcacttttcagactcttgtaaaccctcaatgtaaagttcctaattcacatattcatggcattactactcagatggtcaacaaacctgatgttccaaggatggaggacctaattcccattttattccaatacgttcgaagtcgtgagaagcctgggggagatgtgttatttgtagctcacaatgctcgctgttttgatgtgcccttcatcatcagtgagttacggcgttattccataaagattcctcctaattggttgtttttggacacccttcctttagcgcgggaactaatgaagtccggaggaacaacactttcttcatcatccctagctgcccttcgtgacctctacggaattaaggtggatggatcagctcacagggctatggtagatgtgaacacattgtcgttgattctttccaggttgacctctgatctgaaattgaccctatctgaccttgtcgacaaatcattcacagaatcagatattatcaactctaagaagaagaagaagaattag

SEQ ID NO: 14315 - DNA, 1749 bp, Glycine max
  Peptide Sequence Number=SeqID_131093
atggaatattcaaaaagacaatctcagcaggagggcactgatgatcaaaagggtattcaaattcgtggtcaagattcaaagcgaagacgtgaagattcacaacaatcggataccctccgtatcattagtttaaggtctctagttcacataacgaatgacgacatcgcgcggtacatgaaagacttagtccaaagattgaatgaattgcctgatacaatttatactaactccaagatcaaagcaaaaggcaacactcctcttgaggttgttctttttgatattgaatctaagtctatagtcgccgagggttcactgtcttcaatcaagatagaaatttgtgtccttgatggtgagttctgttcaataaatgggcgtgaagattggagcgaagatgaatttaatgccaaaatcgtacgtcaaagagacaataaagggcggttactgaaaggagatacgattattacacttgaaaatggagttggttatatcaccaaccttgagttcactgacaactcaagctggagaagaacccgatgcttcagcttaggagccaagttgttgcaatcaaatctgaaagacgcaattaacatcagggaagaaaatcagaaacgcgacactccttccctcaatgatgaaacatggcgtttgaaacatatatcaaaaaacgtttatcggcggctgcttaagcacgggataaaaacagttggggatctgttgaaggagaatgaaaccaatccatcatctttgcaagaggaagaaattattaagcttgctaagaaagcaaagtatgccaagacttgcgttgctgaagccacatttgatggacaaaattatcattcagagaagaatactctcatctccaaccagagggaagcttacaaaaatttgaaggatccggtaccaattgagacaataacacatgagttagtgaaaacattgacaccagttaatgcacaatattacagtgctccaaatcaagatgtgcaacagcttgacttttcaattgctcagcaagaagaaatttctagactaaactggtcagcaggggggcagattgttgatggatacatattatcacagattgatgatgaaaacgtaagtaatttcttacctgagataaattctgaattcatctttccctatggtgatgaagcagaatattgcaatagttcctcttttcccaactccgcgttgaatatatcagacaaagggaaaagcaagatgggggtttctcctctctttctctgcagtttgatggatcgggaaggaggatccaacgccggatcttgctactactccgttctcgggattcgtagggatgcctccttctctgatattcgcactgcctaccgcaaactcgctatgaagaggtggcacccggacaagtgggctctgaatcccgcaaccgccggcgaagccaagcgccggtttcagcaaatccaagaagcctactcagttctctccgatcagtctaaaaggtcaatgtacgatgcggggctctacgatcctttggaggaagaagaccaagatttttgtgacttcatgcaagagatgatctcgatgatgaacaatgtgaaagacgagggggacagtttggaggacctacagaggatgttcgtggatatggtggggggagatcatggccatggaatcggcgttgacttgaaccaagatcgaacggctggaaagcgaggacgagtatatggatcgaagggcaacgcgcccaagcgcagcaactctcgcagttag

SEQ ID NO: 14316 - DNA, 1233 bp, Glycine max
  Peptide Sequence Number=SeqID_131094
atggcaacagaaccagttttaaccttctctcttgcttctgtggtggaagatgttcttcaacaacatgatggtcgattggacgtcaacttggcatcaagaaaagctgaagaagcttccttgagaaggtatgaagccgccggttggttgcggaagacagttggagttgttggagggaaagacttgccggccgagccttctgaagaagacttcaggattggattgcgtagtgggattatcctatgcaatgttcttaacaaaattcaacctggagcagtgccaaaggtagttgaaggcccctgtgattctgttattattcctgatggagcagcattgtctgtgtatcaatactttgaaaatgtaaggaattttcttgtggctgtagaggaaatggggcttccttcctttgaagcttctgatttggaacagggaggaaaatcttcaaggatagtgaattgtgttttagagctcaaagcccatgctgaaaggaaacttcgaggaggaaatgggttgtcgaaatatagcagggttgcgaagccacctacctctggtaaaacacttttgaggaaaaactcggaaccattcatgaagtctatgtggactatgacatcaggggacagagatggttatatgagtgatcccgggcatgatctaagtgaaaggggttctgtatcttccttaaattcactagttcgtcaatatttgtctgacaagaagccagaagaaattcccactgtagtcgaatccctgttaagcaaagtcatggaggaatttgagcatcacatgaaaattcaacatgaaatgtggaagataactcaagaagataaggcaccatctggaacagaatgttcaatttcagaagctgcttctattaatgaaaggttggaagaaaaggaagatgaacaggatgaacaagatgggcaaaacatacatgataaccaagaggaaagttatgaagagaagtacattgagcatgaagattcaagccgccagatttcgattttgaagcaacaaaatatagtcgaaacgcagaatcgaagcatccaggaattgaaaagcatcgtccatcaaacaaaattaggaatgcaattcatgcaaaatgaacatcagaaagagataattaatctaagtaagcacctgcatagcctagcttctgctgcttcaggatatcataaagttcttgacgaaaaccgcaagctatacaatctagtgcaggatttgaaaggtgaattctaa

SEQ ID NO: 14317 - DNA, 555 bp, Glycine max
  Peptide Sequence Number=SeqID_131095
atggcagcacttggtggcaatcgtgatgtggcaggaagccagaacagccttgagatcgatggtttagctcgctttgctgttgaagaacacaacaaaaaacagaatgcccttttggagtttgaaaaggtagtaagtgcaaaacagcaagtggtttctggtaccttgtacaccatcactttggaggcaaaagatggtgggcaaaagaaggtttatgaagccaaagtttgggagaaggcatggttgaacttcaaggaggaagaggaaacatcctgcgagcatgtcctccactggatgttccttggcagtgcaccactgtcgaacaagaacaccttgactactttaccaccattcatcgtcgtgtacgaaggtccacccgtttgctatgacattcccaaggtctggatttcggtcaccatccagtgcatccacggtttagctgcatccgcaacgatagctttaaccactatcctaagtccggtcgagagccataggcctcagtcgcagtatgcttcaacaccatccacagtggcaacactcacatcttcaacaaaatga

SEQ ID NO: 14318 - DNA, 411 bp, Glycine max
  Peptide Sequence Number=SeqID_131096
atggtgttacaggcaatggagggaatagttcctatatggagagttttatcaaaacggacgtaccttttgaagggtgtgaagccctggaaaggggcactgatggtgaaagtgctaggaagaagagtacacttacatgtgattgagaataagcttaaacgagaatgggtaagcaaagggtgtctcaagatcattgctttgtacagtgtgtggaggaacagaaatgaggtggttttttctcaaaccgcttcatctgtggaaagtatcatgacctatgtaaaagccttgacgttcaatgttataagttgtaggaaacacgcacaagttactcaaatgccaaaccaaggaatagtgctgcgggatgacaaaggtagagtgaagttgtcctatgcttctaatttaagcatgtgctaa

SEQ ID NO: 14319 - DNA, 813 bp, Glycine max
  Peptide Sequence Number=SeqID_131097
atgggttctgacggatctgaggttttgcaatcagatctgattgcgcctgagagacagcaacattcgcggaagaagacgacgtcgatggtcacggttaacgtcggtagctacgataggttcccgagcgcggcgttaaaccaactcctcgccgtgccaagctttcaagccaccgcgaaaggctttgttgccgctgcgttcgcgaatgacaatttaatagtattcttgtgtgatggtaacgacaatgatgatgttggtaatgtcaatagcaataatgacaataaagattgtagtcgcaatgacgacggtgatggtggtagaggtggcattggtggtgacggcaatacaaatggtggtggtgacaacatttgtgatattagtggcgatggtgactacgttgttggtgatggttgtagtaatgttggtggtgacaatgacgatggtgggatggtggtggtaatggtggtggtggttatggtggcggtgacgaaagtgatgttattggtagtggtggtggtgacaataatattgatagtagtggtggcggcgacattgatagtgttggtggtggtaacaacgttaatggtgataatgatatcaatggcagttgatagtgacgttattggtggtggtggtggttgcgacgacattggtgttgattgtggtatcgataatggagggggtggtggttgcgacgacattgatagtgattgtcgtgacaatgatgacggtgacaataatgttgttggtgctgataatgttggtcaggatggtggtatgggtacttatggctgcggtggtgatagcccgttatga

SEQ ID NO: 14320 - DNA, 1646 bp, Glycine max
  Peptide Sequence Number=SeqID_131098
gggaagttttcgcagacacacaacctctaattcgttcggttctggatggttacaatgtctgcatatttgcctatggtcaaacaggatcaggaaaaacattcactatgtctggaccagatgaccttaacgaggaaactataggtgttaactaccgtgcgctgaaagatcttttctatctctcggagcagaggaaagacaccatttcttatgaaatctctgttcagatgcttgagatttacaatgagcaagtcagggacctactaactacagatgaaattcgcaacagttcccataatggaatcaacgtgccagatgccagccttgttccggtttcatgcacttctgatgtcataaatttgatgaacttgggacataagaatcgctctgttggttctaccgccatgaatgatcatagtagtcgctctcacagctgcctaacagttcatgttcaaggaaagaacctgacatcaggaagtactattcgtggtagtatgcatctagttgacctggcaggaagtgaaagagctgataaaactgaggccacaggggatagaatgaaggaggctcaacatattaacaagtcactttctgccttgggagatgtcatttcttcccttgcccaaaagaatgcacatgttccttacaggaacagcaaacttactcagctgcttcaggattctcttggagggcaagcaaagactctcatgtttgtccatataagtccggagccagaagctctgggagaaacacttagcacactcaaattcgctgaacgagtctccactgttgaactcggtgctgcgcgagttaataaagataacttagatgtgaaagaccttaaagaacagattgctagtttgaaggcagccttagcgagaaaagagggaggagaagcagaacacttccaacaatttgtcaatagtagcagccatgaaatacccaaattgaaatcatacgcatcttctcctcctatggaacgtagtttgataggtggtgcccgtaagttaccaaaagatgattctagtagcctggatggcaagaaaaatgctgcatcaaagttgaaaagacgaagcctagatctccatgacatgcgtaagaactcatcgccgtggccacctgttagaagtcatggaaaggaagaagacaaagaatcaatttctggggattgggttgataaaatttcgataaacagaaatgacagcttaactagtgatgatagtctcgtggggcagtgggaagcagaaagcaaacaatcttctccaatgtcaagtccaacctttctctcagagccttctaaaatatgcctggaccactccttgcatagaaaggataaccaagaattgtttgatatgtccaccacatatgaatctgatgagcttgagattgcaactagtgattctgcagaatcagacttacattggccagcacatatacctaaaccaatcaccgtttcaagcggactaggcattaaagcaaggaagaaaccaattaatctcagaccaacaaagagcctagaagccaggagcatgatcccatcattaattcctattcctgtgccatcgaggaaacaacccaccctagttactccagcaagaaaaaatccagtgtctattgatgtgaagagaaggattgtgaatgccaagtga

SEQ ID NO: 14321 - DNA, 248 bp, Glycine max
  Peptide Sequence Number=SeqID_131099
gactcctttgatggctgccatgcatgaggatgattctcctgacttaagagaaatagcaagaatccttaatgacatatttgaggcaagaaaaaatgtggtgaaggtgtgtgatgtggtcactcggaatgactgccaattggtggatgatattccagttgaaaagctgctaatccatgatgtaccagtggatatcatttatacctcgacacaggtcatttttacaaatacatctatcccaaagcctcaag

SEQ ID NO: 14322 - DNA, 525 bp, Glycine max
  Peptide Sequence Number=SeqID_131100
atgttaatctgtgtaagtgtgtgtttggatagcccccaaaatcatggtagaccatggtataaagataatcgccatgtgagcatgggtgcagagaaatggttggacattgaactgtgggactctacaaaggagtgctttaaaatgttgaaatcacgcggttatcgaattgccacaactcatgtgggaatggatgcggtctctattcttgatttagattggtccagcccaactacaatcgtggttgggaatgaaaataggggtattagtgatgaggcattggagttgtcagatctgcattgcagtattcctatggcaggaatggtgaagtctttcaatgtttcagttgctgcaggaatcctcatgcaccatgctgtttgtgatagaatatctcgtatgggctatcatggtgatatgacagtagaagaatgccagattctacttgcagagtttttgttgcgtcatagcaagagttcgattagtattgttgaagattatgcaatgcgtaaagcagtaacattgacttaa

SEQ ID NO: 14323 - DNA, 174 bp, Glycine max
  Peptide Sequence Number=SeqID_131101
atgttggaatctatgcttgaagtggtgtcaagatttaaattcttctgggtcgagagatatcggagagaaaccattagcatggggaagaaggtgagttacatggagggattgggaggagtgggattagagtgtgtcagaggaaggcacatggagtggaagaagggtactatataa

SEQ ID NO: 14324 - DNA, 2169 bp, Glycine max
  Peptide Sequence Number=SeqID_131102
atgattgttatgtccactctttttgacagttggattagcaaaaagttgcgacgaaggaattcaattagcaatggtgacagtggcagcgacagcttccagaacggtgctgccacagttgtggatgacaatccatttagcagcggggtggagtgttacgcctgcacgcaagtaggtgtgccggtgtttcactccaccagctgcgacagtgccttccaccagttgcagtgggaggcttcggctgggtcgtctctggttcccatccagagccgacccaacaaggtcctcggctttcggaccgtgtccggatcaagtcgggggccgttcgggcgggttctggatccgagaagcaagcgcgtgcagaggtggaaccgcgcgctgctcctggcgcgtggggtggcgctggcgatagacccgctgttcttctactcgctgtcgataggaagggaggggtcgccgtgcttgtacatggacggagggctggcggcgatggtgacggtggcgcgcacgtgcgtggacgccgtgcacctcttgcacgtgtggctgcagttcaggctggcgtacgtatcgcgggagtcgctggtggtggggtgcgggaaactcgtgtgggacgcgcgtgagatcgcgtcgcattacctgcgatcgttgaagggattctggttcgacgcattcgtgatcctcccagtcccccaggttgtgttttggttgttagtgccaaaattgctaagagaagagaaaattaaaatcattatgacaataatgctattgatttttttgttccaatttctccctaaggtttaccatagcatctgcatgatgagaagaatgcaaaaagtcacaggctacatcttcggcaccatttggtggggttttggtctcaatctcatagcttattttattgcttctcatgttgctggagggtgctggtatgtccttgcaattcaacgtgttgcgtcgtgcctccggcagcagtgtgagagaactaatggatgcaatctctctgtgtcatgctcagaggagatatgctaccagtctttgttaccagctagcgcgataggagattcatgtggtggaaactcaacagtggtaagaaagcctctgtgcttagatgttgaaggacctttcaaatatgggatctaccaatgggcacttcctgtcatatccagcaactctttggctgtaaagattctttatcccattttttggggtttgatgaccctcagcactttcggaaatgatcttgaacccacaagccactggctagaagtgattttcagtatatgcatagtactcagtggactattgcttttcacattattgattggtaacattcaggtattcttacatgcagtcatggcaaagaagagaaagatgcagctgagatgtcgtgacatggaatggtggatgaggaggaggcagttgccatcgcgattaagacagagagttcgccattttgaacgtcagagatgggcagcaatgggaggagaagatgagatggaaatgatcaaagacttgccagaggggctgaggagggacatcaagcgccatctttgcctcgatctcattagaaaggcaagtaatgttcacatgaaagaagttcctctattccacaacttggatgatcttattcttgacaacatctgtgacagggtgaaacccctagtcttctctaaagatgaaaagataatcagagaaggtgatcctgtaccaaggatggtgttcatcgtccgagggcgcataaaacgcaaccaaagccttagcaaaggcatggtagcctcaagcatccttgagccaggagggtttttgggtgacgagctgctttcatggtgccttcgcaggccgtttatcgatagacttccggcctcctcggctacatttgtgtgtcttgaatcatcagaagcctttggccttgatgccaatcacttgaggtacatcactgatcacttccggtacaaatttgcgaacgagaggctgaagagaacagcaagatattattcatccaattggagaacctgggctgctgtcaacattcaatttgcttggagacgttacaggcagaggactaaaggtccagtgacccctgtaagggacactaatggaggcactgaacgcaggctcttgcaatatgctgcaatgttcatgtcaataaggccacatgaccaccttgaatga

SEQ ID NO: 14325 - DNA, 486 bp, Glycine max
  Peptide Sequence Number=SeqID_131103
atggcgcgatggcatttttgtaattttcacagttccttctacgacagtttggtccatacctgtgcccccttataccctaaagctcagttgacgcaagtcatagctctattgtcgtacctctcatcctgtgccgttgatctcctctgccgtacgtgccgccgtgacctcctttgccgtacgtgccgccgtgacctctcacagttccttctacgacagctctattgtcgtacctctcatcctgtgccgttgatctcctctgccgtacgtgccgctgtgacctcctctgctgtgccaccacgccggagtcacctaatccctaaacaagcagcacgtcctgctcgattcccgccgtgggcttccccccgctctcgaagttttaagacaattctcgaattaagctacgcttggcactgtgtctgctattcaggatgccgctacggccaacctggttgggctcttcgagggtaccaacctctgcgctattga

SEQ ID NO: 14326 - DNA, 235 bp, Glycine max
  Peptide Sequence Number=SeqID_131104
atggctgcaacgacctctcgtgcctcaccaagatcccctaaaaaaaaaaatctcagccaccacgatggtcactcctttgccgcacgtgtttgttttcaaggacctggtcatggacatgacgaacttctacaatcagtacaagagtgtcgagccatgactgaagaggaagagcccaccagtgccgagaaaagagattctgcagagcaagaaggagagggagaaggctgggtgggat

SEQ ID NO: 14327 - DNA, 870 bp, Glycine max
  Peptide Sequence Number=SeqID_131105
atgttgttgtatcaaaagggagtctccaaggataaggagcagaggaggtttggatctctcgtgagacaacaacactcatcatgtcattgtggttttcttgagtttaagaatcaggaatctactcaatttcaatgtgttggtcccagaacaccgagtggtggtggtggtggtggtgctagataccggtttccaaaggaacctagccaaggcttttgctttgactatggcataacccttcaatcccgaagagaccctagatgcaagttccgggaaattgctaacaatgcctctctgcatttatcctcaaagaggtccattgataatgtgctatgtactccctcacatgcaccttctgtgaacaatggcgagaagccttactccagagaacaatgccataataataataataataataataataataataataataataataataataagaactatgagagagagagttcttcaacgaagaggcgaattgatgatgtactaagtactccctctcatgcatgttctatgaacactagggagaagcttaactttagagaacaatgccatgataataataagaagaactatgagagggagggttctttgggctggaaaccacttaataaagggaacaatacttctgaaaggttttattctcgaagcacagtaaatggtagggacaggaacatgaatatagtggaaagcagtgccaacagtgtgattgaagagacaaggaagaggccgaggctaagttggggtgaaggacttgctaagttcgagaaaaagaaaactgagggtgatggtgtaagtgctgctactactgctactcctgcttcttgtgcatgcaattccttctcaggatttagtaaataa

SEQ ID NO: 14328 - DNA, 339 bp, Glycine max
  Peptide Sequence Number=SeqID_131106
atgggcgctagggatgcaaataatggtgaaattttagaatccaactgcaagggtgagagctctgctaaggtttctaagaaggacgaaattgaggaggacaaggtgtctgagtcggaagtcaatttgcttcaatggagtaggaagaatagatggaaggtagtgggggtgttggaagaagatggtgttacaggcaatggagggaatagttcctatatggagagttttatcaaaacggacgtaccttttgaagggtgtgaaggtattatggatgatgattggttttatcaattcattaatggaaccaacactggtggtgcaagccctggaaaggagcactga

SEQ ID NO: 14329 - DNA, 3585 bp, Glycine max
  Peptide Sequence Number=SeqID_131107
atggtccttacactcagaatgaatgagttgcatgtcgtcaaaaagacaatgcctcgaaattattgcgatacacttcaagaagacaaagagataaaatcggtgtttgaagatcgagattattggcgcctttcggatttgaggagcagctatgacttctttgagccgagaattagtgtttctgatactccaatttttggaggaggagaagttcaaggagtcggtgcacaagaggaagcaattcgtgccacaaaatggagggaaacttttgaaatgcttgagaaagaatctgggtttttcttcaatatgaagtactttgaggaaaaagtacaggctggtgaatgggaagaagttgagaagtacttaacagggtttaccaaagttgatgataatagatactccatgaaaatattctttgaaatcaggaagcaaaaatatctagaagcacttgatgggcaagacaaagcaaaggctgttgagatattggtgggtgatttaaaagttttctccaccttcaatgaggaactatacaaagaaatcacccagctgttaactcttactaacttcagggagaatgaacagctgtctaagtatggcgacaccaaaactgctcgagggattatgttgatagagctaaaaaagctcatagaggcaaatcctcttttccgtgataaacttatcttccctacccttaggtcatcaagattgcggacgttgatcaatcaaagtttaaactggcaacaccagctttgcaaaaaccctaggccaaatccggatataaagactttattcactgaccacacatgtacacctcctaatggtcctctagcacctacacctgtcaatcttcctgttgctgcggttgcaaagcctgctgcttatacttcaattggttctcatggtccctttccgcctgccgcggcaactgctaacactaatgctttggctggttggatggccaatgcctcagcttcatcatctgtccaagcagctgtcgtcacagcatcaacaatacctgttccacagaatcaagtgtctatcttgaagcgtccaagaacacctccgacaactccaggcatggcagattatcagaatgctgatcatgaacagttaatgaaaagactccggcctgctccttctgtagaggaggtttcatatcctgctgctcgacaagcctcttgctcactggatgatttaccaagaacagtggctatgacattgcatcaaggatcctctgtgacaagcatggactttcatccttctcacccaaccttacttctcgttggttctaataatggtgaaatttcactttgggaacttgggtttcgagacaggttggtctcaaagccattcaagatatgggatatctcagcgtgttcattaccatttcaggcagctatggtcaaagattcacctatttctgccagccgtgtcacatggagccttgatggaaattttgtgggtgttgcatttactaaacatttgattcacttgtatgcctacactggatcaaatgagttggctcagcgtatagaggttgatgcccatattggtggagttaatgacttagcatttgctcatctgaataaacaactctgtattgtgacttgtggagatgacaagttgataaaggtgtgggatatagctggacggaaactatttaactttgaggggcatgaggcagctgtatattctatctgtcctcatcacaaggagagcattcagtttgtattttcaactgccattgatggcaaaataaaagcctggttatacgataatatgggttctagggttgattatgatgccccaggtcattggtgtactacaatgctttacagtgctgatggaagtagactgttttcttgcggaactagtaaagatggagagtcatttcttgttgaatggaatgaaagtgaaggagccattaagagaacatacaatgggttcagaaagaaatccactggtgttgtgcagtttgacacaacccaaaatcgatttttggctgctggtgaagatggccaaatcaaattttgggatatggacaacattaatcttttaacaagcactgatgcagagggtggactacagacccttccacacttgagattcaacaaggaaggaaatcttcttgctgttactactgcagacaagggattcaaaattcttgctaatgctaatggtcttagatccttgagaacagttgaaactccaggatttgaagcattgaggtcaccaattgaatctgctgcagtcaaggcatctggctcttctgctgttaatgttagtcctgtcaactgtaaagtagaaaagagctcacctgtcgggccttctccaattcttaatggagtcgataccacaggtcaaaatgcggagaaacctagaactgtagaagatggagtagatagagctaaaccatggcagctgtctgaaattgtggatgctgtccaatgtcggttagttaccatgcctgacagtacagattcttccagcaaggttgttcgacttttatatacaaactctggtgctggtgttttggcacttggttcaaatggtgttcagaagctgtggaagtgggctcgtagtgaacaaaatcccaatgggaaggcaactgccagtgttgttccacagcattggcaacccaacagtggtcttcttatgactaatgatgtcgcgggtgtcaaccttgatgaagctgttccttgcattgcactctcaaagaatgactcatatgttatgtctgcatgtggtggaaaggtttcgttatttaacatgatgacattcaaggtaatgacaacattcatgccaccaccacccgcctctacctttctagctttccaccctcaagataataacatcatagccattgggatggaggattcaacaattcacatatacaatgttagagtggatgaggtgaaatctaaattgaagggtcatcaaaagcgaattactggtttagccttttcaacctgtcttaacatcctggtttcatctggtgctgatgctcaactttgtgtatggagtattgatacatgggagaaaagaaaatcagttcctatacaactacccgcaggaaaggctcctgttggtgacactcgtgtgcagttccatttagaccaaatccggttactggtggcccatgagactcagttggcaatatatgatgcctctaagatggatcgcattaggcagtgggttccacaagatgttctggctgctcccatatcatatgcagcttattcctgcaacagtcagttaatatatgctacattttgcgatggcaacactggggtttttgatgctgacagcttgagactaagatgtcgtattgcactatccacatacttttcacctccagcagctttaagcgggaatcaatctgcgtatcctgttgccattgcggctcatccactggaacccaaccaatttgctgttggattgacagatgggtccgtgaaagtgatagagcctagtgaatcagaaggtaagtggggaaccagtccacctatggataatggaatattgaacggtagggcagcatcaacatctataacaagcaacctcacacccgaccaggcacaaagataa

SEQ ID NO: 14330 - DNA, 1497 bp, Glycine max
  Peptide Sequence Number=SeqID_131108
atggaagcatgttttctctcccacaattccttcaccaaaaccactgatcaactcatccccacaatcagaaacgggtctctaccacaccccaaacgatcttctcaacatttccactatagaaaagctagaattccacttcccatatcatgctgccacatgtcatcaccatcaccatttgatgatgatgaaaaatctaccctaagtggtgattggcgatctttccgagcaaaactggtggctggagaacaattgacaaggcctgttgaggaggtttctttttcttcggtgaacgatctagacattgttgtggatcaccctccactgatcaccattggtgacaaatgggcccacgtaatccacgagcccgaaaaggggtgtatactaattgccaccgaaaagcttgatggggtccatattttcgaacgaacggtgatccttctgctgtcaactgggcccttaggcccatcagggatcatcctgaatcgtccatccttgatgtcaatcaaggagactagatcaacggctctggacgtggagggcacgttttccaatagtcccttgttctttggggggcccttggaggaagggctttttttgttgagcccaaaagagggtggtggtggtggtgatggggtggggaaaagtggggtgtttgaggaagtgatgaagggcttgtattatggggcaaaggaaagtgttggttgtgctgctgagatggtgaagaggaatgtgattgggcttggggattttaggttctttgacgggtattgtgggtgggagaaggagcaattgagagatgagataagggctgggtattggactgtggctgcttgtagcccaagtgtggttgggctggggagtgtgggaagtgttgggctttgggatgaggttcttgggcttatgtccagaaggaagctcctccgttcaagaacccttgccaagcttaaaacgcgtgagaagaagttcaagccggtggcggagcacgtgaacgcggtgcatcgcctcctcgacccagcctcgttgcccttcaagtggtcgtggcgcgacgtctcgataaagaagatctgcctctcccttcaccacttcaattggaaggacgataacaatcattgggagaattttcttaaatacaaagaaggtgaggaggttgggttcgatggtggagctgagggaggtggtggtgaagcgcgaggagaggtagcgggagagggagttccgccggaagaaggtggaggcaaagcgggagaggaagaggagagaggcggagtttcagtgggagaggcagagggagtggttggaggatcgggagatggagctggaggagcgccagttgaggtgggtcagtgtgctcttgttcttctcagccaacgcgacaaccttccaaaaggaggagtttaccctcctgggatcatctttggtccaactgatctccaggaaagacttcaacagaatggaatatcctttgatgtcatctcagaaagcaccatttcttcttga

SEQ ID NO: 14331 - DNA, 774 bp, Glycine max
  Peptide Sequence Number=SeqID_131109
atgtcaccacccttactatacccgcaaaccatcgtcgaccacgagacgatattcctccaaggcattctctcaaacagctcaaacgccgtgtccatctcccccgccttggcgcatttcatcaaacagcttacacgcaccctgcaactcaccacatctgaccaacccaccaatcatggagttccaagtgaccacatccctctcctccatggccaaaaacaagctcatggccccatcaagcccggcattcccgcacctggagtaggagtcaataagcgaattgggcacaaagatatccccataaaaaccaattttttcaacatgggcatggatcattcggaccaaaggaagcgaggaggggccagaacaagccttaaggagaaaagggtacgtgaaattatcaggaaagagtccgtttttctgcatttggaagaaagcgttgaaggggagagaacggtgggaactgttgtgggcgtgggctctgatgatggagttgtagaggtggacgttggggtgggggacgtggttgaagacgttgacagcggaggcgaggtggcggcagagggagaaggcggcgatgagtttgggagcgacgaagaggtcttggtggagattggctttgaggacttgggcgtggatttggttcacagagtccaaattggtgcacttgtggaggtcgcagagcttctcttcgaggagtcttcgccgagagaaccatgtggggactcgccctcccaccggaacttgcatttgcatcgccactcacacagtgcatag

SEQ ID NO: 14332 - DNA, 1356 bp, Glycine max
  Peptide Sequence Number=SeqID_131110
atggaggagagggatgtggtcacttggaactccatgattggtgggttggtcagatgtggtgagttgcagggtgcgtgtaagctgtttgatgaaatgcctgacagggatatggttagttggaacaccatgttggatgggtacgccaaggcgggggagatggacacggcgtttgagctgtttgagagaatgccttggaggaatatcgtctcgtggtcgacgatggtttgcgggtatagtaagggtggtgacatggatatggcgaggatgttgtttgacaggtgtccggtgaagaatgtggtgctttggacaacaataatagcgggatatgctgaaaaggggcttgcgagggaggcaacggagttgtatgggaaaatggaggaggctgggatgaggcccgatgatgggtttttgcttagcattctggcggcgtgtgctgagtctggaatgctcggattggggaagagaattcatgcgtctatgaggaggtggaggtttagatgtggcgctaaggtgttgaatgcgtttattgatatgtatgccaagtgtggttgtttggatgctgcctttgatgtctttagtggaatgatggcaaagaaagatgtggtgtcttggaattccatgatccaggggtttgccatgcatggacatggcgagaaagcacttgagctcttttcttggatggtacaggaaggttttgagccagatacgtatacatttgttggccttttgtgtgcttgcactcatgctggccttgttaatgaagggcgtaaatacttttattcaatggagaaagtatatgggattgttcctcaacttttcatgcttctgcgcagcatgcctatggaaccaaatgccattatattgggtactcttctgaatgcttgtcggatgcataatgatgtagatcttgcaagagctgtgtgtgaacagctgtttaagttggagccatcggaccctgggaattactcccttctgtcaaatatttatgctcaagcaggagattggatgaatgttgccaatgtgaggttacaaatgaagaatacaggaggtgaaaagccttctggggctagttccatagaggtagaagaagaagtgcatgaatttactgtatttgatcagtcgcaccctaaatcagatgatatatatcagatgattgacagattagtacaggacctcaggcagtgcattgctggtttactaaaaacaagtaaacaaatcattgtattcatcactaccactggtttagcaacaaagttgtatgcatggctcatggctgaacctatgcttctggtgcaagcatcacagtacggatcccaaaagctctgcttgcagcatggcgtgatatctcttgcatga

SEQ ID NO: 14333 - DNA, 1137 bp, Glycine max
  Peptide Sequence Number=SeqID_131111
atgagttcgtgttgcttagagaaagagaaccatgtggtggaaactgccaccccacaaagagaagacactgatattatcctggatgccatggtgctcggttccaatgtggtctttcctgccgctctcaacgctgcaattgagctcaaagtgtttgagatcattgggaaggaaagctcagaagagagtggtggattcatgtcaccccatgaaattgcttccaagttgttattaccaacacaacaacaccactctgacttgccaaataggcttgagcgtttgttgctcttgcttgctagctactctcttctcactgtttccactcgcaccgatgagaatggtagcgccgtgagagtttatgcggtctcaccatcgggtaaatatttcgtctatgataaaaatggtggtggctatcttgcttcattcacatcatttctgtgtcaccctgcgatgttaggagtatggttgaattttaaggaagcgattattgatcctgagattgacctattcaagaaggttcatggaatttctaagttcgagtactttgggaaagaaccagaactaaaccacgtatttaacaaagcaatgaatgatgtatgcacaacccatatgaaaaaaatacttgaagtatacacaggatatgagggtatatcaactttggttaatgtagcaggtggaactggacaatgtctcaaattgatcatctccaaatacccttcaattaagggaattaattttgacctcccacatgtgattgaaaattcaccacccattccaggggttgagcatattgggggaaatatgtttgaaggtgttccacaaggtgatgccataatgctaaaggccatatgccataattggtcggatgaaaaagccatagaacttttaagcaattgtcacaaagctttgccaccaaacgggaaggtcattgttggggatctcatagtgccagaagatccagaacctacaaatgattgcaaaatgatttcaattcttgataacatcatgtttattacacctggtggaagggaaagaactgagaaacaatttgaaagtttgggcaagcgttctggattttctaggtttcaagttgtttgtcgggctttctctactatggcagtgatggaattttacaaataa

SEQ ID NO: 14334 - DNA, 789 bp, Glycine max
  Peptide Sequence Number=SeqID_131112
atgacaacactcccatctccctcactcctctttatcctcccaaaccttaaattctccaaaacacgtgcccagtgtgtcaacggtttgctttgtatccaccccaaatgcactgttaagttttcttctcgtgtcaatgctttcactctcgtagcaaaccccaccactagacaggttattactctcccccttgatcaatctatagacaaagattttgcaagtcaactcattttggatacaacgctgatcaagatgagttcaaagttcttggcatggttatgtatcaaggtggttctcatcatgaggtcaagacactatgctttgatgtaccatgaccttttgtccgcttttgattcgatgtggggactgaacagttcaggggtcatgcctgctcctccaagatatctggagggagttgtttggaatttgaagcacctgaatctcatggaaattcatggttgtttgtgtttgcctggacacacgtacaataatagcagaaatttgaagttgtggattttgatggactacatgtgggagcaacaaaaaagtgttgtcctcccttctagggttatttttccactctgtagagtccccacaggtgagatcctacttctgccatattttcttgatagatgtgttggagaagcctacagtgacatggacacaacaagctccaggagtcttgtggtcatggaaatgccttgtgatccattgtggggtgatcatacattagtagactttgacattttctattctcaagaaagcttcaggctattaagtgaagagacttag

SEQ ID NO: 14335 - DNA, 1497 bp, Glycine max
  Peptide Sequence Number=SeqID_131113
atgtacactcccaacgccgattccggcacggcgccgcatccgcgccccaccatcacgctccctccgcgtccctccgccgaggccttcttctctgccgccggcggcgccagccccggccccatgaccctcgtctccagcttcttcggctccgatgccgctgccgactgccgctccttctcgcagctcctcgccggcgctatggcctccccaatggccttctccgccgccgcagcatccgccgccgacaactccggcaaggacgacgatgggccccacaaggggttcaagcagagcagacccatgaatttggtcattgctcgttcccctgtcttcactgtcccacctgggttgagcccttctgggtttcttaactcccctggcttcttttcccctcaggctttagcacaggttacagctcaagctgtcctagctcaatctcatatgcatatgcaagctgattaccagatgccttcagtaacagctcccactgaaccacctgtacagcagctgtcttttgctctaaatgaagcttcagagcagcaagtggtatcatgtgtatcagaacctagaaatgctcaacttgaagcaccggaactctcacaggctgataagaaatatcaaccatcttcccaggccattgacaaacctgcagatgatggctacaactggcgtaagtatgggcagaagcaggttaagggtagtgagtatccacgaagctattacaagtgcacacatctgaattgcgtcgtgaagaaaaaagttgagcgtgctcctgatggtcacataactgaaattatctataaaggccagcataatcatgaaaagcctcaggcaaataggcgtgccaaagataatagtgattcaaatggaaatgtaactgttcagcccaaatctgagtcaaactcacaaggttgggttggacaattaaacaagttaagtgaaaacattcctaattcttcagttcctgaaagtgaccagacctccaatcaaggggctcctaggcaacttctacctgggtcaaatgagagtgaggaagtgggtattgtagataatagggaagaggcagatgatggcgagccaaaccctaagagaaggcaagtttatccattacctctgtctcagaagactgtcacagaacccaaaatcattgtgcaaacaagaagtgaagttgatcttttggatgatggctacaggtggcgaaagtatggccagaaagtggtgaagggaaaccctcatccaaggagttattacaaatgcactagtgctggatgcaacgtgcgtaagcatgttgagagagcttcgacggaccccaaagctgtcataaccacgtatgagggtaaacataatcatgatgtacctgctgctagaaacagcagccacaacacagctagtagcaattcaatgccattaaaaccgcataatgtcgtgccagagaagcatcctttgcttaaagataaggattttggagtacagaatgaagagaatgaagttgcctag

SEQ ID NO: 14336 - DNA, 2109 bp, Glycine max
  Peptide Sequence Number=SeqID_131114
atgtctcaaaaattaactaacagtgagtttagaagtcctcagtttacaaccaacaataaaagtctcataccggagtgtctgcttggccttctaaaaacaaaaactgtgatatacataactcatcaagtagagttcttacctgatgctgatctaatattggtcatgagagaaggaaggataactcaatcaggaaaatacaatgacattctcaggtcagacactgattttatggaacttgtaggtgcacatagagaagctttgtcttcagttatgtcctcagagagaattcccacacttgaaacagtgaatatctccacaaaggactcagattcattaagatattttgaacttgagcaagaagagaaaaacatagatgatcatcatgataagtcagatgacacagttaagccaaaaggccaactgattcaagaggaagaacgggaaaagggtagagttcggtttaaggtctactggaaatacatcacaacagcttatggaggagcttttgtaccctttatattgctctcacagacacttaccacggtttttcagattggaagcaactattggatgactttagaaactcctatttctgcaactgcagaaactggtattgaaagctttacccttatggttgtctatgttgctttggcgattggaagttcatttttcaaccttgtcatatcagttcttagagagatagctggatacaagacagccactatactctttaataaaatgcatttttgctttttccgagcaccaatgtcattttttgatgccaccccaagtgggagaatccttaatagagcttcaacagatcaaaacacaatagacataagcatttcatatttggtatgggtatttaccttcattttgattcacctcttgggaactattgctgtgatgtctcaagctgcatggcaggtgtttataatattgattcctatcacggccacttgcatatggtaccagcgatactattctgcatcagcacgggaactggcacgattagttggcatatgccaagctcctgttatacaacatttttcggaaacaatttctggatcaacaaccataagatgttttgagcaagaatctagatttaatgacatacatatgaaactgatagatagatattctcaacccagattatacagtgccagtgcaatagaatggttggctttcagattggatattctatccattaccacatttgccttctgtttggtttccttgatatcttttccaaattcaattactgctccgggcattgcgggattagctgtgacgtatgggcttaatctaaatgaactacaatataatttaatctgggatctttgcaatttggaaaatgaatttatatccgtagaaagaatacttcaatacacctccatcccaagtgaagctcctcttacaataaaagacaaccaaccagatcattcttggccatcatttggagaagttcatatccaggatttacaggttcgatatgcgcctcatttgcctctaattttacgtggtcttacttgcactttcgctgctggagcaaaaactggcattgtgggaagaacaggaagtggaaaatcaactctagtgctaacactttttcgacttcttgaacctgttgctggacagatattgatagatagtgttgacatatctttgattggaattcatgatttgaggtccagactgagcattattccacaggatccaacaatgtttgaagggactgttcgaagcaacttggaccccctggaagaatacacagatgaacagatttgggaggctctagatatgtgccaacttggagatgaagtaaggaagaaagaagggaaacttgactcctcagctactgcctcagttgatacagccacagataatattattcagcaaacagtgaagcaacatttttcagaatgtacagtcattaccattgctcatagaataacttcaatcctggatagtgacatggttctgtttctaaatcaagggctcattgaggaatatgattcaccaaagaaactacttaagaacaattcttcatctcttgctcaactagttgcagaatacacaaggagatcaaactgtggttttggaacttaa

SEQ ID NO: 14337 - DNA, 1944 bp, Glycine max
  Peptide Sequence Number=SeqID_131115
atgtcttatttcttcaagcaaaaccttacaatattaaaaagttccagacttggaatccaaaccggctgtgtaaagatttatgaatcagctcatgagcttgtaaagaacagagactctgagcaagctaaacttagcattggacaaggtacatatagcagtgtattccaagcacgcgaagttaaaactgggaggatggttgccctgaagaaggtgcactttgacaaatttcaagcagaaagcattaggttcatggcaagagaaatattaattctccgcacacttgaccacccaaacatcatgaaattggagggtataatcacttcaaaactatcaaatagcatataccttgtatttgaatatatggagcatgaccttgctggcctagtcgcttctcctgacataaagttcaccgactcacagattaagtgttacatgagacagctattaagtggaattgagcattgtcaccttaaaggtattatgcatcgagacattaaagtatctaatatattagtgaacaatgaaggtgttctcaagatagcagattttggattagccaatacccttgtcccaaatagtaagcaacccttaacaagtcgtgtggtgactctatggtatcgtcctcctgagaacttgttgggatcaacaaattatggagtttcagtggatctatggagtgttggttgtgtatttgctgaactttttctggggaagcccatccttaaggggagaactgaggttgaacaattacacaaaattttcaagctttgtggttctccaccagaggagttctggaaaaagaataagcttcctctggccacaatgtttaagcctcggactaattacaaaacttctcttaaggagcggtgtaggggttttcctgcaactgctgtaaacctactagagaccttactttccattgatccctctaaacgtgggactgcctcctctgccctcatgtctgagtatttcagcaccaagccatatgcttgtaatccatcactcctgccaaagtatccaccaagcaaagaaatggatgccaaaaattgggaagatgtgcgcaggaaaaagaatggaggtaaagtgagagaggccgtaacatcaaaaaggcaaagacaagtccacaaagtttcccatgaccatatcaatttcaacaaaccagctttgaaagaggaaatgcagaatgattctcaaaatgctgctccagatgatggtagggcacatgttacaaaaggaaaagtagcaggagctatgcataaagagcaaccaaagccttcatatgatgcgaagtcagaggctgcccaagtggtgaatggttgcaatggatacagtgtatactcaggaccatcaccagtctcgggatctagtggctttacatgggctaaaaggagaaaaccaaaagcttcatccatattgtcaaatggctcaataagaaaagtcagtgctctggatccaacctttgcaaaaggcacatatgttttaacagaacatgggatagaagtttcagaaaggaaacatagttacaacacaaaccatcaggatgtgacttccaactatgtatcaaaaaagtacctggctcctcgtgttcaacaaaaatcatttgatgtagctgatacatacaactcaaattattacatggactttgatttcacagataaaatggatgctttgatagatactcagggccacagaaaacatggtgagcctgtggagccaaaaataatcccatcagataaaaatgatgagatgttgcattggaatgaacatagtatgcgacaatgtcttcgtaaatcgaggtttggaagaggtgttgtagaaagtgtagacatctacgacgacggttgtaatgaaccgtcatctctacatgatgaacaacatgcaactacatcgtttcagatacaagacaacgagagaggaaagagatcaaaagatttaaccaaataa

SEQ ID NO: 14338 - DNA, 1011 bp, Glycine max
  Peptide Sequence Number=SeqID_131116
atgaagaaaggaagaaggaatgggaaatgtggggggagggaagctgctgaagcaatggcaaaggaagctaagaagaatgacatgatgttgtgtagctctggcattgttcatgtcgatggttcaaacaactttgcctccgttttctccaaaagaggccagaaaggagtgaaccaagattgctgcatggtgtgggaggaatttggatgccaagaggacatgatattttgtgggatatttgatgggcatggaccatggggtcactttgtggccaaaagaataagagagtcaatgccaccatctttgctatgcaactggcaggagacattagcccaaacttcaattgatcatccggctattgatgtagaggaagagaaaagtaaacattacagattcaacatatggaagcattcttacttgaagacttgtgctgccattgatcaagaactagagcaatatcgcaagatagactcgttttacagcggaacaactgccctatcaattgttagacagggtgaactcattgtcatagcaaatgttggcgactctcgtgctgtattggctacaacatcagatgatggaagtctggtaccagttcaactaacaatcgatttcaagccaaatttaccacaggaggcagagagaataattcagtgccaggggcgtgtgttctgcttagaggacgagccaggggtgcatagggtgtggttaccggatgaagagtctccgggactagccatgtctagggcctttggtgactactgcatcaaagggcatggtcttatttctgtgcctgaggtttgggatgtaatctctaataaagaagcagtggatattgtatcttcagcagcagataaagctaaggcagctaaacgtttggtggagtgtgcggtgcatgcatggaaacgcaagagacggggcattgccgtggatgacatttcagctatttgtctcttctttcactcttcttccctttcaacagggcaagttagccaggttgccacattaaaatag

SEQ ID NO: 14339 - DNA, 312 bp, Glycine max
  Peptide Sequence Number=SeqID_131117
atgaggcaccaaatccctatgataggtggtatgatgaatgtgttgagtggtgcaaccctcatttgtaaaatcacccatgcatccaacatcttcatgattcacatatatagggactcattagcaccactcattgagttggtgaggaaccatgttccctcatggaagatgcccaggaaatggggggatggaatgatgcaatcctacccctcaagggcattgaatagaagactccaagaagattgggctagagatgcaagagaaggcgctatggttctcatgagccttagggtagatttcgggcccgtgggctaa

SEQ ID NO: 14340 - DNA, 1242 bp, Glycine max
  Peptide Sequence Number=SeqID_131118
atggcaaggaagagaaaggttactgaagcagttgaagagaggaatccatgtgaggcaacaatggcatgggaagaggtgatgaaggaagctgctgaactaggaagtgccaggagattgaggaagaagtttgttggggtgagacaaaggccatcaggaagatgggtggctgagataaaagataccattcagaagataagagtgtggttaggaacctttgatacagcagaagaagctgcaagagcctatgatgaagctgcttgccttcttcgcggcgccaacactagaacaaacttctggcctagttctcaatcttcctcaactcctgctcttccctcaaagattaccaatctcctccttcaaaggcttaaagcaagaaacaacaataacaataacaacccttgttctctttcttcttcctcctcctccagttctcttttcatcaatcaccaacaaaagcagctagaagatgtatgtggaactgagtcaacatttttctcaatggacctgttctcggatttccttaatgaccctgaagattacagcacaagcaacgatgagtttagcaatgatagtgcacaaattgattacatcacaagtagtcttgaatcatgtttaaatggaaatgatgattgcagggaaaaagaaaaagaaatggaaatggaatttgacttcagcagtgtgacaccaacatcaagtgctgatgtaaattcaggaggggagagagaggaagagagtgaagaagccactgatttgagtgctcaggattttcagtttcttgacaatgatgttccacccggttacttttattcaccttttgagattgctgaagatattgaggagcaattggagccagagaactatggtgatgagccttcaatgctgagagaagtaatgaagagaatgaaatatgagaggaagttttcagcttctctttatgccttcaatggaatacctgagtgcttgaagttgaaacttgagtcaggaaacacaaatggaagaggggtttctatttctaatcaactaaccaacctcaagatggcttgtagcaaaaacaaaaatgaggctaataagaagaatgaagaatacattgaagcaatggataggaaagaggaagaaaacccacaaacatcaattggcatggaatgctcttccctctctttctcatccaggattgatgatgatgatggagaactgttgctatggaattcacttgatcttcctactctttgctttgttaactag

SEQ ID NO: 14341 - DNA, 207 bp, Glycine max
  Peptide Sequence Number=SeqID_131119
atgaaggcaccgccgtcgcccggagagaacactctgaatgatgctgaagcttctgagagtaggttgacgggatgggagtttagggatattttaaaatcgagggtgcacgaagcaaaatgggaggtgcaggaagtaaaagccagcacgtacgcaagaataaaccattatagacgaggggcctgtactctagctaatactaattgctga

SEQ ID NO: 14342 - DNA, 387 bp, Glycine max
  Peptide Sequence Number=SeqID_131120
atggctccccgcagtttcgtcaccgccactgccggcatgcgccgctgccatctcggcgacaaaaacagctctaccaacatcggcattggaggcgacagtagcaacatgcagaggttctacacggatgatgcctcggggctgaagatttcaccgatggtggtgctcatgatgagcctctgctttatcgactttgtcaccgcgctccacgtgttcggcaaactctaccactccaaatctggtggcacccccgacctaaaaagcatacgttttgacgttgttgctacgtcaacaacgtcttcgaaggtctacaacgacgtcgcatttaaagacaggcctgcaccgtcgttgaacgccaacaaggaccgatgtaaaatgggttttttctaa

SEQ ID NO: 14343 - DNA, 258 bp, Glycine max
  Peptide Sequence Number=SeqID_131121
atgaggatcaaaaggtcttttaaggttgtaatggggccaaggacaaggcttgtagtgagctccaaaacaaggaaagggaaacaaggctcaaaagggctatcaaaggaattaattcaaggcaagtccatttggctagaagcttataagaacaaaattgcctcaatcatttccaaatatgcatgggaattgggacgcatcaacaagaatcaagccaaggctattgtgcaagcaatcaatggggcaaaacacaccaaatga

SEQ ID NO: 14344 - DNA, 117 bp, Glycine max
  Peptide Sequence Number=SeqID_131122
atggctattgtgattcctcgtgcagtacaaattaatgtcaaggatcctatggttgttcttgttcaccttcattccattaggttaaaaatagaaatgaccccactcaactataagtaa

SEQ ID NO: 14345 - DNA, 1731 bp, Glycine max
  Peptide Sequence Number=SeqID_131123
atgattcttgctgctcttctaacttcagttgtaattaaccttggcctatgttttatatttttcaccctctactctgtattgaggaagcagcctggtaatattaccgtctatgcaccacgcttagtttctgaagggaaacgtcaagagggtgatcaatttaacttggaacgtttgttacctgctactactgctggttgggtgagaaaagcatgggagacctctgaagaagaatttttatcaactgccggcttagatgcttttgttttcatgcgcatatttgtctttagtttaaaaatatttacttttggtggaattgtggggctactcattcttcttccaattaattgtacggggagtcaacttcatgatgattctgattttcaaaacaagtctttggattccttcagtatttcaaatgttaacaatggttcaaacaggtatttcaaagcttttctgctgcctatgcaatatgcatactgtgtttcaagaccgggatgctcacctattcattgtgtccataaaggttattccatcgaatgccatcagatttggcctttctcaaggttatggatccatttttgtgccgcatatgttttcactggagttgtctgcattcttctttatgatgagtatgagcatatttcatcaaaaagaattgcttgcttctattcatccaagcctgagcctcatcactttactatattagttagaggtattcctgttccacatggaagcacctgtaacgatattgttgagcacttcttccaggagtatcacccttctacttatcattcacattcagttgttcgtcgaagcagcaaacttcaaattctagttgaggacattgcacaggcccatcttaccttgtgctggaacttagtttttattcagaagatgggggagactgatgcagagagactgtacaaaaggcttacccaactaaaagataaagataatgctcctcaacggcataggcgtgatggatgtttgggactttttggtcacaaagttgatattttagatcattatgaaaagacattgggagacattgcagataatgtgagaatggaacagtcttcattggcaggaaaggaaattccagctgcctttgtctcatttaagtcacgatttggtgctgcaatagctttaaacattcaagaaggtgtcaatcccacagactggagtactgagcaagctccagagcctcatgatgtttattggcctttcttttctgtcacattcattagaagatggatcagcaagctggtggcttatgttgcatgcaatattcttacaatcctatttttgatcccagttgctctagtacaaggtcttatccatcttgatcagttggaaaccatgttcccttctctgagatgcatactgagaatggcagttgtaagccaagttataacaggatactttcccattctgattcttcagatgtttctgtctgctgtgccacctattatgattatgctttcatccttgcaaggatacatatcatggagtcagatacaaaaaaggtcagctctctatcgattgactatctttcttgagcccaaagagtttcccagagtactagcagaagctgtaccagcacagttttatgagaagtttctaaattgtttatatcaagatgaagttattaagagagcaagaaaccagaagaaaaatgatgataaaaaagactatgtcatctcaaaggagcttccctatcagtctgcataa

SEQ ID NO: 14346 - DNA, 2145 bp, Glycine max
  Peptide Sequence Number=SeqID_131124
atggcgaatacgatgcctgcatgttatgaggtatatataaccaatcctagtcgaatctggcaaactgataaagtcctcaaaacagagctccctattatcgctttccaaattgcctttgtcgttgtgttgtctcgtattttcttcattatctacaaacctctccatcaaactcgcctcatttcacaaatctctgttggtttcttgctaactccaccattacttgggagatacacaccaatttttgagttcatatttcctgtaaatggtgtcctaaatgttgaagttctttcccaccttggtctcatattttatgcattcctcagcggtttggagatgaacttagataccattttacgagtgaaaaagaaggctgctagcattgcggttgccgggatcgtctttccgatggtgatgggcccatgcttatatgctttgtaccgaaaaatttacggcagtcatggagtattcccccttgaagaaagtacagttaatgcttatttactttggactttaattctcacagtcacaggttttcctgtcatagctcacacactttctgagctcaagctcatttatactggtcttggcaaagctgctttaacagcagccatgatcagtgacacctacagttggattcttttcactttacttgttccatttgcaattaatggtcaaggagctatctacacggtgctaagcacgttagtattcattgttgtatgcatctttgtggtacgtccaatcattctacggtttatggataacaagattttaagcactttatttgccagtttcttctttggtgtgcacactaaagatggtttagccatgggcttgcttctcaataccaagggtgccatggcactgatcatgctaaacattgcttgggatagagcgattttttctgtacctacctatgcggttatggcttcagctgttcttctaatgactgtagtagtatctcctgtcatcaatgcggtctacagaccaagaaaaagattcgagcagaataagctaaagactatacaaaaactaagagtcgatgcggagcttcgaattctagcatgtgtccacaatactcggcaagccacaagcatgatcagcataattgaaacttttaatgccactagacttacccctatacatgtttttgccatgtaccttattgaacttactggacgtgctgctgcccttgttgctgcacatatagagaagcctagtagccaacccggagaacaaaatctcaccaaatcacaggcagagttagaaaacattgccaatgcatttgatgcatttggagaggcatatgacgctgccagaatcgaaaccttaaatgtggtgtcatcctatgcaaccattcatgaggacatatacaactcagcaaatgagaaacacacaagcttaattgtccttccattccataaacaattaaattcagaaggtgcgcttgaagtaaccaatgttgtgtacagagatataaaccaaaatgtaatgcagcatgccccttgctctgtgggaatatttgttgatcgtgattttgggtcaatccccaaaacgaaccttcgtattcttatgctttttgttggaggccctgatgatcgtgaagccttagctgttgcatggaggatggcaggacatccaggaattaaactatcagtgattcgaattcttttgtgtgatgaagcagcagaagtagattcttcaattcatgctgaagcacgagggatattgtcttctgtaatggatagtgagaagcagaaagagttagatgacgattatataaattcatttagatatacggcagtcaacaataaggattatatatcttactcagagattgatgtccatactggtgaagatattcccgcaatcctcaatgagctagaaaaaaatggttgtgatttgtacgtagtgggacaagggaattgtaggagctctaaagtcttctcaaatttgctagaatggtgtgaatgcttagaacttggagttataggggatattttggcctcaaacaattctggttcgcgctcatctttgctagttgttcaacaatatgggtatggaggaatggcttttggaaataatctccaccaaaagggcaccaataacgatggatttgagtcacttgttgtgaagacagagtaa

SEQ ID NO: 14347 - DNA, 255 bp, Glycine max
  Peptide Sequence Number=SeqID_131125
atgactgatgacagtgaagtgtcattcaataacttatgtgtagccttccacaggttgcacgaatactctatagagacaggcctagcaacaattattgatggtgatgacattctaaaagttagtaccaaacatctgagggaccttacttttcaagttggctctgtctaccaattcattagtgaactccttatccaagctgtaatgagggagttttgcaagcacgtgttggtagaaacgttgatgggattgatctaa

SEQ ID NO: 14348 - DNA, 834 bp, Glycine max
  Peptide Sequence Number=SeqID_131126
atgtttcatgaggccattgatttccttttcctaacacgccgccgcggaatcgtccctgatgtcctcacttgcaacttcctcttcaaccggctggtggagcatggtgaggtggataaggcattggctgtttatgagcagctcaagaggtttggctttagccccgattgttacacctatgcaattgttatcaaggcgttgtgtaaaaagggtgacctgaaacaacccctttgtgtgtttgaggagatggagagagttggcgggattcctcattcgtattgctatgctggttatattgaggggctttgtaataatcataggtctgatttggggtatgaggtgttgcaggcatttaggaatgggaatgcgcctttacaggtttatacatacgaggttgttcgcgggtttagtaatgagatgaagaagttagatgaggctcggggtgtgtttaatgggtattgtaagagtcataatctgctcaaggctttggctttgcacgatgagatgctacattcttcgttgtttggggagatggggatgactttggaggtggtggaccagtttaaggatttgaaggaatccaggatgcttcttgatggggtggcctacaacattgtgtttgatgctttgtgtaagttggtgaaagtggaggatgcagtagagatggtggaagacatcaatgggtactgccttcagggtgatcttgttactgcatttagcgtctttaaggaaatgaagggaaagggttttaaacctgatgttgtcacatctaatgtactggcgaccaggttgtctagaaatggtcatgcttgcgaggcagtgaagcttttggtttga

SEQ ID NO: 14349 - DNA, 240 bp, Glycine max
  Peptide Sequence Number=SeqID_131127
atggagctagccaaacctgtaatggaattggagttacagaagttgaatgatattgcctcatctatccacgacgagatcttttatcttcgtgaaagggaggtagagatgcaagatcttaacgacgagaccaacaccaagatgtttaccttcactttggtttctattttggtttgcttgtctgtggctggtttgcaactatggcatttgaagtcattctttgagaagaagaagctaatctaa

SEQ ID NO: 14350 - DNA, 1932 bp, Glycine max
  Peptide Sequence Number=SeqID_131128
atgggaaccaccactgttgcgttcaccctcgcccacatggcagagaggtgcacgtgcatgcgcgacctgaagctcctccacgcccacgcgttccgcacgcgcctccacgaccacacggtggtccttggcaagctcttccgcttcgccgcagtgtcgccactcggcgacttacgctacgcccaccgcatgttcgaccaaatgccccacccaactaccttcttctacaacaccctcatccgcgcccacgcccattccaccaccccttctctctcctccctctccttcaacctcatgaggcaaaacaacgtcgccccggatcagttctccttcaactttctgctcaagtcacgctcaagaaccacccctttgactcaccacaacgacgtacacggcgcggttttgaagttcgggttttgccgtcacttgcacgtccagaacggtttgatacacttttatgccaatagggggatgacccttttggcaagaagggtttttgaggatgttctgcaactgggtttggaggttgatgttgtgtcctggtccgggttgcttgtggcacacgtaaaagctggtgagttggaggttgcaaggagggtgtttgatgaaatgccccaaagggatgtggtttcatggactgccatgttgacagggtattctcaggcgaaacggcctagagaggcactagagttgtttggggagatgaggcgctctggggtgtggccggacgaggttaccatggtgagcctggtctcggcttgtgcgagtttgggagacatggagacggggatgatggttcacaggtttgtggaggaaaatgggtttgggtggatggttgctctttgcaatgccctcattgacatgtatgggaagtgtgggtgcttggaggaggcatggcgtgtgtttcatgggatgacgaggaagagcttgatcacatggaatacaatggtgactgtgtgcgcaaactatgggaatgctgatgaggcatttaggttgtttgaatggatggtttgttctggggttgtgcctgattcggtgacacttctggcacttctggttgcgtatgctcataaggggttggtcgatgagggaattagattgtttgagagcatggacagggactatggagttgaacctcgtattgagcattatggtgctgtgatagatatgttggggcgtgcagggcgattacaggaggcttatgatctgcttacaaatattccgattccatgcaatgatgctgtttggggagctctgcttggagcctgcaggattcatggtgatgttgaaatgggggaaaagcttataaagaagttgttggagttgaaaccagatgaagggggatactatattctcctgcgtgatatctatgttgctgcaggtcagactgtagaagccaatgagacgaggcaagccatgctggctagtagagctaggaaaaatcctggtttccaccaagggaattacaatggggagtttgtgtgtgcctttgcttctaacttgggtgtatgtttgattgtcaaagtggagctttgggcaattcttattgccattatcttggctctgtctagaggtttttctaagctgagcgttgaatgtggttcagcgacagccatcaatatgataaattctggagtggacgcttctaccaacttgggaacaactctgaattttaggtgctatcatgtgtttcgggaagcaaactctccagcagatgcagtagctagtcacggcatgtccatagacacagggattaaacttcttgatagtattcctgacttcatttatcttcttctgttagcttatgcttcagcagctacttggtattgtcatgaagaagctgagcagttcctgatgtatcctttcattgatccagaaccagagaaaccttggcttgctcaaaggagggccctcaggatttcatattctgcttga

SEQ ID NO: 14351 - DNA, 228 bp, Glycine max
  Peptide Sequence Number=SeqID_131129
atgttgtacaggttaaaaggaatgcttcggattcttggagatggagaaacaaaaattctgatctccaataaagtagctttcatgattttgagggatactgttatgactagaagcattgatcaacaaaaccaagaaccaggaactgcagaaccaagcaaggatgcaaaaccaaataatggccaaaaagagaaatcaacaaaccctactaccttaaaggattttgtttag

SEQ ID NO: 14352 - DNA, 195 bp, Glycine max
  Peptide Sequence Number=SeqID_131130
atggggattcatcgtttagtgtttgtgttatttcgtcaactgggtagggaaacagtgtatgcaccaggatggcgccagaatttcaacactagagaatttgctgaactctacaaccttggattgccagttgctgctgtctatttcaacattcagagggaatctggctctggtggaagaagctgcagaatgttatag

SEQ ID NO: 14353 - DNA, 114 bp, Glycine max
  Peptide Sequence Number=SeqID_131131
atggaggatgcttatgtggaaggggagttgttgttgcagtgtttgaggtggtgggcatgggttagtgaagttggagcgaattggtttggagtgctaaggattcaaaacatgtaa

SEQ ID NO: 14354 - DNA, 486 bp, Glycine max
  Peptide Sequence Number=SeqID_131132
atggctacgaaggttccagcgagtgcagaggtagcaatgaaggccttgctggcggagaatgcagcggagggcggtggaggctcggcgctaccggagggtccgggtgagggtcctggtggagtgttaggagaggtggggcttggtgtcactgtaggagaaggtgaaggaggagaggctgcaggagaggaagcaggtgtaggtgcagccgttggtggtgctggtgctggtgttggtgttgctgctggtggtggagttgctgctggtggtggagttgctgctggtggtggggttgctggtggtgctgatctgggtggtggtggtgatggggttgtagtgggtggttgtgacggtgcagcacctggtgcttgggctaagcatgagctagccaagagccccaagatcagaaacagttgcacagcaccagaacccatatctagagagaaagtagtagtagtagcagtgcttcggtgtgtaagagagagataa

SEQ ID NO: 14355 - DNA, 168 bp, Glycine max
  Peptide Sequence Number=SeqID_131133
atgaaggagaagtggagtgagtgtgaggcagcagaggagaagaagcggaaagtgttactcgacaatggtgtcgcagaagtagaagtgacagacctagatgttaggggtaaattcgatgatgccgaagggtttgagaacaatgtgatacatgcaacaaagatatgttag

SEQ ID NO: 14356 - DNA, 903 bp, Glycine max
  Peptide Sequence Number=SeqID_131134
atggatcccttcatccacaagctccgtcgccaccttctcgcatggttccaccgatctcgctccggtgcggtgttttttgtgcggagaatttcgtataaggacgttagaagagcgacggacggtttccacagagtcctttacagcaattccgaggtttctgcgtacgctgccaagttcggagacggcggcggcgcttgtttggtgagagaagtgaaaggcttcgatgaaggaaacgacgatttctacagacacgtgcagttcttggggcgcttgcgtcatcgccaccttctctcgctcagaggcttctccgtcggacgcaatcacaagagattgctcatatttgacaacatagaaaatggaagcttgaaggatcatctaaatgatcctttgaagactcccttggattggaggacaagattacagatagctaatggcgttgtggctgcactggaatacttgtttctcttcagtgacccaccagtatgtcatgtctctatcacctcaagcaatatcatgttagatgagaacttcacagccaaactatctgactttggccttcttacatctggtggaaattctgttatggtgccatattcagaagatttgaagcagaaaagttgtaagattatattccaacttggagtgctcatattggaactggtcaccggtcagtcatcagagatggaaggttcggatttaatcgaatggatccaagaatcccgtttttacaattccatagataagatgatagatcctgatcttggtaacaattatgactgtacggagctcaaaagtcttctagctgtggcaaaattatgtatcaaatcatgggacaagccttcatttacaattccacagttatttcggcatctccaaaagaagattgatattagcaattactag

SEQ ID NO: 14357 - DNA, 372 bp, Glycine max
  Peptide Sequence Number=SeqID_131135
atggatctaagtcgaccacaattttctaaaccagactcatctgagagtcttcaattcttttggttcttgctactgttgaatcttgaatcaactctgttatgggtccatagagtaggaactcacaaatcttgtgatacactctcgtactcgttcgaagttcacagcaacgcaagatcattgcggagtgatagaagagcgagattcacttggaaatcttctgaagagcttccgagtttgcgaatgagagaactcggcattgactcagagacggttcgttatattttcgtggccgatggtgaaatgtgcctcaactctacgatttctggatctgcgtttctcttgcttggaattctaggttttaatggctattaa

SEQ ID NO: 14358 - DNA, 1551 bp, Glycine max
  Peptide Sequence Number=SeqID_131136
atggataagtgtttgggagttactgatattgggttggccaagattgctgtcgggtgtgggaaattggagaggctgagtttgaagtggtgcttggagatttctgatctggggattgatcttctttgcaaaaagtgcttggatttgaaatttctcgacgtgtcatatctcaaggtcgagggcacaaagtggacgacagaggatagtgacttcagcagaccacttcattccctacctttgtcactattgatggtaacaagtgaatctttgagatcaatagcttctctgttaaagcttgaggtttttgttatggttggctgctctttagtggatgacgttggattgcggtttcttgaaaaagggtgtccactgcttaaggcaattgatgtatcaaggtgtgattgtgttagctcttccggtttaatatctgtaattagtggacatggaggtcttgagcagttggatgcaggatattgcctctctgagctttcagcacctcttgttaaatgcttggagaatttaaagcagctgagaataattagaattgatggtgttcgagtttctgactttatcctccagacaattggcaccaattgcaagtctttagtggaacttggtttaagcaaatgcgttggagtgaccaacaagggaattgtgcagctagtatctggctgtggctatttgaagatacttgatttgacttgttgtcggttcatatctgatgcagcaatctctactatagcagactcttgtccagaccttgtctgtctgaagctagaatcttgtgatatggtgactgagaattgtctttatcaacttggattaaattgctcgcttctcaaagagcttgatcttactgattgctctggtgttgatgacatagctctaagatatctatcaagatgttcagaacttgtaagattgaaattaggattatgcacaaatatatcagacataggattggcacacattgcttgtaactgcccaaaaatgactgaacttgatctctatcgatgtgtacgtattggagatgatgggctagcggcactaacgagtggatgcaaggggttgacaaacctcaacttgtcatattgcaatagaattacagacagagggttggagtatatcagccatcttggtgaactatctgatctggagttgcgtgggctttctaatatcacaagcattggtataaaagcagttgcaataagttgcaagagattggcagatttagatttgaaacattgcgaaaaaattgatgattcaggtttctgggcccttgctttttattcgcaaaacctgcggcagataaatatgagctactgtatcgtgtcagatatggtgttgtgcatgcttatgggtaacctgaaacgcctgcaagatgccaaactggtttgtctttctaaagtgagtgtaaaaggattggaagttgcccttagagcttgctgtggtcggattaaaaaggttaaactgcagaggtccctcaggttctcgctttcctctgaaatgctcgagacaatgcatgcacgagggtgcaagatcagatgggattag

SEQ ID NO: 14359 - DNA, 390 bp, Glycine max
  Peptide Sequence Number=SeqID_131137
atgggacacatccacggcctccaacatgggacacgcccgaatcagcatctccaagcccacatgccccaacccggtggcgcgactcagcacgagtctcctcagtccccgagtccaactcgccgatccctgactcagcacaaccgacacagctccgtcctcgatccgcggacacatcgacaggtccagcgtctcaatgttgcagaacttctccaacaacccaagcagaaactcgattcggaggatccgaatcttcttccgggtcgacgattcgacccggagaaactccttgcacaccagccgccacggtttccgatccggcccgagcttttcgaggacccggatgagcaggtcctcggtcaagaggcagaaaacggattcagacaacattaa

SEQ ID NO: 14360 - DNA, 1698 bp, Glycine max
  Peptide Sequence Number=SeqID_131138
atggggggagatgcacagaagaagagaattgccataattggcgtgtctaccttcttgctggtggccatggtggtggcagtgacagaagaaagcaaatccagtgtagcttcctcgatcaaggccgtgaaaaccctttgcgcacccaccgattacaagaaggaatgcgaggacagtcttattgaacatagcaacaacatcaccgacccacgagaactcataaaaatcgcgttccacgttaccatctcaaaaatcggagaaggacttgagaaaacagaactcatgcaccaggtcgagaacgaccccagaaccaaggaggcactcgacacttgcaagcaactcatgaacctctccatcggggagttcacgaggtcactcgataggtttaccaagttcgacttgaacaacctcgacaacatcctcaccagtttgaaggtttggctcagcggtgcaatcacgtaccaagaaacatgtttagacgcatttgagaacacaaccaccgatgctagtctaaaaatgcaaaggctcttgcaaagtgccatgcacatgagtagcaatggcctttctatcatcaccgagttgtctaaaactctctcggaaatgcacatcggcaaacctggccgccgacgccttttgaacaacaacgttcttggccacgactactttgaccttcccgaatgggttgatgatcaagttggtgttcgcaaactcctacatatgactggacggaaacgcatggcccatgtggttgttgcaaaggatggcagtggaaatttcaccaccatcaatgaagcattgaagcacgtgcccaagaaaaacctaaggccatttgttatctacgtcaaggaaggagtttacaacgagtacgtcgaagtttccaaaaatatgacccatgttgttatgattggtgatggtggtaagaagtcaaggatcaccggcaacaaaaacttcgtcgatggggttgggaccttcagaaccgccagtgctgccattctaggagatttcttcgttggcataggtatggggtttgagaactcagctggtgctgaaaaacatcaagcagtggccttgagggttcaagctgacaggtccatcttttacaaatgccgaatggatgggtaccaggacacactttacgcccacaccatgcgtcaattctatcgtgattgcataatttcaggtaccatcgactttgtctttggtgatgcagtggctgttctccaaaattgcacttttgtggtgcgaaagccattggaaaaccagcaatgcattgtgactgcacaaggcagaaaagagatgaaccaaccatcaggattaatcatccagggaggaagcattgtggcagaccccatgtactacccagttaggttcgacaacaaagcttacttggcccgtccatggaagaatttctcgagaaccatatttatggattcctacattggtgatttgatcacacctgatggttacatgccatggcaaacattggagggtttgaggggaatggatacttgtttctactctgagttcaacaaccgtggtcctggttcagacaaagccaagcgtgtcaaatgggaaggaatcaaggccctcgattcagatggaatatcaaacttcttgccagccaagttcttccatggagatgactggattagggtcactagggttccttactactctggccaaccctcccccactcattga

SEQ ID NO: 14361 - DNA, 240 bp, Glycine max
  Peptide Sequence Number=SeqID_131139
atgagtaaacaaaacccacaacttcgtcttcaacctccagcagtgagaagtgagtttggtgatacaaaactgagagcaccccatcctatttatagagtctgtccatcacagagctctctcaacttgttatcagaacgttgggtgtgtggggtgaagaggtcgattagcgctttagctgtatctatatctggggattcatcatccttcaaaataaagagagccacaaaacagaatatttaa

SEQ ID NO: 14362 - DNA, 513 bp, Glycine max
  Peptide Sequence Number=SeqID_131140
atggcggcctcttcttcctctctctctgcctccgacgactcttcttctcaccgtcgcaggcgtcaccaccgccatcgccgataccgtgataaggactccctcaagattcgaaagaagagcaagtcccaatcccaatcccgcggagaacgacgccgtaggcatcaccgccactcttccgattccgattcctattcttcatcttccctctctgattactccagaagtgaaagttcttctgatagtgagcatgaaacatctcaccgttcaaagaggcataaaaagagtgacaggccaaagaagaataaggaaaaggatcgaagcaaaagccaccgccataagaggcagaagcataaagtaaaagagtttttagggcatgacaaagatgacggtgtccgtcgcagtgctgtatctggcaagaagattcttctgaaacttgagaaaacaaaggaagataaagtggctgaaagcaagagaaacgaactgctgaactttttaaatgctagttttgattag

SEQ ID NO: 14363 - DNA, 1134 bp, Glycine max
  Peptide Sequence Number=SeqID_131141
atgtggcaagagctacatgaccttcagtctactcataagggagcttggtcttttattggcactttaacaccatccttggtgcccacgagaaacaggggtgacctgttgtgccctccccaagttaattctgatcacaatccattgatgctcctgatgaatggagtccagcgtcccaaagctcccttcaagtaccatgccatgtggtctagccatccggattgtaagcgcctggtctctgaaatttggaatcagcctcaggtggggtgtccaatgcaagttctaaagcaaaaactcaaaaatctgatatctgcccttaaatcttggaacaatgaagtttttggtaacatccatcaaaactgcgatcgtgccatgcaacaggtagttgctattcactctcgtattgaacttgaagtgctcaatgatgagctagtgaggcttgatttcaaagcacaaaaggatcttcacgaagctcttgcatatgaagaagctttttggaaggagaaatctcgtcttgactggctcaccttgggagataggaattctgccttctacagaatgaccaaaatcaaaagagccactaaaagcatcagcactatcaaatatggagatataatgctatgctctctaatttgctctctctggaaggaagtcaaagctgcagttttttccatgagtagctctagtgctcctgggcccaccagcttcggaggttttggattttgtgccactttctgctgctgggtgcggattattctggagttagcaagactctcttttgctataaatgactctttgtgggggggcaaagaaaaatatcactattctcatgactttttttcacagctacagggaggtttctggccagcttatagtccggaaaaatgtcaattctttcatggagccctatctaatataagagttagggagatcaagaatattctgggattctcagttggttctttgccttttatctacctcagtgttccattattccaggagaagcctcgaccagtgcatcttaggccaattgctgatagaataaaagcggaacttcagtcttggaaggggaatttactttcttttatgggttgtgtgcagctgattatatctattatcgatggaatgcttctttaa

SEQ ID NO: 14364 - DNA, 828 bp, Glycine max
  Peptide Sequence Number=SeqID_131142
atgcagcatgttcgtccattgaatgatgatggccgcgctatatgtagagattatgatggatttcctttgacttccagtggcaatccacacgacagtatggtagtgttaaagcaagagtctcaatttgcaaaggcgaatgataatagcttttttcattttaatcttcaaatagaacaaggtattccagttctttctaagtggataatcttcaatcgatttaaatttgttgcttcaaagggaatcaaacttggaccagcatttctcttgacaaggttgtttgacaaacagttggccaacatcactaccctttcttgtgacaggcttacaggtggctcaattgttggggacatggctccttaccaagcattttccattggaggggttgggagtgtgcgagggtatggtgaaggagcagttggatctgggcgatcatgtctggtggctaatagtgaactgacactccctttgcgcataagggaatatatgtccccatctgataagaagttgacaggatcatgctgcatattcaccatcttctctgatctcttgtttgtggctcagtgctttgctcatgacatattggctttaaagaattttatgaataagatgttggaaggtgccattttcttggattttggaacagacttgcggtctggtcaccttgtaccaggaaatccagcgttgaggcagggtaaaccaggatctggaattggattgggatatggacttcgatttaaatcacaatttggtcattttcaagttgattacgctattaatgcatttcagcagagaactctctattttggcctcagcaaccttgcttcgtga

SEQ ID NO: 14365 - DNA, 555 bp, Glycine max
  Peptide Sequence Number=SeqID_131143
atgatgataaatgtgatcccagctcattatgagacccttcgccatttgaaagtgtctttcttatgccattgtaatggacttaagctttatcggttccttgttcgaaggactggcagcaatttcaatgctgttatactcaagcgcttgttcatgagcaaggttaacaagcctccaatttctttgtcaaggttaattaagtatacaaaggggaaggaggataaaattgctgtaatagtggggactgtaactgatgatatcagagtatatgaagttccagcattgaaaattacagcactcaagtttactgagagagcacgtgcaagaatagaaaaggctggtggtgaatgcttgacatttgatgagcttgcccttagggctcctttgggacagaatacggtccttcttagaggccccaagaatgctcgggaagctgtgaaacactttggtcctgctcctggtgtgccacacagccataccaagccctatgtacgagcaaagggaagaaagttcgagagggctagaggaaggaggaacagcagaggatttagagtttaa

SEQ ID NO: 14366 - DNA, 234 bp, Glycine max
  Peptide Sequence Number=SeqID_131144
gatagacaaattgctaaaagaagattagtcacgatattttctgctccaaattacgggggggaatttgacaatgctggtgcattgttaagcgttgatgattctcttgtatgttcctttgagatattgaaacccgctgatagagcttcaggaagtggttcatcaaaaatgaattttaagaaggagtttgacatgggagagccttccttccactctacgattgcagattgccaatga

SEQ ID NO: 14367 - DNA, 537 bp, Glycine max
  Peptide Sequence Number=SeqID_131145
atgaatacagcaaaggccaaaaaagctgctacatcctcagctttcaggtacgagaaaatgcgtcacacatcgaaaggagaagaagggcctgatctgttctgccctctcttctctagaaaagaaataacgaccttaccggaaaacggagaaatcggaggagtagaaccggcaggagaaaccggaggcgatccactctggtaccctggcggtttcacgatcatgatactacgcgtcactctagtcgcttcctccgacgattcgtcaccttgtggacttgtagttaaacgaaaatcgttggtgacttatatgagtgtgattaacgaggcactgaggcagggcgtacccttgccggagctaggtcggaaagtgaaggtgtggtgtttccggagcttgccgagaccgttttccggccttgggccggcgacggtgtcgtcccacaagtggtcgaggaggcccatatggatcaagcgtattttagcagatccggcgtatggagatcccaacaatgaccaggtctcagagtcaggccatatttaa

SEQ ID NO: 14368 - DNA, 327 bp, Glycine max
  Peptide Sequence Number=SeqID_131146
atgactagcatggaaatggttctgcttgatgcaaagggtgacaatattcatgcgtatgtgaaaaaatcactaaaaaaagatttcaaagatgttatccaagaagataatgctgacctgttcgaaaatttattggttgctctgaatgattaccagtttaaaactaccccacacaaatttaaactgaattttatgggttcaaccaagtgcaaagatgtccacgatgatagtattccaaaattttcctttgatttcatgtcttttacagatattctaggaaaaactagggaaaacatattgcttggtaatgttttattggacttgttgtga

SEQ ID NO: 14369 - DNA, 181 bp, Glycine max
  Peptide Sequence Number=SeqID_131147
atgtcaacttgtatgagcaagaaaatccaaggccaaagcctttctatagaagaagagaacacggtggtggtgcagaagcagggcattgtgaccattttcgcctctaaccacgatgctcccacttctcttcgacgcactctatccgcagacatgtcttccaagacatggctttctcaaaatg

SEQ ID NO: 14370 - DNA, 342 bp, Glycine max
  Peptide Sequence Number=SeqID_131148
atggggttgaaccaagctcatgcttttacgaaaaaggttcatcaagtcaagttgaagtatggaagtaaccatcttgcaaaaattggggcaaaagatggatcggaacacgctttacggtgcccttaccgaacccttgctagagctagagtaataggtgaagtagaggaggtgcaagagcagataaagaccgacatggaggccatgaaagagcaaatggccacattgatggaggtcatgatgagcatgaagaagataatggaggtcaatgcggttgcaatagccgctaccagcagcattgctgaggtggacctaacccccccccatatggcctcaaccaaataa

SEQ ID NO: 14371 - DNA, 237 bp, Glycine max
  Peptide Sequence Number=SeqID_131149
atggagtccaaggttcttgtcgataaaggggtctccgatgtcgagaatgacactggtcatgccaatgacaactctacggttgttgctgtggtggcgggaatggcaatagcaagacgacaaaggcaaaggctaagctcctctctttgtgtggctccgccgtcacctcccacaccaccacagaagcaagatgacgtgaaatcttatctgtcacatcatcacttaacagatgcaaactaa

SEQ ID NO: 14372 - DNA, 285 bp, Glycine max
  Peptide Sequence Number=SeqID_131150
atgttgaaacgtacttgcggcgtggagagttggaggagaagagagacttgtgcgttgggacctttgatggttgtgggaagaatacttgagttggagaagaagagaagagccgaaaagcagggtttaaattacgttgtgggaaagaagagaagaacgaaaggagctgcgtctgttgctgttgcaggagaaagaaaaggaaaaagggatacaaaaatcaattgccttttttgtgtttggcctagtcgagcgagtcagtccagattgaattttcctattttaggctaa

SEQ ID NO: 14373 - DNA, 234 bp, Glycine max
  Peptide Sequence Number=SeqID_131151
atgaccagtgtcattctcgacatcggagacccctttatcgacaagaaccttggactccatctcatgatgtttgacaataggaggggattggggattgggctggagaataggttgttttatagaaacagttttcaagtgggtgaggttgttgaaggcgataggacaggacccgaagaagttgttgaagcccatgttcaagcgaacaaagtctgccatatcaaacagaaagggtga

SEQ ID NO: 14374 - DNA, 183 bp, Glycine max
  Peptide Sequence Number=SeqID_131152
atggagaagaagggtctcattgggctcagggcttattcttctaccttgattcagtggtgtaagcctccccaggattggttgaaatgtaacgttgatggctctgaggcaggagttttaagtgggcttcctttggcaattggaagcttggttataagcataatattggtgttgttgatgtgctga

SEQ ID NO: 14375 - DNA, 342 bp, Glycine max
  Peptide Sequence Number=SeqID_131153
atgctcgggcccgtgatagagtccaagctcttcaagcatattatcaacctcagctacctcataattctgccacaatacggacacctgttgcttctagcactcgaagatccagtagtcatagtgggttcttcaggacacaattttcaggaagaaacccatctgccaagtcgattccatgctagggaaagagagcacttgccttcattgccattaaaccatgttggtagagaatcaagttggcgagcataccaccagactgccagtgtgtcagacccaagtatcagatccagcagctttcgattaaggcacgaatccgacagaatgccttcacaaaatcggtga

SEQ ID NO: 14376 - DNA, 486 bp, Glycine max
  Peptide Sequence Number=SeqID_131154
atggaggattggggggagcaggtttttggtaataatggtgtttggaagtgttgtgctggctggctggctggcaatgcatatcatgatatgctgggacaacaggctatatttgcagaacatacagctgtatcatctgctagtcatccttgcccgtatattgcctactttggaccaatacatccctccacctccaattctggcttaactgtttccgaagcttctaatttcaaccactggaatggtccacctgtacctggtgacatgccaacctcctacacatttcctgcagtggatcttcattatcacagttgggaacacaattcctctcatttctcttctgccaacagccgtctaggcacctcagaacagacctcagtatcacctggtagtcaaaggcctgcccggggtggttcagatgtccctagatccgggtcttttatgcatcccttccttgttggtcacaggtgcctctttgtaccttactag

SEQ ID NO: 14377 - DNA, 803 bp, Glycine max
  Peptide Sequence Number=SeqID_131155
tggatcaaagtggccaaaagcaacggtgaaggtgaagaagaacgacctgttcaagctctgatggttcttaaatatgggggcgttcttacacatgctggcagaaagcaggctgaagaactaggaagatatttccgcaataatatgtatccagggctgcttcgcctccatagcacataccgccatgatcttaagatatacagctctgatgagggtcgtgtgcagatgtctgcagctgcttttgccaaaggtcttcttgaccttgaagggcagctcacaccaatcctggtttcacttgttagtaaagactcctccatgttggatggtcttgacaatgccagtattgaaatggaagaagccaaggctcggctaaatgaaatcataacttctagttcaaagacaatctataacaatggatcacctgaattttcttggatggttgatggtgctggactgccacctaatgcgtcagaattgcttcccaaagatcatgttgagctttcgtttatgttcatactatctcatccttatctactgggaacctgtttgccattgtctgagcccattaatcttgaaaggatggttactgaacaagtaagactgctagccaccgatgaagatgagaaacttgcagaaaagagcttatatgatgtaattcctccttatgaccaagcaaaagcacttgggaagacaaatatcgatgttgatcgtatagctgccggattaccttgtggtagtgaagggtttctattaatgtatgctcggtggaaaaagctggaaagggacctgtataacgaacgcaagga

SEQ ID NO: 14378 - DNA, 252 bp, Glycine max
  Peptide Sequence Number=SeqID_131156
atggaaaatcaagggagaaatgaaataaagggggaaagggagagtcgacggcgtggttggcagtggtggtgcaatggtggtggttccattggagaaggggaagaaggagatgacatgacaataataccagatcgagaaagtgatagtgaggctgaagtcgagcacactgaaaagctccgtcaagttaaagctgtccttgaagaggtttttaatttcaactttgttcattatatgataatagcaagtttgtag

SEQ ID NO: 14379 - DNA, 640 bp, Glycine max
  Peptide Sequence Number=SeqID_131157
gtttgatttgaagatttgggtgtcgtcttcattatcaatctatcacatttgcatgtgcaatatgcttattctgctttccattctccacatcatcgtgaatggtccaactctctgctttgggaataaggttgaggacaaaattttgaaagttggagaagagctatggagagaaactttgccattacatggtggctcttgcttttatcaattacagggtctaaaaccccacacgtggtatgaagtgaagatatcatatccagcttctatacctgctagcttttccatacaactgaagagaaacaagtcagatgtggtgctgaacaataacaggagattgctcaacaccgaaaagctaatttttaagaccaatagcaatcaggatgaattccagtcagtattagtaactgtggagccagaggggtttcctgcaaagctgcatgtagcagagaggcaatttattatcttcaatatagtgtctgatgaactattattaggcatacctcacaaagcttggtgggtagtggcactggctttactcggtctaggaattgctttcatcgtgccttcttttcttccattgtatttgctaccaaagaaacaagtctcgaggacagataattatgtttctaaaacttcttaa

SEQ ID NO: 14380 - DNA, 342 bp, Glycine max
  Peptide Sequence Number=SeqID_131158
atgcatctccatctctcaaacccaaaccagagcttagatccactctcaccggaaattgaggggatccgctaccgtgaccctatcgtgtcgccgtcgtgggactgggcgcctctggtcgcatcttcgtcgttgcattgtggtcctttgtctgaacttgaacttcctgagcctaagccatacacgcaccttagtcacaaattcaactcagcctataaccaaatattagtaatgaatccctttttcagtgtaagttcccaacccgatcctgacataggttatggacttgtggtcagaaaaactaccgccactggagacaacaggctatacacctttgaaggttaa

SEQ ID NO: 14381 - DNA, 369 bp, Glycine max
  Peptide Sequence Number=SeqID_131159
atggcctctagaaagagacatgcttccacctctagacctcaggaaccttacgacacatctcggttcgtgtctgaggtcgcttgcgagcggtacgagcaaaatgtacatgccaggaacatcctcccagagaggaatgtggagctggcagtcacccagtatgatgagttccgccaggtgctcaagaggcgcaaatggagtagggccttgaccaagcaaccatataatcatattgacttagccctggtcaatgagttctatgcaaatttatatgaccctgaagactgctccctgaggagcttgcctcgaagctctgcatcccagggcgaggattcgttcttaatgctgagggagcaccatggaagcttctga

SEQ ID NO: 14382 - DNA, 207 bp, Glycine max
  Peptide Sequence Number=SeqID_131160
atggcatctgtgctctgcatggaggtgtcgactggtgctgagggtactggagctggtgtaggtgctggccaagttaatggtcgggctgagggactcgaaggtgagggaatcagacacaactcctctaacgatgcacaaggctgtgataagtgcaagaaatcaaaacctagaggagttgggctgggccatctgggagatctagcctga

SEQ ID NO: 14383 - DNA, 393 bp, Glycine max
  Peptide Sequence Number=SeqID_131161
atgattcagcagcctcgtattccttcctctgggttgatgcctgcaagtgatgttcttattcgtgcaaaggaggtgataattaacagggacaatctggttaaactacttgccaaacacacgggaaattcagaggaaacagttgctaatgtgatgaagagaccgtattatatggatgcaacaagggcaaaggaatttggggtcattgacagaattctttggcgtggccaggaaaaggttatggcagatgttgcttctccagatgactgggacaagggagctgctattcacagaaaactagagctgtcaactgggtttcggcccgtgggccagcccggtccagtgcgggttagagctagtaactcaagtggcaattcacattcagaaatagagtaa

SEQ ID NO: 14384 - DNA, 987 bp, Glycine max
  Peptide Sequence Number=SeqID_131162
atgagtcatccttcagtctcattccgattggcactattcctctcattttctcttacggcatcatcgtccttgcctcccttaccggttttttcgaagcgttacgctccatcatcttcacttatccccaaagccactccctctgacttattgtctctgttgggttccaaacctcagtcctcagccgtgaatcccgaggtagcgcgcgacctcaagtcatgcttcaaattcctcgtccctttctctcccgtgcatcctcgtcaccggaagttgggcttgggccggcccaaactcacaagcccaactcggagagacaagaacaagcttatttggtggccgccggagcccgttttggagctagcccgtctcgccgtcgattctggcggcgaccccgccgctattcatcgccttcttgacccaaccattatccaggtacctgattgtgaaggatcaaaggatgagcgctgtgagctcactagaactccctatggcagacgcttcatttgtgaggaactgaacctgtatctgcagttcttgtttgaactcattgttgatcgaggtccatctgttgggttggatgttaccttgaaccggtttgatctgttccacggtcacctttttctagcgctagactctggaagacttggtatcttattccatgcgaaggaatacccagcatatgataaacaagtgttcccatacaatatgggtttttgtcagagagggtccaatgtgacatatgatgattcaatgaatctgagaaatattctctggctggctccaatgcctggcgattctggtgaatcttgggtggcaccaggtgttctggtagtgctggatgctcgtcctgatgggatcatatatagagacctaatacctgattatgtaaattttgcaaggactatatatgaagataactatgacgtactttcacttcccaacgatacaccagcttatataaatgaagattgccgaagcttaaacgaataa

SEQ ID NO: 14385 - DNA, 375 bp, Glycine max
  Peptide Sequence Number=SeqID_131163
atgtttcagaagaaggcaacaacatgtggaggaagaaaaagctgtcacacggtggatgctcttccctattatggggcaaagcggatgctcttccctgctgcatttgggcttactttgcaattgatagattttgggtcattgaaattagtcgtgcttcctattttcttcatcatggtgatactttgggctataatgttttctcagttctggaaacgtaaaaattctgcacttttagccagatggcctattagttctatagttgcagctgaccaaggatacaagatttcaggcaggaagtctagctcctggcaacccccaatggaactcatgaaagtatttgagactgatagagctaaagagaaggaaatattctag

SEQ ID NO: 14386 - DNA, 1058 bp, Glycine max
  Peptide Sequence Number=SeqID_131164
actatgaaggtattaaagatgttagactgagaaaggctgtaagtatgaccaaactctatgaaagcttcactgtgaaggatgaagagtctatgaatgatatgtttggaagacttaaagttcttttgaacaatctggaagcccttggacaaacatactccaaggcccagataaaccgaaaggtgcttgaaagctttcccaaggtgtgggaaccaaagactacaaccactcaagaagcaagagatctagaaaatcttgcatgggatgagctattgggcattcagagagtccacaaagttcaccttcaaaacagggagcattttcaaaagaagaattttgttgccttaaattttgaagagacacactttagaagagaagaaaagaaaagcttgtccaaggctcttaaagtgcaaatgcaggaaactgatggatcagacaattctaatgcatccacagatgacgaggagaagaacaatgagatcatctactttgagtgcagaaagcctgaacatatgaaggatatgccatatgctgttcttcttcaaaactttgatttgatttaccttcagtggataaagcttaaagaaaaattcaaagcttctgcttctgaaaacactgaactaaggaaatcaaatgaagatttgaaaaagaaaaatcagactctagagaaaagtctagaacaggcaagtatgacagacgaatcatccatagttgaaaaactaatagaggaagtagtatttattactgaagtgtttgagaagtttttgcaaagtccaaagactcttaccgttcttttgaaattccatcaacatccatatgataagtctggcctgggtcttaaaaagggaacaacatcctttaagtcaccatctgactcgaacaaatgtgatttatgtgataactcatcacacttcaagttcaaatgcatccataagaagagacaaatgtctaaggatatccttggtaggaaaaggtcgatgtttaagctggtacctggacagtggatgctcatgacacatgataggggaaaggtttatgttcctagacctaaagccacatga

SEQ ID NO: 14387 - DNA, 222 bp, Glycine max
  Peptide Sequence Number=SeqID_131165
atgcaactaaaacctttcctaaagattggtttatccatggaaaatggggtgggatggacaccttttctagagaaggtcagcaactggcactattacctctatgttctttttcggggaactgccaagcaggatggagttaacatcaaaagaactgttgatgggactcaagtggggatctccaaccaccaccgttgttgcatctattcactctggatggtttga

SEQ ID NO: 14388 - DNA, 621 bp, Glycine max
  Peptide Sequence Number=SeqID_131166
atgatgacaacaaaagatgatgacaaatgtgatgaacaaaaagctcaagtaatcaaagaacatccatctcaagattcaagattcaagttcaagaatcaagaagaattcaagactcaagaagaaagcctacaaacaaagattcaagatctcaagaatcaagatcaagattcaagaatcaagaatcaagactcaagatttcaagaatcaagatcaagattcaagactcaagattcaagaatgaagaaaagactcaatcaagataaagggtacatctacttgggtttgactgagaacaagagagggtacatctcttgtggatcagttctagtggagggtacatccattaggttcaaagagaacaagggagggttttttacaaggttgaaagaaatctcaaggaccgcaggtcgcttggggactggaggtaggcacaggttgttgccgaaccggtataaaaatccttgctttcagtttttgtgtcttgcatactttggaactaagtttcagttaggagtggacaagctagttttgattcctaaggtaaagtactacaagagcaaggaaaaaagattgaggatgatgaagatgcaccccttactcgctacgttaaggaaagactag

SEQ ID NO: 14389 - DNA, 888 bp, Glycine max
  Peptide Sequence Number=SeqID_131167
atgagcaaagactgggagaaaaagataacccaaaagattgtcctactctatgaaaagcctcgcccaaatagaggtgataagaaggttcttaataacttcttaaggacaacaaacctgacttatatgtgtaggatgatttacaatgggctattcaaaatagtcatgccaagagtaagatcaagggattatgttagtgacaaagactgcttttgcatgtacaagatcatgggttttaaggacatgttgaaccccaaggtgaagaagaaccctattccctatggaatactcttcacacatattatgagactagctgaagtggatatctctttattggagccatcatctagaaccactcagctaaacggggcaacctttgtgaatatgggaataactgaaaatttccttgagtatgtgcaaagacacattaagaaaaaagtgaagaaggagaccgtaggaactcaagctcatcctttggatcttgagtttgaagcgtctcctcaacaaacgcagggggaacaagaccaagccaagccaagccaacccagacacaagctaccaaccaagagaaaaaaactaccttcatcttctgaccctatacccttaaccttatccaaaaagcctaaaaaccaaccaccatctaaccccaaaaagagaaagccttttcaacccaaaccttcatctaaatctccaccaccctcacttacacttgttcaaaactctgaagcttcccaacccaaacctgcctcaccatcatctgaggtaaagatccttaaaacaactagccctttaccttcaccatccttagccattccttctcaacacacacccaaatccacttcaccccctcctagcaaggctgaaactgctactattggcaaggccaaataa

SEQ ID NO: 14390 - DNA, 144 bp, Glycine max
  Peptide Sequence Number=SeqID_131168
atggcaatcttccgagaccaatgtaggaagtgggaactgcaaagagagaaagaggagagtggttgggttgggacccgcaatacatctctggccagacggtgtttacgcgttccaaagctactccatgctccagctgccatctga

SEQ ID NO: 14391 - DNA, 1059 bp, Glycine max
  Peptide Sequence Number=SeqID_131169
atggctgcaactgcacctgcaacagaaacaagagttgaaattaaagaacctcctacagaagaacttttagaacctctcatgtgcaagagctgtgtgttgaaagtctccattcattgtcaaggctgcacaaggaaagttaaaaaaatcctacagagcatagacggtgtttattgcacatcaatagatttgaggcaacagaaggttatagtaaagggaaacgtagacagcgacactttgattaagaaactaacagagacagggaaacgcgctgagttatggccagaccaacccgaactgaagaagaagaagaagaaaaagaaaaagaagaagaagaaggcaaacccagagaacaaagagaaaccgagcgaacaagaaagcagcgaagaaagcaaccagagcggcgacgacaacaacaacgaaaaggaagctattaaggttgtcgttcaagacccagccaaaaacaacgaaggattttttaacgtaaacagagttggtgaaggaagcgcaaccggcttaaccggggtgcagttccaggatccgaggatggaggtgaggcaaacggtgatggtaccacccggttaccagtcatcggtgatgggcgagaaaagggttactatcaacgtccctggcatgatggatgagaacgagggtggcagtggagggaaaaggacgaaaagcaaggggcaaaaagggaatgttgtaatcaacggcggcaacgagggtgttactgtggtggaacacgctggtggagattggaaccagatgcctggtggtcatggacatgggccacccaatgagagtcccccacggcatcagtacccaccgcactatcatgcgcccgcatctccagtatacactggaacctaccacacagcgtatcccactgtcacccgctacggtgctgcgtattatacgtccccgcaaccgtattcgtattctcacgtgtatcggtgcgttgggtccgagtcagactcagaaacttatacatcaccttcaccaccgtcttgttccttcgaattattcagcgatgaaaatcctaatgcctgctttatcatgtga

SEQ ID NO: 14392 - DNA, 696 bp, Glycine max
  Peptide Sequence Number=SeqID_131170
atggattcacaaaatgctaggagacaaaattcaaaggttgttgataatttgtttccacttgatatagacaggaaaatcaaagctattattctcaagccattagagctcacatactctagatacttgcattgccgctccacccacgagacatgtcgcctagaccctcccccaaaaaggtgtttgatacaagggatccctaagtcaaggatccatcactatcatctttctcgtctgagctggttaccaagtcaaatcatcggctctaataccaattgttgggaaatcaaggggtatatcattgcaacaaccttttttgttaattcagagttgggtatcagggaagttgaggtcacgacgttcagaatggccattatcaatgcaaatgagttagaccccactcggtgctggaataatgttgagtcacgaggaagagagttgttccatggtttggttgatgagtgcaagaggttgattcatggcttacatccaaataagcttttgttcaccaaaagagatggcaacaagactacccatattctagcttcgttggcttttctttatttcgatcattgctggttagaggaggtcttatctcaattggaccaaatcatttcctcttatgcgtacacctcattgcgcagtgtaggaacctcttcaacaatcaaagacttctctcaagtcgcgcgctctacttaa

SEQ ID NO: 14393 - DNA, 2388 bp, Glycine max
  Peptide Sequence Number=SeqID_131171
atgggtcttgattctcaggctcacagcatggtttttatcattaccatattgatattcttgtcattgcaaaatgcagcaggaaatgaaaatcagattgagacaatctcaggaatggatgagaatgaaaacaagcaaactcctatagtggaaaactttagaactttgcttggactcaacatgttcaacacaagaaagccatgctataatgttgctgactctaactttgtgtccctctcaccttctctgtcacccaacaccgaagctgaggctctggctccggctccggcttcggagctgcacgtgcaccctcattcctatcactcacataggaacttgccacttcacaagattctaaaagaagataaaggcatggcaaaaagaacaacaatagtagctgttgtagtacctggtggagttgctaccttaatttgtgcacttgggtgtgtctgtgtttgcaagaaattcagaaatcacaaaaggaaacccaataggacaatgccactcttcagcaagaacgaaagaacaggatgtacgtctacgtaccaaaattcatcaagcaatgtgagtttaaactctgcccctgatctgttttacctcacttgtttgaaacaaacttgtgacacacaaaatagaagtacttcaacccatgattcccccaaacgtacaatttatgagaagaaagtgttgcgtaaagaagaatatgacaaggctagcactagtagctcttccacaaaggaaattctctctgttcatgaggatttggaatatcaatgtggcaaagcttcatctggagaaaaaactgtccttcgaggatgccatagccttccatcagacaacgaaagttttcattcatgttttgatactcactcatcagtaagtgaaacagaaacattgtgtctctctcctagaaattcaatctcttcaacaaatcaatttccttgcccccctcagaattcaactacaaaggtaaaactaaaacctaaccaatcgcaatcaccatgcattccgcaacaagatgaacaaaagaagattcaaacttgtcaacctagcattcctcccccaccatgtccacctccatttttgaaaggaaacattaacagtgcaatcaaaactccaccttctctacttcctcaaggtaagggtggaagttctccactgccaaaactcaaaccacttcactgggacaaagtaagagccacgccagatcgaacaatggtgtgggataagctacgaacaagctcatttgagttggacgaggtaatgatcgagtcactctttggctacaatttacaaaactcagtgaagaacgacgaaacaaagagcaaaaccccgtctcctagcaagcatgtacttgagccaaaacggtttcaaaacatagcaattctctccaaagctctaaataccacagctgaacaaatatgcgaagccctgatactagggaaaggcttgtctttggaacaactagaggcactggtgaaaatggtacccacgaaggaagaagaggctaagctcttaagctacaaaggagacgtcaatgaactagggtctgctgaaaagtttgtgagagcaatgcttagcgtaccatttgcctttcaacgagtggaaaccatgctttacagagagactttcgaagatgaactatttcacctcagtaactctttttcaacgctagaggaagcgtgcaaggaactaaggtcaaacaggttcttcttgaaattgctggaagcagtgctgaaaacaggaaaccgcatgaacgttgggacaatcaggggaggtgccagagccttcaaactcaacgcccttctgaagcttgctgatgttaaaggaacagatggtaaaacaaccttgctccatttctttgttaaggagattgttcgctcggaaggaatcaaggcttcagagaggatcatggggcagaaaagcgaaaacagaacggaggaagagaaggaagaaaattataaaagaataggactagaacttgtttctgatctaagtgctgagttatgcaatgttaagaagacagccacaattgacttggatgttcttgcaagctctatctcaaacctatcaagtggagtggctaacatgcagaacctggtaaagggtcttttgtgtgaggatgaaaagagtgagagctttgtcatttctatgaagtggtttctgaactatgcagagagaaaggtacaggacctgcaaggatgtgaagggagagtcatggctcgtgtcaaagaaataacagagtattttcatggggatgagagtaaagaagagtcgaatccacttcgaatctttgtgatcgtgagggactttctggagatggtagataatgtttgcaatgagcttaaaaggtcgtctacgaaatcacctcgcaccattcggttacagtag

SEQ ID NO: 14394 - DNA, 1269 bp, Glycine max
  Peptide Sequence Number=SeqID_131172
atggagattacgttaagcgacaatgctctgaaaactttcgcgcgttgcatcacttgtctcgcacgcataggaaacgagctcgcaattcaagcctcttcctctcagcttcttttccacactattaattcatcacgttctgcctatcaatgcatcgctttcaagtctggtttatttgatgcgtataacgtttccagcaactccctgcaatgtagtgtgcttctgaaggctgtttgtgctgttctcaggacacctattacgaatatcgaccatttgaccgtgagactgcctgatccagatgctcctaaagtgcagtggattttggattgctataatggtatgagaaaaacctattggattacttgcaatgtagaacctgacatacatcacttgtcccttgataggcaaaaatttcccagcaactttgttgtgaggcctcgagatctgagcaggttacttgctaattttcagtcatctcttcaagagatcactatcattgcaacagaaccttcttctctacttactgatgcatcaaatgaaattggtggaaaggaagttgaacttcgaagttatatggacccaaccaaagacaatgatacgttgctgcacacccaactgtggatagatcctaaagaagaatttttgcagtatgttcatactggagatccaatagatgtgactttcagtgtgaaagaactgaaggcatttctttcattttgtgagggctgtgaagttgatctccatttgcattttgagaaagctggcgaacctattcttatggcacctaaatttggtttggaagatggatctcactcaaattttgatgccacccttgtactggcaaccatgttaatatctcagcttcatgaaggggctgcctcagaacctcctgtgggggccaccggaacacaccctcataccgaagaaagaaatgcatctcacatgctgcaagagaattgtagagcaaatgtgtcatttgagcctccatctgatcacacccgtatctggtctgacctctcagcaagtgcatttaaaagcattagtcctttggaagaacgacaggcacaaggagaaacaattttgaatgatgatggtcaaagagaaattcaaaggattagcacaatgcaaatttcaggagtagcatcagttcccggaaataatcccattgattccaatagaacatttacagagtatgggatgctcaaaccagacactaggagtgaaaccctttatttggattttagacttatttgcatgtttaaaaccctttaa

SEQ ID NO: 14395 - DNA, 594 bp, Glycine max
  Peptide Sequence Number=SeqID_131173
atgccttgtccatcctcccatctcagaacctcacaccctccaccctcttcttcagccctaagctccatgaagctcaagagcctcatccacaccctcatagtctcccacatgtgccgcatcatccgtgcactctccaaagtcaaagccacaatccttgagattctcaaaggatcaaacaaccaatccaataacattcacttccaccacaaaaagaagcaaaagatgactaagaaaatcatctttggctcgttcaggctccactacaactggtgctcctcaaaatcttctcatgttatccctgttcccgctcgtgtctttgaagggttgccaaaagctggtgacatgatccatcatcatgatgaacaatatttgtatgaggattgccatgatgatgattctcagcttgcgggatacctacagtggcttgaagagaaggttcaagatgatgatgatgataaaaaggcttgtggaaatgagatgaacgagattgatatgttggctgaaatgttcatagcgaattgccacgagaagttcaagttggagaagcaagagtctgatagaaggttccatgaaatgttggctaggggcatgtga

SEQ ID NO: 14396 - DNA, 189 bp, Glycine max
  Peptide Sequence Number=SeqID_131174
atgaaagcagtggcgtatttagccacactaacacaaggattgggacggattaatgatccaataattgattacgcagttaaccagatcaaaacgactcatgcaatcgtcattacgcacataatgacaacaccaacatccgccttcgacgaatgcagtcaagctcaacgtggatggcagctctctgggtaa

SEQ ID NO: 14397 - DNA, 945 bp, Glycine max
  Peptide Sequence Number=SeqID_131175
atgcttattccaacaaatcctgctggtcttattgaatatagggcacatccattctggatccagaaatattgccctactcatgaacatgatggtactccacgctgttgcagctgtgagcgaatggagtcacaagaggcaggatatattgctcttaaggatggccggaagctctgcttagagtgtctagattcttctatcatggatactaatgaatgccaaccccttcatgccgatatacaaagattttatgatagcctaaatatgaaactggaccagcaaattccacttctattggttgaaagacaagcactgaatgaagcaagagagggagagaagaatctgtctaacgtactaggaactattttttggtgtttggcattatctgcacaactaacattaaaaggccactatcacatgccggaaaccagaggactctgcctctcagaggagctcagcactttctcgagacgacctagacttgggacagcaatggacatgagagcgcagccgtacagaccgactacacgctgcgatgtgaccgcaattctcgttttatatggtcttccaaggttgcttactggatcaatcctagctcatgagatgatgcatgcatggctgcggcttaaaggttatcggactctaagtcaagatgttgaagaaggtatctgtcaggttttggctcatatgtggttggaatctgaactttcttctgcatcaggcagcaactttgtatcagcctcatcctcatctgcatcacatacatctagaaaaggtaaaagacctcagtttgagaggaagcttggggagttcttcaagcaccagattgaatcagacatttcccctgtttatggagatgggtttagggcaggtcaaaaagcagtgcgtaaatatggtctacaaaggacccttcaccatatcaggatgacagggacttttccatattaa

SEQ ID NO: 14398 - DNA, 330 bp, Glycine max
  Peptide Sequence Number=SeqID_131176
atgaaacaagaacagatgagcaaaattgaggggaatggtgtgcttctagcctttgttgaaggcagattaaagaaattgaggttggggaggagagggtcgatggtggtggtgctatcacatgatcacatttgtgaccgttccattgtcactgaggatacatataccaccctaggtggcgtagatgacaacattttcgaagacgtcacagtcgctgccgacttcaaggatatgggcacaaagcatgttggcgctctccctgattgccagcttcaacttcttagaccctttcgtaggctgttgcgggtgctgccccaccacgtggaggtataa

SEQ ID NO: 14399 - DNA, 270 bp, Glycine max
  Peptide Sequence Number=SeqID_131177
atggtcaattccagtgaggttagtttagtggcaggaatgtcaatgccacaacggttgaggatggtgaaaaattgtctcagagaatgttgtgcagctattttggttcaaagcgtggaatgtgtggctgagggaggtggttgctgcagggtgtgtaggcgacgtttggcagatatagcagatggatggtcatggtacagggtatggttcacagtagcagaagctggacatggttgtggtttttgcgatggtgtggataagttaacaagatga

SEQ ID NO: 14400 - DNA, 1785 bp, Glycine max
  Peptide Sequence Number=SeqID_131178
atgggggcttcaccttccttcctttacacttgcaatggcctcaacaaatcctgcctggccttcctcatcttcaaatcaaaacctcctttcaattccatagccacaatctccaacctcacatcatcaaacccagaagagcttgcaagaatcaatgatgtcaatgtgctcaaagtgttcccaactgggaaagaagtgcttgtccctttgaactgttcttgcttaacaagggactattaccaagctgaaaccaactatgtattggggcaatccccaacatatttgacagtggcaaatgatactttacagggtttgaccacttgcgattcgcttatgcgtgctaatccatacggggaacttgatttgcatcccggcatggaattgcacgtgccactcagatgtgcttgtccaacatggcatcagatcacaaacggcaccaagtatttgctgacatactcagtgaattggggtgataatattacaaatattgctgcaaggttcaatgtagcagcaggtaatgtggttgatgccaatggtttttccacacaaacacaaactatttttccattcacaactgttctgattcctttgccaagtgaacctgtgagttcaatgacaagaattgttagtgatccaccagatgtgtcacctcttgtttgcagctccaaaaagtgcaactcaaagaggaaactttacactgttattgccaccactgggggttccatgctggttctttgtgtcgtcttatatggggtttttctgttcagaaagagatcagcaatgttcattaagcgaggtgaacaaggtgagaaatcaaagaagttgtcttcagaagatatccgtggtgagatagcaatcattgaacatcactccaaggtgtacaagtttgaggaaatagagaaggccactgaaaactttagttcaaagaatagaatcaaaggttctgtgtatcgtggggtattcggtaaagagaagaacatattggctgtcaagaaaatgagaggggatgcatccaaggaagtgaatttgctggaaaagatcaatcatttcaacctgataaagctgcaaggttactgtgaaaacgatggttgcccctatcttgtttatgagtatatggaaaatggctctttgagagaatggctaagcagaaacgggtcaacggagcaccagagtttggcaaggaggatcctgattgctctggatgttgccaatggtcttcagtatcttcacaacttcacagaaccttgctatgtgcacaggaacataaacagtggaagcattctgctaaacaaagatctaagggccaagatagcagactttgctcttgctgaagaatcagaaagtaaaataacttccggttgtgcctcatcacacatcgcgaaatcaaggggctatatggctccggagtatctggaggcagggaaggtcactaccaaaatggatgtttttgccttcggagtggtgctgttggaattgatcacgggtaaagatgctgttaccctacaagatgggagagaagtaatgcttcgtgcattcatagtaaatctcattggtaaagaggatgaagaagagaaggagagtttgttcattgatccgagcctcaatggaaacattgagaaagtatgggctctccagctagttaaacttggtctagcctgcttgatccaggaatcagcagagagaccaaccatggtagaggtagtctctagcttattgaaaacatatacaagttatatggagcaaataataccacctagcatcagcaacagtcctagcatggagaggtga

SEQ ID NO: 14401 - DNA, 207 bp, Glycine max
  Peptide Sequence Number=SeqID_131179
atgggtttcattcataaccaagctcacatagggataagaactgtgggcgtagaaaaagcttgtaacttctccactaattcagatctttgcattcctagttacttggaatatgaatggccagctgttggcttgcaagaggctcctccatgtccacgaaacaaagttgcaactctgctttcagcagctcttgatgaaagtcatacgtaa

SEQ ID NO: 14402 - DNA, 1152 bp, Glycine max
  Peptide Sequence Number=SeqID_131180
atgcggagagagcaaccccggtctccttgcctaactgatgtggagccagacagaatcagttgcttaccggggcacgtgatagaccaagttctgtcacatttgtcaattagggaagcagtgagaacaagtgttttatctagcaaatggaggtacaaatgggccacactaccgattcttgtgttcgatacccattgcgtctcggtggcttctcaggaccatatgattatcaagaacaagcttttgaggattatagatcacgtactgctactccattctgggccaatcaacaagttcaagctctcccatcgtgatctcattggtgtgactgatatcgatcgttggactcttcatctatgcagaaagtctatcaaagagtttgtgctggaaatctggaaagggcaacgttataagatccactcttgtttattttcttgtcaaagtttgactcatttagaattatttaattgttggcttaaacctccgtcaacatttcaaggcttcaagaacttgaagagtcttgatctgcaacatgttaccttggctcaggatgtttttgaaaacttgatatccagctgccctttgcttgaacggttgacattgatgaactttgatggcttcactaatctgaatattgatgcaccgaatctcctgttttttgacattggaggtaaatttgaggatattagctttgagaacactttccaattagctgtgtatttggcagtgggggttgtgccaataaagcttccaagaccatgcattgatctaagttatctttccatacgaattaacttcaatgatttgaaggaaatttcagcttctctttgcctcttaagaagctcacctaatctacaagaactagaaatattggctcgacccgaggagcagacggttctgttaacacacacctattgttgggaagatgtctacttttcttgtccggtcatgcaactgcgatatgtgaagatagatggcatatctggtatcaaacccgagttagattttatcaactttctacttctacactctcctgtgctagaaaggatgactgtgaagcctgttgcaaacgttggattagaactgatgaaagaactgttgcggtttaggagagcctcaggacaagctgaaattatttacctggaaccttcttaa

SEQ ID NO: 14403 - DNA, 174 bp, Glycine max
  Peptide Sequence Number=SeqID_131181
atggctgagaaagattcaattacatatttacgcgcaatgaggattagaaattcagaagacactcagaagaagttaccatgtcaagctatcaaagtaccaattaataaccaaatggtgaaaaagaggattgagaaatgtggcagaattggactgattgagaagtactcacagtga

SEQ ID NO: 14404 - DNA, 630 bp, Glycine max
  Peptide Sequence Number=SeqID_131182
atggattctcccttactagaaaacattgacaactcttgttctaatgttgaggaggagaagacaccgaacactgttgttaagagatttgggtttgagtcgaagaagctatggaaaatagctggccctgctatcgttacctctatatgtcagtactcacttggtgcactcactcaaacatttgctggccttgttggtgaccttgatcttgcagcagtttctgttgaaaattctgttattgctggcctcgcctttggagtcatgttgaatgataatgtaaaaactttgatattacccatgcaaaagaggcagagaggtaaaaataaatgggcagaacatagtgggaaggaatgggatccctgcagttcatattttaagtgcagaggatctgcattgctattgggaatgggaagtgccttggagactctgtgtgggcaagcatacggtgcgggacagatcaggatgttgggtgtgtacatgcagagatcatgggtcatcttgttcatcactgcccttattttgttacctctttatatttggtcacctcccatcttgaggctcgctggacagacggctgagatctcagatgctgctgggataaaatccagagactttttgtttttaaatgactaa

SEQ ID NO: 14405 - DNA, 1260 bp, Glycine max
  Peptide Sequence Number=SeqID_131183
atgtcttatgtgcttgttttactaatggataagtatgtctcggaagtagtgaatagtgttgtgaggttattggaatgtttactggggattaactttgcctcagaagtagttaagagttgcttgaagctcctaccacccgagaagcttgagcaactggatatccctgtggaagaagaatcttctagtgttcctgttggtgaagttttatacatgtcagagagtgatcggtcttttgtaggagggagtgttacgttgtctcaattgcgtacagaggacacgaggtttaatttgtttactggaaatcaaacatttaagcagagagatcaaagttttgagctacttgctttcactgcttggccttttgtttatgtgtataccctaccctaccctaccctttgcttcttcatcttcatgcagaagaaagaaacaatggcgatacattgtgggttctacagtgtgaatggggggtttaagatatctgatgaagataaaagttacatgcaaggttgcaaagttgttgtatctacttgtgcatttggcggtggagatgatctctatcaaccgatcggagtgtctgaggcttcgcttaagaaggtttgctatgtagcattctgggatgaaatcaccctgaaagcgcaggaattagtggagcgcagaattggggaaaatggatttattggaaaatggcgtgttgttgttgttcgggatcttccttttgcggaccaaaggttgaatggtaaaattcccaagatgttaagccatcgtctttttcctcaagcaaaatactcaatttgggtagactccaagtcccaattccggagagacccactaggtgtgttggaagcactcctttggcgctcaaattctttacttgctatatcagaacatggagctcgcagtagtgtctatgatgaggctaaggctgttgtcaagaagaacaaagccaagccagaggaagttgaagtgcaactgaatcaatacagaaaagatggcttgcctgaagacaagagatttaatgggaaaaaagctctatgtgaagcctctgttatcgtcaggaagcatacaccagtaactaatctattgatgtgcgtctggtttaatgaggtggctcgcttcacttccagggatcagctcagcttcccgtatgtcctgtggcggctgaaagcattcaaaaatatcaatatgtttcctgtctgtacccgcaaggatcttgtcaatagtatgggccatgtccgcaaggccaaacctttgcaaagctga

SEQ ID NO: 14406 - DNA, 600 bp, Glycine max
  Peptide Sequence Number=SeqID_131184
atgagaagtatgaacataaatggttgggatgccatgattgcgattgggttcaatgctgctataagtgtgagagtatcaaatgaacttggagctggtgatttcaaggctgcaaagttttcagtgtgggtggtttccatcacatcagtgtccataggtgttgttgtcatgatcggagtgctattaacaaaggattactttccctacttgtttaccaccagtgttccagttgccaatgaaacaactaggctttctgctttgctagctgtcacagtgcttctaaacagccttcaaccagtcctatcaggtgttgctgttggggctggctggcaatctctagtagcatacatcaacattgtgtgctactatctagttggattaccggcagggataatattgggatttaaacttggtcttggagcagagctctttaatctttatgcctgtgtaattcagggtatttggtcagggatgattgcaggcatagttttgcagactacaatccttataatcgtcacttcaatacgaaactggaaaaaagaggctgaagaagcagaaagccgcgtgagaaagtggggaggagcaatttcatatgatcaatga

SEQ ID NO: 14407 - DNA, 564 bp, Glycine max
  Peptide Sequence Number=SeqID_131185
atggcttcctcttctgccacggatgacatctccaattcattctttcttcgtcctttggataacccaggcctgaacctggtttcttggcccctcaccagtgacgattacagtacattgctccattccatgaaaatggtctcagttgcgaaagcagatggttttgtgaatggcctgtcaaacgagttgattaactgctctcaagggtcacttaatgtgaatcagtactgtaccaaattgaagagtatctgggaagagctgggtgggtatcttgtgaaggaatatcttcaaggaaatccattgtggcttcaatacattaaggtccccttaataactttgggatatgaaagtaattatgatgtttttgtcaaagctgagggtggtggcctgtctggtcaggctcaggcaatctctcttggcattgctcgtgccttgctgaaggtgagcgaagatcatagagtacctttgagacaggaaggacttcttacaagagattccagagtggttgagaggaagaaagttggtctcaagaaagctcgtaaagcccctcaatattccaagcgttga

SEQ ID NO: 14408 - DNA, 210 bp, Glycine max
  Peptide Sequence Number=SeqID_131186
atggaagggactattgtggcagcacaacaaacaaagggcacgatggcaaagatgttgacgtcgtcttccacacctcgctattggagagcggccacattaactttggtacatgtcatccttgcttcaaagagcacgactgttgctaaaaagggacgtacaggaagatcggcatttggacacaacatgatgaatgatgatctttcggcgtaa

SEQ ID NO: 14409 - DNA, 369 bp, Glycine max
  Peptide Sequence Number=SeqID_131187
atgagaggaaagggacttacgttctctgacaccagcgacaacatgggtggtgggatcgaggcgattcaagtttgcggggggttccttgcgaaatgtgggactagatctatcagctttattaatggtgggaacaatgatgagaagcatccagtatctgagaagcagcttcctcagcaatcgtctgttcccgagtttcttgcgcttccgtcgcgcgcggatccgcatccgacccagctcgtcgggttcgtcatccgagacggagatcgacaaaccgttgttgttgttgttgttgttgttgctgctgctgctgtggaacattgtggaaggaagatttggcctaagacgataagagtggaagaggggaactga

SEQ ID NO: 14410 - DNA, 414 bp, Glycine max
  Peptide Sequence Number=SeqID_131188
atggactgcacagtgcccaaaatcgaaaaccaagcagtacctaaaaaggcacaaaacaatgatgcaaaaaaggagtttttgcccaaaacaagtccgactgagatgaaacttaagggacagagtcgcatggggacgttgttgggtatatcggcaccgggcgctcctgatggtatgtttgtcgtccggaaagtttgccagaaagtttgccagagagtcgacggccgccagaatagtggcagtggctggccggaaaatgaagcagagttcgccggaaaagtgaggcaagtagacgggctcaccggaagaagggcaatgagcaaaacggctcacctggggacacagatgcaagtcgcaggaaaaggtgaggcgactataaaggtccaccagggacagtggctccccgttggtggataa

SEQ ID NO: 14411 - DNA, 828 bp, Glycine max
  Peptide Sequence Number=SeqID_131189
atgcaatcagtaaataacaaatctctcattgaagagcttgataagcttcttgagcgattgcgtgtcccttctgagtatgccacaagtttgacaggaggttcatttgatgaagcccgaatgcttcaaaatgtagaagcatgtgaatggttgaccagtgccttgcgtggtcttgaaatgcctaatctagaccctagttatgcaaacatgagagctgttaaagagaagcgtgcagaacttgaaaaattaaaatctacttttgtcaggagagcctctgaattcttgagaaattattttgctagtttggtggacttcatgataagtgataaaagttacttttctcagcggggacagttaaagaggcctgatcatgctgacctgcggtacaagtgcaggacatatgcacgtcttctgcaacatttgaagagtcttgacaagaattgtttgggtccattgaggaaagcttattgcagttctctaaacttgcttcttcgcagagaggcccgtgagtttgcaaatgaacttcgtgctagtactaaagcatctagaaatccaactgtttggcttgaaggttccacaggttctggtcagaatgtaaatgctactgacacttccacagtctctgatgcttatgcaaagatgcttacgattttcatcccgcttctagtggatgagagttctttttttgcacacttcatgtgctttgaagttcctacacttgttcctcctggaggtgtcgttaatggcaacaaagctggatctgatgatgatgatgatttgggaattatggacattgatgagaatgacagcaaatctggtactcatacctga

SEQ ID NO: 14412 - DNA, 1041 bp, Glycine max
  Peptide Sequence Number=SeqID_131190
atggcgaaatcgagcgccgacgacggtgagctccggcgagcttgcgacgccgcaattgaggacccgaagcagaagatcgtgatggcgctgcgcgtcgccaagagtcacggcatcttaggaaaaccttcctccaagctcggtcgcatggccaagcctagggttctcgctctctccagttaccttcctcttcctaaatctctctcttccattcgcaattcaactatatctattacctatactcgctgctacttcgattttgcttgcacgagattccatccatttgttggtgacgacgtggtgtttcctgcagcgaaatccaaggggcagaggacaacggcttttcttcgagttttgaagtattctacgggaggagttcttgaacctgcaaaactatacaagctaaagcacctgtcaaaagtggaagttgtagcaaatgatcccagtggatgtacatttactctgggatttgataaccttagaagccagagtgtggctcctcctcaatggaccatgcgcaatatcgatgacaggaatcgcctccttctttgcatcttgaacatctgtaaagatgttttgggccgccttcctaaggttgttggtatagatgttgtggagatggctctttgggctaaggaaaatacaccacctgtttctgctcagaataaagtgcgagatggtggtcctgttgcatctgttgtgactgaaacagaaatcacagaattgaaagtcaatgttgaaaaggaacttgtttcgcaggcagaggaagaggacatggaggctcttttgggaacttatgtcatgggtattggtgaagcagaggaattttctgaaaggttgaagagagagctccaggctctggaagctgcaaatgtgcatgctcttttagaaagtgaacctttgatggatgaggtgttgcaaggacttgatgccgcaaccagtgttgtggaagatatggatgaatggttaagcatattcaatgtaaaactccggcacatgagggaggatattgcatcagtaaggaccctgtacccttcaatttaa

SEQ ID NO: 14413 - DNA, 690 bp, Glycine max
  Peptide Sequence Number=SeqID_131191
atgacacttcacttaacatccttgagaatgaaaaacataaggttgagaatgaaagggttcatggtgctcaagctagacaagtcaaaagcatacgacaaagtggattggacttttttagaaggggtactgcgagtgatagacttcccggttaggcatggcaacggggcgggtcgggatcgggttttgtttaccccacccccgcccccgaaaccgacgggggtgtgtatttacaccccatccccgtcctcgaccggggtcggtggggcgggttcgggtacgggttcaggtacgggttcggggcgggtattgagaatctcatccccgaccccgaacccgaatttggctatcggggaaaacccgaccccgatcccgaccccggtcaactcggattttcctcgtcaaaatcggagcgggtccggggcgggccccacgggttcagtccccgttgccatgcctattcccggtgaaatcggtgttgttgattataaagggtgtcaccatggcttctatcgcaataatgttgaatggcagagtgcgaccaagcgatccatgggatcaaaatttgccctcgagatccacaagtctcccacttgtttgatgatgacaacattattttctccaggggctatgttggaagaagcatccaaactttctcacatcctcaaaacctatgagatggcatctgggtag

SEQ ID NO: 14414 - DNA, 1233 bp, Glycine max
  Peptide Sequence Number=SeqID_131192
gaattttaccatttcttccattctgtaggtaaaaattctgtggagcttgaagctttgaataaatcacttaaggatttacttgatggaatacaagaagacttctatgctgttgtggattgggcttacaagattgaccctttacgctgtatatcaatgcacggaataacagaacgctatctctctggtcagaaagctgatgcagcaggatttgtacgtgatttgcttcgtgacctggagtctcggatatctatgcagttcaaccgatttgttgacgaagcttgccatcaaattgaaagaaatgaacgcaatgttcgccaaatgggtgtcctatcctacattcccagctcatcaggcactatctatagtgaatgggcttggcgcatgaatagtatggtaggtggttcagtaatggatttaaggacaagctttgatattatgtgggattttgggtctaattcaatcctacaaaatcggcatatttgcaacccttgcaactcggatggagcagtacatccaggtttttaccgtaatattactggcgggaatgtcgctttacaggttagcataatgtttgcaactttagaaaaaattgcacaaacagatccaaagtatgcagatattttcctttttgagaactatgctgcttttcagaatagtttgtatgacctcgccaacattgtgcctactttggccaagttttatcatcaggccagtgaagcctatgaacaagcttgtacacgccatattagcatgattatctactatcaatttgaacgccttttccagtttgctcgaaggattgaagacttgatgttcactgttgcacctgaagagatgtattacgaggttcatgaacggacttggacaggggtcagtaatgtggatttgggtgacgtaacctcaaatgaggctattggaacgggagaatgtccccacaagggggtaaagatggcaaaaatagattccttttcagcttggactgtcaaaaatggatcttcggaagatgttaaaatccagtttatctggggtatggttgacaagtccattgctgcgatgtataagaaactgcaaaagaatttgacttcggaggaattgttaccctccttatgggacaaatgcaagaaggaatttcttgataagtacgaaagttttgcccaactcgtgtctaagatttaccctactgagacgatcccgtctgtagcagagatgagagaccttttagcttccatgtag

SEQ ID NO: 14415 - DNA, 150 bp, Glycine max
  Peptide Sequence Number=SeqID_131193
atggataagaagtttgagggaataggagttagagtcaaaagtgcaattgatgaccatgctagagagagccaatttgaagcaatactgtttgtggataagtatgcaagaaccaatgccaagtacccctcagcaacacatgttagcctttag

SEQ ID NO: 14416 - DNA, 346 bp, Glycine max
  Peptide Sequence Number=SeqID_131194
atgtgttcattggttatgatgcaagttcaaaaggctgcaaaattgtacaatccaagcaatgggaagattgttgtaagcaaagatgtagaatttgatgaagaagagacatggaattgggagaaagaagaatgcacctatgatttatttccttattttgaagaaaatgatgaagaagttgtagtagcaaatgagttttttactccacctccttcaccaactcagtcaattcatgaagcgtcatctttcgaaaggagttcaagtgaaagaccaagaaaaatgagaagtcttcaagacatatatgatgaaactgaaattataaattattcgttttgtctttttggttaca

SEQ ID NO: 14417 - DNA, 201 bp, Glycine max
  Peptide Sequence Number=SeqID_131195
atgggagaaaaagaaggaataacaacttctttggataaaatggccaactcttttaaccgaatggtagaaaaaatggatggtaaagttgatgatgaagatattcaagaagtattacctgacgatccaaagcaattagctattgtgaaagcccttctaattcacgaaaagacagattatgttttaacacatcttgcagaatga

SEQ ID NO: 14418 - DNA, 506 bp, Glycine max
  Peptide Sequence Number=SeqID_131196
tccctcctgctgtggtggaaagggagaaatttgatcatatagaggaaaagctaagggtcattgaaggaggcagaaattatgcctttgccgacatggcagagttgtgcctagtgcccaacatggtcattcctccgaagttcaaggtgccaaatttcaataagtacaaggggactacttgtcccaataatcacctgaagatgtactacaggaaaataggggcatatgcgaaagatgaaaaattattgatgcatttcttccaagaaagtcttactggggcagctgtcacctgggatctggcagctcaagtagcacccccagtgatggagagggagatgataataatgatagtagacatgttaccggtgttctactatgagaagatggtgggttacatgccttcaagctttgcaaatttagtgtttgctggcaaaaggatcgaagtggatctgagaataggcaaatttgattatcctgctttgatgaataggaagcctggggaaaattga

SEQ ID NO: 14419 - DNA, 468 bp, Glycine max
  Peptide Sequence Number=SeqID_131197
atgaggaaggggaacaagaagaagcagaacaagttggtgtggatcataacgacgccgttgagaatgttggggaaagcgagggacatttacgtgagaagcataacgaattgcggtcacaagatgaactatagcaaccccgtggatgctgctggcagattccaggccttgcccaggagctacagtgctgccacgtcacgctccgacaacaacgaggatttcgccgagcttttgcgagcggcttccgccaggactctgggcaacagaatcgatgtggatttggttctcaaacagcaggcccaggcccggcccgtatcttcgaatgggctgcccaagtccaccagcgttggcatgggccggatcgacgaggacacgccttatgatttgggggaaggggaagttcccgttgtgcccaaagcgtatcccagaagtagaagctacgctgttggaatgacaagtgctgttttgtga

SEQ ID NO: 14420 - DNA, 384 bp, Glycine max
  Peptide Sequence Number=SeqID_131198
atggcgagaaagaaatactttcacgatgagacctgctttgataaattgctcatgccgttaagaaggctgccaccattgacaacgatgggaaacaacgtcgaggaagatgaagcagaaacaaacgaaaggagaaagcgaatttgtttcgtggaagtaggtggtgaaactgaaccagaggagcatgcagaactcttctattattttattgattattttggaggagttgcatgtccactgacatttaaaaatgaggaatacaacgggagcttacctaatttgaccttgaagccacaatcatggacaaaggttgagcttgcctggaaatttttggatgaattagatcatatattaatcgatgacattgatttcatttgttgcagctaa

SEQ ID NO: 14421 - DNA, 1202 bp, Glycine max
  Peptide Sequence Number=SeqID_131199
aaaaagtcaaactcctcaaaaaagatattaaggagtggattcttgagaaatttggaggcaaccaagctaatgggaccaaattggtgaccgacatcaataacctagacatgggagttaaacggattatctttcggggagaacccgtggtaataaaagaggtaaaggagcatttccaaaatgtgttccttgaacaaggatccatggaggtgcctttggaaggaataaatgttagaactatttcagaggagaacaatgctatgttaatagctattttttccaaaaaggagattatggaggcggcatcactagagccatacatgaattccatagccatggacgattgccgaaagggtcaaattaatgcctcattttttacacttataccaaagaaagaaaatccacaagaattgggagggtataggccaatatcacttatagggtgtctgtataagattactgcaaaactcttggccaagaggattagcaaaatcttgggaaatgtggtgaatgagaggcaatcgacgttcatcagagggagaaatattttggatggagttatgatagcaaatgagcctataagttacatagattgggctttgacacaaaatggatatgagggtgcctacaatcatcctcaactttcatccttattaacggtagtgcaatggaagagttttggtttggtgggaatcaatgtggagcaaagggatgttagaatgtgtgtaagtgtgttgaattgcaaaatcatgaccatcccctttgtgtatttgggggtttcgattggtgcggatgcaaggaaactatcaacttggcaaccggtcattgacaacatgcgtgcaaaattcctagaagagcgattagtattcttaataggatacaaaaaggctttctatgggggggctaaaggtgaagggaggaaggtagcttgggtcaagttggtgagtgaaaaacaaggattatggaagaagggggatttggtgagtatatgtgagctagagaggtcaacggtgggtcagtttcaaaaaggtatgtcaagagtggtaggtaatggaggaaagtcattggagaaaagtcacctagactctcttgcaatgacggatggccatgttgtgaaggaggttcatgaactgctacatagtaagggaaacaatgaagatgcaagcttttacatgcaactatggaaattgcaaataccatcaaag

SEQ ID NO: 14422 - DNA, 414 bp, Glycine max
  Peptide Sequence Number=SeqID_131200
atgaacaaagttgggaaaataggcctttgttatctcgtcgcctgtgtttctacctttttacatgtgcaagtacatgtgcaagcccaagaaaggaaagctccggcttatccattgattacgcataatcctaattttagtatatggtcgatgacggatcagctgaatgcatcgacaacgaaacactggaccgaagctgatcattcgttgttaggcttaattaatgttgatggtaatatctatcgttttcttggtaaagaggaacctaattatgcggttattctgccaactgccgaagataaatcttatacaatacattattcagaatccaagccacaaggggactggcagtctgccgcttataaagcggagggatggaaatcgggtgttgcccctattggtgacgatgaaaagcag

SEQ ID NO: 14423 - DNA, 891 bp, Glycine max
  Peptide Sequence Number=SeqID_131201
atgaagaaggaacagggtctcaagattgaggttgctacattcagagtcacagtggttgctgtgatgctgtcattgctatgcacatgtggggcaagcaacttcgaccctctgattctaatacctggtaacggagggaaccaactagaagcaagtgtcatacttgctcctttcactcaatgctttgctgagcgcatgacccttcactaccaccaagaactcgatgattacttcaacactcccggggttcagacccggatccctcactttggttccaccaactcccttccttatctcaagcatatcaccggatacatggcacccctggtagattcattacaaaagcttggctatgctgatgctccatggggtggtgatatagacgaaatgtacacctttgcatctggcaacactctaggagtgcccctagtggaccctttattagtgagggatgaacaaagaagctctgagagtaacctatggcttttgcctaaccccaaagtatttggtcctcaaaaaccaatagtgatcactccaaataagacctattcagctcatgatatggtcgattttctcaaagacattggttttcctgaaggggtttacccttatgaaacacgcattgtacccttgatagggaacattcaagcaccacaagtgcctataacttgtatcatggggacgggagtgagaaccttagaaactttgttttatgggaaaggtgattttgatgaacgtccagaaatttcatatggggatggtgatggaacggtgaacttagtgagcttgttggtgtttcaatcactatggaaagaggagaaaaatcaatatcttaaagtggttaagatagatggtgtgcgcatacttcaatacttaaagatgaggttgcactaa

SEQ ID NO: 14424 - DNA, 495 bp, Glycine max
  Peptide Sequence Number=SeqID_131202
atgaaaggttctgagactattggaggggctaaagacgtggcattagtgcatcttgcaacggtagagcatgtatcatatatgaacttcttcatatcatccgaggtaaagttgtgctcatctccagaacacataatagtgagtgggctcacatgtctatatccatccatagtgacaacaaaggttaaagtcaaatgcaaaagggtttgtgtaggctggggccatacaagctccctcgctattatgtcttgtgggatgaacacaaatacctacagaacccaggccaacaagattagtgtaaaaaggggtgaacctccgataaggggactgattcattctcgatacattggggttagtttctgctttgcacatctacatgttctgttttgcactcggattttaaagagaccttatccaaaagaatgttcattctctatggcatcgtccatgttgatcgcaggaacagagctgaagtctgcattctctatgtgtttttga

SEQ ID NO: 14425 - DNA, 728 bp, Glycine max
  Peptide Sequence Number=SeqID_131203
atggaagatgttgttatagtcgagaagatcttgcgttccatggcaccaaagtacaactatgttgtgtgttccattgaagaatccaaagatgttgatacactttcccttgacgagctccaaagttctttgctggttcatgagcagaagattaatcaagatacaattacacaagagcaagctttgaaggcatctacctcttcaagaggcagaggtaagggcacaaggagaagtggtagaggcagaggacggggagatcaaaacaacaacagtggaaggggagatcaaaacaacaacggtggcagaggtttggccattatcattctcaatgttatacaaagctgctacgcaacaaagaaaaggaagtttatttcaaagtttgttgaagaaaatgaaactgaaacactattgatggctattcaaaatagtaaggaaccaaaatcagatatttggtatgtagatataggctgcagtaatcacatgagtggaatggctgaaatcaaagatccttcatggttatggcattttcgttatggccacttgagttttggtggattaaagactctcaaccagaagaacatggtgataggacttcctccaattgcagccccttgccaagaaaaatctgaagcatttactgcattcaagttttttaaagttcgtgttgaaatgaggctggaaaaaatatcaagacctttcgtacagatcgtggtggtgaatattgctcaaag

SEQ ID NO: 14426 - DNA, 990 bp, Glycine max
  Peptide Sequence Number=SeqID_131204
atggcagcaagagcaatgtggatgcaggaattgcataaacaaacaaagcctgaatttgaaatttttggaagaagtgcttcctactcaagagacaaggcacagcacgatgattttactcccaacttattggatgatgcttattctgatgacacgcctaatcagacatatggatatagaacaacctctttgtccatgatgtcagattgtgagactgataagcacatggttgaaagttctggaatgcatttcaccgataagtctgttattgaggaaaattcaattattaaaactgaaaacaaggatctaaaatgtggtcgaccctctcaaattattattcaggattatgatgatgatgatgaatggccagaggaagattctgatatagggggatatggtggaacaactcatcccatggtgaatgaagatgacatatctttcagtgatcttgaggatgatgattatggcattaaacccgttagttccagtacaggatcagtagatcctcactcagcaccaagaacaatgaagagattgcctgatgttgggaataacaaaagtgctgaacttgttaatcctttttttccctacatctgttatgggactatgggttctaagagatccaaaatgagaatatgggatgaaatatgtgcttcaatccgagggacagctctgtttcagaagcttttggatccgactggtgagaccaagccggttttgctcaaacccggtgacccggccggatatgggacccgaaccgccttagcagctaagtcgtctcgccgacgcacgcacggtctgggtgcaggaactcgcacactcggtgaagtccgaagctcgctagcgcctagtctcggcgttggaggctttgatctgtttgaatttgaaagttacacttgcacggtggactctggtactctgcttttgaggaacacgtgtagtcttttgtcatttggaaatggacaaaggcatccagacaaagttgcttactag

SEQ ID NO: 14427 - DNA, 849 bp, Glycine max
  Peptide Sequence Number=SeqID_131205
atgtcatggctggctcgttccttcgcaaactctctccgactcgatggcgacgtagacgacgaaaacgacatcgtactggatccacctaccacctcatcgagagaccccgcgcaacagcaacacgaggcacgagaaaatgcattcggatcagaagctgaagaagacgaagaaacgcaagatcgtgctggagtcaaagaggacctcgacgaaatcaagcaaaccctaactcgtcaattttggggaatggcctccttcctcgctccaccgccatctgattctcattctcattctcaatccgatccctcttcgttcgtttccgatcaatccaatcatcgcgctgtttctccgaacgaagaactgcaattggatgaggctgcgatttccaatcactctaattcggtttcggtgggatccgattcggaaggggattttggtctcgagcaacgcgcggttggaattaccgaagaggtgctggtcttcgcgatgaacattgctatgcatcccgagacgtggttggattttcctattgatgaggaagatgacaccgacgattttgacatgtctgatgcacaacaagagcatgctgcggttgttgaaagattgactcctagattagctgcgctcagaattgaactgtgcccttgtcatatgagtgaaagttacttctggaaagtgtattttgttcttttgcattcaaggctcaataaggaagacgcagggattttgtctacaccccaggaaggagtgttccaatatctttatctgatggaagagcaagctcacagtttggaaataggtggttttcaatgtcacctgttgggaattaaattaccggataagaatgactaa

SEQ ID NO: 14428 - DNA, 912 bp, Glycine max
  Peptide Sequence Number=SeqID_131206
atgcttggtgatggaggcgaaatcccctcaaggtatgaattgttgagcatggtgaagaagcattccaatttaatagggaaaacggtagttgaggagcaacatgcttctgatatcgaaatggatatgaggttttggcacgatgtctttgatttgtattttgtctgtggcaaggagtcaaggggacgccaagatgatgatcttgttttctttgtcagaaaattgggttcccatggttctggttccaacaataaaacagagagcgttgatccttattttgtacgcaggtgggcacctaagttgagcaacttagttgatgaaacttctatagatgtgaactggaggcgttcattttacttgaatctaattgctcatacatcattcagtgtaactgttgcaatttgcagtcaccaggatcttctgaaccatcgagctgggcaggatacacctgctgggcaggatacacctttatcccctatatataaggaagtggaaacgactcctgcttatccagatatatgtttcgcaattgatgattttgactccacttttgatgctgtggttttgactgaaaaagatcattgctattgtgtagttcttaacgcacatgatggggcagcatttccgagtgaaaaggtggccaatgattgtagtactagtgatagctcctctttgccagtccattctagttctgcaaagaaaaggaatacaaagcatggacattataagttgaaacctgaaactattcatactacattcatatgtatctggtttttacaaaatcaaattcagtggacatactatgaaggagcagctaaattcaatagaataagaccatacctgaaatccatgttagttcctaatggtgtgacttcttcagagatgctctctgttaaccaatcaatacagaagtaa

SEQ ID NO: 14429 - DNA, 513 bp, Glycine max
  Peptide Sequence Number=SeqID_131207
atgggtgccacataccatatatctgttgtctcactagccagttacaatatatttactccctcttgcttcactgcagctggtaggtctcgatttgggagccttttatccgtgggccattcttcaggcaaaacagacaggatttacatgaaaggtcctggtggccgaggggaagttgaagtagctgtttctggtgttgcggatcaaagccagcaggattcaggcccattttcgccagttatatcaaagaaagggtttgggcttggcgtcattgtccacaaagcagcatctgctgcatcagtagcagcaaggcatgcttatgcagctgcctctgcctccagcccaaattttgatgagttgatacctttgaaatgcagcttaatgtccatatcattgccctgggaatttattgcgtatgatcttctgtttaagccaattccaccagagaagataaaaggtaaaagaaattggtctccggtcaaagctgaactgcacgcaggcagcgatggccactaa

SEQ ID NO: 14430 - DNA, 438 bp, Glycine max
  Peptide Sequence Number=SeqID_131208
atgttgttccacgaagacgaagcggttcagctcccgtgtactccggttcacgaaaccatgctgaccgaaagcgaactcgaagacctcttttctctcataaaccaatcgagagaccagcccagcccggggtccggttcgcaagggtcaaaccgggcggtttactcgccagaggaacgaaagttgagacgcatgaaatcgaaccgggaatcggcccgaaggtcccgctacagaaagaagcagcatatggagaatctaacgagccaactgaaccagttgagaatccaaaatcggttaatcaaaaaccaactagcctccaccatgcaccagcacctcctactatccctacataacgaccatcttaaatccgaatccgttgccctcatggccacactttcggatctatgtgggattttaggcaccatgcttgcacattattaa

SEQ ID NO: 14431 - DNA, 441 bp, Glycine max
  Peptide Sequence Number=SeqID_131209
atggagaggagtatgattgatgctgccagtggtggagctcttggtgatatgacccctactgaagctaggaatttgattgagaagatggctttcaactcccaacaattcagtgcaagaaatgatgctattgtccttagaggagtccatgagcaatctgaagtcaatgagcaacttgaagcttatgctgcaaacatttataatagacctcctcagcagcaaaaccaacaacaacagaataattatgatctttcaagcaatagatacaatccaggttggaggaatcatccaaatctgagatggataagtcctccacaacaacaacagcctgtccctcatttccagaatgttgctggtccaagcaaccatatgttcctcctccaatacagcagcagtgacaacaaagacaaccaacaactaaggctcctcctcaaccttccttag

SEQ ID NO: 14432 - DNA, 963 bp, Glycine max
  Peptide Sequence Number=SeqID_131210
atggtgtttgggcaagtagtggttggtcctcctggctctggaaaaacaacttactgcaatggcatgtctcagtttctcagtcttattggaaggaaggttgctgttatcaatttggatcccgctaatgattcgttaccgtatccttccctctacctctttcagacatcattgttctcaaagttgtatagttcaattgttattgtttcccctaataaagaatatagctatgaatgtgctgtgaacatcgaggatctcgtgaaactaagtgatgtaatggtggaacattcgcttggaccaaatggaggtcttgtgtattgtatggattatcttgagaaaaatattgactggttggaagcaaaattggaacctcttctgaaagatcactacctactctttgattttcctggccaagtggaacttttttttctccattcaagtgccaagaatgtcatcctgaagctcataaagaaattgaacctaaggctaactgcagtgcatttgattgatgcccatctttgcagtgaccctgggaagtatattagtgcattgattttatccttgtccacaatgctacatctagaactccctcacataaatgtcttgtcaaaaattgatttaattgagagctatggaaagctagcctttaaccttgatttctatacagacgtgcaagacttgtcatatttacaacaccatctggatcaggatcctcgttctgctaagtacagaaagctcacaaaggaattatgtgacattattgaaaacttcagtcttgtgagtttttcaaccttagatattcaggacaaagagagtgtagggaatttagtgaagctgatagacaaaagcaatgggtacatatttgttgggatggaagcaagtgcagttgaatttagcaagattgcggttggtcctgtcaattgggattattatagatatccttttttttctttctcatgtgtctaa

SEQ ID NO: 14433 - DNA, 789 bp, Glycine max
  Peptide Sequence Number=SeqID_131211
atgcttcctgcagggcgccacgctcgggccgccgctggagttttgcttaaacagaaggaaacgggtatggctacacaagaaaaacagcttgatgtcatttgtctcgggcgcatcgccgtcgatttctatgctcagcagatcggcgcgcggctggaagacgccggcacattcgccaagtacctcggcggttcttccggcaacgtggcctacggcaccgccattcaggggttaaaatccggcatgctggcgcgcgtcggcgacgaacacatgggccgctttctgcgcgaagagctgcagcgcgtcggggccgatacccgctgcctgatcaccgacaaacagcgattaaccggcctggtgatcctcggcatcaaggatcaggaaaccttcccgctgatcttctaccgcgaaaactgcgcggacatggcgctgacgccggacgacatcgatgaggcctacatcgcttcctcgcgcgcgctggccatcaccggcacgcacctgtcgcacccgaacacccgcgccgcggtgctgaaggcgctggaatacgcgcgccgccacggcctgcgcaccgcgctggacatcgattaccgcccggtgctgtgggggctgacgtcgctgggcgacggcgaaacccgctttgtggaatcggaccaggtgacccgcgagctgcaggaggtgctgcaccatttcgatctgatcgtcggcaccgaagaagagtttcatatcgccggcggcagcaccgacacgctgacggcgctgaaaaacgtgcgccgggccacggcggccacgctg

SEQ ID NO: 14434 - DNA, 279 bp, Glycine max
  Peptide Sequence Number=SeqID_131212
atggcaataatatcggtacctctttgtcttctgctcagcaactataactcttttgaaggagttctttactgcaggccacactttgaccaactgttcaaaagaactggtagtcttgacaaaagcttcgaagggacaccaaaaattgctaaaccagaaaaaaccggggaagagaaacctgcagcaaccaaagtctcaagtatgtttggtggaactagagataaatgtgcgggttgtcagaaaacagtgtatcccactgaaaaggtaacaatacaaccataa

SEQ ID NO: 14435 - DNA, 288 bp, Glycine max
  Peptide Sequence Number=SeqID_131213
atgtggtcatacaccgagctcgaggactcgtacttgtgtgtgaatgtgctgcgtgtgtccgtgaataataaacaaagattaccgaaagatgaagatgggcaaattgttcaaactagggaaggtctgtttcttgaaggggactcgccagtggagttagcgagttggacacgtgacggcgcctggtggactcgccagtggagttggcgagttgctgtccacgtgccgggtcccaccagtcgtactgacgaaatgctttgttacggaatttttttggtgaacttgaagcag

SEQ ID NO: 14436 - DNA, 231 bp, Glycine max
  Peptide Sequence Number=SeqID_131214
atggcttactacaatcaaaatcctcctcctatgtccggggtaattcctcctcctcaagggtatcctcaaccgggttttcaaggaccacctccaccccaacctcaagtttttgttactcaagccccagcacagcctgcacaaggtgcagcagctactacagccttggcgcgttgggctgcctctgctgcctcgagatgtgctgctgcctggaggcgtgtgacgaaatattag

SEQ ID NO: 14437 - DNA, 411 bp, Glycine max
  Peptide Sequence Number=SeqID_131215
atggagtatgtgttttgccaaattgtagaacaacaatggcaacaagaagatggaatcattccaagattttggaaaggatatcaccaccacaaccaccatcattctccagctcaggctcctgttcctttgataaaggcaccaattcatcctcctactcaccaaccagctcacgctccaaactacttccactatcaccaccattctccgactcctacttctgctcccattcctattgggaacattcatattggttcgacaatagaaggcttacacttttgcccatattgtccctctcaaactcttcaatcctcttatttctccaaggtttggtatcctggtgagattgaagaaacatcaacatttcttcctcctcagcccttacatttcaatctaatgtctccagagcgataa

SEQ ID NO: 14438 - DNA, 1065 bp, Glycine max
  Peptide Sequence Number=SeqID_131216
atgtgtttattatcaactattgtcctgcagtatcttaatcattttgttagcaccaagaggcttatgtatgagcgatttgcgctgttgttttccattgcaagtgcatggttacttgcacagcttctgacttcaagcactgcatataaccacaagccagaaagtactcagaatagttgccgcactgatcgtgctggtcttattagtggttctgaatggggaactgaggagcttatgatcttgagtaaaaatgctctctccttttgggggcttttcatatatgtttacaagtttcatctccctttagttcccttcccatggggggttcctaccttcaacttcggagaagctcttgctatgatagccgcttcttttgtttctctatttgagtctactggtacattttatgctgcggcaagatatggaagtggaacacccgtgccaccacatgttgtgagccgtggaactggctgggtgggagtagcttctttggtcaatggctttgttggttctgtaaccggatgtacggcatcagtggagaatgctggattattggcattgacaaaggcgggaagccgaagagtcatccaaatatcagccggctttatgattttcttctctattgctggaaaacttggagcagttttagcttctatacctttgccaatcatagcagcaatgaactgtatattcttcggctatgtctcttctgcaggtcttgattttctacagttctgtaatctcaacagtttcagaaccaaattcgtgttgggtctctcattcttcctcggcatctccattccgcaatatttcatagaatattttcatgtaaagcatcatcacggatggttcaatgatatcgttagcgtgatcttcatgtcgcatacaacggtggctgcattggttgcgttcattttggacatcacactctcacgtgaagatgatgcagtccgtaaggacattggtttgcagtggtgggagaagttcagtgtatataatgctgatggtcggaatgctgatttctataaattaccatgtagactcaatgaattcttccctgccctttaa

SEQ ID NO: 14439 - DNA, 204 bp, Glycine max
  Peptide Sequence Number=SeqID_131217
atggatatatcaagttcacaatacaatagtgctggtgaatctggctggacacattacttggatcattcctctctttctgaaagttatttccagatgagaggtgggatagaagaccatggaggaaagggagcaagagtggaggaagaggaagaagatttgtctatgatctctgatgcttcatctggtcctccacagttagcatga

SEQ ID NO: 14440 - DNA, 264 bp, Glycine max
  Peptide Sequence Number=SeqID_131218
atggcatgcgcatctactacgagctcaaagtgtgacagaaactatgactggttcttcgccctcctgaaagactggaatggtggtgacatcgacagtgctggtggtgataatggcgataacaatggtgaaatggtggtgatgcacaacgacaaccatgataacaacaatggagacgaaagaatggtggcaaaggcaaaatataatgacaatggtgatggtggtggaatgatagagacaatagtggtggtggtagtggaatggtaa

SEQ ID NO: 14441 - DNA, 1209 bp, Glycine max
  Peptide Sequence Number=SeqID_131219
atgacacatggtgcatatgatgggttgattgctacacccaaaaaaattaatgattttgttgatggtgaagatgaaagagcaagttcaaagtcacggaagggagtaagactatggagaaaattaaaatatcagcttatagaatacaattcactgccagcctacatgagggacaacgaatttatattgggctattatcgagcagattggccattgaagcagatcttccttagcattttctcaattcataatgagacacttaatgtctggacgcatttgattgggttcttcctttttctctttctcaccatatacacagctatgagagctccaatggttgtggatttcaattctgttcaagatttgtctgaaatgatagggaaagctgatttgaatatgattcgtttagatctcttaaaatgcctggcttcactgcccaacatgcccgagattctcaaattaaatgacttgagtgaatctctttattctttggacttctcctcattatcaggttggactcttgtggaacttctcaccaattgcttgcctgagcagttttccctaaatggtctgaaaggtgacatgaacatggtatcccccttaatgcaaccgattacaaggtggcctttctatgccttcttaggtggggctatgttctgcttgctagccagcagcgcatgccacctccttacttgccactcacagcgcctttcctacatcatgctcagaattgactatgctgggattgctgcattgattgcaacttcattttaccctcctgtgtattactcatttatgtgcaatccctttttttgctacctctacttgggcttcataacactaatggggattactactattgtcttctctcttctcccatttttccaaaagtccgagttcaggaagtaccgcgcttccctcttctttttaatggggttttcaggtgtggcaccaataatacataagctgatactgcacaagcatcaacctgaggccttgcaaactactggttatgagatactaatgggagttctttatagtttgggagcactaatctatgtcacaaggataccagagaggtggatgcctggcaagtttgacattgctggccacagtcaccaactctttcatatcttggttgtggcaggggcatacacacactatcatgatgggttgatctatctaagatggagagattctcaaggttgctag

SEQ ID NO: 14442 - DNA, 177 bp, Glycine max
  Peptide Sequence Number=SeqID_131220
atgattccattgctaaggcttggaagtgccaatagaaattctggtagtgacgatagtgatgtccgtttaactagaaatgagcccatgaaagttgctgaattggggatctcatcgaggttgcgaaatcaaatcaggagtatcagtaacataacaggggaggactccaagttactttga

SEQ ID NO: 14443 - DNA, 1491 bp, Glycine max
  Peptide Sequence Number=SeqID_131221
atgttccctttggatagctctgttggagattatggaacaaacaaggatagtgtgggttgtttttccatacttcctgcaactgaacttgttcctggggatattgtggaagtttctgtggggtgcaaaattcctgctgatatgaggatgattgaaatgctaagcaatcaagtgcgggttgatcaagctattcttacaggtgagagcagctccgtggagaaagagcttaaaacaaccacaacaacaaatgctgtataccaagacaaaacaaatattctgttctcgggtacggttatggttgctggtagggcaagagctgttgtggtgggagttggtcctaacactgccatgggcagcattcgcgattcaatgttgcgaacagaggatataatatttcagatcttaatttgtaaacaacatatgatttcctttcagattcgagcccatgaccaactggtcatcaaggcgcaactttaccgtcgtgctagggctcgccctcacaatagaactatagaagcgcttaccttttttttcaatcattggttgcaggaggtgacaccgttgaaaaagaagctggatgagtttggtacctttttggccaaggttatagcagggatttgtgttttagtgtggattgtaaatattggtcactttcgtgacccttctcatggtggtttcttgcgtggtgcaattcattattttaagattgcagttgctctggctgttgcagccattccagaagggctccctgcagttgttacaacatgtttggctcttggaacaaagcgtatggctaagttgaatgccattgttcgctccttgccatcggttgagaccttgggctgcaccactgttatttgcagcgacaaaactggtactctaactaccaatatgatgtctgttgcaaaggtgtgtgttgtagaatctgcaaagcgtggtcctgttgtttcggaatacagtgtcagtggaacaacatatgcacctgaaggcataatatttgacagtacagggttgcagcttgactttcctgctcaattgccttgtcttcttcacatggcaatgtgttctgctctttgcaatgaatcgaccctgcagtataatcctgataaagggaattatgaaaaaattggtgagtcaactgaagtggcactacgtgtcttagccgaaaaggttggtctccctggtttcaattctatgccatcatccttgaatatgttgactaagcatgaacgtgcttcttactgtaaccattattgggaggaacaatttagaaagatacatgttttggagttttctcgagatcggaaaatgatgagtgtcctttgcagccggaaccagatgcatgttttgttctcaaagggtgccccagaaagtataatatctagatgtacaagcattctgtgcaatgatgatggttccattgtgtcacttaccgctgatattcgagcagagctggactcaaggttccacaggtttggtttttatcatttataa

SEQ ID NO: 14444 - DNA, 174 bp, Glycine max
  Peptide Sequence Number=SeqID_131222
atgaacggcagaaaccaatcaaggtacttaaggacggatgcaagtagggatggggtcacgaccgaccgatcgttgccccttctctgcgcgagattagcagagaatgtcgctgcgaggcagccccgtatcctttgtattttgcagctttcttttactatttgtaagaataagtaa

SEQ ID NO: 14445 - DNA, 600 bp, Glycine max
  Peptide Sequence Number=SeqID_131223
atgtggccttccaagttgccttgcactaagcctggttggcgcgctaagcgccttcttcatcaacccaaaaatgttttcttccttgttgcctatgttggccttgccactgttgctggttttatttggtggtttgtttattctgatagtggccctaaacttccatacacagaattgatgaattttgatacttgcccgaccagggagacaacttatccatgcagtatatttgatgatcgacatccatctactgtatcaatgactgtgcttgtcgtagttgagatgttcaatgctttgaacaatcttagtgaaaatcaatctcttctggtcattcctccctggagtaacttgtggcttgttgcttctataatcctaactatgcttcttcacatgctaatcttatatgttcacccactgtcagttcttttctctgtaacaccattatcttggactgactggacagttgttctctatctttcattacctgttatagtcattgatgaggtgttgaagttcttctccagaaatcccattggtttgagattcagattatggttcaggaggtcggatttactaccgaaaaaagagttacgtgacaagtaa

SEQ ID NO: 14446 - DNA, 765 bp, Glycine max
  Peptide Sequence Number=SeqID_131224
atgtttacttccattgtcggtaatgtatttgggttcaaggccctgcgtgctctacgtctggaggatttgcgaatccctactgcttatattaaaactttccaaggtccgcctcatggcatccaagttgagagagataaattgaacaagtatggtcgtcccctattaggatgtactattaaacctaaattggggttatccgctaagaattatggtagagctgtttatgaatgtcttcgtgggggacttgattttaccaaagatgatgaaaatgtgaattcccaaccatttatgcgttggagagaccgtttcttattttgtgccgaagccatttttaaatcacaggctgaaacagctaaagcattacgtttgtctggtggagatcatgttcacgccggtaccgtagtagatcgaagtcgcggtatttatttcactcaggattgggtttctctaccaggtgttttgcctgtagcttcgggaggtattcacgtttggcatatgcctgctctgaccgagatctttggggatgattctgtactccaatttggcggaggaactttaggacacccttggggaaatgcaccaggtgctgtagctaatcgagtagctcttgaagcatgtgtgcaggctcgaaatgaaggacgcgatcttgctcgtgaaggtaatgaaattatccgtgaggctagcaaatggagtcctgaattagctgctgcttgtgaagtatggaaggagatcaaatttgaattcgaagcaatggatactttgtaa

SEQ ID NO: 14447 - DNA, 234 bp, Glycine max
  Peptide Sequence Number=SeqID_131225
atgcggtcgctgggcagaatattgctaagtagcaatgtcatctatgtaagagtggtcatgttggtgcgcatgatccgcactcgtctctttgcagcggcacgggtgaaatcttgccccagtatgcatagtagcagtgtgatagcctccctttctagttgtgctcgcacagttcgccctcctccaatatcagggggtggccccggaaccgttaaaaggaaactactggtcccttaa

SEQ ID NO: 14448 - DNA, 694 bp, Glycine max
  misc_feature (680)..(680): n is a, c, g, or t
  Peptide Sequence Number=SeqID_131226
atggctaagtttgaccttgaggtagtcctggaattttatgctaatgcttggcccacagaagagggagtgcgagacatgcggtcatgggtgaggggtcagtggattccctttgacgcagattcccttagccagttcctgggtgacccgctagtgttggaggaaggccaggagtgcgagttcagtcagaggaggaacagggccgatgggttcgacgagaaggccgttgcccagctgttatgcacaccggggcaggatttcacccggaccgctgcagggaggcgggtgcggatcatgggcaccagcatgaccaccttgacccagatgtggatgacattgcttctcagcaatgtcttgcctagtgatcataactctgatctccatctaccgaagtgtatgccaaccaccaggcaccctctagacccggataagtctaacagggccctggggtttctggcattgatcacgggcctctgccagtcgttcggggttctcgtcactactagtaaggtgatccgaacgccaatcgcccaggccttcattgagaagtattgcacgcctaggcaggcacagggtgatgcacctcaggccgcagacgcaccgttaccacctcatcaggctgatcccgctgggtcactaggcatggagcgttatctacagcacttggttcgccagcaggcggncaacaacgggggca

SEQ ID NO: 14449 - DNA, 333 bp, Glycine max
  Peptide Sequence Number=SeqID_131227
atgggcccagttttgtcagacccacagagacctctcctgggagatgtgcggaaaaagacacaggccatccagaagcaaaacaccgccccccacttgttgtctcgtgggggttatgaatatttagaacagaagctgatggctgagaagacaaagaaaaaactagaggaagctgctcaatctggaagcattgagggcatgattgacccttcatctcccatcagacaacacatgaagtgcaagatggcccacaccaagaaaactgggcagatgacgtttgaggcaacaaaggaaattgctgacaagattgattctttggaggagcaggcatcatag

SEQ ID NO: 14450 - DNA, 234 bp, Glycine max
  Peptide Sequence Number=SeqID_131228
atggaacgagaggaaaagaggtttgtgtaccgtatacgttgttcctctgatgaaaacaatgatccagagggagtggaggaaggaattggtgtgacccggaatgtcgttgactccgactcgaagtgccctttcgcttcttcgatggttccgccatttgaagagctttttgagatttcaatcggttcaaatgaaagagaatggaaaaagaagaaatttgggctttgtggggagtga

SEQ ID NO: 14451 - DNA, 529 bp, Glycine max
  Peptide Sequence Number=SeqID_131229
gaagaactattggaatcctgatgatctgacagtttctatccgaggggctaggagggtgagggcgaggccagctgagctcctttccacatctgcagctcctactccagcatccacttcagcagctccttcagtcccagctcagagatccattcctactattgagcagtttctggcgagtgtagcctggcctgaggcccaaccttctcttcacagggaagatgaaggtcccatagcccaggtagcacaacatatggaggatgagtcatccgaggccaccattccagagccattcattgcaaaggaggaggcaggtcacttcagagcctcctgcaccagtggtggacctatcctcgcctcagtagaggagcatgcagtagacccctccgctcctatactagagatactagaggactcgaccacactagtccagactttgaacacctctcctctagctactccagtacttcatctaacagatgatgaggatgttcagacacaggacactcaggaccagtcccaggaattctaa

SEQ ID NO: 14452 - DNA, 381 bp, Glycine max
  Peptide Sequence Number=SeqID_131230
atgcatgctttgttagggtcattcaacagtggaaactggtctgactctaaagtccttgatagtgtagggctgagttgtcgtgctttcatgaggaatcagggtgcgataagaatagggccgagaggagaaggaaacttctgcaagacagaacaattgcatccattcttgaggaggaaactcatttccccgacttattatgaccggattcaccatcatcaagggaatctgccacttaattaccagaagccattaccatggcagaagagcatgatcaaaggattacccttgaggattattcaagtagctcagtaccacaattttttaccagcattgcacgtcctgaagtgcaagctaacaacatcaactatccacattccttaa

SEQ ID NO: 14453 - DNA, 468 bp, Glycine max
  Peptide Sequence Number=SeqID_131231
gctttagatctgaatatctgggaagccatagaaattggaccttacatccccactatgatggtaggaaataaaaccatagaaaaacctaggcatgaatggagtgaggaggaaaagagggaatggcaaccaaaggtaacaaccattactgaatcaagagatctttctaacatgtctcttgcaacattgtttggaatgttacaggaacatgaaatggagttgaagagattgaataaacacgaggagaatgataagaaaaagaaaggaattgcttttaaagcttcatcttcaatccaagaagaaagtgataaggaggattcaattgaaatagacgaagatgatgatcttagtctttttgcaaagaaggcctacattacatgggatgacaatgatatggactcatctgaagattcggaaaacgaaattgtaaacttgagtctaatggccaagagttatgaaagtgatgaagag

SEQ ID NO: 14454 - DNA, 435 bp, Glycine max
  misc_feature (432)..(432): n is a, c, g, or t
  Peptide Sequence Number=SeqID_131232
atgcaatcacaggaacttacactgccttcggagcctgaggttggtccttcagctgctcgtgtcagcacaaaggagagttgtgttgatccctcagggaatgatccagacacgggtgactcagacaaatgcgggttatacatcaaagaaaatcctccccgcctagttgccctaggaaaagtttatgagggatcgacaaccgttcacaacatccctttgttgcatgatcaagtgaaggtcggtgttgaggaggttaaagatgcagatgctcccattcttgtacccactgaagaggttaagttagtggagcaggaacttaacaccttccttgcttgcccgacacatctcgtcaagcgtttatcagaacaggaagctgtgggaccagcaaaatctgcagataggccggatcatgaggttgatgatcccactatatcntga

SEQ ID NO: 14455 - DNA, 564 bp, Glycine max
  Peptide Sequence Number=SeqID_131233
atggctgatgcgctcgccaccctagcatccatgtttcagctgaccccacatggagacatgctgtacattgagtttcaatgtcccagcaagcccgcacatgctaaggaagccgagtggatgctcattgaggtgcatgaagggtcctttgggacgcatgctaatgggcatgccttggtcaagaagattctaagggcgggctattactggcttaccatagaaagcgactattgcatctatgtgagaaaatgccacaagtgccagacattcacggacaatgtcaatgctccgcccatgcccttgaacgttttagcagcgccatggcccttctctatgtggggaatagatgtaataggagccattgagcccagggcttcgaacggacatcgcttcatcttggttgcgatcgactacttcaccaaatgggttgaaactgcttcatactccagtgtgacgaggagtgtagtggttagattcatcaaaaaggagataatctgccgatatagtttaccctggaaaattatcacggacaatgccactgatcgaggccgtactcgaatcaaataa

SEQ ID NO: 14456 - DNA, 1254 bp, Glycine max
  Peptide Sequence Number=SeqID_131234
cgcacgcagcagggtcatctcaacccccatgcggcgatccggcgcataggccagctctttgcggccgaccaacagcgtctggtagtaaagttgcacatcggccggcggcagggtgcgcgccagctcgcgcagccgttgttccacggcggcgtactgattgtcgagcatcgaaggcagcagttgcaccatcgcaatgcggtgcagcagcgccagcgtctccaccagcaggttttcccagtccacgccgcgcgaagcggcctgtgcgacctgcgccatcatcttttcgccgtcggcgctgaccagcgcttcgaggatcgccagcggctgttcatcatcgagcgtgccgagcatctggctgacggtggcggcggtcacctgcccctgccccatggcgatcgcctgatcggtcaggctcagcgcatcgcgcatgctgccgtcggcggcgcgcgccagcagctgcagcgcgcgggcgtcgctggtgatctgctccgccgtcagcaccgtttccagctgctggcggatctgatcgacgtccagcgccttgaggtggaattgcagacagcgcgagagaatggtcaccggcagcttttgcggatcggtggtggccaacaggaatttgacgtgcggcggcggctcttccagcgtcttgagcaacgcgttgaagctgtggcgcgagagcatgtgcacttcatcgatcaggtagaccttgaagcggccgcgcgccggcgcgtactgaacgttgtccagcagatcgcgggtatcttccaccttggttcgggaagcggcgtcgatctcgatcagatcgacgaagcgcccctgctcgatctcgcggcagttgtcgcattggccgcacggcgtggcggtgatgccggtttcacagttcagacctttggccagcaggcgcgcgatggtggttttccccacgccgcgcgtgcccgagaacagataggcgtgatggatccgccccagcgagaggccgttggccagcgcggtcaggacatgttcctggccgaccacggtcatgctaacacagccccgcggcgatccgcgaggccgttgtgcccaaggggcgatgccgcatcaatggccggcgaagtccaccaggcagtagcagtcgatgcccagcttgttcagacgcgcttccccgcccagatccggcaggttgatgatgaatgcggcgtcgttcacttcaccgcccaggcggcggatcagtttggtggtcgcttcgatggtgccgccggtcgccagcagatc

SEQ ID NO: 14457 - DNA, 729 bp, Glycine max
  Peptide Sequence Number=SeqID_131235
atgacaaattgggggtacctcactttattacagtgttggatctatgagcactttctgagtgtgcatcagtgcatcaccgatgatgcgtacgaggagatgtccccatgtgcctcccggtggctaacgacgaaggctcatatgaagggaattacaggagcgccctaccgggcacattgtgatgctttgacggtcacagacgtgtgttggttgccttatagtgaccatcgaggggttagggggtttgagctaatttcatcgttccaaggtcagttgagatggggtcctattgtggtcacagttcgaccggagagggtggtatctgcggattacatcgagtggtttttccagatatctcacccattcatcataccgacccaggcaggtgatgagcccagacatccacctgccccagagcatgatgactacatccagctggatatcccagaggttccaatggcatttaacccccctggacatgcattggatgattacgaaggctatgaagcgatcacagaaaggttggagcatgtgcttaaccttaggatggtcactacagacacagagttacatgatatcatgcaagattgcctcaggatcgccaggggggtgccaacgcagatggaagtgttagggctagataaagatggcgcacaaagcattgatgatgttttttatgttttgtacttgacaacattttttgtatttgttacacttttttgtttaatatag

SEQ ID NO: 14458 - DNA, 132 bp, Glycine max
  Peptide Sequence Number=SeqID_131236
atgaacgagaaggccaacgtctccaaagagctcaacgctaaacacaaaaagatactggagggacttcttaaactaccagagaacaaggaatgtgctgactgcaaagctaagtatgtatttggctggatctag

SEQ ID NO: 14459 - DNA, 153 bp, Glycine max
  Peptide Sequence Number=SeqID_131237
atgtttactgccacgtgtctgcatataattgatcatttaaaaggcacaatgaggtgtgggaagggaactgccacgggaaggcttaggaagggagacccgacgaggtgtggaaacagaaccgtgacaaaggaagggtttgggaaggggatgtga

SEQ ID NO: 14460 - DNA, 912 bp, Glycine max
  Peptide Sequence Number=SeqID_131238
atggcaaaacctcaacatgttgagaaagtggaacctgttgcaccaccaccacaagctgaaacttcaaaacagaccactgaaacaacacaaaattcccctccaaaagttgactatgctacggacctttttgacatgttgtctatggatgatccaaatgaaaagggctcaggggcagctaatgataataactgggcagctgctgcagaggcatcggaagctgagaagactgatgccccaaaagcaattgagagtacaccccagtcgacacgccagtccacttctggaattgaggatttatttaaagactcaccttcagttacaccaagtttaactccagaaaaaccacaaaaagatctaaaaaatgatatcatgagcctctttgagaagtccaatgtggtatctccatttgcaatgcatcaacagcagctggccatgctggcacagcaacagtctcttctaatggctgccgctaaatctgctggtggggatcccaagtacctggccagcttacaacaacaacagtctcttctaatggctgctgctgctgctaaatctggtggcacggattccaagtacctggccagcatacaagaacctgggtccaacattcctctccaaagttggctgggtgctggctacccaatgcctggtgcaatgcccatgggtagtcaggaagagttacagaaactcatgcagaccgtgaacatgaatgcagcccattcagctgggagttcagttcaatatccaccatctagctactatgctatgggacaagttgctccctctaatggttccacgccaacggaagcgagcaaacctcaatcagcctctccagcatcatcgaacacttcaaagacagggaacgactatgatttttcctccttaacacaaggaatgtttgcaaaacactga

SEQ ID NO: 14461 - DNA, 1191 bp, Glycine max
  Peptide Sequence Number=SeqID_131239
atgagtttgagtatgagcttgtgcggtaattacagtcttcagcttcaaaatcgcagaatcgtaagctgcaatcttcaccaggatgaccatgtagcgagggattcagttcttacttgttccagatgtggtatggaagggcacttcatgtttttatcgttgggatttggaacaatgtttgttgccaattatttcatcagatgttgctatcctttgtttggttcaacgttcatgtctttgaacaaaatgcatattgttcccatcaatacgcaccaaaaaccttccaaacctgaaaagtgtcttcggtccaaatggaagattaatggcaataacattgggacatgcattggagtcatgacagtggcacacttggttgctccagtcgctgcaaaagctgaagtggctgcttctatttatgctttggctgatggaagcctcggtgactggtttggaggctttctattttcagctggacagcaggccaatgaagctgttcagggccaattaacctctctcagtttcactagtttggctgtaatttatggggctgggcttgttaccagcctttctccctgtacacttagtgtcttaccactgacccttggttacattggggcatttggctctggcaaaagcagagcacaggttgtaggagattccattgcattctccttaggccttgcaaccacgttagcactgttgggtgtaggagcttcatttgcaggaaaggcttatggacagattggccaaggattacctttggcagcttctggtttggctataattatgggtctgaatcttcttgagatcattgaattacggctcccctcattctttgacagttttgatccacgtgcagcagctgccaatttcccatccagtgtgcaagcatacctcgccgggcttacatttgccttagctgcctcaccttgtagtacacctgtcttggccacccttctgggatatgttgctgcatccaaggacccggtgattggaggcagcttacttttaacatacacaactggctatgtttctcctttactcttggctgcttcttttgctggagcactacagagcttgctctcattccgcaagttctcggcatggatcaatcctataagcggagcaatgctgttaggtggtggtgtatatacgttcttagataggctgttcccagtcacaatggtgatgtag

SEQ ID NO: 14462 - DNA, 300 bp, Glycine max
  Peptide Sequence Number=SeqID_131240
atgggaaatgagaaggcaaatagttactgggaagcagaattaccccaacattatgatagagttggaattgaaaatttcattcgtgcaaagtacgaagagaagagatgggctgcaaggaatgagaaaccaaaatcaccttctagtttccgagaagagaaaagtccttcacattggcaaaagcctgaggaaacgaagaaaatccaaccatcaaatgcaattcctgctacaagaattagtgttcctgctcctcccaaagggcctgagctgagtctgttctgctatcagtgttttgactcatga

SEQ ID NO: 14463 - DNA, 531 bp, Glycine max
  Peptide Sequence Number=SeqID_131241
atgagtcgaggaagtggaggtggatacgatcgtcacatcactattttctcccctgaaggacgtctctttcaagtggagtatgctttcaaggctgtgaaggctgcaggaatcacctcgattggtgtccgaggaaaggattcaatttgtgtcgttactcagaagaaggttccggataagcttttggacaacacaagtgttacacacctctttccaatcaccaagtaccttggattattggctactggcatgacagctgatgctaggacactggtccaacaagcaagaaatgaagcagctgagtttcgctttacatatggatatgagatgcctgtagatgtattagctaaatggattgcagataaatcacaagtctatactcaacatgcttatatgagaccactcggagtagttgctatggttttgggtattgatgatgaatatggacctcagctatacaaatgtgatccagctggtcattactttggtcacaaggtacatagaagatcttctctcactttgattgatgtttag

SEQ ID NO: 14464 - DNA, 402 bp, Glycine max
  Peptide Sequence Number=SeqID_131242
atgcaattggttttgggaaaaagcgcaacgaagaagaagccgagagtggagacggagacggtgcttttactctttaactcctttaagcatcgatctcaacttcctactcaagaaaacatggaggttatgattttgagatccaattatgcatcttcttcgttcttcttcttcttcgcgtcgcgattctgcatcttcttcccaagtgaaggcttcttcttcgcgtttctacttcttcctcgaggtacgtttctccttcgtgtttctgcttcttccaccattgttgtcagcgatggcggaaaccgctatcgggaagttgctgggctgtttacgaatcacctgatccgtaagaggcttacggatcaagttgatccggaagaggcttacggatcaagtgatccgtaa

SEQ ID NO: 14465 - DNA, 558 bp, Glycine max
  Peptide Sequence Number=SeqID_131243
atgggtactagtgaaaatatcacactcaaggaaggagggggtaacattaagaaaaaacaacgaatcaagtggtctatgaaagaggataatcttctaattagatcatggctcaacatctcaaacaatccaattgaaggaggaaaagtgaaagctcagatgaggatgtctgtcttcactgaagtatatgctatttatgagcaagacaccaaggaaacattcaattatgagcatgaattagatgcgttgggaaatcatgatgagtacttccaaacaagatttgatgtagctgatataatgagtctttcaccattgcagaaatgcactatcactatttgtgtattggcatacaaatcgcctgctaacaatgtagattactatgttcaaattggtgaaactactgcacgagaatgcttagagacatttgtaagaggtgtgaaccaaaattttgggattgagtacttgagaagacctaataacaacaacactcaatacctactacaaatgggggaggcacatggctttctagatatgttaggtttagttgattgtatgcactga

SEQ ID NO: 14466 - DNA, 762 bp, Glycine max
  Peptide Sequence Number=SeqID_131244
atggctgcagaattggttggtggtgctcttctttcggctttccttcaggttgcgtttgagaagcttacttctcctcaagttctggacttctttcatggaagaaaactcgatgagaagctgctgagcaagatggaaatcaagctgcactccatccaggctctggctgatgatgcagaacaaaagcagttcagagatccacatgtcagaaactggcttcttaaggtaaaaaatgttgtgcttgatgccgaggatgtcttggatgagatacaatatgaaatctccaaatgccaagtggaagctgaatctgaatctcaaacctctacaggctgttcttgcaaggtaccaaatttcttcaaaacttctcatgccagttcctttaacaaggaaattaaatcacggattgaacaagtccttgacagcctagaatttctctcaagccaaaagggtgatctaggcttgaaaaatgctagtggtgttgattatggatctggatcgggtagtgaagtgtcacaaaaattgccatctacatctttgctgagtgaaagtgttatttatggcagagatgatgacaaagaaatgatccttaactggctaagatctgacactgaagactgtaaccagctctcagtactttctattgtaggcatgggcggtgtgggtaagaccacgcttgcccaacatgtatataatgacccaaggatagagggtaaattcgatatcaaagcttgggtttgtgtttcaaatgaatttgatgttttcaag

SEQ ID NO: 14467 - DNA, 402 bp, Glycine max
  Peptide Sequence Number=SeqID_131245
atggctacatggcaacagcaacatcgttcgatatttttcacattagtggcagtggcaccgctagtggcaaaatcaccaaattggggggtctgttattttactacaaagcgcctacctgaggagcgcgttccaccagaacgcgacacgtggcttgtctggacatggcgatgtgacaggggtggtcgtgcctgcctgccaggcgctaccagtcgtgcctacctgccaggcgctaccagtcgtgcctacctgccaggcgcgaccactagtggtagcctggcaggcacttccactagtggtggggcccctggcacgtccatgttccctataaaaccatctgccctccgtttcattttcacacaaacacaaaatcaagctcatttggaaaccttgaagctgagttga

SEQ ID NO: 14468 - DNA, 1806 bp, Glycine max
  Peptide Sequence Number=SeqID_131246
atgacgtatggaatgaaaaccgacataaatgggaaactgttcagagacctcttgattgtggggctcaaggaatcaaaagaacatcacctagagcaattagaaaaagatcactgttggcggttgtttaataaacatgcattccaagatgataatgctcaatcaaatccagactttaaggagattggcatgaagatagttgaaaaatgcaagggactgcctctagccttgaaaacaattggaagtctattgcacagaaaaacatctattttagaatgggaaagcatattaaaaagcaagatatgggaattttcagaagaggacagtgaaattgtccctgctttagcactgagctatcaccacctcccttcccatctcaagagatgttttgcttactgtgccttatttcccaaagattatgagtttgacaaggagtgtttaattcagttgtggatggctgaaaattttctacaatgtcatcaacagagtaagagtccagaagaagttggtgaacagtacttcaatgatctattatcaagatccttctttcaacaatcaagcatcaatgatctatcaccaatatttttcttaacaagttctaggatcagaaacaagacttattttgtcatgcatgaccttctcaatgatttggcaaagtatgttggtggggacatctatttcaggttggaagatgatcaagcaaaaagtattccaaaaacagctcgtcatttttcatttgaaaccaacgacatctattgttatgatgaggagcttgggagtttacatgatgttgaaaggtttcgtacatttatgccaacaagtaagagtatggattttctttactatagttggtattgcaagatgtcaatacatcaattgttctccaaatttaagttcttacgggttttatctctgcttggttgttctgaacttaaagaggtgcctgactcagtaggaaatctaaaacatctacattcgttagacctatccaatacaaacataaaaaaactacctgaatcaacatgttcactctacaacttgcaaatactgaagctgaatggttgttcacatatgaaggaatttcccacaaatttccataaactcaccaatttgcgtcgccttgaattaataaaaactgaagtgagaaaggtgcccgagcagttgggaaaactgaagaatcttcatgtattgatgagttcatttgatgttggcaaaagtagggagtttggtattcatcagctaggagaactcaatcttcatggaaggatatcaattggggagctacagaacattgagaatccctcggatgcattggcagtggatttgaaaaacaaaatacaccttgtggagatagacttaaaatgggttagggaccagaaccccgatgattcaattaaagaaagggatgaaattgtaattcagaatctacaaccttccaaacacttggagaagttgtcaattggacactatggtggtacaaaatttccatcttggctatctgataattcattatcaaatgtggtgtctttaaggttgaccgactgtaaatattgcctgtgtttgcctcgctttggacttttgccatttctgaaggatctggtgattaaaaggcttgatgggatagtgagtattgatgctgatttttatgggaataactcttcttcatttacatctttggaaacgttgaagttctccgccatgaaagaatgggaaaaatgggaatgtcaagccgttacaggtgcttttcctcgtcttcaacgtctttctattaagagatgtcccaagctgaaagggcacctgccagagtaa

SEQ ID NO: 14469 - DNA, 816 bp, Glycine max
  Peptide Sequence Number=SeqID_131247
atgcgtcaggtactccggggtgcggcggcgtcgaggttggcatccatccagtcggcccagaccggtgagggtgtcgaactgcaggtccggctgcaggtgcggatgggtccaggtggctgcttcgcggttgatccagcacccgcgcaggccggcggcgatcgccccggccacgtccatctcggcatggtcgccgacatgcagtacctgtgccggcgccacacccaggcgggtgcaggcggcgtggaagatgctcgcctcgggcttggctgcgccgtgctcgcgggcgcccagctggaaggcgaaatgatgggccaggccgatccgctccagatcggcattgccattgctcagcgctgccaccggcacccgcgcggcaatccgcgccaacgcatcgatcgcatcggggtagcactcgacctggttgcgcgcggcgaagaacacttcatacgccggctccagcaactccaggctggcaccactggtgtgcagcgcttcgtgcagggtcagcctgcgcagcgcgctcaggtcgtggtgaaggtgcggatgggcgtggtacaggcgctcgcgcagttcgcgcatcgccgccaccggatacatctcggcagtggcagggctgttttcacgcatccacgcgtgcaggaccaggtcgatgcgggcgccgatcggagcgaacggccacagcgtgtcgtcaaggtcgagagtgatggcttggacggggaaattcaccccgccattctacgcctgcccgcgcgggctttcattccagcaggcgtgcccagccctgcatgccgtccagccgtgccagcaccagcttga

SEQ ID NO: 14470 - DNA, 1353 bp, Glycine max
  Peptide Sequence Number=SeqID_131248
atggctaccgcaccaaaagaaacctcagctcctggttcaccctctgtaccatcatccaccaaagcaccatcaaaccaggaacaacctgaattccatatccaacccatacaaatgattcctggtcaagctcctgtccctgagaaactggttcccaaacgacaacagggagtgaagacttctgaaaaccctagccttgcaacaagtcctagggaagtagacacgaagatggacaagaaaatccgcagtattgtgagtaacattctgaaaaatgcttctgtccctgatgctgatgaagatgttccaacatcttccaccccgaatgtttctgtgcctgatgctgagaaagatgttccaacatcttccactccaaatgctgaagccctcccttcacccagtgaagaggaatcaacagaagaagaagatcaagccacagaagagacccctgcaccaagggcaccagaacctgttccaggtgatctcattgacctagaagatgtagaatctgatgaggagcccattgccaacaagttggcacctggcattgcagaaaggttacaaagcagaaaagggaaaacccccattactaggtctggacgaatcaaaactatggcacagaagaagagcacaccaatcactcctaccacatccagatggagcaaagttgcaatcccgtccaagaagaggaaagaaatttcctcatctgattctgatgatgatgtcgaactagatgttctcgacatcaagcgggccaagaaatcagggaaaaaggtgcctggaaatgtccctgatgctccattggacaacatttctttccactccattggcaatgttgaaaagtggaaatatgtatatcaacgcagacttgcggttgaaagaaaactgggaagagatgccttggcttgcaaggagatcatggacctcatcaaggctgctggactactgaagactgtcaccaagttgggagactgttatgaaagcctagtcagggaattcattgtcaacattccctctgacataacaaacagaaaaagtgatgattatcagaaagtgtttgtcagaggaaaatgtgttagattctcccctgctgtgatcaacaaatacctgggcagaccaactgaaggagtggtggatcttgctgtttctgagcttcaaattgccaaggaaatcactgccaaacaagtccagcattggccaaagaaagggaagctttctgcagggaagctaagtgtgaagtatgcaattctgcataggatttggcgcttgcaaactgggtacccaccaatcatacttccactgtttgccacaggtttgggtaaattttctgtatgctgttggaaccaagtccaaatttaa

SEQ ID NO: 14471 - DNA, 192 bp, Glycine max
  Peptide Sequence Number=SeqID_131249
gacgacgttcctaaaggaaagccctacaaggttccggaatttcaacaaacattatcgacaataacgaatcatgtggcttcgcatgccaccagactcttgggtcatggtaacaaaaggtgtggtggtcgacaaaagcagggcttttgctcctacgtatcctcaatttctgatgaggaactcaaacctacgtag

SEQ ID NO: 14472 - DNA, 543 bp, Glycine max
  Peptide Sequence Number=SeqID_131250
atggcttgtctcacggcggatcccaaagtcgtgcttcacatatttgacgtgaaaacagctatgggattgggagcagcagccttccctagacctctccctttttccctcaagaaattgactttagagaggctgccaaaactggagaatatctggaatgaagatcctcatggaattctaagcgtgcaacatctacaacttgttattgttgagaaatgtaaatgccttacaagtgtgtttccggcatcagtagccaaagatcttgaaaaactagttgtcaaagactgtgagggattgatggaaattgttgcagaggataatgcagatccaagaggagcaaatctagaccttatgttcccgtgtccctgtgtgaggtcattgaaactacaaggtttgcccaagttcaagtatttttactacggctcactgcagtgtgacatgttccagacacctaccgaggatggaaaggtactattgtcttactactttgtccttaccgcagaatctgatgcctgcttattatatataattgcactacttttataa

SEQ ID NO: 14473 - DNA, 411 bp, Glycine max
  Peptide Sequence Number=SeqID_131251
atgcatcctgcgcagatcgttttgtatggatcaactttatgtgtcatgataacagtgcacttctccatgaaactactagcagaacatgttttgaactggaagaaaccaaaggagcaaaacgccatagtaattataatccttatggccccattgtacgctgtggactcctatgttggtttgataaatttctttggaagtgaagcatttttcacattcttggactcaattaaagagtgctatgaggctctggtgattgctaagtttttgggtttgatgtacagttttttgaacatctccttaagtaagaacatagtgccggatgagatcaagggaagagaaattcaccattcatttccaatgactctttttcaggttgttgatactcaaactattttgcagtgttctgattaa

SEQ ID NO: 14474 - DNA, 180 bp, Glycine max
  Peptide Sequence Number=SeqID_131252
atgtcaagctttcagggaattgtgcttgatctcctggcagcactgggaataatcagatcccgttattcgtggctaaccgtggaacgcattgaggaaggctaccaaaaccttttgcaatacgcatacagtgctgctccatacaaggtcaatagttcaccttcagataaaaaatcaaagtga

SEQ ID NO: 14475 - DNA, 402 bp, Glycine max
  Peptide Sequence Number=SeqID_131253
atggccgccgccgtgacagatatggcccgccgccacacgattagccaaatactggtggacctcctcaagtttgccgtcggttccgccatcgacggctctcgcaaaatcatccctggtaggaagcaggtagataagatggtgccagaaggattgataaacatacccttgccaacccctgtaaatgccaagaaacaccctgatttaaaggttgcaaatgatctccattttgagacaaaaatggaggaagtgaaggaagacttgaataacataaagcagcagtacaaaacatcaaccaaacgcatccaggagtcacagccaccgaacaaatcggatgatggctttaaggaaatcaatcatgtgcagagcaatggaaggagagtattcatccgatctcgactgtag

SEQ ID NO: 14476 - DNA, 393 bp, Glycine max
  Peptide Sequence Number=SeqID_131254
atgcttcctgaagaatacaccttgccgagagatcactacgaggcgaagaagattttatgtcctgtgggaatggagtaccagaaaattcatgcatgccctaatgattgcatattgtacaaaaatcagtttgcagaaatgcataagtgccctacatgtgaggtatcacggtacaaagtcaaggatgacgaattcagtgatgatgcacgcaaaaacaatagtcgtacagcaaaggtgatgaacaaaaagctcaaagatcaaaagaacaactcaagtgaatcaaagaacatctcaagagaatcaagaacaagtcaagagttcaagaatcaagaagaattcaagactcaagaagaaagcctagaatcaagaatcaagattcaagattcaagatcttaa

SEQ ID NO: 14477 - DNA, 498 bp, Glycine max
  Peptide Sequence Number=SeqID_131255
gaattggaccgcgggaagcaagtcgaaaatggggtggttggggtaccaaggaaatgtttggaagcaaaggcgagagtcttggcaagtcaagacgaatgggccccgttcatggacatcctgacacttttgatctttggggtggtcctctttccaaatgtggatgggttggtggaccgggcagcgattgatgcttttctctccttttacgaccacaaggaaagcctggttatcgctatcttagccgatctatatgacacatttgaccaaagatgtgagaagaacaatgcaaggattgtttgctatacactggctctctacagggtccacaaggcatgggaaatgtcgcaaaggaaggacaaggaacttaaggggagtagcaacgggcccatcggcggttaccataggtggttgaaagcctatgcacaagatctggattggctcccgagtttgaggaccactaaagggatggaggttgaaactccagaagaagatgaagag

SEQ ID NO: 14478 - DNA, 249 bp, Glycine max
  Peptide Sequence Number=SeqID_131256
atgtgcagtcctctgatggcgaggacatacagtcctttaaaggtgataggtactagtacccaaaagtccacctttatgagaaagcaagagatcgactcatcgagagagccggtcatccaaaaagattggacacgagatattgactgtctttttgaaaaaggtgataattcatgcaaccttatcccatcttttgcaaatatatccgggaactccctcagagtgtatattctgtttgattcagtcacttga

SEQ ID NO: 14479 - DNA, 739 bp, Glycine max
  Peptide Sequence Number=SeqID_131257
atgaactcgctgtatgaagacggcaacggcaacagcagcaatctggtgatgacgtacaaccgccagaacaacaccaactacaacaccctgagcaaggcgcagttccaaaacgatgggcgtggtactgattacgccaccacgccggagtacaacagcaaagggcagttgaacaagtattacaagatcgaacgcaacccgttcgagaacttcacgctatcgttcacccagaaactgcagctgcgcgacgacctgtcgctgaccctgcagccgtattattactggggcaacggcggcagtttcaacggccagacggcctcggtattgtccagcacgtcggacagagccgggcagtatgacctcagcaacctgcagtccaacacctattaccgcccgtcgtggacccaaacctggcggccgggcatcaccaccaagctgaagtgggacatcaacgagcagcacagcctggatatcggctactggtatgagcgtgcgcgccagctgcaaacccagccgttcatcagcatcaaggacgacggcaacccggcgcagatttggggaaaacctggcggctccgatcaggtgaaggacgccaacggcaatacggtgcaggggcgcaaccagtacaccatcaccccggcgcagaaggtgtggctgcaggatacctggttcgccacgccggactggaccttcgtcggtggcctggcctatcagtatgtggagcgcaaaggggacaaccgcg

SEQ ID NO: 14480 - DNA, 765 bp, Glycine max
  Peptide Sequence Number=SeqID_131258
atgtcattggataccgccgattttccgctggtatggatgcgccaaaatgggcgcgatacccaggccgagctggccgaattcagcgcgctgctggcgcgcgccgagccttttgtcctgatgaccgaccgcagcgtcggcgatgaagaagaagagcacgatcgcgatgcccgcacccaggtcgcgctgtggaagcgcgataaccgcgaggtgctgaagctgtgggtgaaaggcatgatcatgctggagccggacgacgccaaacgcgcggcggcggaagagttcgccgaatacggcgccaagttctggggctatccggtgctggtggccgccgatgaagccgcaggccggcctggatcagccgctgacgctggacgacattgccgccaagtccggctactccaagtggcatttgcagcggatgttcaagcaacataccggccatattctcggcacgtacgcgcgccgcagaaggctgaccgccgccgcgcgcgaactgcgcctgaccggcaccagcgtggcctgcatcgccgacacttaccagttcgattcgcagcagaccttcacccgttgcttccgcaagcagttcggtctgccgccggccagctatcgccgcagccaggattggtcgagctatggcctgcagccgccgctgcggctgaccgaaacaccgttgccgcaggccgatatcgtgacgctgcccgccatgcagctggtgggccatacccagcggcgcagctttacgctggggcagttggcggcctccaa

SEQ ID NO: 14481 - DNA, 243 bp, Glycine max
  Peptide Sequence Number=SeqID_131259
atggcttcgtcttccacgttcataccaggctacatgtccccggaatatgcaatggatggactattttctgagaaatcagatgtctatagctttggtgttttgttattggagattattagtggaaaaagaaacactagttttcgtaatcatgaccagtctctcagccttataggatatgcgtggaatctatggaacgaagacaatattaggtgcttggttgatccagaaatatcagcttcatga

SEQ ID NO: 14482 - DNA, 2811 bp, Glycine max
  Peptide Sequence Number=SeqID_131260
atgggtttgaatgtgaaggacattcaccttcgtttgttcaaagtggttcaagattcaaccaagtctagttactcatttatgcgaaggcatccactggtttcaggtgcttcattagtatgcttcatcctatatgtattcctttcttatatttacaacttattggtttacatgtcccctttccttgtgtgtgctgttattttcattaaaatattttggagttctgagcaaactcaactcaaatatgtcaaaacaaatgaggaaaaaggagggcagaaaaaggttgaaccaaaatgtccaaagataccaaacaataggagacctgagatgctttataagtatccatcacaaaatgccacaagtagaaggagaaactttagggacaagaattgggatgtgtatggtggtttagaggaaaaggccaaggatttgtcagcagtttttcataatgagttcactaaaagaaacatagagaaaaaaggggccagatattttgagaagggagagagtgctttggataataggttgtcaacaaaaaaaactcaggttcctaagaggcaaatcttgagatctgaaccttcaatggttgacttggtggaatgtagtgatttagagatagagaaaaagatagaggatggagatgacgaggatggggaagaaacacaggaggaaagtaacaaagctatagaatggacagaagatgatcagaaaaaccttatgtatcttggcaattcagaaatggaaagaaacagaaggttagagaatctcatagccagaagaagagcaaaaaagctatttaaggggcaggttgagaagggtcaaattgataaaaaaccaatggcaccagtgcttactaaaagaagcaatcacttagattcctcttcaaaggactttgatgatggtttagacatgcctggttctgctccatctcttatgccaagaagtccttctgacaatccctatgatccttctgaggagaagcctaacctcacaggagatagtttccctcaagaattttctagtcagaagtacatgccatttagcaggcatgaaagcttcatttcaagccaccttttcccatcagaaaccaaacatgaccatggagctagagagcactattactttaataaaggaaggaagtattctgatagacttgcatactcaagattcagaagacctcatacagataagggaactcacgattggctaattgaccagttgatatacaatgaaagtggtgaaaatggattgcatacacctaatcctccaacaacaaatggagaggaatcaacacatgaggaggatggaaaatgtataactgatatggaaaacacgatagatgagaatgatcatgaaacaaaatccatgtcaggtcaaataagtgagccaggatcagatagatcacggccatgggcaaggttccctaagcctcacgcgaggctccttagttttccagtatctactactgctactacttatattactaatataaatgaagctttgtatgacactgtcacatctgtagttgataagaggcaagaaagtatgtttttaaaccatgggagaaattgtcacaccccaacatattctatagcttctgacttacaagtggaggtttctgaagttggttcaccaacatcaacagttggtgagaatgctgagaccaactcatccattgatagagactctatactctatgatggggacattggtagagatgttagttctggtagtgaagagttgtggggagcctcattccatggaggaaaagaagcacgaggagttcgaagtgaggcggataataatgccgaagttaacaacaattcgaaagatgttgtttcatcaactactccgcgacatatagatgaaaatgcagctgatgtcagctcaatgtcctcaaaatctgatgtgcctgaagatactccaactaatgcaataaataatcatcataacttctttggttatatgaaatatccagttggggaaactgaagcaccacaatcttccaattcttctcatgctttggatcaattacccaatgaagcacactcagaaagaccagaggaatggtgcaacatgctagagaatgtaacaaatgaggaacaagttatcaatgatgtgaacaactcaacaagcacagaacaagataacacagagaacttaagaagtaatgaagaaccaagcacattggtgatgcgacaagaatcaattgatgaaacctccaattcctcagtttcatcatcaccaaggtctgtgttacctgagaaaactatgtcagatgacgtttcaccgtcaacttttgatcaagacctgcatatagatgttcaacaatttatcatggagggtttggcccaagaaactttaaacagtgaaagtccaactggcacaatgcctcaaactattcagccgacgatggatgagacaactgatgaatcacataatgttgacttcaatcattctcaggagcagactaatcccttagagaattctattgaagaatcaaatgtgtttggcagtatgaatgatgaagaagtcagcaatatggaagaggaggacaagtcaaagaatgatgagaacagtgaaggcaattctgaccacctaaatacacaagctactacagaatccgcaagaccaataagtgagataacaactttagaggatacggtgttatcaacagagctgattgaagatggtaagaatgacaaaccatcaagtagtagtaatattcaaaaggagtgcagcgacaaaagggtcagcactaagccaacggttcacaacaaagaatcacgttatatatatgatatatttgattga

SEQ ID NO: 14483 - DNA, 111 bp, Glycine max
  Peptide Sequence Number=SeqID_131261
atggggagcaatcagtgcttttctcgctcagcggatggactgaagcgccaaggagtgttgcgctcaacggatggctcactaagccagcagattggcttagcgagaggatga

SEQ ID NO: 14484 - DNA, 375 bp, Glycine max
  Peptide Sequence Number=SeqID_131262
atggcagaagaccacccacagaggatgacgctagaggactactctagccttgccacacctcagtacttcaccagcatagccagaccagatgtgcaagcgaccaatatttcatatccacattccctcatccagctaattcaagggaatctatttcatggtctgccgagtgaagatccatacatacgcacacctggccacatacatcgagacttgcaacacggtgaagatagcaggagtgaagcgaaaagatggcttcactcattcaaggggaatagcctgcggacgtgggaagagatggtggagaagttcctgaagaagtacttcccgaagtccaagaccgctgagtggaaggtggaatctcatttaatcatgtag

SEQ ID NO: 14485 - DNA, 117 bp, Glycine max
  Peptide Sequence Number=SeqID_131263
atggaacaacttgaggaatctctggaaattgctagagatgccgctatcgctgccggaatacacgtgagcccgcttagagggttttacttcccatgttgtgataaaccttttatataa

SEQ ID NO: 14486 - DNA, 330 bp, Glycine max
  Peptide Sequence Number=SeqID_131264
atggaatcttctgaagattcagaaaatgaagagataaatctctgccttatggctaaaagttatgaaagtgatgaagaggtgtctttgaggaagaagtggtacatagatagcggatgctcaaaacatatgactggagatgcatcaaagtttacacatatctctccaaagaaaaacgggcatgtaacatatggtgacaacaacaaaggtagaatccttggagttggtaaaatagggtctttggcactagcttttggccacgttcatacgttggatgtcgtgtatgatcgtggggggcactgtgcactgacctttcaaggtctttggcactag

SEQ ID NO: 14487 - DNA, 177 bp, Glycine max
  Peptide Sequence Number=SeqID_131265
atgccaggggatcaccagtaccgggcttatcagcctgaagaacagcagcagcagcgcaacggagatgataacggcttcacggatgccgttcggccggttcagcgcatgctcttccggcgtttccttgcgaatattgaccagctcgacatgctcactctcctccttgcggatggacgc

SEQ ID NO: 14488 - DNA, 398 bp, Glycine max
  Peptide Sequence Number=SeqID_131266
ttggaagaggacacattacttctcaatgccccaccacaaaaacccatgattatgaggggccaaagacttttatagtagccaaagataaggctactacttcaccttcctctagtgaaagtgaaaaagcaaaaggggaagaatctagtgaagaaatctacccccaagaagaaggacaaccattagtggttaaagagaagtgtaaggagttaagtgtctcctccaagagtgatcaaggggttcccatgaaccctaagagaataaaggtcattcctgagtggcccactccaccaagtgttaaggaaaaaagcccagagtttcaagaacctcgggatttgaggtcaaatccttttcaagggggagggaatcatgcaatcctattctgcaagggcattggatag

SEQ ID NO: 14489 - DNA, 1082 bp, Glycine max
  Peptide Sequence Number=SeqID_131267
atgttggaaggtgggcaggaggtgcctttgccctctccaactcctgcgatttctgtggacaacattgctagtgacggtaaagttctaaggaatggacgtgttatccccacattgtttgcaaagaaagtgaatgatccggcagttaaacaggcgacagtgaatggccccggtacaaggaaggaagtaggccaatccaatgggactagcaagaattctgatcatgacgagattctgaaactgatccagaagaaagcacaccgtgaggctctaatgaaagtgttggaccaagcttttgtggagagggacgtgactgttaatcaattggacagtatagtaggaaacattactgcctgcaataatttaagttttagtgatgaagagcttcctgaggaggggaggaaccacaatctggcgttacatatatcggtgaactgcaagtctgatgctctgtcgaatgtacttgtggacaccggttcctcattgaacgtaatggccaaatccacattaggtcaactctcctaccaggggcctcccatgagaagaagcggggtggttgtcaaagcatttgatggatcaagaaagtctgttatcggggaggttgatttgcccattacaattgggccgtttgttttccaaattacattccaggtgatggatatccaagccgcatacagttgccttttgggtaggccgtggatccatgaagctggggccgtgacatccactttgcatcaaaagctgaagtttgtcagaaatgggagattgatcactgtgagtggagaggaagccttgttggttagtcatttgtcagctttttcctttattggtgctgatgaagtagaaggaacctctttccaaggcctgactgtagagggtaaaaagccagagaagaatgaagtgtcttttgctacttggaagagcgcacagaaagtggtgcaggagggaacaggtgtaggatggggaaaagttgtgcagttgatagagagtaaaaaccgtgaaggactgggatttgcttcctctgcaggatccgcaacgaacagtgttggatcaagctccattactagcaccttttgtagcgccgg

SEQ ID NO: 14490 - DNA, 120 bp, Glycine max
  Peptide Sequence Number=SeqID_131268
atgatgttagcaaagatggatgagctcatgagagtagactatgttgagcttaaggagtgctttgcatctatctcggaaaggtcggatgctatgggagcaccttatgtggatgatatctga

SEQ ID NO: 14491 - DNA, 370 bp, Glycine max
  Peptide Sequence Number=SeqID_131269
atggccgaccatcatcattctgatgtcatcggacttgtttgtctctggatgataaagtctcgaccggaagacgctaacatctccggaaaaggtgcagatgatgacatagcaaatgagactatttcacagtctcggccggaagatgatgacatcttcgagaaaggtgcagatgatgattctcggccggaagtcgctgacatcttcggggaaggtgcagatgacgactctcggccggaagatgctgacatctccgaggaaggtgcagatgacgacgttagtcactgcatgctatcggactttgagttcttacggatagcaaatgagacttttccgcagtctcggtcggaagacgctgacatcttcgaggaag

SEQ ID NO: 14492 - DNA, 915 bp, Glycine max
  Peptide Sequence Number=SeqID_131270
atgtctacttcaaaatcttatgtctctcactcttatccaaagaaagaccaaggtcaaggcatcttaggggtgacaccttctaagcccaaagatgataagggaaagacaatagaaaagcaagcccctaaggctagtatgcaagagaaaactagctctataaagtgctttaaatgtcttggaagaggacacattacttctcaatgccccaccacaaaaaccatgattatgaggggccaagacatttatagtagccaagatgaggctactacttcaccttcctctagtgaaagtgaaaaagcaaaaggggaagaatctagtgaagaaatctacccccaagaagaaggacaaccattagtggttaaagagaagtgtaaggaggtcagtgtctcctccaagagtttagctaagaaggaaactcattttacaataaagacaaacaataaagaaactttccctcttagacaacctccacattttctcttttgtaaaaagacacttgctagcattgccacacctcttgggcttgagtttattcctcaagtaaagaagttgttggatgagggtttggttcacaagagcttaaatccttgtgctttgttggtgcccaaaataggtattattaggcaccaagtccctaaaataggtggtatgatgaatgttttgagtggtgcaaccctcttttgtaaaatcactcgtacacctaacatcttcatggtgtgtgtacatagggacccattaggtagtgatcaaggggttcccatgaaccctaagagaataaaggtcattcctgagtggtccactccaccaagtgttgagggaaggagcccagagtatgaagaacctcgggatttgaggtcaaatcctttccaaggtggagggaatgatgcaatcctatcccgcaagggcattgggtag

SEQ ID NO: 14493 - DNA, 207 bp, Glycine max
  Peptide Sequence Number=SeqID_131271
atgggagttgctacatgcacccagcattattgctggggcacccagcaaacagtgaagtggcgaaactgcccttcagcaattattcttccggaagaagacaatttccggaagaacgtcatccggaatgtttccggaagaagcttcttccggaagaattccattgtcttccggaagaagcttcttccggaagttagtttttttttttaa

SEQ ID NO: 14494 - DNA, 288 bp, Glycine max
  Peptide Sequence Number=SeqID_131272
atgtcgctgcatgttctttatctttatgtgttttctgggtttcccccagggattccccgtctactgtatctctcgttacaatcttttaaagaagtgaacgtgggggcaggatcatctcgagctaccttctggggtggagacaaagttaaagcagcaggaaccaatcaaggtaagacaacgacgcggtcgagatttgccacacctcgttgtttcctactttcagatacttggggacggacacaaaaagaggctagggtcactaccaataggtcgtcatccttaacctag

SEQ ID NO: 14495 - DNA, 762 bp, Glycine max
  Peptide Sequence Number=SeqID_131273
atgggattgcaagtagaacaaatatttttccaaagagcaatgggaagattagtgtctgatgagaagaatgagttggggccagtggtgagtcagaagttatcccgacgtcaagtagtggcaccgaaggaggtgaatggagccaatggtgatacacttgaaatgtataggtggaggagttggattctcccatgggaggaacaggaaggcagaaacaaacttagactcaaaggtggaaccaaagaaaggaataggcttaagaaaggtagtgatcaccatggcatcacccagttaaagcagcacctatgtcaccattttcgaacaaaagatctgttacttcttagggatagaggtgacgccataggtaagaagataaaggccatactcgagttttgtgccttggtgacttgttggtcatgggttcgaatccggaaacagtctctttgcatatgcaagggtaaggctgcgtacaatatcccaccttcgcatagcgaagagcctctgggcaatggggagctccaatcagttcgtggtcagcttgcatctgagcaatcgaggtgtttcaaactcgaggtggaggttgctgaattaggtcagaagctccaaacgattgggacattacagaaggagctggagcttctccagcggcagaaggctgcatcagagcaagctgccttaaacgcaaaacagaggcagagttctggtggcgtgtggggttggcttgccggtactcctccccctagccggaatgcagatgatgcgtga

SEQ ID NO: 14496 - DNA, 471 bp, Glycine max
  Peptide Sequence Number=SeqID_131274
atgccgtcagggagtggagacaaactggctgttaccaacctgcaaggcgcagcacatctcagcctgggtcaatcattgcctgctttatcttcagtgaagtctgtacagtatacttctgctggacctactggcggcaggcattttgcaaatcgcagttctagtgctcttgcgtctaatgtgcctgctgaagcagctgcctttgatccattgattgggaagaaagtttggactaggtggcctgaagataaccacttctatgaggctgttgtaactgattacaaccctgctgatggccggcatgctttggtttatgatattaataaagtaaatgagacttgggaatgggttgatctcaaagagctgttagatgagggtgatatctacataagtgtaaaaagctgctccccctttcctcacccagttgtcacatgtcctaaaactgatgcaagcagtacggattgtatattttga

SEQ ID NO: 14497 - DNA, 1338 bp, Glycine max
  Peptide Sequence Number=SeqID_131275
atggcgatggcgagagcaacttctggtctgcaatacccagagcggttctacgctgcggcgtcttatgtggggtttgatggatcctctccaaccaaaaccctcacctccaaattcgccaagtccaccgctcttcttctctacagcttataccaacaggctagtgtaggaccttgtaacatcccagaacccagtacatggaaacttgtggagcatagcaaatgggccagttggaaccagcttggaaacatgtcctccactgaagctatgcgtctttttgtaaaaatattggaggtcatgcaagaagaagatcctggttggtattcaagagcatctaactctgttgtagaacctgtcatagatgtgcaaatgaataattccaaagttgaaccagtaattgagaatgggaactcttatccagagacaaagactatttccacccaaaatggaagtgaagttggaacacaggataaagatattgttgtggaaggctttggttcagttgaagtatatgatcaatggattgcacctccagtatctggaggaaatccaaaagcccgatatgagcatggagctgcagttgtgcaagataaactgtacatatatggtggaaatcacaatggtcgataccttaatgatcttcatgttttggatttgagaagttggacttggtcaaagattgaagctaagactggagttgagtccccaacaacttcaatcccttgcgctggccattctttgattccatggggaaataagcttttgtcaattgcagggcatacaaaagatccttctgaaagtatccaagtgaaagagtttgatcttgaaacagctgcatggtcaactctaaagatttttgggaaagctccggtatcacgcggaggccaatcagtgaaccttgtagggaaaaccttagtaatttttggtgggcaagatgctaaaaggactctcttgaatgatctgcatattcttgacttggaaaccatgacatgggacgaaattgatgctgttggggtgccaccttctccaaggtccgatcatactgctgctgtacatgtggaccgatacttacttatctttggtgggggttcgcatgcaacatgctacaatgatttacatgttcttgatttgcaaactatggaatggtctcgccccacgcagctaggagaaataccatcaccacgtgctggacatgctggtgtgacagtaggggagaactggttcattgttggtggtggtgacaataagagtggggtctctgagacggttgtactgaatatgtctacactgacttggtcagtggtaacttctgttcaaggacgagttccggttgccagtgag

SEQ ID NO: 14498 - DNA, 249 bp, Glycine max
  Peptide Sequence Number=SeqID_131276
atgaaaaatataaaattgaatgagcactatggttatcccctaacggaaatttctggttggtttggtagtggtttggtttccactagtgttgttatcgctatcaataccttcccctggaaactcaaccttgccctcaaggttgtaagcaatagacaactcatgcgtctctgtaatttggcctggatggtgtgtctggagttcaagagggagttaatagcttcaactggagacgagcccaacacgtattga

SEQ ID NO: 14499 - DNA, 213 bp, Glycine max
  Peptide Sequence Number=SeqID_131277
atgaaggtgaaggaggttgtgggggtgatgcgaggaaggagaggcaggagggaagggattgattccgcagtggtgtcaacaaggaggtgcaattccatgggagaaaggaagaggaagagggtgaacgaggggagagaaagatgggtaagcaaggaaatattacaaaatttgggagtgcagaaagcaaaaaatagggtgcttaacttagagtga

SEQ ID NO: 14500 - DNA, 1539 bp, Glycine max
  Peptide Sequence Number=SeqID_131278
atgtcaaactcaaacatcacaagttgtgatagttggagattctctacagagaataatattaatagtggagaagatgcagcagtagctgttaaacagcaattggagatgcttggccagttacatagtccaaattcaaacacatcaaccacaacaaataatagcaatggtagtgcctcaaacacagattcacaaccacctgctaagaagaaaagaaacctaccaggaaatccagatccaagtgctgaagtcatagctctatcaccaaacaccctagtggccacaaacaggttcgtatgtgaaatatgcaacaaagggtttcaaagggaccaaaaccttcaattgcaccgacgaggccataatctaccgtggaagctgaaactgagaaccacgactgatgttcgaaaacgggtttatgtttgtccagaaccctcatgtgtgcaccacaacccagctcgtgcactaggtgatcttactggcattaaaaagcactttagcagaaagcacggcgagaagaagtggaaatgtgagaagtgctcaaagaaatatgctgttcagtctgattggaaagcccattcgaaaatatgtggaacaaaggaatacaaatgtgactgtggcaccatcttttctagaagagatagtttcatcacccacagagctttctgcgatgcactgagtgaggagaacaacaagttcaacgaaggacaattgccaaagatgcatggttcaaacttgcaaccaccaacaataatcccaaacctagttgcatcattaccaatcaatggcgccaataatcacaagcacccactatcactccctcacgacctcatgacaacaattcccgcaaaaccctttaacaacaacatggctgcagcattcacgagaagcctttcatccacctctcaactaagctcaaaatcaccaaacattaacatgttcgaggaaaatggtctcctttcacctcacatgtccgccacagcattgctccaaaaagctgcagaaatgggtgcaacagtgaatagtaacagcaacaacaacagcatgatgatgagtggagaaaaaagctttattaatgtcacaagcatggcaccaccatcatatgggatcatgaaccccaacatgcacaacggtcaacaagacttgtctcagtataatttcattgccaatggggtggtggatggtggtagcaatggcatgggaatgagtggtttggatatgtttaatgctatattggatcaaagtaaggccttgtcgaagatcatagagcagaacaatcgaagcagtacttataatggtgttttgcatgcaatgaataatggtaggtcaagtggttccattgaagttggtggaactaaagagagtgaagatgtgatgactttggacttgttggggataggaggaggtggtggtggtggtggtgatggtaatttctatggtggtgatcaacagttagaaatggttggtggagatggaatatggggaaattggtcaaataagaatgcagggcttgaatcattttcagcaacaaacagcaccatatga

SEQ ID NO: 14501 - DNA, 966 bp, Glycine max
  Peptide Sequence Number=SeqID_131279
atgttgcacactcattcactctcgaccttgttccacatcaccagtgtacctaaccaaacccaaccttcctcttcttcctcaaccatttctaacatcactaccccttttcccattaccttttttatttccaaattcaaattcctatttattgaaccttcgggtctttccccacatcgtcctataacacaccacattctccttcttccacactcaaacccagttaacgtcaaaccttaccattacccaaatagccagaaagctaagctcgaaagacaagtatcatctgtgttggatgcaggtttaattcaacttagtaagagtcctttctcttctccaatgttgctggtaaaaaagaaagacgacagctggcgatgttacattggctatcatgctttgaacgtgataacagtgaaggacaggtttccaatgccgacaatcgacgaactcctcgatgaattgggtgaagcttcatggttttccaagctggacttgcgacagggattccatcagattcgcatggtcgagatagatatccccaaaacagctttcctcactcaccagggacattataagtacagagttatgcctttcggcctctgtaacgcactggcaaccttccgggccaccatgaacaaagtactcaaacctttcttatgcaagttcaatgcaatttttttcaacgacatattgatctatagttcctcgttgccatatcatgtgcagcacttggaggcagtgtttgtagttctagcagaagcccaatttcacttacgccaatctaagtgcctttttgccagaaaaaatctccaaaacctgggacacatagtgtcgacttctggtgttgccccggaacccgccaagattcctgctatggtggattggcccacaccttcttccactattgcattatggggcttccttggtcttaccaattttaatcgtcgtttcattcgtggttacgcctaa

SEQ ID NO: 14502 - DNA, 1764 bp, Glycine max
  Peptide Sequence Number=SeqID_131280
atggaagaagatgattatgtggagtatgtgcccgtggccaagcgtcgtgccttggaagctcagaagattctccaacgcaaagggaaggcctctgctgtcactgacgatgatttggagaaacaaagagtggctgaaactaagcccagtcttctggttaaagcgtcgcagctgaaacgagagcaacctgagatcagtgtgaccgagcagattgttcaacaggagaaggagatgattgaaaacttgtcagataggaaaaccctcatgtctgtccgcgaattggccaaggggattacttatacggaacctttgcctacagggtggaagccgcctttgcatgtgagaaggatgtctaagaaggagtgtgatttgattcgaaagcagtggcatataattgttgatggcggtgatatcccacccccgattaagaattttaaggatatgaggtttccggagccggttttgaagaagttgaaagctaaggggattgtacaaccaacacccattcaggtgcaaggtctgcctgttatcttatctgggcgggatatgattgggattgcattcacgggctcaggaaaaactctggtctttgtgcttccgatgatcatgatggcaatgcaagaggaaatcatgatgcctattgttcctggagaaggtccatttggtttgattatttgtccatcaagggaactggcaaggcagacatatgaagtgattgaacagttcttgatacctttgaaggaagctggatatccagagctcaggcctttgctctgtattggtggagtggatatgagatcgcagcttgatattgtgaagaagggtgttcatattgttgttgccactcctgggaggttgaaagatatgttggccaagaagaaaatgaatcttgataattgcaggtatttaacattagatgaggctgatcgattggtagatttgggatttgaagatgacattagagaagtttttgatcacttcaaagctcaaaggcagactcttctattttctgctactatgcctaccaaaattcagaactttgccagaagcgctttggtgaaacctattattgtcaatgtgggacgtgcaggggctgcaaatcttgatgtaattcaggaggtagagtatgttaagcaagaggcaaaaatagtttatctccttgagtgtctacaaaaaaccccacctcctgttctgatattttgtgagaataaggctgacgttgatgacatccatgaataccttctcttgaaaggagtggaagcagtggccatccatggaggcaaggatcaggaagagagagagtatgccattgctgcttttaaggctggaaagaaagatgtgttggtagcaactgatgttgcatccaaaggtttggattttcctgatattcagcatgtcattaactatgatatgccagctgaaattgaaaattatgtccataggattggaaggactggacgatgtggaaagactggtatagcgacaacatttataaacaagaatcaaagtgagacaacattacttgacttgaaacacctcttgcaagaagcaaagcaaaggattcccccagttttggctgagttgaatgatccaatggaagataatgaagagatcacagacataagtggggtcaaaggatgtgcatattgtggtgggcttggtcatcgtatccgtgattgtcccaaattagaacatcagaagagcatggcgatagcaaataatagaaaggattattttggatctggaggttacagaggggaaatttga

SEQ ID NO: 14503 - DNA, 2445 bp, Glycine max
  Peptide Sequence Number=SeqID_131281
atggattcttttaagaatttgatagtggtgaaaataattgaaattaatggtcaggaaatcttagttccttcaataagtgtgatgctttgtaaaataaatggccagatggaattaattcaggagaattttaacgatgatttcatggatcatgcatctaatagtcctccaaattcctcttatataagcggtttagtcggtgctccacagctggatcctcgggttggtcttgaataccaggtggaagttccttccataataaaacaatcagaacagcttcaacttctaatgaatcctgctgagtcagaagttgggcatgacaattcactttccttcgcaattggtttacccatctctgttacatggatacataatgaagtggagaatagtggacatgaaggatggggatatcttagagacaacaggaaagaattgaaaccaatcacatctcaatctgtgatgacaggagacaacaattcaagccaactgggtaaaagcaaaacttatgcattggtccctggcacattaagtaactcctggagtgacactgatgcaaaaagttttctccttgggctgtatatttttcggaagaattttgttcagataaaaagattcttagagaacaaagggataggggaaatacttgcattttactatggaaagttttacaaatctgatgaatatcgtagatggtcagactgcaggaagataaaagggagaaagtctacgataggacaaaaacttttcactggacggaggctacatgaactattgtctcgcttgattccccatgtctcagaagaatctaaagacattttgctacaggtttctaagtcatatatggagggcagagcttctttagaagaatacatatcttctttaaagtccactgttggacttggtgttcttgtggaagcagtaggtattggaaaggagaaggaagaccttacatgtcttgctgtggaacctgggaagaacaattgggtgttttcagcgccaacttgcaaagcttggtcttctcttggacctagtgatataatgaaatttttaacaggatttcgactgagcaaggccaaaagtaaggatctcttctgggaagctgtttggccccgcttactggcaagaggttggcactctgagcaaccaaagaatcaaggctatgtcagctccaaagattatctggtttttcttgtccctggtgttgaggagttttcaagaacaaaacttgtgaaaggtgaccattactttgattctgtttgtgatatcttgagcaaagtggtagctgaaccaaatctacttgatcttgaagaagctaaagttgatatctgcaatgatgaagagccagaaaggggattgaataaggatgatcaatctgattatcatcctcaaacatacctcaagccccgttcttctacttacaacacagatcatataaaattcacggttatcgataccagtttggtgcatggaaggaagtcatctgatttacgagaatttaaatctgtacctgttaattcagtgggtaacgttgaggtaaatgctgctggtacacataaaggggccaaatatattaaggatatgcctgaaaacattgatcaaaagttgactgataccagcatgctttgtgaaggtaaattattgccggcgagagaactgaaatatctgccagttgaagtggaaaatacttctaagatggaagctaatatgctgatatatgacaaaaataatattagtaatgctgatagccaaaacaatgcaaagaaaatggaagaaagcctggagaatcagaagacctccgtgtctaatgataatcaactaaagagcgccataaagcaacgattcagtccgagagtgagaccaggttattccaaacatcccattcttcccttcaaaaagaggagattgactgcttgtgccaaggcagagacaagccaaatcattgggaactcctcaggagacttgggatccgaaaaaatgacattctctcaagaaaatgttgatgatcctgttagctgtcagaagagtggagcatctgctgaaaaaagtgtggaagagaataacgaagaaagcattctcaatgaagtttgtcaatgcacgagtgtttctgatgataaagttgagaaatctgaatcacagtcatcagtcaccttcaagataccccaagttgcattgaactctgaagatggtgaaagggcaacggtggaggaagatgggcagtgcctaaaggcaaatgatcaatgtttatcatctgatgctcaggcagtggttgaacagccaccgagaacctctggtgatgttggttctatggaaaatcagcctaatatgaattccaggaggcagagcacaagaaaccgatcactgtcacttagagcgttggaatctctagcaaatgaattcacgcttggggaaaggagacagaagaggaaaaacatccaaacacaacgatga

SEQ ID NO: 14504 - DNA, 198 bp, Glycine max
  Peptide Sequence Number=SeqID_131282
atggtggttcatgacgagccagagggggaggatggtggcattggaggggaagtatggtgtgagggacgagatcgagatgatgtcaaattgggagttgcggataagcttggggacgatgagaatgtagagggaggagcggtccgagaaatccgcaacgacgagcgtggtggaggcgaggagggaggtgaatggggatga

SEQ ID NO: 14505 - DNA, 909 bp, Glycine max
  Peptide Sequence Number=SeqID_131283
atggttttttatgtgatgttcaaagtgtaccgggtttcatcttttctcttgtggcttctgcttcttgctcaagcacatggaaatgataagataggattttatcaactcaagagaggaaatttacatctgaatttgacaaattatggtgcatcagttatctccgtttttgtccctgataaacatgggaatttaggtgacattacgcttggctacgatgacattgagcaatacaagaatgattcatggtacttcggagccactattggacgtgtggcaaatagaattggacacgctcaattcacattggatggtcatacctataaattgcctgctaatgatcacggcaacaccctccacggtggtttcacagggttcagtgatgttgtatggacagtaaaaagtcacaaggaagatgaccacgtaacatttacctatgacagttatgaccatgaacaaggcttccctggaagacttgaagtaagtgtgacctacatggtcattggcacaaacaaatatagtgtgaaaatgattgccaagccaatagacaaagccacaccagtgaacctagcgcatcatacatactggaatctaaagggccacaacggtggtgacattctatcccacgaacttcaaatctttggctcaaagatcacaccagtggataagaaactcatccccaccggaaaattcgaatccgtgaagggcaccccatatgatttcctagaaccaagggaagtcggtagccgaatcaatgaccttcctggattatatgacatgaactacgtgcttgatgcaagtagccctaatcacttccgacccgtgcttatactgagagaaaaagtctctgggaggaagctagagttgtggtcaaaccaaattggtcttcagttctacaccgtggcatgttaa

SEQ ID NO: 14506 - DNA, 426 bp, Glycine max
  Peptide Sequence Number=SeqID_131284
atgcgtacctccgacgaaataggaagaacagccactaacaaaacttcaaatacggaacacgggaccaccaaatcttcaaatacttcacgggaccaccaatggaaaatgcaaaagggaccacaccgaaagcaacaacaaccaaccaaaacgaaagaaacaaagcacagaaggaagaaagcgcaggcaaaatcgtcattacatcttccggaagaagctttttccggaaacattccggatgacgtccttccggaaggagtttctgagtacttccggaaatcacaaattaatctttcggaaaaaggttcttccggaatgtttccagaaaaagggtcttccggaatgtttccggaaaaagcgtcttccggatttagatttactgaagggcagtttcgccacttcactgtttgttgggtgccccagcaataa

SEQ ID NO: 14507 - DNA, 423 bp, Glycine max
  Peptide Sequence Number=SeqID_131285
atgacaatggactctcaaaccatatcaaaaatgaaaacttggattgaaagagagtttagccaacaagcaaacatagcgggagcaatcggggccgccgtggccgtcgtagacgccgatgaaggtgctgaagccgccggactcgatctagctctagacctcgaggacctagttggcctggacgacggccatggagaaatcgccggcagcgaactttccgatgtcgcgaaaccagaggaggtcctccttgcattctcttccggtggcggcggcgacattaccgacgtcatcaccgtgcccaaacagcttccaaccgcgtgcgataaggctcacgaatgcatggaacatcccatatctctcagaaaccctaaccctaggctccccaacaccggaaaccttttttttccaatggtggcgcgaatctga

SEQ ID NO: 14508 - DNA, 1032 bp, Glycine max
  Peptide Sequence Number=SeqID_131286
tacaaatttaatgtagatggtgagtggcggcacgatgagcagcagccatttgtaaatgggagctgtggagtagtgaacactatttatatagtgagagaaccagatatcttaccttccatcttaaatactgaaacacctggtcgatcacacatggaggttgacaacatggaagctaatcccaggatgactgtgtctgatctggaggtttctcgccaccgtatatcggtattcctgtccacgcatacttcatatgatttgcttcccgagtcaggaaaggtcattgccttggatataaatttaccagttaagcaagcattccatgttctttacgaacagggtatatctatggctcctctatgggatttttgcaggagccagttcgttggagttcttagtgcaatggacttcattctaatattgaaagaggccggaccccatgaatgtcttaaagatgtggctttgaaggttttgcaaaacaaggtgtcatctgttcctatcatccactcttcttcagaggatggttcacatcctcaactgctacatcttgcttcgctatctggaatactaaaagtggcttcaatacctttgggtacatggatgcctagagttggggaaccaaatggacggccactagcgatgttgatgccaagtgcttctctcggtgctgctctttcaatgtttgttcaagccaaagttagctcaataccgattgtggataataatgattcgttacttgacatttattcaagaagtgatattactgcattggctaaagataaagcttatgctaggatatctctcgatgaaattagtattcaccaggcattgcttttgggacaagatgcaacttctccttatgggctttacaatggtcacagatgtcacatgtgtttgagatctgattcgctttacaaagtgatggagcggttggctaatcctggggttaggagacttgtggctgtggaggctggcagcaagcgtgtggaagggattatttctttaagcgatgtgttcagattcttgttaggctag

SEQ ID NO: 14509 - DNA, 126 bp, Glycine max
  Peptide Sequence Number=SeqID_131287
atggtggtggtggtaatgatgatagtggtgacaaccaatggtggtggtcggtggggatggcagcagcaattgactggtggtattgttggtgactgtgatagcggcagtaacatgtgggtcttttag

SEQ ID NO: 14510 - DNA, 666 bp, Glycine max
  Peptide Sequence Number=SeqID_131288
gaagagagtgatagtgaaagggagagaaatgatgtaccaggatctcgacaacctatgaaacgaaagtgtggaaaaattcagcttagtatatccaatgattctgtccaatctcagtcaattgcttccaaggatggttgcctttctctattaaagaaaagacaatttgatggtatcccaccttggccagttgcgaaaaggacgcctcgtttcccagttaacgactctaagcctgatgatagggaaaattatgttttgcctaataagagaaacccaaagtcaatgtttgatgctaatgatgacgaagctgcacatgttgtgactatggcatcaactgaggctgcacaaagaggtgtctctccccgtgaatctcaaaatccatacaaaaaatcaaagcaggagttctctctggttcagagtgggcaaataatgcaccaagagtctgagacagttcctgccaagttttatgatgcttctattgatgaagagtacttgaaagataaaagctcttccatggatgctttgctcactttggctgacatgtgtctattggtatcaacatctacaatggaatctggtaagaaaggagtttttggtataggagacatcccatctaataacccagtctacacgatattgagagcatttgtgagttcaatacaagaatga

SEQ ID NO: 14511 - DNA, 189 bp, Glycine max
  Peptide Sequence Number=SeqID_131289
atgcactggagtagcaaatcttgtttctctggtcaacgtggaatgaaagtggatgatggggacttgcctaaacatgctgatgcaagacaagatgggaagacaaagttgttacagaaaatcacatatcatatgcatttttcaccggtcacaatttttcctaagtcaatgctttacgataacatatcctga

SEQ ID NO: 14512 - DNA, 1245 bp, Glycine max
  Peptide Sequence Number=SeqID_131290
atggctcacaaaaaagatgagaagtctgttttacctgaaggaaaatcaacaaggcaaaacagagataaaattaaacttcagggtttgaaacagaaggttgatcatgcagtccctggagttggttcatcaactaaacatagaagtagacgtaagacgattttacagagaccattcacacctaaagagaaatcttctgagaaaatattgaaaagtaaacagaataagaatttgaccccggtccacggtggggcattaaacattttagttggtacgtatcaggaaaagctttctggttgtttgtcatcttatatggttcgtcgatggtgtatgtttgaatggttttatagcgcaattgattatccatggttttccaaaagggagttcatggaatacttaaatcatgttgatctagggagaatcccaaggctaactcgtgttgagtggagtgtcattagaagttcccttggcaaacctcgcaggttttcagaacgctttcttcacggagaaagacaaaaacttgaacagtatcgtgaatccgttcggaaatattacgatgaactgcggactggtatcagggatggacttccaacagatttgtctaagccgttatgtgttggacaacgagtaattgctttccactcgaaaaaaacaagagagattcatgatggcagtgtgcttacagttgaccatgacaattacagagttcagtttgaccgtcctgaattgggtgttgattctgtcatggtttttaatgctctgtgttattcgaggaaacataatacagagcacatcagaaactctccgccaccacagatgaatcccaaagcaagttttgacaatcatgacagccttcccaatacaatggatggttctctggtgcaagagttagggtcagctgttgaaattattaaaggatccaaacttagagcacatgctatggtggatgctgcatttcaggcattgtcttcgacgaaggaaggtgaagatgctttgacgaggattgaacaggcattggattgtgcggataatcagcagctggcaaccaactcaaggttacctgtgattaggtcccaagggcaaattagtggaagttttgattaccataatcggtcaatttctcatccatcgaagcctctactcaataatgcatctggtagaaaactgcataatgattctgacaaagttaatactcaaattctcctggacctcatcacttcctgtgtcgccacagggatcacgatacag

SEQ ID NO: 14513 - DNA, 547 bp, Glycine max
  Peptide Sequence Number=SeqID_131291
gcatctcactgaaacatgtatgcgagcggggaattctgatatctatggattcctcgagcctcagtccattcagaggtctgggcaatcacagtttgaatctgaaagttacataaagagttggatgcagaattcacaacgcgatgtgtatcttggagcctacctaaatgggttccactgtagtggacattggcagatggtggtcatcctgcccaaggaacacttagttgtctggttttgttcattgcataacaagccagacaactaccttaaggggattattaatagtgctatcaagggtcttgatgatgctccacaacctaaatcaaaggctcctgctaggtggattgtcgtcaagtgtaatagacaaaaaggaactattgagtgcagcaactatgtcatgcactggatgtccaccatcattttaggaagttttagaaataattgggaagcgtattttaacgaccctagaccattggagcccgagagattaaaagcattgcggattcagtgggcacaattttatctccgagttagagatcaagcctag

SEQ ID NO: 14514 - DNA, 393 bp, Glycine max
  Peptide Sequence Number=SeqID_131292
atggcaccaacgaagaaacctagaactatgaagaataagcggttttcaagtgaagtctctaccaagaaagatgaagtcggctcaagtaaaaataagcaacggaagaaaaatatgtctgatgaattaggacctaaatggaaagccggagaactaaaccagttttatgaagcgtacaggaagcacgggaaagactggaccaaggtggctgaaattgtatctagtagatctgctaaaatggtggaggccctttacaatatcagtaaggcatacctatctctgccaaaggagtcagcttctgctgttggcctaattgcaatgatcacagatcactatagtatggtggtatggtcaaagataaaaatttgccgctttgttatgattgtggttgtctaa

SEQ ID NO: 14515 - DNA, 257 bp, Glycine max
  Peptide Sequence Number=SeqID_131293
atcacgtcttttccggtttttccgacgttttcctcaaataaacgttggtggcgactccgcacgtattcctttcgtggaacatgcatcccgcgagtcacgcgtcaccctcccgccgaaggagaaagctgagtgttttggtcttttccttttatgtggggcgggatatcgccagtcgagaacagggattcgaaaggaagagacaccaaaaatgggtcttcctttgccgacagtcacttatcttgccgacaattcatctg

SEQ ID NO: 14516 - DNA, 1641 bp, Glycine max
  Peptide Sequence Number=SeqID_131294
atggtttatgcaccctcttcctctacatcgaccatatttattctttcccctaccatgctcgatcccacttcttccattccaccgccattgcttaatgcgggggtaacaacgataggtgtcttaatgagcatgcttcctccttcctccgtttttccacctttagctcccattgccccatctcgtgtcaaaagcttggctatcttagaagaaaatgggaataggcacaaggaggccatgaataggattgcttccttggaggcgaaagctacaaagtggagggccactttaaggataatgtggcgagaggagtgccccaaggtggcaaatgctactgttgcctttgctgaagtcgtcaggtccaaccatcagttgtcgtcctgggtcaacaatgtttttgccaagttagtgagcataagattggacagggacgaggtgagaatgagtgagtatgaaaagagtgagatgaaacttggtacttatagagtggaatgggagctacgggtccatgtttgtaggagctgttacggtgatgttacaacatattcaaataatgaagtggttagagataacctattcggtgagagcctaactgttaaaggcatgacatctgtgctcatgtgccagggccgacatggagggatgacgttgtccaatgtcgtgggagattgtcttgtgtcgagggtagtagcattgacaagtagaagggtcggttttgaagccccctctgcctggacaagggttgtccgggctacttctatcaagttgtccaaggtggacattcttttagttttgcaggcgaaatcggacgtgttagtacagtgcatgtgcattgctcttgcatacatgtcactcatggagtgggcatatactggagacgtgtttcaaggtattcttcttcgacaatgtctttcatctctgactccgccatggtcatgggcggtagtgactcctgggtcctcttcctttgagaggttgatggtcttgagccatgttggtgaaggcacctttcatctccgtagtagggcacaacctcctgcttcttctctggatggggaatccattccaatcaccatgattcttccctcttttgtttctaggggagaaagaaggagtgatggcggggacgttagtgcttcccccgtgtcctcctttacttctgtggtgagtgtcgttgctttgcaccgccaagtgaaattggccaatctggaagattcctgcaagctggctgtccaggcttgtgggagtgatgatttcccatttcttagggcgacgtcggcacttgaacgtagccctttctcaactccaccccaacagttgggctatggtgaggatcgtttgttcaatgtcctggctattgatgtcgtggctggtggcttgccactaatgttcaacttggacggggagccccacttcccgtataatggttacttctcttggaggcccctagtgaagcaagtcaaacctgttggtgcgattgtgccacctgtcattcctcctactggagaatggggtcaacccgctgctggggttggccctactaataaaattgttcaggtctcccccaacatgccttcctttattttggctaagaggaagtgcgatggcggtgctgggccgcaagaagtcgagggccccttctag

SEQ ID NO: 14517 - DNA, 288 bp, Glycine max
  Peptide Sequence Number=SeqID_131295
atgtctattggttttaccagaataggtttagttagtgaaatttcaaggcgttacactagggtcaccctaccccgtgcttctgaaaccatcgaagttgatgttgtcgaggttacacctgacgtgcctccttctgtggtgaacaagaggaagcgtagcgaagaggttggagggaccgatcagtgcaagaaatcgagggctccctttagtcttctggctctaaagcatgccaatgggttggtgttcaattcaagtcgtccctctttacttcatgtgactgccaagccctga

SEQ ID NO: 14518 - DNA, 432 bp, Glycine max
  Peptide Sequence Number=SeqID_131296
atgggtgaaaaagagaggccatggggtaagttttatcgcggccccatagtgggcgccaaatgtacttatcaaaatctagagctatcccacgttagggtggacatggccaaggtaagctctaagatcttgtatgtcgtactgagagttccctttgttaagaggacaagagggggcacctacaaaacaaaggactttgacgctcaatacaagcattataaagatgttgggtttggcgagactcaccaaggacagatcttgggtttgatgagcctttggagatttgaccaagagcgcatttgtctcgggtttggcgagactcaccatggatggaccttgggtttcataagcctttggagattcgaccaggagcgcgttcttcctgggtttggcgagactcaccaagggaggaccttgggtttaacgaggctttag

SEQ ID NO: 14519 - DNA, 336 bp, Glycine max
  Peptide Sequence Number=SeqID_131297
atggcaaatctggccaccatcgttgagcaagccttcaatgttgaggttcccatacaattaccccctgtacctcccccagacctggtctgcatagaactaagcactacaggtaccactgcaactatggttacaacatcgaagactattgggccctcaaggacaagattgaggaacttgtacaagaaaggttacctagcccaggaaaagacaaaggacaagatagaaggggagatagaatggaggatagaggaagaccgaggcctcaccaacaaagacgtgggttttcccatggaggaatatccgactagtcccaaaagcgtcatctctatgccataa

SEQ ID NO: 14520 - DNA, 510 bp, Glycine max
  Peptide Sequence Number=SeqID_131298
atggaagctttgatggtgtcgagaagaaatcacatgtttgtcatcatcaaaaagggggagaatgtgaatgtatgtatacatgatattgatgatgccaaagaagaatcaaacaaggttgcttcaaaggataagcatttgcttcaagatttatacaagattgcttcaacaaacaaacctatcccacttaagattattgaggccacaaggtccaacagaaaattgttgcagacttttattacacaggagcaactgcatttaaagaggctatgggttatgaatagtccaggttggatgattgcctacaagtcacaaatgaagggaaatcggatggttattaaactgttaggaaattccaagggtgaagaagtggagaatggggacatgtatcttgttgtatattttttgtctgttgaggttcctgtgtgggtacttttttttgctctcgatgtctcatctgacaaagagattgtagatctcattggttgtggcaatgatgatgtcagaatttag

SEQ ID NO: 14521 - DNA, 285 bp, Glycine max
  Peptide Sequence Number=SeqID_131299
atggaggtctcccaatcggcgacaccgtcacggagggagtggcggtggtgggaagaggaagcagaggatggcgagggagatcccaagaagaagagtacaatgaagctaaaggaacaaaaagaaatggcagatattcctcgactgaagcttggaagccaaggccttgaggtttccaagttgggattcgggtgtatgggcctgaccggagtgtacaatgatcctgttcttgaagaggttggcatctctttgatcaaatacgcatttagtaaagggatcacttgttga

SEQ ID NO: 14522 - DNA, 770 bp, Glycine max
  Peptide Sequence Number=SeqID_131300
atgtcattcgaccgcgccgtcggccggcagcgtgagcttggagccgtcggccaattccagcgtcacgaaaccattgggcgcggtcacgaccttgctgccttcgctcacgctcgcgccgggtttgagcgactgtccgtcgatgttcgcctggccactgacatgcaccacgcgcgcgtcggcggcgcgttcggggatcatcgacaacgggatgcgcaactccaggccgatgggcaggcgctcgggcgtggtgacgctgttgagcgtctgcagcggactccagttggcctgattgcgcgtgtaggtggaagcgatgtcgatcagcgtgtcgccttggcgcacgcgatagatgaaattgtctcccagcgcgccagcgggctggccatgcgaggaagtggcgagcagcaggccggaaagcaaggctggcaaagaaagcacgcggcagcggctcatgactttcaaatctccaggcggactcagcaactccagccggtagccgagcgcgtaggaagaactcaagcgcacgccatgttccgggcgcagctggagcttttgccggatgttcgacaggtgggtgtcgagcgtgcgggaggtggctggaatctcgcgattccagacgcattctgccagcacatcgcgcgacatgagccggcccaggttgccaaagaacagcaacgcgagctcgaactccttgggcgccagcgcgacctgcgcgccatcgagcgagatcgcgcgcgcagcgcggtcgacgcgatagctggcgacgtcgaacg

SEQ ID NO: 14523 - DNA, 183 bp, Glycine max
  Peptide Sequence Number=SeqID_131301
atggaggatagggtcacgaccgaccaatcgtcaccccttcccgacgctgggccagcggagaacgtcgctgcaaggcagcccagccttaggcctatgttgtgttctgaagcaatggggcatgccacattgcccccattctcttgcaatttatgtccaaacgtgcgcccaccaagtgctcggtga

SEQ ID NO: 14524 - DNA, 279 bp, Glycine max
  Peptide Sequence Number=SeqID_131302
atggcaccgggaataatgaaaatcagacggccaaccaaaataaagaaactgatcagcaaaacgatgcgggtcatggtaccggttttgggacgtcttcgtgcagagatggcgctattcacgcggggtggttcctgtaaaagcccggctgggcggtggcaacatttagtcacaacccgaccgggagccggcgggcgaagcgtgcgtcatcgactctgcaggggcgtcattgatgacgaccgaaagccgcatactttcaccaaccgcactaatccgttgtag

SEQ ID NO: 14525 - DNA, 865 bp, Glycine max
  Peptide Sequence Number=SeqID_131303
atgtctgcttcgcacgcacaacaactatcagaaacccgccagcgaattctgcaccttctgctcagcgagcacgatttagtcgatgtgctgttggataaatccgtcgacctcaatgccgccgaactgcgcaaaatcaccggctggcgtcagcagctggagcatgaactgccgcagctgcacgcggccgaccttgcggacattctcgaagcgctgccggaagaggagcgtctggcactgtggcggctggtgccctacgagcagcgcggtcgcgtgctggtggaggcctccgaaaccgtatgggccagcctgacggaagagatgaccgaccgcgaaatcctgcgcgccatcgagccgctggatattgacgatcaggtctatctggcgcgttacctgccgcgcgatctcaccggccgcctgctcaccacgctcgatcccagcctgcgcgcccggctgctggacgtgattgagctggatcgcgatcgcgtcggccaggtgatggactttaatatcctgaccgtgcgctcagacgtgacgctggcgacggtgcaacgctttctgcgcaagcgcaaaagcatgccggacggcaccgataaaatcttcatcaccgacgaacacaatcagctgctgggtgaactggcgctgaccgatatcctgctcaacaaacctaaaacgctggtggctgaggtgatgaacgcgcgccccaccactttccagctggatgacaaagcggaagaggccgccagcgccttcgaacgctataacctgatctctgctgcggtgaccgatgccaaaggcaagctgattggccgtatcaccgtggaagatgtgattgacctggtgaacgaagagaacgaaagcaacatcc

SEQ ID NO: 14526 - DNA, 1758 bp, Glycine max
  Peptide Sequence Number=SeqID_131304
atgattgatttcaggtccttgtcaaggaaggatattcaagttttggttggttatggatgccccactgtggacagaaaagtggttttctctgcaaaacttttaaggaagcatgttcaccttgacgaaggagatgtctgtagttcctgcagcttgagaagcaattgtgaaagggggtatttgctaacaaacaaagaggatgaggcacggactcttgatgtcatgaggctcctgctgacttttggttttgatcctgttgatggatcagtgatcaataagtcacttctaaagcagaagtctgtgaaaacagtggttcgtaaattgcttcatgaggttgtcaagctgagttcagttcccattgatccaaatcttcctcctccggtgattaaaaaaccaccaccaaaagtgaaacaacctcctcctcctccaaagagacgtgttgggcgggatgacgttgagatgaaaagaggggactggctgtgtcctaagtgtgaattcatgaattttgcaaagaatactgtttgcttacagtgtgatgccaagcgtcctaagagacagttgctgccaggagaatgggagtgccccaagtgcaatttcttgaattacagaaggaatatggtatgcttccattgtgagtgtaaacggccacctgatgagtttctggagaataaaatgcaagatagaatacagaattccaaacctaagttggataagaagggcagccgacaagaggtttccaatgcctggaattttgactttgatgacaatgaatcagatggtgcagatgtagctgcttttgagtatgcagatactcatgctatagatgagaattcagataatcatgctcaacgtggaaatgatagggggtgggaagatgattttgagaagaacaacagagtgcaagggtcccctgatggagaatatgctaatcctggtctttatagatctagaacagggtttgatgattttgaggatgaagatgatatagatagttatgagctagaaactgctcaaaatagtatgttcagtcccgatcaattcgcaagaatacgtctttctctgggtccaaaggatgatgaacttgattttggtaccgatgaacaactgtctgtggtctccaatttcaaatatgggcacgtttctgcttctgacagaaaaagaaaaggcagaggtccttccaagaaattaagctttggttctgaatctgaggaagacatgggtggtggcttatactctgatgaggatggtgacttaaatgaagaatattcatttaggaaaaataaagggaacaaagacacgattctggaagaaggaactttaccaaagacaggaagtcaggatctattggtggtcgccgagcaaatatgctcagtgatgattttgatggatcatcccagcagtcttataggaacagtagggggtctcagggaaatgaccgtaatcggaagagttttgaagattttgatggaccgtctcggcaatcatatggtgatggcagagggtcccgaggaaacaaccgtaatggatcatcccggcagtcttatgggaatggtagggggtctcgaggaaatgaccgctataggcagagatttgaagattttgatggaccatctcaacgatcatatagtgatggtagagggtcccgtggaagcaaccgcaatggatcatcccggcagtcttatgggaatgatagaggatctcaaggaaatgaccgtagatggcagagatctgaagacagggagaatagcacaggacggttaa

SEQ ID NO: 14527 - DNA, 1662 bp, Glycine max
  Peptide Sequence Number=SeqID_131305
atggagtgccttcccctagtaatggaaccagaatctggattttattcagatcctgttgttgtacttgacttccagtctttatatccatccatgataattgcatacaatctttgcttttgcacttgtctcggtaaagttgtggcatcaaaggccaacacacttggggttagttcattctcaccagagcaacatgttctgcaggatttaaaggatcaaatcttgctcactccaaatggtgttatgtttgtaccttcgaaggttcgaagaggtatactgccccgcttattggaagaaatcttaacaacaagaattatggtaaaacaagcaataaaaaagttggctcctccagagaaagttcttcagcggatatttaatgcaaggcagcttgctttgaagctcatagcgaatgtaacatatggctacactgctgctggatttagtggtcgcatgccctgtgcagaacttgcagacagtatcgttcagtgtggccgtagtacactggaaaaggctatatcatttgtaaatctacatgaaaagtggaatgctaaagttatttatggagatactgatagtatgtttgtcctccttagaggatgcactgtcaaagagtctttccaaattgggagtgagattgcctctgctatcactgctatgaatcctagccctgtcaccctgaagatggagaaagtttatcacccatgtttcctccttactaagaaaagatatgtcggctacagttatgaaagccctgatcaaattgaacctgtttttgatgccaagggtattgagacagtacgcagggacacatgtggtgcagttgcaaagataatggagcagtctttgagactcttctttgagcatcagaatttattggaggtgaagacttatttgcatcgtcagtggaagaggattctttcaggaagaatctgccttaaagattttatctttgcaaaggaggttcgcttgggtacctacagtgcaagaatctcatcacttcctcctgctgcaattgtagccactaaggcaatgacggttgaccctagggcagaaccacgttatgctgagagaataccgtatgttgtaattcatggagagcctggagctcgcctggttgatatggttgtggatccattggaagttttggcaattgattccccatttagaataaatgatttatattacattaataaacaaataataccagctttacagcgggtatttggacttgttggtgctgacttaaaccattggttttcagagatgccccgccccacaagggaagcttctgcaaagcatacattaactacaaatttccatcaaaccagaattgattattactatctttcaaaacattgtgtattatgtgataggttggttcaggcatcagcccgtttatgcaatcaatgttctgaaaatgaagtagctgctgcaacagcagtgattagtaagacttcaaagttagagcaagagatgcaacatcttgttgctgtatgtcaccattgtggaggcggggataggcttctggaaaatggtgtgaagtgtacgtccatttcatgcttggtgttttatgagaggcggaaggttcagaaagaactgctagctgccacccatgttgctgcagataaagacttatatccgagatgcacagtggaatggttctga

SEQ ID NO: 14528 - DNA, 627 bp, Glycine max
  Peptide Sequence Number=SeqID_131306
atgtcacctcctaggcagaaggaggtgataccccagcaacaacaagctccaacggcagatttgacgcgctctaaaactaatttggatcgccttgaagatgccactacaaaactcacctccactcaactcaatttcttagccactcaaaacaccatagtcgccaagcttgatgacttcatacagaaagtatccttcctcgaaacaaaccaacactcttcttcctcttctaccgcaaaccctaccttctcttcaccttcccccacaccataccgcatgaaacttgaagtaccaaggttcgacggttcagacctattggggtggattttcaagatcaatcaatttttttattaccacgccacacttgatatcgaatacctgacaattgcctcgttctacatggatggaccagcacttgcctggtttcatccggcactagccaacaaaatcattggccttcctcctcccttcttactaagctgctccatctcaagcttatcgtcaaacatccaccgaaaggttcaagctttacaggccctcatgttgcttcaggaaatcgccttggctctccttcaagaggagaactcctcaattcacaatgaacattttgtggtcgtgctctttcaccag

SEQ ID NO: 14529 - DNA, 2403 bp, Glycine max
  Peptide Sequence Number=SeqID_131307
atgataacaaatgttgaagggaatggcatgaaaggaaaacttgggaagcctgcatatttggaagactggatcaccacaatcacacccttgacagcgggtgaatcggcattcagggtcgcatttgattggaatggtgatgaggatataggaaccccaggagcatttttagtaagaaataatcatcacagtgagttctacctgaaaagcttgacacttgaaaatgttccaggccacggtgtcatccactttatctgcaactcttgggtataccctgcacataaatataaaaccgatcgcattttcttcagcaacaagacgtaccttccaagtgaaacaccagtgccacttcttaagtatagagaagaagaactagagaatctaagaggagatggaaaagggaccttgcaagagtgggatagggtttatgattatgcatactacaacgatttgggtgatcctgataagggtgcacaatatgctcgtccagttctaggagggtccattgaatatccctatcctcgaaggggaagaactggtagaccacctacaaaatcagatgctaatagtgagagtagattgaattttgccatgagcttggacatctatgttccaagagatgaaaaatttggtcacttgaaattgtcagactttcttgctaacgcactgaaatccatagctcaaattgtcaaacctgagctggaatcactattcgacagcatccctgaagagtttgatagctttgaagatgtgtttaaactctatgaaggtggaattaaggtgcctgaaagtatactaaagaatattagggataaaatccctgcagagatgctcaaagaaattctccgaactgatggtgaaaggttcctcaagtttccagtccctcaagtgattaaagaggataagtctgcttggagaaccgatgaagaatttgctagagagatgctagctggtgtaaacccagttattattcgctgcctcaaagaattcccaccagaaagtaagctagattctaaagtctatggcgatcaaaccagcacaataaggaaaaagcacattgagagcaacatggatgggctcaccgcaatcagacaaaagaaattgttcatattggatcaccatgatgcactgataccatacttgagaaggataaactccacttctacaaagacttatgcaagcaggacaattcttttcttgcaaaatgatgggactttaaagccattggtcattgagttgagtttgccacatcctgaagaagatcaatatggtgtcattagtaaggtttacactcctgcagaagaaggtgttgaaaattccatctggcagttagctaaagcttatgtagcagtaaatgactcgggctatcatcagcttattagccattggttgaatactcatgcagtgattgagccattcgtcatagctgcaaaccgacagcttagcgtgcttcaccctatttataagctattgcatccacactttcgtgacaccatgaacataaatgcacttgcaagacaaatcctcatcaacggaggtggcattgtagaggccacagtttttccatctaagtattccatggagatgtcatctgtgatttataagaactgggttttccctgaccaagcattacccacagatcttatcaagagaggaatggctgttaaagattcaggttgtccacatggccttcgactcttgattgaagattacccttacgctgtagacgggctagagatttggtttgccataaagaaatgggttcaggattattgctccttctactacaaggaagatgacacagttaagaaagattcagaactacaatcctggtggaaggagttaagagaggagggtcacggtgacaaaaagaacgagccttggtggccaaagatgcaaactcgtgaagacctcattgaagtttgcactatcatcatatgggttgcttcagctctgcatgcatcaaccaactttggacaatacccttatgcaggtttcctcccaaaccgtccaaccataagccgaagattcatgcctgaggaaggaacttcagaatatgatgaacttgtgaacaaccctgataaggtttttctgaagacaatcactgcacagttgcagacccttattggcatttcactcattgaaatattgtctaggcactcttctgatgagttgcatcttggacagagggacactcctaattggacttgtgatgtggagccattggaagcttttgatgagtttggaaagaagctggttgaaattgaggagaggattatggcattgaacaatgatgggaaacacaaaaaccgagttggaccggttaacatgccatacacattactctttcctagtagcaaagctggactaactggcatgggaattcctaatagtgttgcaatttga

SEQ ID NO: 14530 - DNA, 525 bp, Glycine max
  Peptide Sequence Number=SeqID_131308
atgttggctcctcctcgtcggagttgggtcgatgttgatggagaggtcggcattggcgtcgacggtgacccgaatttccgacgcgcgccgccgacgagggtaggggtggcgcggggaggaggggtggatttgacaggtagcgcgtggtgtgccaaagagagaatcgggagtgcgcatgaagggatgggatgggtccgatgggtagtgcatgagtgtgagttgatgattacttatgtacccattcagtgttgttgcattgcggaatttcttggatccgcaattgcaactccatctgctattgcagctgctatgggtgccgtgtcatggtcgccacatgcatccggcatcctcttgccatcttcaacgattaaattggttgatttgtctctgctttcggctgcagagattgattggcttaataactatcactcactagtctgggaaaaggtttcaccattgttggatggctctgctcgccaatggctttggaacaacactctgcctatcgtccatgagaaaatttaa

SEQ ID NO: 14531 - DNA, 831 bp, Glycine max
  Peptide Sequence Number=SeqID_131309
atgatgggcagcatgagcttaaacttaataactacccctacgattctcccgtttggaagtcgcagttttgcacagtttgcgaagaagaaggcaagagcgagttgcagtctgagagacgatgatgctcctctctccattgcttcgtcttacgccgtgcttggtctcgaccctcactgctccgccgccgatatcaaagctgcttttcgaaccaaagtgaagcagttccatccagacctcaacagagatgctaatgcaagaacattttctgatgctatgattcgccgcgtaattcaagcataccggatactatccaactgcactccatcagaattaattgaaagtgaatgcttagatccctttgacacgccagagtgtgaagcttttgatctttttgttaaccagctgctttgtgtcggcaaagggtttcaacatgtggaaggtaatgcagttctgatcgggagtataattatgggtgggcagaattataattatgcagcgtgttcaaattcctgtgtggaaagagcccctcatgctttcacatatgcctcttcaactggaacagcacgtgcatcttctcaaggtcatggggacgactaccaagttcaatgtgctgttggacaatgccctagaagttgcattcactacgtaaccccgtcacaaagaattctcttggaggagctacttgacagtacactggaagcaccctatgatacatcagctgaggcagacttgctgtattcacttataactaaagctaagtttgagaataaccgatatcaaaaaccaaagaagcaacccaaatcttcaagccaacatgtcgattggttttaa

SEQ ID NO: 14532 - DNA, 1989 bp, Glycine max
  Peptide Sequence Number=SeqID_131310
atgcaagacattttcggatcagttcgtcgatcactggtattccgcggttcgccggagaacgaagaagcctcctcgctcggagtcggaggaagcctcgtcgataagatcagttattgtatccgaagttccagagtcttctccaaaccctcgccgccgtcgcctccgccgccgtcctttcctaagaacgctgctcctccgatccgatggcggaaaggcgagttgatcggttgcggcgcctttggccaagtctatgttggaatgaatctcgattccggagagcttcttgcggttaaacaggtcttgattgcggcaagtaatgctacgaaggagaaggcacaggctcacataaaagagcttgaggaagaagttaaattactgaaagacctttcacatcccaacattgttcgatatttgggtacggtcagagaagaggacaccctaaatattctcctggagtttgttcctggtggatccatatcatcactattggggaagtttggggcattccctgaggctgtaataagaacctacacaaagcagctactacttggactcgagtacttgcacaaaaatggaatcatgcacagagacattaaggtggatttttatttcattgataataaaggatgcataaaacttgcagactttggggcatccaaacaagtcgttgagctggcaaccatttctggtgccaagtccatgaagggtactccatattggatggctccagaagttattctccagactgggcatagcttctctgctgacatatggagtgtgggttgtactgtgattgagatggccactggaaagcctccctggagtcagcaataccaacaagaggttgctgctctcttccatatagggacaactaagtctcatccgccaattcctgatcatctctcagctgcagcaaaagattttctgctaaaatgtttgcagaaggaaccaattttgaggtcatcggcatcagaactgctgcagcatccctttgttactggtgaacatatgaattctcttcctctgtcatctaatgtcacggaaaactttgaagcttcttcaccatcatgtgccccaaatgatgatgaatccttccttttccgttcaactgtaaatcctctggactcgggaaataaacagtcgtggggaatgagcaatgatgatgatatgtgtgtgattgatgacaaagaagatttctcgcagagtgatgccaaatacaaatcatttatgtcaactaataatattgagagtttcaacccaatgtctgatccctctgatgattgggggtacaaatttgatgcaagtccagaactggaaaatagaggggttagttttggcactgatgtaagttacatgccacctgatcagtcaggggatgatgataaggggcagaaagatttctcctttccaggtgtgccatctctgtcagaggaagacgatgaactcacagagtcaaaaattaaagcttttttggatgagaaggctcttgaactgaaaaaattgcagacacctttatatgaagagttttacaacagtttaaatacatcttgttctcccaatgtgattgagagcactagtgaggatactgcttgtcgaaaatatttgaaattacctcctaaaagcaggtcaccaagttgggtaccaattagcactccatctaaagccgttgataattctgaaagtcctggaagtaatggccggtcatcatcaactgttggccatgtaaataaccatagtccacaggatattccagcatctccccttaatgaatggaaaggactgacagttgactctcagcagcagcccagtagcccaagtctaagcttttctgagagacagaggaagtggaaagaagagctcgaccaggagcttgagagaaagcgagaaatgatgcggcaagctggcatgggcggaaagacatcttcaccaaaggatcgagctttaaatcgacagagggagaggacaagatttgcttctcccagcaaatag

SEQ ID NO: 14533 - DNA, 3402 bp, Glycine max
  Peptide Sequence Number=SeqID_131311
atgtcagattcacagtccaattcagagatttttagcattcggattgtcaccatcgactattacatggcaccgcccatccccgacgctgatatctgttatagcagcttccacggtggaaaggtgaatgaagtgcctgtgataagagtgtatggtcctactcctgctggccagaagacttgcttgcacattcatcgagctttaccctatttgtatgtgccgtgttcagatataccacttcaactggactcaggtgatgcattcacctataaggtagctgcttctcttgagaaagccttaaagtttctcatattaaagatgtggcatcaaatttggttgcaacttctacagcttaaaggcaatgctggttcaagtagacaacatgctggtgctgttcttgataaaagtttacagccttatgaatcacatattccctttattcttcagtttctggttgattacaacttgtatggcatgggtcatttgcacctatcaaagatgaagttccgctaccccattcctgacacttgcaagaaattaaataccgatgatcagcatagaaaggcagattcagatgctcatgcatgtttagagtcaaaattgtggatgtcttccacgatctcatctgagtggatgtggtcacccccaagcaaatccggtgctttgtcaaatgatgaggctcactgtcctaaacgtcaaagtatctgtgagcttgaaggagatacttctgtggatgagatacttaatcagcaatttaaaatgtattcatctctctcacaaacatgctcagatgtcaacatggttcagtcacttgtaccaatatgggaggagcaacagaaacggaatggggttcatgaggctaccatgccttctgatcctggcaaaccactaccagaagatgttatgaaacttctctctgttggtcttgactttgagaaaaaatttattgaattgtgcagtgaagctgaaacctctttattttgtactttttctgcgaaggaattgagagaaacagacataataggctcggcatcaccaccagcttcattatgcaaaaatgccaaattgcatgaggaagggactgatgcaaatcttgaaatgttgactatggatgaaatcccttcatctgaaatgattggaacattggacataaaggcagctgctgataaggaagcacaaaatattcttaagtggcttgcaacttctcaagctgcagaggatataaactctgacgatgaacttgtttatgaaacaatcttgactcccttgttacctgctgcaacaattgataaggtgctggaggaagctaatattgcttatgagaatgagtcccaaaaggagtgtcaggatattctagattcaattgatgatatgcttgagttggagttaccaaatgaaaaaccctctcattccttggatcactattgtcctattggagcttcatcaagcagtatgttacctcaagttgatggttctaatgatgatgagttctcaagtccacgtgatagtttggctggaacctcttctctagtagagataaacagtgaatacacaagggcttctgagcaccatgtactgcccaatactgacacaagtacacttattaaagataaaaggaataaacaatgggggtctttgcctttttcctcaattgataaagctaataatgatggagagcatgctactttacttgtgactcatccatttgaaagtgagactggagattctgctcactcaaattacttaaacagaaatgaggttagaaatggtgcttgttttataaggaacaagggcagagatgcttcagattccaaagaagtacacaaattggttaactgctctttgcgggacttgatgaggcgaaagcgatcctatcgagttgaacaagctgactgtgagtctggaactactaaaaagcttcttttagacaggcatgaggaacaaaatgcatgcctttggcaaaaacagctggatttaaaaacaatgcaaactgatgaagaagaaatggaacaccagaagaattgtgaatgtgaagttagcaatcatgctaatttagtgcatgggaaaatgccccttccagctggcagtgactgtcttttacaagctactagccggccaaaagatgaatattttggtcaacatgaaatagaaggtttggaagcaagttcagtgttgaggaactgtacaaatggagagtctgctttaatgcatgggggaccaggcctccaaaagcctgaaaaattatacttaatcaattccatagacccatctatggtttgtaggggtgaaaaccttaaggttggcacaacttttacaaaacctgtagcttctgatgcctgtacccaaaatcccctcttggacacacggtcgagaacagcttctgttcatacagtcagagcttctgagaggactccacaaactgatacttctgcttcaagtagtgtgcagagctccttcattgatgataaagtgtctgacaaattcatggatcaaagttctcatggaagcagatcttttgtgcaacatgatcagatgacgttttgtgagaattctgtggagaaaaatgctgcaagtgatgtgcaagtattgttaagtgaaaaagtggatactcaaaagctgggtgaaaatttgttgcatgagactattaaattaactgaaataaccacaggcaagaaccccctggctgataagactcttgaaggtactttgaccttgccaacaacctctaatacccattttcatttggatgaggacagctctgatgaaatgccaggggatgttctggatgactttcttccgatatctgcaagggattctcagaaagggatggagacttgcaatgagtatgttacagttaaaacccttacatctaatggtacaaagagtgtctcgacccactatcaaaatgatggttctcacctatacctattaactcctaatattttgcctccttctgtgggtactgtgcatagatggttactttgtaacaagagagggaacattcctgatcatacacatcaagaaacagatgcagaggacaaggatgttccaaaatgtgcttctgagactgaacctcctcttaggcctaagctgtatcaagattctgatacagaaaataagcctccatgcaatggagaaggacaaacagaaagagtgaaagcatgcctagatgactcacaagatatttctcagatatcagaccctgatagaaaatcaagttttacccctctaagtcaaattggatttcgagaccctgcaagtgttggctgtggacagcaattgacattacttagtatagagtcttgtttctcacataggtctaatttgactgcaactggtagattcttgcagaatgtagaggagaccttttacccgatcctcaatttgatgccatcaacattgtag

SEQ ID NO: 14534 - DNA, 1416 bp, Glycine max
  Peptide Sequence Number=SeqID_131312
atggctatcatcacagaagaacccgaaccagagcaaccaacacactcacgctcacagatctcacccaccaaacccaacaacaaccccttctccttctggttctacttcaccctctccgtctccctcttcactctcttcttcgtcttcacctcctccaccctctccccccaagactccaaaacctggttcctcacccttccctcccccctccgccaccactactccaacggccgcaccatcaaggtccaaacacaccccgacgaaacccccctccaagtcttcaccctccaagagggtcccacatcgtccgaaaacatactcattgtccacggccaaggtctcagctcttactcctaccgccacctcgccaaatccctcgccgccaatggcctccacgtcacctccctcgacctccccggacacggcttctccgacaactccgtcgaagtctccgtcgagggcggcgccaacggggtttttgggaggttttggtacgtctacagtgagattcaagagaggggtcttttctgggcgtttgatcagatggtcgaaacaggtcaaattccctacgaggaaattcaagctcgcatgtcgaagaggaaaataagaaagcctattgatttgggtccgcaagagatggggaaagtgttgggtgaagttattgattccatggggcttgcacctgttcatttgattcttcacgattcggcattggggttgagtgctgattttgtttctgagagggctgagttggtgagaagcgtgacgcttatcgatacggcgtcgtctactaagggggcttttcccgtttgggctctggaggtgcctgtggtgagggaggttgtggtgggggtttcttttgtgtttgctaaggtggtggggttgtgctgttccaagagggttggtgtggcggattcggaggggtcgagggcgctgttgaagggcagggatgggaggagggcggttgtgaatgttgggaagagggtgaattctagctttgacttggcagagtggggtgaggggctgaaaggtgtgccaatgcaggtggtgtggtctgctgggtggtccgaagaatggagccgggagggtcaccgggttgcaagtgcccttccacaggccggttttcttacgcattctggaggccggtgggctcaggaggacgcagccgttgagatagctgaaaaaatttctcagtttgtattgtcattaccaaagtctattaggaaagttgaacaggagtccaccccagagcacgtacagaagatgcttgatgaagcaaaaagcagtggtcatgatcatcatcaccatcaaagtcctgatcatggtcatggacatgatcactatggtgatgctcacatccatggagctaattatatggacgcatatgggcttggtcatggacatcatggttggtga

SEQ ID NO: 14535 - DNA, 1014 bp, Glycine max
  Peptide Sequence Number=SeqID_131313
atggttactagaagcccaccaaagcaaaacaaaatgttagctgttctcaatcctgctctaatcagagaaacactcaacaaggtggatcagtgcatggttcgactacaggaacttcagtacacggtggccggtggaaagaaggtggtgtcaggggtaagtctcagccctcgcagcaccaaaggttatctccgaaccagtctaaggtgcaagcaagaatctgtcaggatcaagcatgatgcaccaagaagatttaccccggggaagtttcctaagccaactaattcaggtgaagaatggaggcaaatgtcattgccagcaatgcttgttggcgaaactgttggagaaatttataaggcaagtcaatttgccagagaaatagtttcagcagttagtaggaaaactgccaccaaggaaccaaaaactccactgtcccaacggtcaaaccagaaagttgaccttgaaaacacacaactcaatgctagaagaaggaaagagaagcaaattaaaccagtctctgataccccaccacctcaacgggctcgttcaaggatcaactttaagatttctcctccaaaagcctttgacaaaaagaatgataacaagtgtttgccaaatagggcatgtgctagcaatagaactaacaagaaaaagaatgataacaagtgtttgccaaatagggcatgtgctagcaatagaactaacaagacaatgctagtccccaaacctttattcttgtctacacattcttcaaggcaacaacagttttgccagacaaaatctcctgtcatatcaagaaacataggaacacaacaaaagtgtttgatcaagtccccaccaccttcagcagcttccaaagttcaagtcaaagtaaaaaacccatcaattatgtttatttcttcttcacccacaagacctacaactacaagtttgagttttttgagtttcagcaagaagaattctcctcaaacaaagagatgggttcgaacttcctctccttctagaatagcaacatga

SEQ ID NO: 14536 - DNA, 2016 bp, Glycine max
  Peptide Sequence Number=SeqID_131314
atggatcagcactatctgttgtcaattttgagtcaacttctgatgggcttcaagtcatttgctctgattcttcaaaaaagcactttaaatttgattatgtattcagacctgaagataaccaaggtacatgagaaattagaacttttggatgagactgttttcgaacaaacaatacctatcgtcacatctgtattagatgggtataatgtttgcatttttgcatatggtcaaactggaaccggcaagacctttactatggaaggaacaccacagcataggggagttaactatagaaccctggaggaattatttcgaatatctgaagagagaaatgacgtaataaaatatgaattgtttgttagcatgttggaggtttacaatgagaagataagagatcttttggtggaaaattcagttgaacctactaagaagttggagataaagcaagctgcagatggaacccaagaagtcccaggactcgttgaagcttgtgtttatggaacagatgacgtgtgggaaaagctgaagtctggtaaccgagccagatctgttggatccactagtgctaatgagcttagcagtcgttctcattgtttgttgcgagtgactgttttaggggagaatttaatcaatggccagaaaacaaggagtcacctttggctagtagatttagctggcagtgagcgtgtggtgaaaactgaagctgaaggagaaagactgaaggaatctcaattcataaacaagtctctatcagcacttggtgatgttatttctgcccttgcatccaaatcagcccacataccttacaggaactcaaagctcacccatatactccagagctctttaggaggtgattgcaaaactttaatgtttgtccagataagtccaagtgcagcagacttaacagagacactttgttctctgaattttgccgcacgtgtacgaggaattgagagtggcccagcccgcaagcaaacagaccttactgaactgaataagtacaagcaaatggtagaaaaggtcaaacatgatgagaaggaaactagaaaattacaagataacttgcagtcattgcaaatgagacttacttcaagagaactcatgtgccgaaatcttcaagaaaaggttcgggatcttgagaaccaggtgacaggggagagaaaaatgagactgaaacacgaaaatatattgcttgcagcagtttcagctcaaccttcaacaatgtgggagtcaatagcttctgatcagaaaatcatgaagaagccaccgctcgatccaagactgccacttagaagaattactaacattttgcctccaccaccagagagaaggccctcatacagctcttctatggatgaacaggaaaacgttgctagaacaacttcaattaacgcacaagaccttgtgaaaccaagaaggggggtatccatagcggtaagacccccacccccaccatcaacatcacagtcccttcagccaagaaggaggcgtgtttccgtagctacactgtgtcctgtcagaactccactctgttcccccactcggcaatcactgataaggccctcatgcagctcttccatggatggacaggaaagcgttgccaaaacaacctcaattaacacgcaagaccttatgaaaccaagaagaaggggggtatccatagctgtaagacccccacccccaccatcaacatcacaagcccgtcagcctagaaggaggcgtgtttctgtagctgctctgtgtcctgtcagaactccactccgtttccccactcagcaatcaccgaaaaggaaccaaagggaagctcagtattcaaggttgtttgccatattgccagaagctagaacctcagttgagacagcatcaccaactttgatgaggagcagcagtaagtttgctggcagcccgaggcatccaagacgcaaacctttagtgtggactcctctcaagcagaaggggggcttgaaaattagcagcagaaagtcattggttataccatctcggcccttctactga

SEQ ID NO: 14537 - DNA, 141 bp, Glycine max
  Peptide Sequence Number=SeqID_131315
atggagggtataatgagagaatccatccatgaaggaagatgggcattgaatttccatctggatttcatccatgaaaggggaaacaaagaggctgatgaggcgtcatacatcgaccagataatcatcttcttttgcacataa

SEQ ID NO: 14538 - DNA, 3614 bp, Glycine max
  Peptide Sequence Number=SeqID_131316
gtatggcaagagttttggattactggggatgttgatggacgtggtgtcccagtgtccaatccaaatggtccactggaccatgaccttttcttgttttctgcaagagacacagttaagcttctaagaaatcatcctagtcttgccctatgggttgggggaaatgaacaagttccacccgatgatataaatgctgctcttaaaaatgatctgaggcttcatccttattttgaaagtgaggatgaaaatagcaaacctgtaggagactggttcccaatgtcaacagatttcagtcagtatcttgatggcacacgcatttacatacaaggttcaatgtgggatgggtttgctgatgggaaggggaacttcactgatggtccttacgaaattcaaaatcctgaagatttcttcaaggatcacttttataattatggattcaatccagaggttggttctgttggaatgcctgttgcagctaccataagagcaacaatgccctcagaaggatggcagataccagtgtttaagaagcttccaaacagttatgttgaagaagttccaaatcccatatgggaataccataaatatattccttattcaaaaccaaccaaggttcatgatcagattcaactttatggtgatgctaaagaccttgatgatttttgtttgaaggctcaacttgtgaactacatacaatatagagctcttctggagggatggacttctcgcatgtggagtaaatatacaggtgtattgatatggaagacacaaaatccttggactggtctgagaggtcaattttatgatcatctacttgatcaaacggcaggtttctatggttgtcggtgtgctgcagaaccagttcatgtacagcttaatctggctacatatttgatagaggttgttaatactacatcagaagaattgtctaatgtcgctattgaagcttcagtgtgggatcttgacgggacatgcccatactacagagttcatgaaaatttctctttgctgccaaaaaaagtagcacctattgttaagatgaagtatccagagtcaaaagatccaaagcaagtctactttcttcttctcaaactctataacatggcagataatagagttatatccagaaacttttattggttgcatctttctggtggagattacaagttattggagccatatagggagaagaaaatacctctcaagataacatcgaaggtttcagttgaagaatccatttataatattcaagtgcttgtgaccaacacatctacaagatcagactctacaagttcaacaggtaggttaagtgatggtttttatggcacacactcattggaaactctggattgtggggttggaatagaacaagaaactggtgggtccaagaggatacataaatgtttttctgggaaaagtgatggtttgaaagttactgaaataaatggacctgatgtaggcgttgctttctttcttcatttttctgttcatacttcaaagagggactacgaggaagggaaggacacaagaattcttccggttcattactctgataactatttttcactagtcccaggagagaccttgcctataaatatatcttttgacgttcctcagggtgtcactcctcgagttatcctgcatggctggaattatgatggagcctctttgtttcccctttcatggatgaaatccagatggaaattcaatgcccatcttccttcatggatggattctctcattataccctccatcatgaagaagccaccaacttctcaaaacccatttcctgcaacctcaaaatctgtcctcaaccacgcagacttgagctctcttctctctgtttgtggcagagatggaaaccttaatcttggttcttccatccatgcccgtatcatcaagcaacctccatctttcgattttgatagctccccacgcgatgccctttttgtttggaactctctcctctccatgtattccaaatgtggcaaactgcaggatgccatcaagctgtttgatcatatgcctgtgaaagatactgtgtcatggaatgcaattatttctgggtttttaaggaacagggattgtgacacgggttttaggttctttaggcaaatgagtgagtcaaggacagtgtgttgtctatttgacaaggctacactgactacaatgttgtcggcttgtgatggactggagttctctagtgtgaccaaaatgatccattgtttggtgtttgttggtggttttgagagggaaattacagtggggaatgcacttattacatcatattttaaatgtgggtgctttagtcaaggtaggcaggtttttgatgagatgcttgagaggaatgttgtaacttggacggcagtgatttcaggccttgcacaaaatgaattttatgaggatggtttgagattgtttgatcaaatgcgtcgcgggtcagtgagtcctaattctttgacatatttgagtgcactcatggcttgttcaggtttacaagcattattggaaggacgtaaaattcatggactgctatggaaattgggaatgcagtcagatttatgcattgaaagtgctttgatggatttgtattcaaagtgtggaagtttagaagaagcatgggagatttttgagtctgctgaggaacttgatgatgtttccttaactgttatacttgtagcttttatgcagaatggactcgaggaggaagctatccagatatttatgagaatggtaaaattggggattgaagttgaccccaacatggtttctgccattcttggggtatttggtgttggtacttctttgactcttggcaagcagattcactctttaattataaagaagaacttcattcagaatctgtttgttagtaatggacttataaacatgtactccaagtgtggagatttgtatgactcactgcaagtctttcatgagatgactcaaaagaattcagtgtcatggaactctgtgattgcagcttacgctcgctatggggatggtttcagagcgcttcaattttatgatgatatgagagtggagggtatagctctgacggatgtaacatttttgtcattgcttcatgcttgcagtcacgcaggcttagttgagaagggcatggagtttttggaatctatgactagagatcacggattaagtccgcgttctgaacattatgcctgtgttgttgacatgttggggagggctggacttcttaaggaagctaaaaaatttattgagggattgcctgagaatcctggtgtactggtttggcaagcattgcttggtgcttgtagcatacatggtgattctgagatgggtaaatatgctgcaaatcaactgtttttggctacaccagacagcccggctccttacgttttgatggcgaacatatattctagtgaagggaaatggaaggagagagcacgttccattaagaaaatgaaagagatgggggtagcaaaagaagtgggtataagctgggttgagattgaaaagaaagtcaatagtttcgtagtaggggacaaaatgcatcctcaagctgatgctatattctggcttttgtccaggttattgaaacacttgaaagatgaaggctatgttcctgacaaaag

SEQ ID NO: 14539 - DNA, 387 bp, Glycine max
  Peptide Sequence Number=SeqID_131317
atgcttgaggttaacccgaagccaagaccaagaccaagacccgtttggtttgatgtcatagcaaaaggtatcatcaataacaaaaacaaaattacggtaggcctcgttaatatcgatgctagagtggatggtaacatattaaaacaattagatgcacttcactcccaagtagagactatatctatagattttgatcatgttgataagaatttcaaatgggaggatatttttcccgaaaggattgatgaaaacgggaaatggggtctacccaagtgcccaaatttgccaatgccggcgttgcagaattatggggatctcaatgttgtgatggcaaaagttccatgtgggattagggatgtgtttggctggtggctaatttggctgtag

SEQ ID NO: 14540 - DNA, 1353 bp, Glycine max
  Peptide Sequence Number=SeqID_131318
atggcggagcaactccgcaagacgacgctggattccgggtgggtcgcggcgaggtccacagaggtccaattcaccggaacccagctcaccactactcactctccaactggccccacttctccatggatggaagctctcgttcctggaactgttctggcgaccttggtgaagaacaaagccgtgcccgatcctttctatggactgcaaaatgaacacatcattgacattgctgattctggaagagactattacaccttctggttctttacaacctttaattgcaagctttcaaatataagtgtgcctgatatagctgcaattgcggtggcagagtccaaaaactttgatattgcggcttcaatcacgattatgaacctctttttaaagccttgccaggatctaaataataatctgcttttgaataaacgatggtgcaatgagcattgtgatcttaactttcgtggaatcaattactctgctgatgtgtatttgaatggccacgaaatcatcctaccaaaagggatgtttcgaaggcactcccttgatgtcaccaatattcttcatccggatggcaccaacctgcttgctgttcttgttcatcctccggatcatccagggagaattcctcccgaggggggacaaggcggtgatcatgagataggaaaggatgtgactacacagtatgttgaaggttgggattggatggctcctataagggataggaatactggaatatgggatgaggtttctatttctgttactgggacaatggtgcttccagctgttccttggtgggatgacgcatatctacatacaacaactgagttggaaaacaggagctccttgactgctgagtgttctttgagtgtcctagtgacaacagaacttgaggatagcatttgcttagtagagcatcatcttcaaactcaagatctcacaatcccggcaaactcacgggtgcaatatacatttcctgagcttttcttctccaatcccaatttatggtggccaaatgggatgggaaagcaatctttgtacaatgttgttattagcattgatgttaaaggatttggtgaatctgattcatggagccatcactttggattccgcaaaattgagagccatattgatgatgctaccggtggaaggttatttaaagtcaatggagaaccaatttttattcgaggaggtaactggatattgtcagatggactactgcggctctcaaagaagcggtataatacagatatcaaattccatgcagatatgaattttaacatgattcgatgctggggtggtgggctggctgaaagaccagagttttatcattactgtgattgttatggccttctg

SEQ ID NO: 14541 - DNA, 216 bp, Glycine max
  Peptide Sequence Number=SeqID_131319
atgatgtccggaaaatatacgtcgattgacgcgcagcagcttcagggatctgttcctgccgttccagattcacgacccgccaccgtcaatttcgcagattcaaatcttcagacttttcctccttctggagctcagggcaagatcaccgctgcttccgggcctcctcgtgacgctgatggtctgtgtctatatccctggattttattttatttttaa

SEQ ID NO: 14542 - DNA, 972 bp, Glycine max
  Peptide Sequence Number=SeqID_131320
atggctgaagaaatgaaaatggtagaacctggaagaggtaagaggaagtttttcaaaacgcaaggccataaaaagtcaagtaagaaagcaaaagtgatgccaccacaacatggacaaaagaaagttaaaatagacaaaaaaatgaagaaacttttccgcaagcgagcacgggagtataattctgatgatgaagaagatgatgaggccactgtccctgctaccttagagcctaaaagtctggcatctatcaccaataaaagaaatgacaaggatggcatagaaagtgaggataggtctgaggatgaaggagctgctggaccacaaaaaacatggaataagaatgctactgatatgaattatcatagctctgatgatgaaggggaagatgatgatgaaattcagccaggaattacaaaattcacggaaggatgtagagcattcaagatggcctttaggaatcttatgaagaagagtgttcctgacgacatgttgggtccaatattgtcagggcaaaggaaacttgttgtagataaacttgcagaagaggaagcagaacgcaaggtcaagggagaggccaaaaaggaaaagcagatgttggcagaaaaggggcatgtcaaacctgctacttacttggattcacatgaaaagtttttaataagtgttgctacaaaaggagtggtcaagctgttcaatgctgtcaataaggcacaaactgctcagagggggctggacccctcaaggactaaagatgcaaaagagttagggaaaccatcattgcctgcaattggcaccactacaaaggccaaggaaagcactgatcgggtagaagatgaacaacctgcttgggctccattacgagataactatatgctgacaagttcaaaactaaaggattgggacaaaatgcctgataaaaatgtatcagatgacatgggaaaaacttctgaagatagtagttcagatgaagattag

SEQ ID NO: 14543 - DNA, 207 bp, Glycine max
  Peptide Sequence Number=SeqID_131321
atgccaaaagagttgcaagcttattgtgaactcacggagaagatgaatgaaaggattgtgaagtggagaaggatagcaaggaatgctagtttgtctgatgggcattggaagattaagattaaatattcaaatataatattgcaagctgttgccatgacttactcttatggatcagacaccaccataccaccatctaaaaatagttag

SEQ ID NO: 14544 - DNA, 866 bp, Glycine max
  Peptide Sequence Number=SeqID_131322
agaacagccgccagttgctgcgtcatgccttcgaccttggtattacccacttcgacctggcgaacaattacggcccaccgccgggatcggcggagagcaacttcgggcggatcctcaaagaagattttctgccctaccgcgacgaactcatcatctccagtaaagcgggctataccatgtgggacggcccttatggcgactggggatcgcgcaagtatctggtcgccagcctcaaccagagcctgaagcggatgggccttgagtacgtcgatatcttttatcaccaccgcccggatccggagacaccgctggaggagaccatgcgggcgctggatcatctggttcgccaggggaaagcgctctacgttggtttatcaaactacccgcttgagcaggcgcgtcaggctatcgctatcctcaacgatctcggcacgccttgcctgattcaccaacccaaatattcgatgtttgaacgttgggtagaagaagaattattagcgatgctgcaggccgaaggcgtgggaagtatagcgttttcaccgctggccggcgggcaattaaccaaccgctatctaaacggtattccaccagactcgcgcgcagccagcaatagccgttttttactgccggaacagctcaccgacgagcggctggaaaaagtccgccaacttgacgccattgccgggcgccgtggacagaagctctcacagatggcgttagcctgggtgctgcgagaagataaggtgacgtcagtgctgatcggcgccagtaaaacggcacaactggatgatgccgtaggcatgttaagcaatcgccagttcagcgctgaagagtgcgccgctattgacgcgatccttgcggtgtaa

SEQ ID NO: 14545 - DNA, 771 bp, Glycine max
  Peptide Sequence Number=SeqID_131323
atggcctccggtgaaaaccagtttccccctcagaagcaatacacacagcctggcaaagagtatctcatgaatccaccacctcaatacagcagccccgattacaacccatcaaatcaacttcaaggaaagatagctgtagtaaccgggggtgattctggaattggacgagccgtgtgcaacttgttttcattagaaggtgctactgtgatcttcacctacgtgaaggggcaagaggacagggacgcgagtgacacgcttgagattataaaaaaggctaagactgaagatgccaaagatccattggctatacctgttgatttgggttatgaggagaattgcaagagagtggtggacgaggtcatcaatgcttatggacgcattgacattctggtcaacaatgcagccgtgcagtacgagagagattcactggaagagattgatgatgcaacactcgaaagggtatgcagtgaagcacgtgaaggaaggaagcagcattataaacacgacatcggtgaacgcatacatgggcttgtgagcaagggaataagagtgaacggggttgcgcctggacccatatggactccgttacaaattgctagtttgagggtggaagaaatagttggattgggttcggatacgacggcaatgaagagagctggtcagcctattgaagttgctccgtcctatgtgtttcttgccagcaacttatgctcctcttacattactggccaagtcctccaccccaacggtggaatcattgtgaacacttga

SEQ ID NO: 14546 - DNA, 555 bp, Glycine max
  Peptide Sequence Number=SeqID_131324
atggccaatgtcacagagtgtagcaagaagagtactccaagaatgagtaatccgtggccattgagaatcaagcttacaaacgatcgtatgctctgggatagcatcaagatctcatccaaggagtttgaagaattcattctaggacagatgaatgaaagtagccgcaaatctttggagtcctggattccggtaaacattctgatttatgatgttgataactgtgaaacttatgatgctaagttgttcaagaaagagtcattttggtttgatcctatgcctgttttgggtgaaaagccaaagaagggtgaatccatgaaggagtcatcctcttacagtttggagaaggcaaggaaagagtttgcttattcaattgagccttttagacaaatcataaggaaaagaggtctgaaatatgatcaagaaattggacttcgctattgtggtggccaagtggttgtagcattcgagttttcggggagtgtggcgaggaagctaaaatcaaagatctcatggaaagagttgaagaggggtgttggagggaggcacaatctttga

SEQ ID NO: 14547 - DNA, 1644 bp, Glycine max
  Peptide Sequence Number=SeqID_131325
atgagggaattgaaaaaattgcatgggctaatagttacaaccccaactattaaaagcataatccccttgagcaagcttattgacttctgtgtagattcagaatttggtgacatcaattatgcagacttagtacttcgccagattcataaccctagcgtttacatttggaactccatgatacgaggttttgttaacagtcacaatccaagaatgtccatgcttctgtatagacaaatgatagaaaatgggtattccccagatcattttactttcccatttgtactcaaagcatgttgtgtaatagctgatcaagattgtgggaaatgcattcatagctgcatagtgaaatctgggtttgaagctgatgcctatactgctactgggttacttcatatgtatgtgtcatgtgcagatatgaagtcaggactcaaagtgtttgataatattcccaagtggaatgtggttgcttggacgtgtttgattgctgggtatgtgaagaataatcagccatatgaagctttgaaggtgtttgaagacatgagccattggaatgtagagcccaatgaaatcaccatggtgaatgctttgattgcctgcgctcatagtagagacattgatactggacgatgggttcaccagcgcattcgtaaggctggctatgatcccttcatgtccacatcaaatagtaacatcattcttgcaactgcaattcttgaaatgtatgccaaatgtggcagattgaagatagcaagagacttgttcaacaaaatgcctcagagaaacattgtttcttggaacagtatgattaatgcctacaatcaatatgagaggcatcaggaggcgctagatctcttttttgatatgtggactagtggcgtttatcctgataaggctacctttctgagtgtgttgagtgtttgtgcccatcagtgtgctctggcattgggacaaactgtccatgcttatctgttgaaaaccggcattgcgacagatatttcccttgcaactgctcttcttgacatgtatgccaagactggtgagttaggaaatgcacagaagatttttagcagtttgcaaaagaaggatgtcgtgatgtggactagcatgatcaatggtttagccatgcatggtcatggaaatgaagcattgagtatgtttcaaaccatgcaagaggatagctctctagtccctgatcatattacctacattggagttttattcgcttgtagtcatgttggactggttgaagaggctaaaaagcattttaggctaatgacagagatgtacggtatggtgccaggaagagagcattatggttgcatggttgatcttttgagtagggcgggtcatttcagagaagcagaaagattaatggagacaatgactgtacaaccaaatattgccatatggggtgctcttttaaatggctgccagattcatgaaaacgtttgtgttgctaatcaagtgaaagtacgactaaaagaactggaaccttgtcaaagtggagtccacattcttctatctaatatatatgcaaaggctggcaggtgggaagaggtaaacgtgactagaaaagttatgaagcataagaggattacaaagacaattggtcatagttcagttgaaatgaagctgttaagctaa

SEQ ID NO: 14548 - DNA, 831 bp, Glycine max
  Peptide Sequence Number=SeqID_131326
atggctaattcatctgaaaacaacttcccccctcagaagcaagacactcagcctggcaaagagtacctcatgaatccaccaccccaatacaacagctcccaatacaagccatcaaataaacttcagggaaagatagctgtagtaaccgggggtgattctggaattggacgagccgtgtgcaacttgttttcattagaaggtgctactgtgatcttcacctacgtgaaggggcaagaggacagggacgcgagtgacacgctggagattataaaaaaagctaagactgaagatgctaaagatccattggctatacctgttgacgtgggttatgaagagaattgcaagaaagtggtggacgaggttatcaacgcttatggccgcattgacattctggtcaacaatgcagctgagcagtacgagagtgattccctggaagatattgatgatgcaagactcgagaggcacatgaaggaaggaagtagcattatcaacacaacatcagtgaatgcatatcagggagacggaacactagtggattatacttccacgaagggtgcgattgtggggtttacacgagccctagcgcttcagcttgtgagcaagggaataagagtgaacggggttgcacctggacccatctggactccgttaatagtagcaacaatgaacgaggaaacaattgttcgatttggttcggatgtgccaatgaagagagctggccaacctattgaagttgctccctcttatgtctttcttgctagcaacatatgctcctcttacattactggccaagtcctccaccccaatggtggaatcattgtgaatgcttga

SEQ ID NO: 14549 - DNA, 1215 bp, Glycine max
  Peptide Sequence Number=SeqID_131327
atggaggttaaatccagagctcccgggaaaattatcctaaccggcgaacatgctgtggttcatggatccaccgctgttgcttcttctattgacttgtatacctacgtttctctccacttctccactccttccgacaacgaggattcgttgaaactgaagctgcaggagacggcgttggagttctcgtggccaatcacgagaataagagcagcgtttcctgaatccacggctcagctatcttccacgccgaactcatgctctgtggagaatgccaaggcaattgccgcactcgttgaagagcttaacattccagaggccaaactcggactcgcctctggagtttccgcctttctctggttatactcttccattcaaggatttaagcctgctactgttgttgtcacttctgaacttcctctgggctcaggattgggttcatccgcctcgttttgtgttgcgctggcggccgccttgttggcttatactgattctgtctctctggatttgaaacatcaaggatggctctcctttggggagaaggatcttgagttggtaaataaatgggcttttgaaggggagaagatcattcatggaaagccctctggaattgacaacacagtaagcgcatatggtaacattatcagcttcaagtcgggtaacttgacacatatgaagtcaagtgtgccgcttaaaatgctcattactaacaccaaagtagggaggaacacaaaagcattggtggctggtgttggagagaggatgctaaggcatccagatataatggcttttgtgtttagtgctgttgattctattagcaatgaattgacttccattctcaagtcacctacaccagatgagctctcggtaactgagaaagaagagaagatagaagaactaatggaaatgaatcaaggtatgctccagtctatgggggtcagtcatgccacaatagaaactgttcttcgaacaacattgaagtataagttagcctccaaattgacaggagctggtggtgggggctgtgttctgacactgcttccaacatcacattttagaaacttcaagcattttccctctccttcaaatcctctaaatattggaggtgagacaaaaatattagggaaggggtttttacttccttatttcccctccaacaaaacactatgccaaaagggttgtcctgaaagttctgatatttatgtgctacctggttaa

SEQ ID NO: 14550 - DNA, 672 bp, Glycine max
  Peptide Sequence Number=SeqID_131328
atggttatgggagatttcatcagcagactctccttccccgaaaacaccgagacttttcccagtctcacaagttatccagaactacgtaggtctgaattcctcatgggaggatacgtaggagcaagagcctcgcttttgtcgaccacaccgaattttgttgccatgactcaagagctggtagcacgcggagataccttacggttattcgcacctttttgtcatccagaggcggcgggcccgatgacaagcagagaccaagtttggtcattctgcacccatgatacgcggagatactttacggttagccgcacccttttgtcatccagaggcggcgggcccgatgacaagcagagaccaaagaccaagtttggtcattctgcacccatgatacgcggagataccttacggttatccgcacccttttgtcatccagaggcggcgggcccgatgacaagcagagaccaagtttggtcattctgcacccatgatacgcggagataccttacggttatccgcacccttttgtcatccagaggcggcgggcccgatgacaagcagagaccaaagaccaagtttggtcattctgcacccatgatacgcggagataccttatggttattcgcacccttttgtcatccagaggcggcgggcccgatgacaagcagagaccaa

SEQ ID NO: 14551 - DNA, 1539 bp, Glycine max
  Peptide Sequence Number=SeqID_131329
atggcagtggcatcctccttcatcatcatcatcatcgtcatcatcgctctcatcttcttctccctaaaccctcctccttcaccatcacgtaggtcacttctcctcaccacttcatcgtcttgctccaacgaatccaatggccttctcaactaccactgcatcttcccccaaacttcctctttctcaatcccctccctctcgctcttcctcctcctccacttctacatcctcatcaccaccgcgcagcaccacttctccctcgtcaccacaaagctcgcctcgcacctcaacctctcccccagcatggccgccgtcacgctcctctccctcggcaacggcgcccccgacgtcttttcttccctcgccgccctccgcgccggtcagtaccgcaccggcttcggcgccattctctccgccggcgccttcgtctccgccctcgtcgtcggcttcgtcgccatctacgctgctccgttttccgtcgatcccgcgcccttcgttagagacgtgctcttctacttgaccgccgcaatgttcctcttctatgtgtacctcagcgccgagattttcctctggcaggccgtcggattcgttggattttacttgttcttcgtcggatttgtgttttacatggatttggggatggcggatcgcagagagaagagttccgaggatctcgagggacagaaggaacctgattccgacgatgtcaaggtttccgaatcttccgtgggagagaaacgcgcttcttctggattgcgtggagctattcgattgatttctaaaacatgggagcttcctgtcaaaactctcctgagattgacaatccctcaaccagcaccttcacaatggagtagattttatgcatcggccaatattgcactctgtccgctagccctcttgtatgcctgcaactcattcatgccatttaatcatcccatagttttcctcctccccaactctcacgtccccctctggtcagtagtgctcatgacaagtttctctcttgcactttttcactatgtaatggaaaaagaaccccccaagacagagcatatgcctgtggtcatcgtggcatttgtgatgagtgtgttttggatatctactacagccggagagctggtgaactgcctagaagctataggtgtgcttcttgaactgccgccagcactcctgggtctcacagtgctggcgtggggaaattcagtgggagatcttgttgcagatgttgcagttgctaaagccggtcatccagctatggcaatggcgggatgctttgcaggaccaatgtttaacatgcttgttggccttggaactgctttggtcatacagacggccaatatatatcctagagcatatcagcttaatttccacgttggtatcgtgattgcatttgtattccttcttttaagccttatggggtctctcttggtgatcacttggtgcagattcagagtgcctaggttttggggcttctgtctggtaggcatctatgttgcttttacggcagtgagtttagtaatagccatgttttcagggtga

SEQ ID NO: 14552 - DNA, 2874 bp, Glycine max
  Peptide Sequence Number=SeqID_131330
atggtgaaggcctaccttcgatacgagccggcggcgtcgtttggagtgatagcgtcggtggtttccaacataacatacgacagctctggcaagcacctcctctctccggcactcgagaaggtcggcgtctggcacgtgcgccagggcctctgcaccaaaaccctaactccttcctcttcgtcgcgcggtccttctctcgccgtcaattccatcgcctcctccccttcctccctgattgctagtggttacggtgatggtagcataaggatttgggactctgataaaggaacgtgtgagactacgttgaatggacacaagggagctgtcactgctcttcgttacaacaagactggctccttgctcgcctctggtagcaaggataatgatgttattttgtgggatgtggttggcgagactggactctttcgccttcgcggtcaccgcgatcaggtaactgacgttgttttcctgagttctgggaaaaagcttgttagttcctccaaagacaagttcttgagagtgtgggatattgatacccagcattgtatgcaaattgttggtggccatcatagtgaaatatggtccctagatgttgatctggatgaaagatatctggtcactggttctgcggataatgaacttcgtttttattcaatcaagcatgagtctgcggatggggagtctgtaaatggcggtgaagaatcttccattcaaaataaatgggaagtgttgaggcattttggtgaaattcagcggcaaagtaaggatagagttgcgacggtgcagttcaacaagtcaggaagtctgctagcttgccaagttgctggaaaaacggtagaaatataccgtatattggatgatgctgaagcaaagcgcaaagcaaaacgaagggttcaccgtaagaaagagaagaaacatagtaaagaggctttggagggaatagaaaatgtagacgggaataatgagaacaaaggaaatgattcttctgtcactcacgggcccattgaaacaagtaaccccacagttactgtgcctgatgtttttaagctgttgcatactatcagagctagcaaaaagatatgctccatttctttctgtccaatcactccgaagaattcactgggtagtttagcattgtccctcaacaataatctacttgagttttactccattgaacaaggggaaaccaaaaaaacacttgctattgatcttcaagggcaccgttctgatgtaagaagtgtcacacttagttcagacaacacttttctgatgtcaacaagtcacaatgctgtaaagatttggaacccaagtactggctcttgcctaaggaccattgattctgggtatggactatgcagtttaattcttcccaccaacaagtatggacttgttggaactaaagatggaaccatagaaattattgacattggaagtggaacttgtgttgaagtaatggaagctcatggtggttctgttcgctcaattgctgccctaccgcataaaaatggttttgtcacaggaagtgcagatcatgatgtgaaattttgggagtaccaaattaagcaaaaacccggtcaagctgctaagcaactcattgtgtcaaatgtcagtaccatgaaaatgaatgatgatgctcttgttgtcgcaattagccctgatgctaaatatattgctgttgctctcttggatagtactgtgaaggttcactttgcagacacattcaaattcttcctttcattatatggccacaagctgcctgttctgtgtatggatatctcctcagatggagatttaattgtaactggctctgcagataaaaatataaaaatctggggtttggactttggtgactgtcataaatccatcttcgcgcatgctgacagtgttatggcagtgcaatttgttcccaagacacattatgtgttcagtgttggaaaagatcgcctagtaaaatattgggatgcagataaatttgagctgctgttgactctcgaaggacatcatgctgatatttggtgtcttgcagtcagtaatcgtggtgattttatcgtcactggatctcatgatcgttctattcgccgctgggatcgcactgaagagcagttcttcattgaggaagaaaaggagaaaaggttggaggaaatgtttgaggctgatattgacaatgcatttgaaaacaaatatgcattgaaggaagaaataccagaggagggagctgtggctttagctgggaaacaaacccaggaaaccctttctgcaactgacttaattattgagagactagacattgcagaagctgaagaaaagtgtattgcagaacatcaggagaaaaatagcagaaatgttgctgttttccaagcaaatccgcttatgaatgggctttcaccttctgactatgttctaagtgcattttcagatgttcactccaatgatttggagcaaacattattgaagagcatcagtgcatccggtgttagtggaatggccataggtgctttaccattttcagatgctttgaagcttctgtcgtacttgaaagactggacttcatactctgataaggttgagcttgtttgcagaataggcacgctgctgttgcagacacattacaaccagcttcttgccacgccagctgcccgacctatcttgacagttttcagtgacattttttatgaaagggtcaagggatggaaagacatctttggttttaaccttgccgccatggatcatattcagcaaatgatggcttcaagatcagatgctctttttcatgatgcaagatcaaaactgctagagatacgtgctcggcaatccaaacgcttagaagaaaggtctgatactggggaagtgaagcggaagaaaaagaagacataa

SEQ ID NO: 14553 - DNA, 643 bp, Glycine max
  Peptide Sequence Number=SeqID_131331
tcgtggcgaccaaatctccagcccaggaatctgtccgtgtccttccattgttgcaggcggagttggggaggcagcagaaacggagagtatccctgggccggaggatatggtagccacggccatggcaagagtgggaagaggagtgacccacgtgccacccgggaaaggacggagaggagcttgtgggtatgatgatgttgttaaagatggttatgggcttgacatggcagcattgagctcagttttgtttaaccacggtgacaatggaggatggtgcaaccctccacgccagcactttgatttagccaaacctgcgtatctcaaaattgcacagtataaggctggcatcgtcccagtccaatatcgcagggtaccgtgcaagaagcaaggaggtattcggttcacaatcactgggaatccttacttcaacctagtagaagtgtggaatgtgggaggagctggggacatcacaaaagtgcaggtgaagggtgacaagaagctgctcaattggacaaatttgaagcgaaattggggtgagaaatgggagactaatgccatgttagtgggagagacattgacgtttagggttaaagccagtgatggcagttttggtcaaacctttgaaggcaaaaacttcccataa

SEQ ID NO: 14554 - DNA, 1226 bp, Glycine max
  Peptide Sequence Number=SeqID_131332
ggctgcacgtcctcgccttcagaaggctgcacgtcctcgcctttagagggatgcatgtcctcaccttcagaaggttgcacgtcctcgccttcagagtactgcacgttctcaccttcagaaggctgcacgtcctcgccttcagagtactgcacgccctcgccttcagaggactacacttcctcacctttagacggctgcacatccttgccttcagagggcttcacgtcctcgcgtttagaaggctagatgtccttgccttcacagagctgtacgtcctcgccatcagagggctacacgtcctcgcctttagaggactacacatcctcgccttcagaggactgcacgtcctcgcctttagagaactgcacgtccttacctttagaggactgcacgtccttgcctttagagggatgcatgtccttcccttcagagggctacatgtcctcaccttcagagggttgtacgtcctcacctttagagggctacacgtgctcgccttcaaagggttgtacgtctttgcatttagagggctggacgccctggcctttagagaactgcatgtcctcgcctttacagggcttcatgtccttgccttcagaggactgcaggtcctcgccttcagagggctacacgtcctcaccttcagaggactgcaagatttcgcccggaccattgcagggagacaaatgcggatcatgggcaccaacacatggatgatgttgctagttagcaacattctgcccagtaagtatgcacgtggctcaactgatttccgaggtcatctactatttgctgggatcgcacccccaagacacccaatggacccggagaagtccaataggaccctggggtttccatctctgtttacgggcctctgtcggttctacagagtgcctatctcccccagcaagcgcagggtgaggcaccacaccagcctggagacggccagcagcgggcgacagacgtaccgccaccacctccatagtccacctcagctcatctacaaaggctggagcgttgcctacgacacatggccgaccgacaggcggccaaccaccggggcaggtactaggcccctctccacaaagtggtccagaaaggacacctctggggaaggctctagtgccgcccaggattttgatagtcaccaattccggagtgccgagcaccagcagcgtttgaaggctataaaaggatggtcgttcctcagggacaggcaggtctag

SEQ ID NO: 14555 - DNA, 356 bp, Glycine max
  Peptide Sequence Number=SeqID_131333
cccacaagacacccagtggaccaggaggagtccaacagggccctggggtttccagctctggttatcggcctctgtcagtcctacagagtgcccgtccccccccagcaaggtcacgccatcatcacatagggatcacgcccgcaagacacccagtgggcccgaagaagtccaacagcgtcatggggtttccaactctgattacaagcctctgtcaattctacggagtgcccatctcccctggcaaggtcatcaggccccctattaaccggactttcatcgagaagtattgtgccccaggcaggcgtagggcgaggcatcacagtagtgggcaacaggcacaccaccaccacttctag

SEQ ID NO: 14556 - DNA, 192 bp, Glycine max
  Peptide Sequence Number=SeqID_131334
atggcattcgcgcataaatttgtgaattttgcttatggaattggtttgtgcatacatggttgccatttttggatgcgtgggcagcttgtgaaagttagggccaacacttggtttgggctataccatgatgatttctttgtacctagatggtgtgaaaatgttgttcaccatgtacatgggtatatagagtag

SEQ ID NO: 14557 - DNA, 168 bp, Glycine max
  Peptide Sequence Number=SeqID_131335
atgtcacaaaactttacggattacgcaaccatcccctctttgacttctggaatgttacgggactttatggattgcgcaataatgcttcctttcaactcccgacatgtcgcgaaacttcacggattgtctaacgatgggtgccaagtacctcgaagcggtcaagctaag

SEQ ID NO: 14558 - DNA, 195 bp, Glycine max
  Peptide Sequence Number=SeqID_131336
ttgagcttagctcataagtgggctaagcgcgcatccaccactaagagtagcttcagcgtgacaaaagaatctggcagagcatcaatatcaaggtcgcgcgctaagggtgtgatccgtgcactaagcacaacagttgtcttcagccaggctcagcgcacgactggcgctaagctcaaattcacttacttgcgctaa

SEQ ID NO: 14559 - DNA, 1364 bp, Glycine max
  Peptide Sequence Number=SeqID_131337
atgctgggtcgaaccacagtcttcgccgccgaggctgccgctttcgttatggcggaagcggttttcgtcgatcaggaagaaactgacctcgacgccgagcgacgccgcccagctttcaagcaggctgcatttacgctgcagcagttggcgttcttcgttatccagccaggcctgatggcatacccagatatccagatcggaagagcagctttgcccgacggaagaggtactgcccatcgaatagacgccggccgcgatgcagttcgagttcgtcaagatagtggcgttgggtttcatcaggcgtgtagaggcaaatgccgcggggaacgttaccgtcaaggtaacccggcatcagcgggtgatgataatgtagtaatgtcggcagaagactgtaaacctgctggaaagcgggtcccatggcagcaagcgcgcgatccacgcgcagttgtatttcaacaagaaccgtcaccattcgtcatcggtgtggttgtgatgaactgctggctgacaaatggtttaaaacgtgatcaatttaacaccttgctgattgaccgtaaagaaagatgcgctacatacaagtgtagcaccgtttgccgggtcatcatgccagcatcccacattaaccgtgaaactaacatccctaaagcaacaatgttaggatggctcatggtcgacaatgacggtaacaagcatgcacattatgtgaaagagcgcctggagtcctgtcatccggggctttccgttgagctggtgccaatggtcacccgcggcgacgtgctccttgataccccgctggcgaaagtaggcggcaagggcttatttgtgaaagagttagagctcgccatgattgaggggcgcgccgatatcgccgtccattcgatgaaagatgtcccggtcgaattccctgaaggcctgggattggtcaccatctgcgaacgtgaagatccgcgcgacgcatttgtttccaatcactatgcctcaattgacgcgctgccggctggcagcatcgttggcacgtcaagtttacgtcgccagtgccagttggcggcagagcgccccgatctggtgatccgctcgctacgcggcaacgttggcacgcgattaggcaaactcgataacggcgagtatgacgctattatccttgctgccgccgggctgaagcgcctgaaactggaatcgcgtattcgccagccgctctcgcctgaacaatctctgccggctgtcggccaaggcgcggtgggtatcgaatgccgccttgacgatgaatggaccaaagcgctgttagcgccgcttaaccatacagagaccgccgtgcgcgtacgtgccgagcgggcgatgaacacccgtctcgaaggcggtgtcag

SEQ ID NO: 14560 - DNA, 2274 bp, Glycine max
  misc_feature (2010)..(2010): n is a, c, g, or t
  Peptide Sequence Number=SeqID_131338
atgcctgagcaccatacccgtcaggtaaccacagaaaagctcgaggaggccattagaaacctcaatgtcggccaagccaacctcgataacaaggtggaatccatccactccttactcgcggccaagttcgattcgctcgccgaacgcttcgccgccatggctattccccaccattccccagcgtcttcccccgtacctcctccgcatacgcccactcaccgccatcacatgaaattggacgtgccgcaatttgacggtcacgacgcactaggttggattttcaaaatttctcagttttttgattaccaagggattccggatcaggagcgcctcacggtggcagccttttatatggacgggtcggcgctgtcatggtaccaatggatggcacgcaatggtttctttccttcatggccggcgatgttgcaggccctcgaatcgcgatttgcgccgtcgtactatgacgatccacaaggggctttgttcaagctccagcaaacaggcacggtgagtgaatacctcaccgatttcgagcgcctcgcgaacaggaccatcggtcttccgccctcttgtttactgagttgcttcgtctccggtttaacaccggagctccgccgggaagtgcaagccctccgtcccctttctctccctcaagcaacgaaattagcacgcttacaggaagataaacttctcgatcgccgccgcggcgcgcgcgcacctcctttccaccccacgccgcttcctgcgaatagaacgcaacctcctacctccaaggtccccattaaacgactcacgccggaggagatggccacccgccgtgagcaggggctttgttaccagtgcgacgagaagtgggcccacggccatcgatgcaaatcgcgtctccacatcctcattgccgacgaggatccagaaccttccccacggccgatttcccccgcagtcccttccgatatcgaactggaccccaccctcaccccacacatcagcctcaacgcgatggagggcacgccaacaccgcagaccttccgtctcctggggtccctgaaacgccaccaagtggtcatactcgtggatggaggaagtacacacaacttcatccaatccagagttgccaagtttctggacctaccgtcaaccccgacaccggcgttgcaagtcatggtgggcaacggccacacccttgactgcgataacctgtcgcggcaagttccggtttggattcaggggcacgaattcaccctcgacttgcaccatttacccctttgcggggtggacctggtcttgggcgtacagtggctcaaacttctcggcccaataaccacgaattaccagacattaaccatgacattctcacacttgggccaacctatcacacttaatgctgatgcaccccccacaccttcatcagcttcagcccatcaattaaaaagactcacccagacccagagtatcgcagccctcttccttctcaccaccacatcacttcagtctccaccaccctcttcttcgtcccctgatcccataccacccgtgatcacctctgtgcttaaccgttacccccatatcttcgcggaacccactcaacttcctccaccccgaaacatccaacatcacattcatctccttccccaagcttcccccgtcaacgttaggccctatcggtatcctcattaccagaaaacagagattgaaaggcaaatttcggccatgctcgaggccaatctcatacaacccagccacagccctttttcctcccccattcttctcgtcaagaagaaagatgcttcctggaggtgctgtgtggactatcgcgctttgaatgccgtcacggtcaaggaccgttttcccatgccgacgatcgatgaacttttggacgatctggggcaggcgtcgtgtttctccaagctcgatctgcgtcaaggatttcaccaaatccgcatggctgacgaagatattcataaaacggcttttcgaactcacctgggccactacgagttccgggtcatnccgttcggcctcagtaacgcgccgtcgacgttccaatcggccatgaatgacacactcaggccttttctgagaaaatacgtcgccgtgttcttcgatgacatacttgtttacagccctgatctcgacacacacgtctcccacctagactccgttttggccacgttatcggacaaacagttccttctccggcaatccaaatgccttttcgcccaatcacaacttaactaccttggccacatctgttggaccttgtggcctcaataa

SEQ ID NO: 14561 - DNA, 531 bp, Glycine max
  Peptide Sequence Number=SeqID_131339
atggctgatctttcatctgacccattcttccatgcaggttcctcaccagattcatcttctggtgaagtgaggttgtccaatgttgcttcaagctgtttgcaggggaggagaatggcaatgaaacaattttctgaagatatgctggttcgatgcagcttttaccaagagggtagaccggtatgttcatctgagtcttttgatactccagttgtggaagttgattcagctgttcaagatgaaagtctcaaccttggtggacatagggatgcttgcaatgaaaaaattaatatttccaagatgtcagaatctacccctcttgaatcatctgtcagtgatagcagttctcttgctgtaactcctggaagtgttgtatgggcgaggacagattctcaagtgtggtggcctgctgagacaaaaagaatccatagttacaaaggccatcctctcttccagacgtccttgaagaatctcttgattttacatgcagttcacttaccacctaagttcttcagtggaaaatacacaggctga

SEQ ID NO: 14562 - DNA, 344 bp, Glycine max
  Peptide Sequence Number=SeqID_131340
atggaagaaacatctgtgctatccaaccctggcaatgatggacatgttttagtgcagttttatggaaatcttcccagtgcctggattgatccaatgacagatatttcaacttttgaggattcttttgaagacaggagcaacaacccttcagaagattttcaaaaggctttaaagcaggccttacagaggaaggcacaacttagttcttgccaaaagttgactcctgataggtctgctcactatgatctgcaagaacgttcatctggcaatccttgcacaatggatccaaggtcttccctgaaggcaactataagttggtgtgcatttggaatgctacctcaaag

SEQ ID NO: 14563 - DNA, 189 bp, Glycine max
  Peptide Sequence Number=SeqID_131341
atggagattcatatgaaagtgagctgttatacacttgggatgtcattcataagggacaaggctggaacgttgcaagcgggtgccgaccggaggtctgggcagctggtccacggtggtttaggcgctgttggtttggcagtttcccgcaacaatgagatgttgaagaagcgaaaagaagaagaaaattga

SEQ ID NO: 14564 - DNA, 779 bp, Glycine max
  Peptide Sequence Number=SeqID_131342
gtggtggtggagattgtgctccatacataggagagtgtggaggaggtggtcctctaccaccagcaggtggtggcgttggaggtgggagaagtggggatcgaccaccaggagtaggtggggctccatacattggaggaggtggaggaggtggtcctctcccaataagagaagttggcggtggaggtggtcctccattcattggaggaggtgggggaggtggaggaggggctccacttaatggaggaagaggtggcggtgggggagggggggctctagacaatggaggaggtggtggagggggaggtgtaggtggagctctatgtaatgtaggaggcggtggtggtggagcttgcctaaaaggaggtggaggtggaggtggtggagatggaggtagtgaagctttaccaaaaggagggggaggtggcggtggaggtacaggtggtggagctaaatatatatatgaattagctaagggtggtagaaggggaggcagagatggagatggaggtgggggtgctggtggaggtgaagctttatgtgatgcaaacggaggtggtgggggaggagggggtggagttctatctgttgaagctgtaggaaacatggtagtaggaggaggaggaggaggaattgatggaattccatgctttggaagaggtgatgctaatggtgttagaggaggaatggatgaaacttcataccttggaggcggcattggaggtggtggtggaggaggctgtgaaagtgccactgcagtacccactacaaaaggactatga

SEQ ID NO: 14565 - DNA, 1332 bp, Glycine max
  Peptide Sequence Number=SeqID_131343
atgaagaacaaagagaaggaagccatttactctgttattcaagggtttgttggaaagtggtggaacggttcatatctttatccagatccttgtgggtggactcctgtacagggagtttcctgtgagcaatatgatgatggcttctggtatgtaagcactgtaaactttggaccagtttttgacaactctctcgtgtgcagccatgaggctcaattccctcaacaactattcaacctcaagcacctaaaagtcctctcactgtccacttgcttccattctcctaccaaaaatcctgttaaactccctctttcaaagtgggacaagttctcacacagtttggagtctttaacacttagatcaaaccctggtcttgttggcaccatcccaccagcaattggcagcctcaagaatcttcaatcacttctacttctagaaaatgggctaagtggtgaactaccactaagtattggaaatttggtcaagttgaggcaactagtccttgcaggaaataatttggaaggtgaggttccagccaactatggaaggctttctgagcttttaatatttgatgcaagcaggaacaatctatcaggagtttttccatcaacacttggacttttggattcacttctaaagcttgattttagtaacaacatgcttgagggagagttgccaagggagctaggaaggctaaagaatcttactttacttgatataagtcataacaaacttagaggtgggttggttaggacaatcaaagaacttgtttccttaaagcatttggttctgtccaacaaccctatagggggtgatctcttgggggttaagtgggaaaatttccaaaacttagaagcattggacctttccaacataggtttggaaggaagtgtcccaaagtccatggcaaaaatgaaaaggcttaggtttctggacctcagcaacaacgacctttgtggaagtctctctagaagtttggaaaaactgccatgtcttacagctctccatgtaaatggaaacaacttgacagggagacttgagttctcagagaggttttacatgaaaatgggaatgcgttttgcagcttggaataatacaaatctctgttgcatggccaaaccaacgacgcacgaaatgccttatggagtaaaaccttgtgtgcagaagaacatcacaatatctgaaggggtttcaactgttaagatgagtgaggggaattacgaggattcctttgtagtggcctctttgggaggttcaggcttttattatggactttggtgtcttttcactgtaaatggagttctttatgttttcctgtgggatatgttattttag

SEQ ID NO: 14566 - DNA, 192 bp, Glycine max
  Peptide Sequence Number=SeqID_131344
atgcctaaggaacttaaaagagaaatcaaaagtcctaatatggtgattgaaaaaactgagagggagttgcgcccacagtggtggggtgcgcgaatgacatggcggtgtggagccttgaaggggaagggtggcacagcgcaatctgaccagatctccactgggaagggtggcactatgcagtgcgatccttga

SEQ ID NO: 14567 - DNA, 1161 bp, Glycine max
  Peptide Sequence Number=SeqID_131345
atggctgtttccacctttcaggcggcgccaccgaaacccacattgggttccagtcttcttagccgtcgtatgaaacacgttcccttctccttgtcatttttctccgctcctaagaccatctcttcttacagacccatcctacgcattcgcgccatcgacgcggcccagcccttcgactacgagtccagaatggcccaacagttccacgactcccagaagctgaagatcgccatcgtgggcttcggcaacttcgggcagttcctggcccaaaccctcgtccgccagggccacaccgtcctggcccactcccgctccgaccactccctcgcggcccaacaactcggcgtcaccttcttcccaaacccccacgatctctgcgaggaacaccccgaagtgattctcttatgctcctccatcatctccacccagcgcgtgctcctcactctccccctccagcgcttaaaacgcagcacactcttcgtcgacgtgctttccgtcaaagagttccccaaaaacctccttctccacgcgctcccctccgatttcgatgttctctgcacccaccccatgttcggcccacagagcgccccccgcgcttggaccggcctccccttcgtctacgagaaggtccgaatcggctccgacgagcaccgaatcgcccgctgcgagaaattcctcggcattttcgcgagggaggggtgcaggatggtggagatgagctgcgccgaccacgataagttcgctgccgggtcgcagttcataactcacaccgttggtagggttttggagatgcttacggtggagtcaactccgattaacacgaaaggttacgagtcgttgttgaatttggtggagaacacttccggggacagttttgatctcttctatgggttgtttatgtataataagaactcgctggagatgctggagaggttggatttcgccttcgaggacttgaggaaacagctcatggggcgtttgcatgatgttgttagagagcagttgtttgataatgctggaatgggaaaggtgcagagtttgcctgatgaatatgtccatcaactgctgctcaagaatggtcaaaatggttctgctgcacctgtgctatcactgccctccaatgatctgagtataactacctttgacgctgcggttgaatga

SEQ ID NO: 14568 - DNA, 237 bp, Glycine max
  Peptide Sequence Number=SeqID_131346
atggtccatagcaacatagctaactactttaactgtagagtccttgccatcaatcagcctcctgcgtccccactgagtccaatggtaggagtccaaggaagttcagccaacatggacttttcacagatcgacatatctagattacaagttcctgaacgccctccaccaaagattaaggaggtcaaggagaagaagatgaaaggaaagatcaacacctcaaacatctctcgaagctga

SEQ ID NO: 14569 - DNA, 928 bp, Glycine max
  Peptide Sequence Number=SeqID_131347
atccagtgatgttgttaaactctacaactacaagtcaaatgatgcaaaccagtctgatgacaaaaccaagctcaagattgcaattgttggttttggcaacttcggacagtttcttgcaaaaacttttgtgcgtcatggtcatcaagtgttggcatactctagatcagattactctcacgtggctcaagaattgggggtttcatatttcaataacattgacgatctttgtgaacaacatccagaagtgattttactttgcacttcaatcctttccacagaaaaagttcttaaatcattgcccgtgcaaagattgaagagaagtactttgtttgtggatgtactttctgtcaaggaatttcctagaaacttgtttcttcatcatttgccacataattttgatattctctgcactcatcctatgtttgggccagagagtggaaaaaatgggtggaatggtcttgcttttgtttatgataaagttagaataggaatagatgaatcaagaacatcacggtgtgatcagtttcttgacatttttgctagtgaagggtgccgaatggttgaaatgtcatgtgctgaacatgattggcatgcagctggatcacaatttatcacgcatactaccggaagatttttagaaaaactggagttggagggaacgccaattgacacaaagggctatgagactttgttgagtttggtggaaaatactgctggagatagttttgatctatactatggtttgttcttgtataatataaatgccatggagcaactagaaagatttgatctggcttttgagtctgtgaagaaggagctttttgatcgtctgcatggcttctaccgacagcaagtatttaaacatgaagaaaaactccatgatttgccagagaggcctatgttgtctaagatatctgaagataaataa

SEQ ID NO: 14570 - DNA, 294 bp, Glycine max
  Peptide Sequence Number=SeqID_131348
atgcagagcatccatgctttggctcagcatcagcccatcatgagcatggtggagtttgcttctcaggtggcttggccaggagtccagccttctttttttgggggaggtgaggcctctgcagcccaggagcctcagccagagatagaggctgatacaaatgttgatccagaggctgacctagagatcccagagactgacccaactactcaggaggacgctgcagaggctactccagagacaactccacagccatcaccagtgaccacacctgtgctggagttgtcttccccatag

SEQ ID NO: 14571 - DNA, 540 bp, Glycine max
  Peptide Sequence Number=SeqID_131349
atggcttctggaaagagaaaggccacagcctcccaccctcgggaaccctatgatacatccaaatttgtatccgaggctgcatgggagcgttatgcgcaaaacattcactcccggaacatccttctagagaggaacgtgaatctctttgtgatagagtatgatgagttctggagggagcttattaggaggaactggcatagggccctgacccaatacgagggcggtcacattgatgtggccttggtcaaggagttttatgccaacctctatgaccctgaagataaaacccctcgccaggttcgcattcgagggaggctggttaaatctgacggggagacactcaacactttcctggagacaccaccagtcatccagccgggagagcagtatacttcttactccttgttttgcaggttgcgtcccaatccacaggagtttgcagctcgattgtgcattctagggcgaggatttgtgttgaacgctgaaggagcaccctggaagctcctacggaaggatcttacaacgttggctcagacctag

SEQ ID NO: 14572 - DNA, 333 bp, Glycine max
  Peptide Sequence Number=SeqID_131350
atggagggatctataaaggatttcggagcccccgagtcatgggacgtcgctgatttggacgagtccatgaactgcttgaacctcatgctctcttccaacaacgattctaagcaacctcaccaatgtgtcgccgatgatgacgatgctatgtcgcctcctattccgcctcctttgtccaatggcgacgaggtttttgattatgtcatcaatcagctatctatcttttctttagagacactcctatttgagacactttcagacactaaggatagcttccctactccacatagtgagagacttgataatcctttcttgttgaagaaggaagtgtga

SEQ ID NO: 14573 - DNA, 798 bp, Glycine max
  Peptide Sequence Number=SeqID_131351
atgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcacctccttttcatctttccctcgcggtacttgttcgctatcggtctctcgccagtatttagccttggacggaatttaccgcccgattggggctgcattcccaaacaacccgactcgccgacagcgcctcgtggggacttgggcccggtccgccactgaggacgcttctccagactacaattcggacgccgagggcgaccgattttcatggtgggctttttcccgcgtgcgtgcacgcaaagggtcgtcgatgggtccagaactgaccggctcgcacgtgattggtctacgagcgtggctcatccaccatttttatcacggcgaagtcggccatgaacccagattttcaaccaaccacgaggcgggtgctcgcgggaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggtagatga

SEQ ID NO: 14574 - DNA, 1203 bp, Glycine max
  Peptide Sequence Number=SeqID_131352
atgccagaattggatctggactgtgaggaggaagaaggaggggaaagaactgaagaggggatagtgacctgtggggaaactagagccaaaggtgcaaaaatttatagtgctgctgtagctgctacagctgatggtcaacagacagcaaaagagggagaagaaaagggagaagtggaaatgatatacgatgtgattaggtacagactacatcgcatgaagcataagctgaaagatgagttggagaacaaaaacacacttcaggaatacatatgtccaaactgtggaaaaagatataatgctttggatgctctgcggttagtgtcatttgaagatgaggacttccattgtgaaagttgtaatggaagactagaggttgaaagtgataagatagctgctcaagaaaggggagatggagatgataatgcaagaagacgacggcgcgaaaagttaaaggacatgcttcaaaagatggaggtacagctcaagcctttaatggaccaactcagtcgggtaaaagacttgcctgtccctgaatttggcagtcttcaagcatgggaagctagagctagtgctgctgtccgtgcagctaatggagatatcaatgctggtgattctaaaatttcgcagccaggatataatggagtgccttacagtggagacactaaggttgtagttgacttcaatactgaaggcaaaggagagggtgttaagtctgaaactgacagtacatctttaaaggttttgcctccatggatgattacatcaggtatgaatcttacaaaggaacaacgtggagaggtgaagcaagaaacaaagatggatgggacttcaacttccacagcagcacagtacacagatgacaagaagtcaacaattggacatgacaacaatcaaaatatacaggatgagtatattaaggcttattatgctgctttacttaaacaacaacacgaattggaagaagctgcaaaaaaacaattgtcaaatacacttgctgctgctaatccttctagcagtacttccattcgccaggttggcatgaaatcaaaacgtgaggaagacgatgatgatactgaatgggaggaggctccaattgcaggcaatggaaatggaggttacacggttgatttgaatgttgaagctgaggaagttgcagcagaagatgatgacgacgatgacgacgttgactgggaggaaggttga

SEQ ID NO: 14575 - DNA, 270 bp, Glycine max
  Peptide Sequence Number=SeqID_131353
atgggtttggaccagttggaacaaggcgtttctcaacaccatagcgtggatcaatctcggtctcctttgactccggcacgccactccggtggtggtgatgctgatgatgatgatggtggtggcggtggcggtggcggtggcggcggagaaatgggacagagagaactgaagttggttgttgcttatgatggccttatcattgttggatttggaaccaaaccagccatgaaagagtaccaagaagaggaagagccaaagaatgaagcttag

SEQ ID NO: 14576 - DNA, 2121 bp, Glycine max
  Peptide Sequence Number=SeqID_131354
atgcatatgcttatgctgtgtttgttgctgatcagacaggtgacggttggtgatgctcattacatggactggggtggtagtgttaaccatcactacagaactacttacaaagacgaccaaaaatccatgatggaggtggcactaatttcaaacatggatcctgtaaatattgggctgggctgttcagataagccaggtcctgttacttcactgaagccaagaaagaaaacaatgacttcagtgtatttgaagttctttgagacagctgctgatggcaagactcgcagatgcaagttttgtggacagagctattctattgcaaccgccacaggcaatttgggaaggcatcttgctaatcgtcatccaggttatgacaagtcaggggaagctgtcagcaatgcagcggcacgacctgccactgtggtcaagaagtcccaacctcatggaaaagcaaaccaggtggattatgatcatctaaattggttgctcattaggtggcttattttagcttctctccctccttcaactcttgaagagaagtggcttgtgaattcctacaagtttctaaatccatcaatacaattgtggccaagtgacaagtatagaactgtacttgatgaagttttcagaagcatgagggaagatgtaagagcattgttggaacaggtttcttccaagttgtccattacacttgatttctggacctcctttgaacaggtctactatatgagtgtaacatgtcagtggatcgacgaaaactggtgcttccagaagttgcttcttgatatctgtcgcataccctatccatgtgggggtgcagagatctatcgttccctcgtaaaagttcttaaattttacaatattgaaaacagaatcctgtcttgtacccatgataatagtacaagtgccatgcatgcctgccatactttgaaagaggacttggatggtcagaaaatagggccgttctgttatattccctgtgctgctcgaaatttgaatgcgataatagatgatggattgagatccgcaaaacaagtcatttctaagatacgggagtttgccatagagttaaacgcctcaccagtgatctctgaggattttattcaattatccacagcttatcaagaaggtatttggaaatttcctcttgatgtttcagcaaggtggagtggaaactaccaaatgattgatcttgttcgcaaggcaggtaaatcagtggatgctgttattcgtaaatacgaggaagtgctaggcagtaggatgttgctgggatcttctgacaaaagtgcggttagcatcatgcatcaatatcttgaaccattttacaaaaccacaaacaacatctgcacaagtaaggtgccaacgattgggcttgtccttttcttcatggatcacatctcagaaacaattacttccttcagagaatcacgtctcagcccagaatggctaaaaaatgctgcagaagaaatggctaaaaaagccagaagttatattaatcaagtttgcaacgtgtttacttatatgacagcaattctagatcctcgaataaagggagacctggtccctgatagtttaaactcagaaaactttctggatgaagcaagaacccattttatgagaaattattcaaccagccatttctcatccatgagttctggatacaatgctcaagaaattgaagatggaggaagcttttcctttgctgaggagatagcacgcaagaagcgaaggataagcatgagctttgccactgatgagcttacacagtacctatcagaggctccagctccaataccagcagatgtcttagagtggtggaaggtcaacagtacacgctaccctcgactatctgtgatggctagagatttcctggctgtgcaggcaacttcagttgtgcctgaagaacttttctgtggcaagggtgatgaaattgacaagcaacgaatctgtatgccacatgatagcacacaagctattctttgcatcaagtcatggattcaggttggcgtcaagtttaagtttaaatcaactgagatagattatgagcggttgatgaaattggcagctgcagctgctgcaacagataatagtccttcaagttctgacaagaagcaaaaatag

SEQ ID NO: 14577 - DNA, 777 bp, Glycine max
  Peptide Sequence Number=SeqID_131355
atggaggtttgggaccggcgcgcgttgaagccaagccaaagtgtcgaacgaacggtgaggagagagagactgaagaaagttaataatgtttctgaatatgtcattatcaatcaatcaaaaaggaaaagaaagagagagttagggaaggaagatgagctggcgcagggtattgaattcagcacaggccttggctgcacacactttccttttgtgcttcactctcttcctcgttctcaagctcgatcacaatctctcttcttcttggtggctgcagagtacaaaccgacaatgttggtggtttttcacatgggaaccaatataatagagtgtgcaagcttctgcttcaattggcgttggaatgatggccgtgtgttagttaataagctaccaaagaggattaccagacaattcaaagtggggcccacctttaggttgaagcttgagtgggtaatatttttacctctttggatgttccatggtgttgtggctcgaggaaggttttcattacctgcgccatctgctccacgtaatcgaaattgggctccatgccatgccgttgttgcaacaccattgcttattgcatttgaattgctcctttgtatatatcttgagagcttatatgatcgtggctatgctgcagttggtctaaagatagtgtttcttcccttactaacatttgaaatcattattctcattgacaatttcaggatgtgtaaggctctaatgccaggggatggagaaaacatgagtgatgaggctatatgggaaactcttcct

SEQ ID NO: 14578 - DNA, 435 bp, Glycine max
  Peptide Sequence Number=SeqID_131356
atggctcttaagattgacattagcaaggcttttgataggacagttaattattgtgttgttgttaatagggaatctgttgggcaattttctccagggagagaaattaatgcaccaatggtatttacacattcaggagcgcttaccatcacattatggagagcatcattgatactactcatccaaaagctacaggcgaagctcttttggcaagcggctggattgcggaataagcttaatacctcaatccccaatgaacaaataacatggctccctccaatgactggctttgtaaaatgcaatctcgatgcggcgatcttcaaagactcctattcttatggtactgacattgttatacgtgactcaaatggcatattcctcaaggcaagatccagtacacacaacagaattccaactccaacagaagcagaagcttaa

SEQ ID NO: 14579 - DNA, 540 bp, Glycine max
  Peptide Sequence Number=SeqID_131357
atggttgtcgaaaataataaagattctgacttaactgtcagggacaaaaagaggtgcatatctgttgctaccaaatcagacgtaaatgaagaagctaaatcaaccaaccctacaccaaaaccaaccttagcctcatttaaccctgatctggttaactctcactcacacctacccactctaagcactgcctcagatgaaccaagccctcaagcaaaccttatccaaccaaccactagcgtacccctttcaaacccaaaccttacaaacacaaacatgaacactaacccaccaaccataatctcaaacatccttagccccatgatggatcttttcccgaactccaaactctcaaaaggtattgctgccaaatctgatcactcccttattctcctctacctggatgcctcaaaaagaagaatttttggtaggaacttcatattcgagaactcctggcttcttgaacctggtttggaggaaatagtccattttggatggtcaaagcctttatcaaacaacctcatctccaaattgaattgttga

SEQ ID NO: 14580 - DNA, 1068 bp, Glycine max
  Peptide Sequence Number=SeqID_131358
atgtattcctcaaatacctccctcaacggcaatgaactaatctcgtaccctaaccaaccattttgctttaggcctttttcctttgaaagcaacccaactaattcttcaaaagaagaaaccaattcgaattacgcccttcctcttcctcctcctcctcctcttttgtcctttttccaatctccctttgacgaaaatatcttccaggaacaccaccatgacttcctcctacttcaccactctctagctgactctggagtactcaccaaaaaccttgacgttgcggccgaaatctcgccaattccttgccctggagaaggctcaattgcgatggagcacactccaagaaagagatccagcaagagagatcgccacagcaagatcaacaccgcacggggcctcagagatcgaagaatgaggttgtccctcgaagtcgcgaagcggttttttgggttgcaagacatgctaggctttgacaaggccagcaaaaccgtggattggttactaaaccaagcaaagggtgaaatcaaacaacttggaagggaaaaaacaagtgttggtggtgcgaagagtgcatcatcaacttcggaatgcgaaggggtgtctagcttggacgaggttgtagtgagtggaggagttaacgaggagcaagagagggagacagtaccaaacatgaagagaagaacaaacaaggtttgtagaaagagtgcattcaatcctattgataaggaatcgagggaaaaggcaagagaaagggcaagagaaagaacaagagagaagatgagaactcggagagtacttgctgatgcatcaaacctgaaccgtttgagttcttggaacccctttgaaacggttgaagactctgcgggtactactcatcaaagccaaagcgtgaaccatccctccttggatgtgcaccttcctgaggctgatcaagaaccaagttctcacaacgcgaaggagcattggggagagaacatggcgcatgaagataattctttggcgatcatgaacaagtggagcccaactatgatgttcaattctcttcacaactcaggagtccttcaggaa

SEQ ID NO: 14581 - DNA, 585 bp, Glycine max
  Peptide Sequence Number=SeqID_131359
atgaatcagaatttagtgtgctttttcggtttttccctatgttatcagatattgagtggcacaaacaatgtgttctcaaatggtgatgtaggtgctctgggctggtgggacttgtttattaattttattattgccgagtgctttgctttccttgtatgtacaaagtggtccaatcccgtcattcatagaaattcaagagaagctagtagttcatcttcaactacgattggatatcttgactggaacagtggtttagtggtttctacagacgaaaatcaaccccaggggagaatctgtagccttcaagacataggaggtcatttcatgaaaataccaattattgtattccaggttcttctttgtatgcatctagagggaacacctgcttgtgctgtatatataccgcttccagttattttctctccccttttcctactgcaaggagctggtgtactgttatctgcatctaaattaggggagaagcttgtgcttctgctacgaagtggagctggtggaggaatatattttagattttcttcaagagctcatgattgcttggggttcttgtgccatggttctaggtaa

SEQ ID NO: 14582 - DNA, 936 bp, Glycine max
  Peptide Sequence Number=SeqID_131360
atggaggtgaccaaccttgtagtcttgccagcagtttcggcattctttgtcctttctctacatttcatcactaaagctgacagactcaggaaacatccaaacctcaatcttcctcctggaagattaggatgtcctattgttggagaaaccctcgagtttctgcgtacaatgaatgagggcaacgtgttaaggttcatacaagagagagtggagaaatatgacgccagggtgttcaagacttcaatgtttggagatcctgttgttgtgttttgcgggccagctgggaacaagttcctatttagcaatgagaacaagaatgttcaagtgtggtggcctagctcggtaaggaagttgttaaggttgtctctggttaataaggttggtgatgaggctaagatggtgagaaggttgctcatgagctttcttaatgcagaaacactcagaaactacttgccaaaaatggatagcattgctcagcgccatatagacacctattgggaaggaaaagagcaggtgcttgtctatcccatagtacagctatacacgtttgaattggcttgttgcttatttttaagcattgaagactctgaccatatatcaaagctttccttaaaatttgatgaatttctgaaagggatcattggcttgcccctcaacattcctggaacaaggtttcatcgtgcaatgaaagctgcagacgtaataaggaatgaaattgaaatgattttaaagaaaaggaaagtggatttggaggagaagagggcatcacctactcaagaccttctatcacacatgcttgttacatctgaccccaatggaaggtttatgaccgaaatggagattattgataacatacttcttctactctttgctggccacgatagttctagatcagtgttatcattggtcatgaagtatcttggaccgttacctcaa

SEQ ID NO: 14583 - DNA, 1446 bp, Glycine max
  Peptide Sequence Number=SeqID_131361
atggaggtgaccaacctggtagtcttgccagcagttttggcattctttgtccttggtctatatttcatcactaaagttgttagactcgggaaacatccaaaccttaatcttcctcctggaagattaggatggcctattgttggagaaacctttgactttatgcgtacaatgaatgagggaaacgtgttaaggttcatacaagagagagtggagaaatatgacgccagggtgttcaagacttcaatgtttggagatcctgttgttgtgttttgcgggccagctgggaacaagttcctatttagcaatgagaacaagaatgttcaagtgtggtggcctagttcggtaaggaagttgttaaggttgtctctggttaataaggttggtgacgaggcaaagatggtgagaagattgctcatgagctttcttaatgcagaaacactcagaaactacttgccaaaaatggatagcattgctcagcgccatatagacacctattgggaaggaaaggagcaggtgtttgtctatcccatagtacagctatacacgtttgaattggcttgttgcttatttttaagcattgaagactctgaccatatatcaaagctttccttaaaatttgatgaatttctgaaagggatgattggcttcccccttaacattcctggaacaaggtttcatcgggcaatgaaagctgcagatgcaataaggaaagaaattagaatgattctaaagaaaaggaaagtggatttggaggagaagagggcatcagctactcaggaccttctatcacacatgcttgtcacatctgaccccagtggaaggtttacgactgaaatggagattattgataacatacttcttctactttttgccggtcacgatacttctagatcagtgttatcattggtcatgaagtatcttggacaattgcctcatgtttttgaacatgtcttgaaagaacaacttgaaattagtcaagggaaagaggcagggcagttgttgcaattggaagatgttcagaaaatgaaatactcttggaatgttgcatctgaagtcatgaggctatccccacctgtgagtggtgcttacagagaagctaaagaggatttcacctatgctgattataacatccctaaagggtggaagctgcattggaacaccggttcatcacacaaggatccagcactcttctcgaatcccgaaacttttgatgcttcaaggtttgaaggagcagggcctacaccattttcatatgttccatttggtggtggcccccgaatgtgtttgggtcaagagtttgctagactagagatacttgtgttcatgcataatatcgtgaaacggttcaagtgggatttggtgattcctgatgagaagtttaagtatgaccccatgctagaaccagtagaaggacttgcaattcgactccatccttcccatttctag

SEQ ID NO: 14584 - DNA, 1199 bp, Glycine max
  Peptide Sequence Number=SeqID_131362
gtcccttatattttgacatcggtaagatagcactggagcttattgctgcttatgtttcaacatggcctgctcctgttcttggtaagctaatggatcttcctattgggaatgcattgcttaaagagaacctgccacctgcacacagcttacccaaggaaaatggagtatctcttgatgaatctgctgctcctgtggctccttttcttcctaataatcagtatatcccacagggcctttttcacgattcagatctctatggagctttccatggccttctattgcagctttggttgttttgggaattgttactcggtgaacccattcttatcattgcaccaacccctccccagtgttctgaggctctccataaaatcccctacattgtctcagttggaagtccacctcctagttcaaacagggtttccctttcgactaggtcttctacaggaaaggtttctagtagacctgaaggtcttgggcttcaacaactttctctgcagaagttttctccttcaagtttattgaatgcaattaagctatggagagacggtcctctttgtctcatgacagaacataaggaagccatttggactacatattctgccacaactaagccagacacctctattttaaataggcttatagatgctggcatgtcaccaagagttgaggagtcaatgattacagcgccattggaaggatcttctccgtatgtagatcctccttctttgcctccatttaatgctgatgaatttcttgcaattttatcagccagaggtccaaggaagttcattttgaagcaaatgaaatctaactggctcgacttctacaggaggcgtgctgtagctgaacagaaacaagatagattgtggaggcacgcaagaatgaaaactgatatacagaaacttatatctaaaatggccgagttggaagttgtggattcttttagtgttatagagagacttctacttggggagttactgcaacctggaaatggaggtattgattccacggtaacttgtcagaaactaatgggagatcttcaggcagtcttcagcgcacttacaaaagatatgcagcaactcatgctttcaaatccacaaagagcatcccttctgcgaggtagcccagaattgacaaaacttccagcactcgcacttgttcaagccgggggtgcatcttctacatcactcacttga

SEQ ID NO: 14585 - DNA, 1152 bp, Glycine max
  Peptide Sequence Number=SeqID_131363
atgaaggttcattcgttggagcatattgaatctgtggaagttacaagtgaatcactttctagttatttcacgtctgatacatatgccaatgagcattcagcacttgctgctaggttggcagctgggttatgtgctgatctagcatcagcaattgtttctgggcgagccaaaaatggatttgctttggttaggcctcctggtcatcatgctggtgtaagacaggcaatggggttctgccttcacaataatgctgccgtggctgcattggcagctcaggctgcaggggctaggaaggatgttcatcatggaaatgggacacaagaaatatttgaacaaaacaaatctgtcttgtatatatcattgcatagacatgagggaggaaagttttatcctggtactggagctgccgaagaggttggtagtatgggtgcagaaggattctgtgtgaatattccatggagtcaaggaggagttggtgacaatgactatatttttgcatttcagcatgttgtccttcctatagctgctgagtttaatccagatcttaccatagtatctgctggatttgatgctgcaagaggtgatcccctaggatgttgtgatattactccctctggatatgcacatatgacaaatatgttgaatgccctttctggtggaaaattgcttgttattcttgaggggggctataatcttcgttctatatcgtcttctgcaactgcagtaatcaaggtattattgggtgagagtcctggatgtgaactggaaaatagcttcccttccaaagctggcctgcaaactgttctggaagtgctcaaaattcagatgaacttttggcctgccttgggtcccatttttgtgaatttggagtcacaatggaggatgtactgttttgaaagaaaaaggaaacagattaagaaacgacgccgagttctggttccaatgtggaggtggggacgaaaaagtttgttattccattttctgaacggccaccataattccagggttctttgtttgagatgtaatgagtcagaggatggagatggaatggaggtgacgggaaacatagacatagacataacagtagacataaagccaccaatttctccccctctcctcttaaactcatatcttatgcttggctcaatatga

SEQ ID NO: 14586 - DNA, 552 bp, Glycine max
  Peptide Sequence Number=SeqID_131364
atgagtcgattcaacaatctcatgcaaaagaaacaaaaaaagaaaagaaaaggaattgcactcaaagctaactcttcaaaggaagattacaaagaaagttcctgtaatgaagaagaggcagagaatttcaacttaatggtaaagaagtttggaaaatttctcaagaagtccaaagacaaaaaattctctaaaccttcaaagaagtttgaaagcagcaacaacaacttcacatgctttgaatgtgcttgggaagataatgcatctacatcttccgactcttctagtgatgaagaagttgcaaatgcatggcagatggcagattcaatggatgactcatcaaccattgaagaaattgaggtaaattctgaatttgaagaagttttggaagcatttaatgaaatgcatgaagaagctcaaaggcttgttttaaacaaaaagttgaaaagcgatctgaaattgcatatcacaaaattgggttcaacacaaactgagctggataaattgaagcaagaaaatgaaaatcttgtttcaagctataaagccattggttgg

SEQ ID NO: 14587 - DNA, 279 bp, Glycine max
  Peptide Sequence Number=SeqID_131365
atggaggataggctatgcgccattaaaggaggaggaaattatgcctttgctgacatggcagagttgtgcttggtacccgacgtggttattcctccaaagttcaaggtgctagattttgatagctcgctaagtgaggcggttgtctcttctgcgctaagcgcaagattagcgctaagccaaatatcacttactcgcgctaagcgcgagaatggcactaagcacgccttcgagagaacagaggaaaaagctaagcaaggaagcaaaggtcctaacttttag

SEQ ID NO: 14588 - DNA, 105 bp, Glycine max
  Peptide Sequence Number=SeqID_131366
atgggtagtggagctctcgaaacgaatgaggaagctgagaacagtcttcataagcaagcttctcaagtttctgatgccaatgatgcagttgctgaccctgatgtt

SEQ ID NO: 14589 - DNA, 594 bp, Glycine max
  Peptide Sequence Number=SeqID_131367
atgcaagtcatggtccaagtcctccgtgccgacaagcatctccgctgcttgatgggcgatgacaattgctctcttgcctggggcgagacaaggggcggtggcaatggcggtggttggcgcggtggtggtggcggtggtcgcctgacaggggcacacatcgagggaggggcaacacggggaggggtgctagagctaaccatggaaaagaaaagaaggttgagggagagcagaattagggcaacggatgcaacacccttggaacccattttcttaaaacttcttgaaaccttaattggtgaacaattgctagttcttgctggtggtggtggtggcaatgttgaattagggggcggtggcagtggtgaattagggagtggtggtggtgagactaagggtggaggtggtggtgattttgtgttacaaggtgatggtggtggtggtttaacacgaggtggcgtggcgatcacaatttggcgttggtctaatagggctatgactgctgacaacagaaacaaaaaagtgatcgatgaagagggaaagggaaacagatgcaataacacccttggaagccatttccaaacagttctctcttga

SEQ ID NO: 14590 - DNA, 423 bp, Glycine max
  Peptide Sequence Number=SeqID_131368
atgggttccaagggtgttgcatccgttgccctaattctgctctccctcaaccttcttttcttttccatggttagctctagcacccctccccgtgttgcccctccctcgatgtgtgcccctgtcaggcgaccaccgccaccaccaccgcgccaaccaccgccattgccaccgccccttgtctcgccccttctcttcttaataaaagaactttttaaaatatttgtatgtttcctttatcaccttatgctaatgatttttttttttcaagaagcaccgtccaaactcgcagagcatcaattgggtgagggtatagggaggcacttagaattgcacccaccaggcaagagagcaattgtcatcgcccatcaagcagcggagatgcttgtcggcacggaggacttggaccatgacttgcatcgttga

SEQ ID NO: 14591 - DNA, 333 bp, Glycine max
  Peptide Sequence Number=SeqID_131369
atggcttgtataatagagttaagggagaagtttccgcgcctgcctcaaacggcatggtcgggcaacaagactgccattgccatgggaatggccaagtccctcgagctcgaaaccccctttgccatgatcaccgccagcgaaatcttctccctccagatattgaaaactaaagcgccatcgttgtccacttcaaggaagaaaccaaagtcgtcgaggttcaaatggaccgtcccgcggcatgaattgttgagcattcacatgcctgcatattctgattctattgttaagggggtctctacagtcatggttcaaactccagttggaatggtgtaa

SEQ ID NO: 14592 - DNA, 148 bp, Glycine max
  Peptide Sequence Number=SeqID_131370
gacccatcaccttgaggacaaggtgagttttccagggcgggatgatgatggaaccattagtgcagcaagcaccatgaacgaagaagcacttgcagagaggccaaggaggaacatctcgagacctagacacttagatgattacgtgtga

SEQ ID NO: 14593 - DNA, 1146 bp, Glycine max
  Peptide Sequence Number=SeqID_131371
atgttggacgagagcaagttcgaggtacacttcaaactgtgggcccttcgaatcccttgccaacattgcaagctcgccacgcgaatcctcaacggttacttgcttgacaagccccgagttaaacccatcaccgaggacccaacctgtgacaaaaaccgttaccttatactctccgacaatgttcacaatcaagatttatctgatattccaaaacaaaagctagatgagctcaagggcttgtgtgagattgaagttgtgccctattctttgactttagggtattcttactggagtgcagatcatgtgctgaagcagatactgcctactggagtggagaaaaattatccaagaatcaaaactattgttaataaagttggaaccattacaaatgaatttcgtgtgccagagtttgaaattttagcaggagagcataatatgattacagaagtgaagcaatatggtgccacttttaggcttgattacagcttggtttattggaattcgagattggaacatgaacacaaaaggttagtctcaatgttccaagctggagagaccatttgtgacatgtttgctggtattggtccttttgccattcctgcagcacagaaaggatgcatagtctatgcaaatgatttaaatcctgatagcattcactatctgaggattaatgccaaaatcaataaggttggtgattgcatttatgcatacaacatggatgctagaaaattcatctcccagatgatggaagtgccaaatactgaggtcacattagaaaactcacatgaagtccctattttggatacacgagacaatgctgaatcaaattctaaaaatgagttgctaactgttgatacaaaagacctaggagatagcaataatagtgggttagaggatgtaaacggttcaacgaggcacactgctacatctgtaattgctggtaaaagatcttctactagttatcatgaagggaatggagaggctcatggaactgacatccttgaaggtggtaggagaaaaggaagcgcaaacaaaagaatgagaggctctgaaatctctgtcacaaaaacttgggaacatgttgatcatgtaataatgaacctacctgcatctgctgttcagtttctaggatttaggagtatttga

SEQ ID NO: 14594 - DNA, 690 bp, Glycine max
  Peptide Sequence Number=SeqID_131372
atggctgcagaagatcaagttcaaagggttaacctactaacatcaactgatgataattatggtggtgttattgtggaacttgatcagcatatggattctgcaacatttgtctcgatccttagagcttcagtttctcattggaagctgctgggcaagaagggtgtttggataaaattacctattcatttagtcaatctggttgaagctttagtgaaggtcctagttgttcaagagaatagtggactatttcaaggaactggagtctggaaattcccaactggagttgttgatcagggagaagatatttgtgtagcagcagtaagagaggtcaaagaagaaacaggggttgattcagaatttgtggaagtattagcattcagacaaagtcataattcattctttgagaagtcagacttattcttcatgtgcatgttgcggcctctttcttctgacatccaagcacagagattagagatactgaatgcacagtggatgccatttgaggaatatgcagctcagccattcatccaaaagagtgagcttttgaagtacataaatgatacatgtttggcaaagatgggtggacaatattctggattttctcctgtatctacgtcatcaaacttttctgaccagaagaattatttgtacttgagtgctggggccttaaagagctccaattcttcataa

SEQ ID NO: 14595 - DNA, 120 bp, Glycine max
  Peptide Sequence Number=SeqID_131373
atggaagattcccatttcatggaacaccttacaagttgcaacacttgtggtgcaacttctaagcctatgaacgttgccaatgaacttcttgaacgccagtgcaaagttgtttacggctag

SEQ ID NO: 14596 - DNA, 1962 bp, Glycine max
  Peptide Sequence Number=SeqID_131374
atgggatcacaagagcatggtgaagaagtcacagatgctgcttttgatcgagttgcagaaactcatcgtgagttcgttcaatcctatgtgggaagtcctcagaaagcgaaagaagcaataatatactcttacacaaggcacatcaatggctttgctgccatgctggaagaggaagaggctgctgatattgcaaaacatccagacgttgtgtcagttttcttaaacaaaggaagaaaattacacactactcattcgtgggaattcatggacctggaaatgaatgatggggtaattccctctgattcactgtttagaaaggccagatatggtgaagatactattattgccaattttgacactggtgtatggcctgaatccccgagctttagtgatgaggggatgggacccataccatcaaggtggaaaggaacttgtcaacatgatcacaccggcttcccttgcaacagcgcaaaatctaaccgtacactgagcacagcacgagactatgagggtcatggatctcacacactatcaacaataggaggaagctttgttcctggggcaaatgtgtttggcttgggaaatggaactgccgaaggtggatctcctagggctcgggttgctacttacaaggtgtgctggccaccaattgatggcaatgagtgctttgatgctgatatcatggcagcctttgacatggccatacatgatggtgttgatgttctttccctctctcttggagggagtgccatggattactttgacgatggcctttcaatcggggcctttcatgctaacaagaaaggcatccctctgcttttgaactccacaatggacagcacttcaagtactctctgtatgcgaggaacaattgaccctgagaaggcgaggggcaaaatattagtttgccttagaggtgtcactgcaagagtggaaaagagcctggttgctttgaaggctggtgcagcagggatgattctttgtaatgacgagcttagtggtaatgagcttattgctgatcctcatctcctgcctgcatcacaaattaattatgaagatggtctagctgtctatgcctacatgaattcaaccaagaatccgctaggatatattgatcctcccaagaccaagttgcagataaagcctgctccatccatggcagctttctcctctagagggcccaacatagtcacaccagagatcctcaagcctgatgtcactgctcccggtgtgaacattattgctgcctactcagaaggggttagcccaacagatatgaactttgataagcgcagggttccttttatcaccatgtctggaacatccatgtcttgtcctcatgtggctggagttgttggccttctcaagactctccaccctgactggagtccaacagttattaaatctgcattactgacaactgctagaacaagggacaacactggtaagccaatgcttgatggggggaacaatgctaacgcaacgccatttgcctatggatctggccacatcagaccaaaccgtgccatggatcccgggttggtgtatgacttaaccaacaatgattacctaaactttctttgtgtctctggctataaccagagtcagatagagatgttctctggtgctcattatcgttgtcccgatataataaacatcctggattttaactaccctacaataacaataccaaaactctacggctcagttagtttgacacggagggtgaaaaatgttgggtcaccaggcacttatactgcaagactcaaagtaccagtaggtctttccatatctgtggaacctaatgtgttaaaatttgacaacattggtgaagagaagagctttaagctgacagtggaagttacaagaccaggtgtggctactacatttggaggtataacatggtcagatggcaaacatcaagtgaggagtcaaattgtagttgggggagttagagggtag

SEQ ID NO: 14597 - DNA, 336 bp, Glycine max
  Peptide Sequence Number=SeqID_131375
atgtggttgaatatttatagacagatatctgactcaagatatgccctgccagatgcattcaggggattaatccagaagaaatattggaaaggatgtctaccatggattcactgctattgcttcattagggcaactgaaactcctgagactataatagctgtagcagaatctgctttagacgctcatatacaagactcaagatttcatagggttagggatgtggctccaaacaagaacaccataacttctacaatcccttactcatggcttttgctttttacttactgtgcaggcaatgttttgtttaagcttcaggttgccagaagcatgccttaa

SEQ ID NO: 14598 - DNA, 1818 bp, Glycine max
  Peptide Sequence Number=SeqID_131376
atggcttccctcaccccaggcattctgctgaaaatgctgcaggccatgaacaccaacacccgcgtcaccggcgaccaccgctccccgctcctccaggtcatcggcatcgtccccgccctcgccggctccgacctctggtccaaccagggcttctatttaaacctctccgactccgtcaactccacctacgtcctcctctcccaccccgacaccgacctcatcctctccaaccgcctccagctcggccagttcgtccacgtcgaccgcttccacttcgactcccctctcccctccgtctccaacctccgccctctcgctggccgccaccccttcctcggcaccccggagcccctcattgctcgcatctccccctccacccgccacttcctcatccaacccctctcagactccgaactagaccccctctccctcctctccctcaacaacaacaacaaatccccaatccctaaccctaaccctaacccaaaccataaccatgaagagcataaacaacatcacaaagacagcagcaaagaacgaatctccagagaccctctcgcgcctcgcgacaacaacttaccgccgcagagattctcatccccggccaccgccaagagatcgcagtcggcgggaaggaataagattgtttccaccacggcggagagggatccatcaccggcggggaaggggaagaggtccgcgtctccggtgccgtccaagtgtgtggttccgagcctcgtttcggcgcgcgaggaaaaccggaaggtgtcgagggagccggcgattatcgtgccgtcgaggtaccggcagccttctccgaccgggaggaagcagccgtcgtcgagtccgcggcggacatcactttctcccgggaggaggttgtctgggggacttaaggtttcgccgctggtggcggactcctccgtgaagaagaagatggccaccattgtcgccggaatctcgaaggtctccgatgcgctggttgggtccaagagtgccaggaagaattgggatgagcaactgccggccacgcctgttgaagctggtggttctaagagtaaggttgatgcacaagcaattttgcgtactcaggctgcaatgtcaaggcggttaagtgatgtgagtggtcaaaaaccgggtagcaatgattcttcgagcaatgagaaaactaaagctgtttctcctcaaagttgtgttcttgaagacaaatccaattttgcagcaatgggtatcaccattcatgagaagaaatggactgatggaagtgttccattagatgctgtttctgggaaccttgcaaggcttggaaaggaagcaatgcaaaggaagatcctcgcttctaccgctgctgctgaagcattagaggaggccaatgctactgaatgtattataagaaatttaagcatgttttcagacctctgctcagtttgccaggccaggaatcctttgccaaccatagacagattcttcactatctatgatgatgttctgaaatcaactgcaatggttgaatctgttgccagcagacataattctgagacacctgatgaaggcattccaacaaaacactcaaaatcactttctttttgggttgaagctgcgttggccactgatctccagatagtatcccttcttactggcacaaccgtggatcctccatcgacactgcaaaaaagcttatcaaaaagacagtctctcggtgcagctaagaaccttaaggttcgttcatcaccacagtccagtctgagtactggtgtgtggacaggaggtagtggaatgaaagagacagtggagcttggagcaaattttgctgtctga

SEQ ID NO: 14599 - DNA, 396 bp, Glycine max
  Peptide Sequence Number=SeqID_131377
atgagggtggggcagcaagggaaaggagcgttgtgtttgttcccatggcaggatgccaagccaacactgatattcagtgcaaggttacgggctgaaaaagcccgaaccggaggaaaggatgaggttgtgcatatgcaattgagatgttggtgctcttcaacagccgtcagctctgatcaaatactggaccgagtgattgcactggccaagaaatatgataaaatggatggctcaaaggttactgaaacagctgattttcaaaaagatttgaacctggacagtttggacagagtggaactcattatggcccttgaagaagaattttctattgaaatccctgatgagaaggcagataagcttgtttgctgtgctgatgttgcaaaatacatagcagag

SEQ ID NO: 14600 - DNA, 456 bp, Glycine max
  Peptide Sequence Number=SeqID_131378
atggcacaagaaaaggcacttcgtgttaggtacctagtggcattccttcttgtgttcttcactatggcctcatgtggctcaggtgttggagtcaactggggaaccatggcaactcacaagcttccaccaaataaggtggtcaagatgcttcaagaaaacggttttgataaactgaagctgtttgatgctgaagagtggattatggcagcactgatggggacagatattgaagtgatgctagcaatacccaataacatgttggaggagatgagtaggaatcctcaggttgcagattcttgggtttatgaaaatgtcactagttacatgtaccctggtggactaaatatcaagttaagtagtcctatgagcatactatatacagcattcattatcacatcatttgtgtgtcttttccgtgcagataatttcttgctcttaaatgtttctactgtttga

SEQ ID NO: 14601 - DNA, 954 bp, Glycine max
  Peptide Sequence Number=SeqID_131379
atggattcccctgcaattattcttctctctgatgcttttggaaagaaaaacattgatcatggtagcggatttgttctttgccccttatatggaagaaaatctaaagctttccaagcggcttctggatgtacaatatcagctattatctcaaatttgactaaaactgcaaaatccactgttgggctatcgttgtctgtggagagctctcaaactctctctatttctgaatatataaaacaaagggcaaaagaggcagttggagcagaagataccccactggggggttggtctgtgacaaggctgcgttctgctgcccgtggaactctaaatgttccaggattgagcttaggagttggcccaaaaggaggactaggggagcatggtgatgctgtatctcgtcagctcattcttacaaaggtttcacttgtggaaaggcgccctgagaattatgaagctgttactgttcgtccgttatcttcagtaactgctcttgttcggtttgctgaagagccccagatgtttgcaattgaatttagtgatggatgccccatccatgtttatgcaagcacgtctcgtgatagcttacttgcagcagttcgtgatgctttacaaactgaaaatggagtgtcaaagactcaaattgcacgtttgacttctagtaatgtttattttcagggtcaatgtgccatacctgtattgccaagactgacaatgcccggtcatcgcattgatcctccctgtgggagagtttttttgcaatatggtcaacaaaggcctgttactgatgcagaaactgcatccatgcatttgaaacatttagcatcttctgccaaggatgccgttgctgaaggtggttctattcctggatcaagggctaaactatggcgtagaataagggagttcaatgcctgtataccatatagtggtgtgcctccaaaccttgacgtaccggaa

SEQ ID NO: 14602 - DNA, 732 bp, Glycine max
  Peptide Sequence Number=SeqID_131380
atgaagcaccgggaactcagccactggggccaaccggttccaccgtatccgatgcaactccgtcaaaatactcgccctgtaccgcgacgagaacttcatggccttgaattttccgcgtccatcggtcctcacgctgaggttgaactcgttcgaattcacgtcgcggccgagaacaggcgaggcaccttcgaagtccgtcgcgacgtcgtacgagttcgtgacggtaagcgtggaaggatcgagagtgagaacggagacgctggaaatgcagagaatcctcttgtagcggccgcgccacgagtgcttaacgaccatataccgcgccaagtactcgggctcttcgagaggcgggggagcggaattaacggcggcggaggcgttggcagcgttttccatgaccggcggcgggtgaagctggacagggcggttgagatcggatgcgtagcggctcacggattcgacctgggggagatgcgcgagggtgtgaacacgtggcgcattgtggaagcggaggaagaaccagagtccctgctgctgcgacgatggagggagcggttagggttgcgggaatcggagaacggaaaatcgaatcggagtaagcaatcgcacgttggagtgagagaaatggcgagagagagagagaatgggggtagtgggaggaggaggaataggaggacgaacgcaccgtctgatgctgatcatgatgacgtggccgtttcttattcgcgatga

SEQ ID NO: 14603 - DNA, 3798 bp, Glycine max
  Peptide Sequence Number=SeqID_131381
atgtcttttccggcagcagttggaagaataatgggtttactcagaaatggttcagaaggtgtagcttctgaagctgcagggcttgttgctgtactcattggtggtggacctggtgatgcaaatgtaacagattctaaaggagaatggcatgccacaattatgcatacaaaattaaaacctacttcagtgtcacctttactgtcaatgactgttgttgaagtgcttgaggctatgatttgtgatccacatggcgagactacccaatatactgtttttgttgaattattacgccaagttgcagggttgaagcgtcgcttgtttgcactgtttggtcaccctgctgaaagtgttagagaaacagtagcaatgataatgcgatcaattgcagaagaagatgccattgctgcagagtccatgcgggatgcttctttgcgtgatggtgctttgttgagacatttactgcatgcatttttctttccagctggtgagcggcgtgaagttagtcgacaacttgttgctctttgggcagattcctatcaaccagctttggagctactgtcccgaattctgcctcctggcctcgttgcttacttgcacacacgtgctgatggagttctagctgaagacacaaatcaagaagaatcatcaattgggagaagaaaaagacgtttacttcagcacaggaaaggtcgcattgggagaggacttacctctcaagaacaaccgttcccttcagctaataactttgatgtttctgattcagctaagcagccagtgggtgctattgttagaggctcagacggctatcataaaacagttatggacccaagttctggacaggcttcaaatattcaatcttctgttgttcacactagtgaacatttgaacaatgggtcttctacaggagaagaaaatgggcattcaacttttgtggattcagctattgtggcatcaacaaactcaaatgaagctccaggatctgatttttcaaattcacttgatcctgacagcaatgcagttgatttgcagaatgcaggcattcctgctcctgctcaagttgttgtggagaacacacctgtaggatctggtcggcttctatgtaactggcctgaattttggcgagcatttgatcttgatcacaatcgtgcagacttgatttggaatgagcgtactaggcaagagttgagagaatctttgcaagctgaagttcataaactagatgtcgagaaagagcgtactgaagatattgttccaggccgtgctaccttggatatggtatcaggggttgagtgtgcaccacaaatatcttggaactaccctgaattttctgttcggtaccctagcttgtcaaaagaagtttgcgtgggtcagtattatctgcgtttactgcttgagagtggcagtggtggcagggcacaagacttcccattgcgtgatcctgttgctttcttccgggcactttaccatcggttcttatgtgatgcagacaccgggcttactgtagatggtgctgttcctgatgaattaggtgcatctgatgattggtgcgacatgggcagattagatggttttggtggaggtggtggatcatcagtgagagaactttgtgcaagggcaatggcaattgtatatgagcagcattacatgaccattggcccttttgaaggtacagctcacattactgttctcttggataggacagatgacagagctttgaggcatcgccttcttttacttctgaaggcattgatgaaggttttatcaaatgtagaggcttgtgttctagttggaggttgtgtattagctgttgatctgcttaccgtggtccatgaaacttcagagaggacatctattcccttgcaatcaaatttaattgctgctagtgcttttatggaaccacttaaggaatggatgtatattgataaagatggtgctcaagttggacctatggaaaaagatgctattagaaggttgtggtccaagaaagctattgattggacaacaaggttttgggcttctgggatgctagattggaagaagttgcgtgatatccgtgagcttcgttgggcacttgccctcagagttcctgtccttaccccacctcaggttggggacaccgctttgtccatattgcatagcatggtgtcggcacattctgatttagatgatgctggagagattgttactccaactcctagagtaaaacgaatcttgtcaagtccacgctgccttccacatattgcacaggccattctttctggggaaccaagtattgttgaggcagctgctgcattgcttaaggccattgttacccggaatcccaaagctatggttcgtttgtacagcactggtgcattttattttgcactggcatatcctgggtctaatctactttcaattgggcaactcttttctgtcacccatgtccatcaagcatttcatggtggggaagaggctgcagtttcaacttcattgcctttggcaaaacgcagtgttcttggtggacttctccctgaatctttgttgtatgtactggagcgtagtggtccgacagcatttgctgcagcaatggtttctgattctgacaccccagagataatatggactcacaaaatgagagcagaaaatctaattcgccaggttttgcagcatcttggtgattttccgcagaaactgtcacagcattgccatgttttatatgactatgcccccatgcctccagtgacatacccagagctgagagatgaaatgtggtgtcaccgttattacctcaggaacctatgtgatgatattcgttttccaaattggccaattgttgaacatgtagagtttcttcagtcactacttgtaatgtggcgtgaagagttgactagaaagcctatggatctttctgaagaagaagctggcaagatccttgaaatatcctttgaggatgtatctagtgatgatgtaaataaaagaaattctctagaggttacagatgaagcttctagcttatcaaagcagattgagaacatcgatgaagaaaaactaaagcgacaatatcggaaacttgcaatgaaatatcatcccgacaaaaatccagaagggagggagaagtttcttgcgatacagaaggcctatgaacgcctccaggctaccatgcaagggttgcaaggtcctcagccttggagattgctacttctgttgaagggacaatgtattttatacagaagacatggagatgtattggagccattcaaatatgctggctatcccatgttgctgagtgctgttactgtggacaaggatgatagcaattttctttcttcagatagagcaccactccttgttgctgcatcagagcttgtgtggctgacatgtgcgtcttcttcattgaatggggaagagcttgtaagagatggaggagtacatcttcttgcaactcttctttcccgttgcatgggtgttgttcagcctactactcctggaaatgaaccatctgccatcattgttacaaacatcatgcgaacatttgcagttcttagtcagttcgaggctgccagagctgagatacttgagttttccggactagttgaggacattgtgcactgcactgaatttgagcttgtacctgccgctgttgatgctgctttacagactattgccaatgtttctgtttcctctgaattgcaagatgctttattaaaggctggtgttttatggtatgcctctttagttattgttttactgagatcaatgtttgaagctgagataggcaaaggatgggacaatgatgtgggatcaactaacaagtaa

SEQ ID NO: 14604 - DNA, 1758 bp, Glycine max
  Peptide Sequence Number=SeqID_131382
atgaagttcatgaaacttggaacaaaggcagatactttctacactgaacaagctaccaggactctgatatcagagatagctgcagaccttgtgatacaaatcaatgatattacttatctgttacacaagctgcagtttccgcttcttccaaaatgtggcctcctacaaaggctttgctatgacacaagtgattccgagagtgtctctctagagcttcatgatataccaggaggagaagatgcttttgaactctgtgccaagttttgttacggaatcgcaatcaacataagtgctcataactttgtatccgctctctgtgcagccaagttccttagaatgaacgattccattgagaagggaaacttggtaggcaaacttgagtctttcttcaactcatgcattcttgaaggttggaaggattccattgcaacgcttcaaactactgctacgttgccagagtggtctgagaaccttggtattgtcagaaagtgcattgattcaattattgagaaaattctcacacccccgccacaggtcaaatggtcctacacctacaccaggccaggttacacaaaaaaacaacaccattctgtgccaaaggattggtggacggaggatgtttctgatcttgacatagatcttttcaggtgcataatcatggctattagatcaacctatgtgctccctccgcagcttattggagaagctttgcatgtctatgcctgccggtggctaccgggcctcacgaagctcaaaagttctggcagttcagcgtctcaaacagaagaatctaataaggagaaaaaccgaaaaattcttgaaacaatcgtgagcatgattcctgcagatagagggtctgtttcggttggcttcttgtttaggcttctcagcatttcaattcaccttggtgtctcttcggtgaccaaaacagaactaataagaagagcaagcttacagtttgaagaggcaacagtgagtgacctactttacccttcaaaatcctcttctgaccagaactattatgatacagagttggttctagcagtgttggaaactttcttgaagctttggaaaagaatgtcccctggggctgtggataacagctactttttgagatcaatcagaaatgttggcaagctcatcgattcctatcttcaagtggtcgcaagggatgacaacatgcaggtatcaaagtttgtgtctcttgctgaaactgtgcccagtattgcccgggaagatcatgatgatctctaccaagcaattaacatctatcttaaggtacatactgacctgagcaaggcagacaagaagcgtctgtgtgggattctagactgccaaagattgtcaccagaagtgcgtgcccatgcagtaaaaaacgagcttctgccattaagaaccgtagtgcaacttctctattttgaacaagacaaaggctctaaggcaaccacaagtcacaaactgccaaagccacatgagatacttctgggagcaaaacatagaccagctacaactaacgaagaattcaacggagaagaaattagagaaagggaccaccacaaaactaaaagatcagatggtaagttgttggcattggacttggaaaaaaagatggttataaaaggagacattgaggagacacggtctgagaaagccaggggaatcaaagatgcaagtagttcaagcggcaaggtggacttggatcccaaaaaaatcattagaaggacaagaagtaaatcagaacatggcgtcaaaaagtaa

SEQ ID NO: 14605 - DNA, 2525 bp, Glycine max
  Peptide Sequence Number=SeqID_131383
tatgactctactgctgaagagtctgatgcaacagaatcgcatggtgttggtgctagtgttcaaattgccaaaaacatgcatgccataaaagcatccttggctttgtcaaggctcagtggcttgtgcagtgatgagagtgcaacaccttacaatcaggcagccgctgatgccctcaaagttttgctaactcccaagttctctagcatgttaaaagatcaaatgtccaaagatttactgtccaaattaaatgcaaacctggagtcaccagagattatctggaactcttcaacacgagcagagttgctgaaatttgtggatcagcaacgtgcagctcaaggtcctgatggtttatatgatattaaggattcacatgactttgtctataaagcactatccagagaattattcattggaaatgtttacttgagagtctacaatgatcagccagactttgaaattagtgaaccagaaactttttgccttgctctgattgatttcatatcttatcttgtgcacaatcaatgtgttgaagatgccgatcataagattgaagatgctgatcagaaggttgaaggcacctctagtttctttgagacttcagagcatacgagtgagactgttgatggatctgtaaatgagcaggttctggataattctggcacaatgtctgaagaacaatctgtagggaaggaagagcttgagctgattaaaaatctccgttctgcgttgacctcccttcagaatcttctgactaataatcctaatttggcatccatattttctaataaagacaagttactgcctctttttgagtgtttttctgtgcccgaagcatcacacagtaacattcctcaactttgcctaggagtgttgtcactcttaacagcacatgctccttgtttgcaagccatggttgcagatggatctagtctcctgcttttattacaaatgcttcactcagccccaagttgtcgtgaaggctctctccatgtgctctatgcattggcaagcacaccagaactggcctgggctgctgccaagcatggcggtgttgtctacattcttgaattgctcttgcctttgaaggaagaaattccactccagcaaagagctatggcagcgtccttgttggggaagcttgttagccaacaaatgcatggaccaagagttgctataacacttgcaaggtttctccctgatggccttgtgtcagtaattagggatggacctggtgaagctgttgtagttggtcttgagcagactacagagacaccagaacttgtatggacaccagcgatggcagcttccttatctgcacaaatttccactatggcattagagctataccgtgagcagatgaaggggcgtgttgttgattgggatttgcctgagcaggcatctggccagcaggaaatgagagatgagccacaggttggtggcatctatgttaggttgtttctgaaagatcccaaattccctcttagaaaccctaaaaggttcttggaaggtctactagatcagtatttgtcatccattgctgcaacccattatgaggcacaggttgttgatccagagcttcctttgctcctgtcagctgctctagtttccttactgcgtgtgcaccctgcactagcagatcatgttgggtatcttggatatgtacccaaactagttgctgctgttgcatttgaggggaggcgagaaacaatgtcatcgggtgaggtaaacaatgggagacgtgcagaacaagcatatgacccggataatgaatcagcagagaacgcacaaactcctcaagaacgtgtgcgtctgagttgtttgcgtgtcttgcatcaacttgcagctagtaccacatgtgctgaagccatggcagcaaccagtgttggaacacctcaggttgttccactgctaatgaaagctatagggtggcaaggtggaagcattttagctcttgagactctaaaacgtgttgtggttgcaggaaaccgagccagggatgctcttgttgcgcagggacttaaggctggcggaaggaatggcttttgttctcagatgaagtggaatgaatctgaagcgtctattggcagggtgcttgcaattgaggtcttgcatgcctttgctactgaaggagcccattgcactaaagtgcgagagctattgaataattctgatgtaagtctcaacagtaatttaacatggctgtttgagttgttggctttagcctcttggcacttcagatgtggtttctgcttttgtttgcatcctgttgctagtatactatccatatctaagttttctccttctacaactgcgttccaggtttggagtgcttacaaagaccagaggcatgatctcttcctcccttcaaatgctcaatctgcagctgctggcattgctggtctcattgagaattcatcatcgtcgagactcacttatgctcttactgctccaccacaatctactgcttctagaactcctccaccatcctctccggacttcaatggaaagcaggatcaacctttaca

SEQ ID NO: 14606 - DNA, 279 bp, Glycine max
  Peptide Sequence Number=SeqID_131384
atgcaaaatcaatggagtaagtttgatcgtctagattcgtttgatacttgtgacgaataccattcacaagaactgtccgtggcactttataacaggcaagattcactatccaagagaagtaacctgagttaccaggatcaagcagaaaaggtagagttttcagggccactactatctcaaatgcacacagttgatgagctcttagaaagacacgagagtcatatccggcgtacggtcagaagatcatggtttcagagaggtaagaagcaagggaagtaa

SEQ ID NO: 14607 - DNA, 234 bp, Glycine max
  Peptide Sequence Number=SeqID_131385
atggttgaaatcaattgcctatgtatatcaaaagaattgagggtgaacttggggtttgaaggaattcctatgtttgtggatagaaaagatgtaggaaagcacattcaagtaagatttaagaaggcgctcatggtagctctggacaaagaagacattctcacttacctggttggtgtcaatgttgacatgatatttgaaaggccaatgttagtaggtttgaatctctcccactaa

SEQ ID NO: 14608 - DNA, 315 bp, Glycine max
  Peptide Sequence Number=SeqID_131386
atggataaagctgtctccagaacatttccattggatttaatgatgaaatctgtgcattttcagttgagcttagctcatcagtgggctaagtgcgcatccaccgctaagcgcagctttagcgcgcttagtgagacagaagaatctggcagggcatcagcatcaaggccgcgcgctaagcgcgagatcagtgcgctaagcacagtagatgtcttcagtcaggctcaacacagactggtgctaagcccgaatccacttactcgtgctaagcgtgagggtggcgctaagcgcaacgtcgcaaatttagagcctatttaa

SEQ ID NO: 14609 - DNA, 372 bp, Glycine max
  Peptide Sequence Number=SeqID_131387
attgaactcatcgcaccaagagaagttgcaagccaatgccctctcaaatctttcaagttctacaagacaaaggaaattcccactggcttctttgagatcaaatccggatcgtcaaacatccgtacaccttggtgggatggaagcgtcatatatggaagcaatagagaagttttagagaaagtgagaactttcaaagatgggaagataaagatatcaaaggatggtcatcttctccataacgaaaatggaacagcaatttcaggtgatgtccggaatagttgggctggtgtttcaaccttgcaggcacttttcactcaagagcacaatgcagtatgtgatgctctcaaggtacgagttgaagcatttgaataa

SEQ ID NO: 14610 - DNA, 666 bp, Glycine max
  Peptide Sequence Number=SeqID_131388
atggaaaatttgattggagtgcaaggagaagaagcattgacaaaaataggagttgaaaggcaacttgtgtcaatgggtcatcaagcttgtggggccctagagctttggaactatccattgtggctcagagatcttgtaccacagaacatagatggaaccgaaaggaaagatcatatagatcttgctgctcttgaaatttacagggatagagagaggagtgtggctagatataaccaattcagaagggctttattgttgatacctatctccaagtgggaagatctaacagatgaccaagaagcaattcaagtattggaagaggtatatggtgatgacattgaagagttagatctactagtaggcctcatggcagagaagaaaataaagggttttgcaattagcgagacagcttttacaatattcatattcatgtcaagcaggaggctagaagctgacagattcttcactagtaattttaatgaggatgcgtataccacagaaggactagaatgggtgaacacaactgagagcttgaagaatgtgattgatcgtcactatcctgaaataacacataagtggttaaactcttcgagtgttttttctgtttggaactcacccccaaacactcaaaatcccattcctttataccttcgtgttccccattaa

SEQ ID NO: 14611 - DNA, 775 bp, Glycine max
  Peptide Sequence Number=SeqID_131389
atgcaggatgaaattccaaaggacgtttacaaggactcagaagacaggtttcgcaaatggtatttccccatccacgatttcactctcacgatgctgtggagcaggtttctcatagtaggcgaggagagaatggtaaacggcacaggcactagcattttcgacatgcacctcgacaaggtcgacaaagattgggccaaagaacttcccaacctagactacgcaataatctcagcgggacactggtttttccgagtaatgcacctccatgaagcaggaaaacaagtaggttgtgtctattgcaacgaagaaaacatcacaagctacaatccagacttcaccataaggaaagcattcagaacagccttcagacacatcaatgcatgcaaggaatgtgggagaaaaaaaatggtgacagtgttgaggacttttgcaccagcacactttgagaatggagtatggaacactggagggtattgcaatagaacaggtcctgtgagtgagagtgaggttgattttggaaagtttgattgggaagtgaggggtattcagatggaggagtttgagagagcaaggagagaaggcactatgggaaaattagggcataataataataataataataataataataataataggtttgagatggtggatgttgctagggctatgttgatgaggccagatgggcaccctggggagcattgggggaataagtggatgaagggttataatgattgtacccattggtgccttcctggtcctgttgatgtgtgga

SEQ ID NO: 14612 - DNA, 273 bp, Glycine max
  Peptide Sequence Number=SeqID_131390
atggccataaaggtcgctaagatacaaggattactattatttcccattgttccccctcctcttctgattatgatttgtgagtgttcggacaaagatgatgctgtgaagtgctgccagatgatttcatactgttggcttctttcaatgtatctgatgatggatttggcatgcccaacaaatgcaacattagattggaagagagtgacccaaacgtctagagctttccatgagcgtgttgaggatttcgatagaaataagtacagaatggagtga

SEQ ID NO: 14613 - DNA, 1227 bp, Glycine max
  Peptide Sequence Number=SeqID_131391
atggatggttatgtcaagtgtgggattgtgggtgaggctagaaggggtgtggagagtgggagagtggtgtttgatgaaatgcctgtgagaaatgagatggtgtttggtaaccaactgggattgagtctggcaaaaggggctagtctcccagaacgtaatgaatcaaggttgggagagggagagatatccacattccatgttcaagagtgtgttgaacatgattacttccaaagaaagctacctttagggaaccaaaaggaaaaggagattgtttttggttgtgggtttgggttgaattcagttactttgtgttctgttttgtctgcttgttctcaatctggggatgtgagtgtgggaaggtgggttcattgttatgctgttaaggctgtggggtgggatttgggtgttatgatggggacatgtttggctgacatgtatgccaaatgtggggggataagttctgctttgatggtgtttaggcatatgctaaggaggaatgtggtggcatggaatgccatgcttggtgggttggccatgcatgggatggggaaggttctagtggagatgtttggttccatggtggaagaggtgaagcctgatgctgtgactttcatggctttgttaagttcttgtagccattcgggtctagttgaacaagctggacgtttggaagaagctgaggatttggtgaagaagatgccaattccaccaaatgaaattgttttggggtcccttttgggcgcttgttattcacatggtaagttgaggctgggggagaagattatgagagagttggttcagatggatcccctcaacacagaatatcatattcttctttcaaacatgtatgcattgtgtggaagagtagacaaggaaaattcccttaggaaggttcttaagagtaggggtatcagaaaggtgccaggaatgagctccatatatgtagatggccaacttcatcggttcattgctggggataagtcacacccaagaactgcagatatttacatgaagcttgatgacatgatatgcaagctgaggttggctggctatggtcccaacacaaattgccaatttctgtttggttgtcccaatggggatgattgcatggaagcaatggaggagatcgttatcgttttcatagtttcaagcaaggttcttgttcttgctctgactattggtgaattaccctttaacctgacagacctttttggaccagcagattga

SEQ ID NO: 14614 - DNA, 1725 bp, Glycine max
  Peptide Sequence Number=SeqID_131392
atgaatggccacaaaaagttgaattctccaaggggagaggttggagagatagacactagggcaccattccaatctgtcaaagctgctgttagtttatttggcgaagtagccatcactagagacagattttctgtcaagagaagatcatcagagaatgtatttgaaaaggagacgcagcttatcttggcccaaaaggaattaaacaagataaagaaacaggtggataatgctgaggccatcaaagccaaagcactttctgagcttgagaatgccaaggagatccttcagagtttgacaagcaagctggccaacgtgagagaatgcaaacaatctgcaatgcaagcagctgaattggtgaggaaccagagcaagcgatttgaaaagacactatcgctaaaagccgtgggatatgaagcttggagaaaagaactagaacatgcaagaaaagcgtacactacgactataactgaactagattcttccaagcaagaactcaccaaaataaggcaggattttgatgcagttttggaggcaaagctggcagcacttcaagcagcaggagaggctcagcgttcagcaaaattaaactcggaaagaatcagtgaactctcaaatgaaattgcaaccatgaaagcatcaattgaacaagtgagacttgcctctgaacaatcccaagaagaaagtgaagcccaacttgttggttattacaaaactgccaaggaagaagcacagaaaaacttggagtccttaaagaatgaatacgacactgaactcatgcaaagtctagatgccaaacttgctcaaacaagtgctgagattgagtttcttcaagagcagattaagaagctgcatgcttctaagatggattctgtgaggcttctaacttcagagcttaaagaagccacaaagacacttgaggaggttgctgaagaaaagaactcccttaagaaactggtgttttctcttaggacagaattaaagcaagttaagaaggagcaagatgaagtgaaggagaagggacatatagcagaagctcttgctgctaacctcactggtaaactacaagggagcatgagagatgcaaggcctaagccaggcactgttgatgacttagaagcaaatatgttctatgtgcagagtgcgaagattcggaagctacaattggaaactgaaggtgcaataagagaagcagaagagacgaggagaaaagttcaagagctgaagcaagaagttgaaaaatcaagggctgtggctgaagaagcagaggaaaaacttgagctcgttctggtggaggctaaagaggcaaaagcagcagaacaaagagccgttaaagagatgaagattttgtctgaagtgggtagagtcccgtactcaaaattcaatggcaagatcaagatgtcaaatgaagagtttgaggcactgagagcaaaggccaaggagtgtgaggatttggttgaaaagaaagaggcaattgtgatggcagagctgcaggaaatctatgcaagaaagaatgaagtggacagaaaggtggaaactaatctgaaggcaattgaggaaacaaaggctgcagaggagacggctttgtggagtgcagagatggcagattctgcaaaagtggcaattgaaagtgaactgaggaggtggcatcaacaacaacaaaaggtgataccaggtgctgcttctcagaaattggagcattctgcagcaccaatcttgaccatctag

SEQ ID NO: 14615 - DNA, 351 bp, Glycine max
  Peptide Sequence Number=SeqID_131393
atgacgacaatgatggtagtggtgctaaatggtgatgctgacggtagtagcaatagaatgaataatagtcacaacagtagggacaatgatgaaggaggctatggtcatggtaataatggtggtgatgacaaatacaagcggcaacgatatggtagtggaggcgaggtgactacaacaagatgtgataggaaaatagtgggagtgaagacgacaacaacaagatgtgataggaaaatggtgagagtggagacgacaacgatagacggtgaaagaacaaggatgatagtggtggtgctgattatagttgtttcgttcgtccgatctccctctgatttcggtggaaacatctag

SEQ ID NO: 14616 - DNA, 474 bp, Glycine max
  Peptide Sequence Number=SeqID_131394
atgcacttgacacaagagaaaggcaagagaaaattgctccttcaaaagttcattgatctctgcgttgattcgaaagttaaggtggagatgaagctcattgaaggtgacaatgctgccagagccatcgtggaccttgtcgaaaatcttaatataaggaaattggttattggaattactcaatctaatttaaggaaccgtgtccgcgatccatatataaaatctgggtctagaagtcaaaattccatagcggccaaggtattaaaaactgcacagggtagctgtgacataaaaatcatatgcgaaggaagagaagtgatcgaccagatgatgagtgattgcacttcaccacgctccggctccatggacgtcaaagggagttcgagagtttcacagcaaaaaaatgaatcccgtggatttgtccttttaagcattttatgtccagtttatggttatttaggtccatcaccaggatga

SEQ ID NO: 14617 - DNA, 258 bp, Glycine max
  Peptide Sequence Number=SeqID_131395
atgaaggctacatgtggaatcaatttccaaagcaaaggtgttggaactcaaaagaaccctgatgaaagcataggttccttgagtccaacttttgacattagaaagttcaggggtctttgtgaaaagaacatcccaaattttggttgtatataccaaccaaacagggtggtcaaatacaaaaatgaccttttattgtgtaaggattggggtatatgcggaaacaaacaccttaaccaagggtctgttacgtgcaactaa

SEQ ID NO: 14618 - DNA, 228 bp, Glycine max
  Peptide Sequence Number=SeqID_131396
atggcgtcggaagttcgagaaaccgcggggaatttggccggagaagggcggcgaaggttccgaaagaggagagggtgcgtttcgtttgggggagggatcaaaacgacaatgcaggaaaaaagaaaattagtggacagcgaaatggcgaatgatgagagcgtatattctctttcagtaattggtgggatggaaggatttgtctgcagagagtttaaattacttgtttaa

SEQ ID NO: 14619 - DNA, 873 bp, Glycine max
  Peptide Sequence Number=SeqID_131397
atggtagttgaggagcctttgcgaacaacgtttcagaatgttcatcaaggatttgtcactgcaactttaatgcggtttctaaaagcaagggactgggatccttacaaggcacagaaaatgaaaccaattgttcctgctgatttatacagagcggtgcgtgattcacaactcataggattatcaggttactcaagagaggtgctcattctcaaacataatcttttcctcgttccatttcatcatagttgtgctttaattgaaagtgtttgttcatcagaaaatggtctgcctgtctttgcaattggtgttgggcttagcacatttgacaaagcatctgtccattattatgtgcagtcacacattcaaattaatgaatatcgtgagcgtatagtcttgccttctgcatcagagaagcaagggcgacctattaccacttgtataaaggtcttagacatgactggtctgaagttatcagccctgaatcagattaagttgttaactattatatcatccattgatgatctgaactaccctgagaagacaaatacttattacattgtaaatgctccatacatattttcagcttgttggaaggttgtgaagccacttttacaagagaggacaagaagaaaaatacaggtgttaccaggttgtggacgagatgagctgttgactataagagacagtggtgccataaacttatctttaaaactctgccattactttctaccacatgcatgcactttacattgcaataaagccccttaccctcattacccagttgcacttcacggtgcctctgaaactagttgcaaaatgtttcaaacttccaagacatggctattaatcactagaaacaccaacagcagttaa

SEQ ID NO: 14620 - DNA, 954 bp, Glycine max
  Peptide Sequence Number=SeqID_131398
atggacatggacgggcatagaagcagcggcaccggcaccggcgtgtgtgagatagaagaagtggacgagaattcgaacgagaggcaactccatgatgatgatgatgatgatgaagagtactgtgtttatgtagcagtgggtaagagcgacacaagcatggacgctctctcatgggctctcaacaactttgttgctcaatcaccatctaccatcatttatctcattcatgttttccctcagatcaaccacattccaaatccattgtcaaatgtcatcttggacaaggtggccaaaccaagtagaatgatcaaagaacatactccctatggatctaatttgaatccgggtcttgcccctctttcttgggggcttgccgggggaaaaggaatgattccaaggaatcaagtgagtgctgagcagggggagagttatattgaccaaaaaagaggcaagaggagagagctccttcaaaaattcctacaatcatgctctacttccaagataaaacaacaaaattattcagaacaggttaaggtagacaccatcctgattgagagtgactcagttgcaaaggctatcctcgacctgattcccattcttcaaataaaaaggctagtgattggagccaacaaacttcatctaagaaaatcaaaatcaaggagagggaaaggcatagccgatcagatactgcagaatgcaccacaaagttgcaaggtgagaattatatgtgaaaagaaggaagtaaatgagcagatgatgtcattgtcacccttcccacagccgcttgccacttgcacctctgctaatgatgcttctataaccagtaaaaaagaagatcatcaaaacgatttggtttcattgtacatgtgtggttgtatagcagcaaaggacaaagggtatagatgtatagctcagtcaagttctttgactcgtaatgtagctcatcatgaataa

SEQ ID NO: 14621 - DNA, 2121 bp, Glycine max
  Peptide Sequence Number=SeqID_131399
atgaaacgctcaaacgacgacgtcgctgcccccgtccccgcctcaacctccaagccagtgttcctaaccaaagcccaacgcgagcaattggctctccagcgccgccaggaagaagtcgccgaccagaagcgccgccaggagcagctcctctcccgcaaccactcctccgatcccaaaccctcctccgaccgcgacagagacagagaaagagaccgagaccaccaccgagaccgggaccgcgatcgtgacagagacagagaacgcgagcgcgagagggcccgcgatcgggatcgcgaagccgaacggcgcaacagagagagggagcgcgaagaggagagccgggcccgcgaacgcgcccggttggagaaactcgcggagcgtgagcgcgagaaggagcttgagtccatcaaggagcagtacctgggctcgaaaaagccgaagaagcgcgtcatcaagcccagcgagaagttccgtttctccttcgactgggagaacaccgaggacacctcgcgcgacatgaactccctttaccagaacccgcacgaggcccagctcctcttcggccgcgggttccgcgcgggcatggaccgccgcgagcagaagaagctcgccgccaagaacgagaaggacatgcgagaccaaatccggaagaaagacggcctggaggagaggcccgaggaggccgacgcccagcgccgcaaggaggctgccgccgacctatacgacaccttcgacatgcgtgttgaccggcactggagcgagaagaagctggaagagatgacagagagggattggcgtatcttcagagaagactataacatctcctacaagggttccaagattcctcgtcctatgaggagctggaatgagagcaaattgaccaacgagcttctgaaggcggttgagaaggctggctataaaaccccttctcctattcagatggctgccattccacttggtttgcagcagcgtgatgtcattggcattgccgagaccggttccggtaaaaccgccgcctttgtgcttcccatgctgagttacatcacccgccttcctcccataagcgaagacaacgaggctgagggtccctatgctgttgtcatggcccccactcgcgagctcgcgcagcagattgaggatgagactgtcaagtttgctcagtatttgggcatcaaggtcgtctccattgttggtggacagtccattgaggagcaagggtttaagattaggcagggctgtgagattgtcattgccactcctggacgtttgattgattgtttggagcgccgctatgctgtgctcaaccagtgcaactatgttgttcttgatgaggccgatcgtatgattgacatggggtttgagccccaggtgatgggtgtcctcgatgccatgccttccagcaatctcaaaccggagaatgaggatgaggagcttgacgagaagaagatttaccgcaccacctatatgttcagcgccaccatgccacctgctgtggagaggcttgctaggaaatatttgaggaaccctgttgtggtcaccattggcactgctggaaaggcaactgatttgatcagccagcatgtgatcatgatgaaggaggccgagaagttttccaagcttcataggttgcttgatgagcttaacgacaagactgcgattgtgtttgttaacaccaagaagaatgcggatcatgttgccaagaatttggataaggatgggtatcgcgtgactactttgcacggagggaagtcgcaggagcagagggagatcagtcttgaagggtttaggaccaagagatataatgttcttgttgctactgatgttgctggacgtgggattgacatacctgatgtggctcatgtcatcaactatgatatgcctgggaatattgaaatgtacactcaccggattgggcgtactggtcgtgcaggaaagacgggtgtggctaccacattcttgactcttcacgactctgatgtcttctatgacctcaagcagatgcttattcaaagtaacagtcctgttccacctgaactggcaaggcacgaagcttcaaaattcaagccaggaactattccagacagaccacctagacgaaatgacactgtttttgcgcattag

SEQ ID NO: 14622 - DNA, 2958 bp, Glycine max
  Peptide Sequence Number=SeqID_131400
atgaagctcgtggttcgtgtgattgaggcaaaaaacttggcaacgtcggattccaatgggttaagtgatttgtacgtgcgggtacagttgggaaaacaaaagttcaagaccaaagtggttaaaagtttgaatccaacgtgggatgaacaatttgctttttgggttgacgatcttaaagattcacttgttatctctgtgatggatgaagataagttctttaattatgactatgtgggaaggcttaaggtgcctatttcacttgtttttgaagaggaaattaaatcccttggcactgcttggtattttttgaaatccaaaaacaagaagtgcaagaacaagcaatgtggtgagattcatttgagtatattcatttaccaaaataattcctctggggagttaaatgacattggtgaacagttattacctccaagaaaatgtcctgatgcagttaccacttctccttcaatgtcttccactggcttttcaaacttgttttctcctgtaagggaagaaactacatcttgcagttctaaggaggagaaatcttgtacacaacaaaaatcatttactgaccgaattgctcaaatttttaataaaggttctgatgtgtcttcaatgtcactcagcagaagtattgacttagaccaatctgtaacaaacaaagctgtagttggtgagatcaagattgaggaagatcagtcgtctaatgagactttcgaagaaactatgaaagaaatacagtctgcagatcaaggaagtgaaattcctaacaatttattgggaggagtgcttattgatcaattatatattgttgcaccagaagacttgaatgtattactattttcacctgattctaattttcccaagtcattatctgatgaacagggtattacagaactgcaaatttgtccttggaagttagagaatggcggggagacattgaaaagatcacttacttacatcaaggctgccactaaattaattaaggctgtcaaagcctatgaggaccagacatatttaaaagctgatgggaagaaatttgctgttttggccagtgtcagcaccccagatgttatgtatggcagcacctttagggtagaagtactttatgtgatcacacctggaccagagttgccatcaggggaacagtgttcgcgtctggtgatatcttggcaaataaactttttacagagcaccatgatgaaaggaatgatagaaagtggagctcggcaaggtatgaaggacagctttgatcagtatgccagtttgttatgtcagactgtaaaggcagttgtctcaaaggatcttggttctagtaaggaacaagctttggcaacattacggccagagccccagtcaatcttgaagctggcagggcagtatttagctaactttacagtcttcacaacattcttaatggtatcatacgtgcttgtccatatttggctggcagcacctggcacaattcaagggcttgagtttgtttggtttgacttaccagattctattggtgaatttgttgtgtgtattgccttggttcttcaaggtgaaagagtgttgggtttaatctcacgcttcatgcaggccagagccagagcacgaaagggtagtgatcatggaattaaggcacaaggagaaggatggatgctaactgtggccttaattgaaggaagcaatttagctactgttgattctagtgcattctgtgatccatatgtggtgtttagttgcaatgggaaaacaagaaccagctcaattaagttcaagaaatctgatgctttatggaatgaaatatttgaatttgatgcgatggatgaccctccttctgtgctggatgtggaagtttatgattttgatggaccctgtgatggagctgcatctctcggacatgttgaaatcaatttccttaaaacaaacatctcagatcttgctgatatatgggtttctcttgaaggaaagttggctttggcatgtcattctaagttgcacttgaaaattttcttgaacaacactagaggtggggatgttgtaaaacactacataagtaaaatggagaaagaggtggggacgaagattaatttgcggtctcctcaaacaaattcagcctttcagaaactctttgggcttccacctgaggaatttctcatcaatgacttcacctgtcatttgaaaagaaaaatgcccctgcagggccgcctatttgtttcagcaagaataattggatttcatgcaaatttgtttggacataagacaaaattctttttcctttgggaggacattgaggacgtccaaatcattccacctacattttcatcgatgggcagtccgataattgttataactctttggccaggaagaggtgtggatgcaaggcatggtgcaaaaactcaagatgaggaaggcagactgaaattccgtttccagtcctttgtgtctttcaatgttgcaaacagcatcattttgaatttaatcggagaggctgtttctgctggaaattataagagtcaatgcactaggactatcatggctctctggaaggccagatccttgagtcccgagcaaaaggtcaagttagttgaagaagactctgaaactaaaagccttagaagcgaggagagtgggtcgttcattggccttggtgatgtcagcatgtctgaggccagtttttttatggagctatttagtgggggtgagttggatcgtatgttcatggaaaaatctggttgtgttaattattcttataccccttgggtgtctgagaacagtgatgtatatgagagggcaatatattacaaatttgagaagcgaatttcacgttatagagttgaagtaacgagcacccagcaaagatctcttttggaaggaaagggttggctgttgaaagaggttaagaacttccatggagttccccttggtgactttttcaatgtaagcaagtcaaatttagcttgttcctag

SEQ ID NO: 14623 - DNA, 394 bp, Glycine max
  Peptide Sequence Number=SeqID_131401
atggcggcattttttgccccaccgctgcacacccaattccctacccttctaaccagttgcgactttgatatcgcagctctgatctcgcatcttcgactctgcaaatcttctctaaagcctcatcgacatcctcgccatgaactgcatcaaaatcttcatatagctaaaaccaatctgtttcaaggggagggggaagagatattggaatacagatctcaagtgataaactttgtgtacaagaacgtcatcggtgccggagagatctcgacgacagtgacaagaatgatctcatggaagaaaaaattgtcatcagaggtggtgggtggtgatggggtcgccggaagcgatagaagggccgccgaaaatggtggagagagagggaaggagaatgagg

SEQ ID NO: 14624 - DNA, 4389 bp, Glycine max
  Peptide Sequence Number=SeqID_131402
atggctaattggaattgtgagctcagagtgattgtgtctgtcaagtgcaaatcattccacatgcttaagttgttaggagaatgcctagcaattgtgaaagcccttcaagctcagtgtgcacaaagctcaaacctggcactacatccattgctccttcgtggcagtgaggaggagctggtgaatttactgaaagatgataatgatacaattcaggaaggtgttctaaatgttttagcaaaggctggtggtactattcgtgaacaacttgcagtcacatcaagttctgtagaccttatattggagagactatgtttagaaggcagtcggaggcaggcaaagtatgctgtccatgcactggctgcaataactaaggatgatggcctcaagatgagccttggtgtgatggtaatgttactgccttgtgacctggaggtctcgggttcaaatcctggagatagcctctatgctttcagtgataaggctgcctataaacttgtagatatgctggaagataaaacacatctgcctgcagtacttcagtctctggggtgtattgcgcagacagcaatgcctgtctatgaaaccagagagaatgaaattgtagaatttatactaaacaagattctaaaaagtgatagtaaagaagataacatgaaaacttcttgggatgataaaagtgatctttgtatgttgaagatatatggcattaaagcatttgtgaagagctacttgccagtcaaagatgctcatattcgtccaaatattgacagtcttctggatatccttaggaatattttattgtatggtgaaatatcgaaggatctaaaatcaagttcagttgatatggcccatttgaagcttgcttctgcaaaggcagttcttcgtttgtctagactttgggatcacaagatacctgttgatctttttcacttaactttaagggtgtctgagattagttttcctcaagctaagaagattttcttgagtaaaattcaccaatatatcaaagaccgccttttggatgccaaatatgggtgtgctttcttattcaacatatttggatccaagccagatgagtttgcagaggataaacagaacctctttgacattattcaaatgtaccaccagttgaaggcacggcaactttctgtgcagtcagatgcaaattccttgatcacttaccctgaatatattcttccatacctagttcatgctcttgctcacaattcatgtcccaatgttgatgattgcgaggatgttggagcatatgatgatatataccggcagttgcacctaatactgtcaatgctactgcaaagagaagaagatgctaagtcagaagtaactactgacaaagagaaggaacttatatctactatcacttctatctttctgagtatcaagcattctgaagacatggttgacacatcaaagtcaaagaattctcatgcattatgtgagcttggtttagcaattaccaaacgcttagtgcagaaggatgttgatttgcaaggattgtcccatttggtttctctacctccattgctatacaaagcatctgagaaggaaggagatgacactttggaaaaaacatttccttccaattatgcatcttcttcctattgcttgattgatgtgattagggtaactgaagttaaaagctggttggctgatgaaagttccttgacccactttgaatctcttgaactagaaatggttcaatcccaatcagcagaggatgaagcttctaaggaagatgaaaaagatggaaatgaaatacctttgcgaaagatgctaaagaacataaaatctcagggaaccagtggcaaaaaggtgaaaaggaataagtctgtgccagctgaaacaaaaaaggctgaaaatgattttgacatcttaaatatggtcagagaaattaatgtggataacttggagacccccactaattttgaaccaagtaatggccatgaccattctttgagtaagaaggagctgaaggatccagagtctgcaacaggcaaaaagagaaaagctagagaaacaacacctgctccagtgcctaaacgtaggcggtcttcttctgctcatggaaaattgagattatcgactagtatatcaaaggcatctcgaagagtttcaggagaagactcccctcaacccaaattactgcttgatgaagaagttaaccctgatgcagatagcaaaaccatgcagagaaaaatggtcaaaggaagtgagaaagatttgtcattatcctcattaaaacgaaaagttaagggttctgacagttaccataatgatgagttgaacaaacatgatgaacttgacatgatgagtcctgatagtacacaactaagtgataagactgtaggaaacaataacaagtcttccacaggatccgctaaaaaggggaaaagaaaaagtatttcaggattggctaagtgcatgacaaaagaaggtgaaattgatactgaagatctaattggctgcagaattaaagtttggtggcctacagataagaagctttctgaagatagagaaagtgtcccacaaggtagttctgaagagaaagaagtggatgaatcaagtggagctttgaggcaaaatattaatggagaagaagaatctgattctgaagggcatcatgataacagcgatgctggcagtaatcctagagaaatggagaaatcacatctagagccatcaaaaagtccccatgatgatgacaacaaaacaatccctgagatttctgatgacgtgcctctggtaaacaactcagccgttgcatcactcatagtaaatggaagtgtaggacggggaagaaaagctcagggaaagaacaatgagcagtttagctattgttatttgtctgtcaagaatgcagcggagttgatgctgtggtacaagtacagtataatggacgaacaattgaggatactaaaagtcattgttgtgcaaggcaaaaaattagtgatccgggattcaagagcagtgacccttatgttgttgtcaagctggggaatcagggtcattcattgttgcttgaatcctgtctggaatgaagagctgaatttcactgtgacagaacctttgggagttctgaatttggaagtatttgataaagattttttgaaggctgatgacaagatgggaaatagttatctgaaccttcaaccattaaactctgcagccagattaagagatattttaaaggtgtcttctggtgagacaacattgaggaaggtgacaccggacagtgaaaactgtcttgctcgtgaaagcagtatcaattgtgttaatgacatcaaaaggccttctttcctcatttcggacgcacgctccccatccatgtctacttgtgtaaaatcccgagatgtttgtattgttggtgttgcacggacgccaataggtggtttacttggcaccctatcatctctttctgccacagagttaggctcaattgctattaagactgctctcaagagagcaaatgttgatccatcactcgtgcaagaggtgttttttgggaatgttcttagtgccaatttagggcaggctcctgccagacaggctgcattaggtgcaggaattcctacatctgtaatctgcactactattaacaaggtctgtgcatcagggatgaaagctaccatgcttgcagcactcaccatacaattcggtctcaatgatgttgttgtggctggtggtatggaaagcatgtcaaatgcacctaagtacattgcggaggccaggaaagggtctcggtatggacatgataccatcatgatggactcttatgccattcgaagctttgagagaggaatatctgcccaaaatgctggtcattttgcttgggagatagttccggttgaagtttccactggaagagggagggcttccaaaattgttgataaagatgaaggcctggggaagtttgatgctgcaaagttaaggaagcttagaccaagctttaaagaggtcgggggttctgtgactgctggcaatgcttctagcataagggttgtctcgtctcgttgcaagaagtttgctaataaattaatacttatgccttgcaatagttatggttctaaactgcatgctcttctgctgataatggattggtttattggcttgactagtgatggtgctgctgcattagtgctagtgagcgaagagaaggcacgtgagcttggattgcatgtaattgcaaagataaaaggatatggggatgcagctaaggcgcctgaattatttacaactgctccttcccttgcaataccaaaagctatatcaaatgctggtcttgatgcttctcaaatagattattatgaaataaatgaagctttttcggttgtagctcttgcaaatcagaagcttcttggtcttgatcct

SEQ ID NO: 14625 - DNA, 732 bp, Glycine max
  Peptide Sequence Number=SeqID_131403
atggaaactggaggcttcacggctaccgcaagctccccaacaccaccgctgtattactcttatcaagaaagcaagcagggcaagttgaaggtctcaagtctcaggttgaagctgtcagtgtcagacatgaacatgaggcagcaggtagcatcatcagatcacagtgcagccacaggagaggagaacgaatgcacggtgagggagcaagacaggttcatgccaatcgccaacgtgattaggatcatgcgcaagattctccctccacacgcaaaaatctcggacgatgcaaaagaaacaatccaagagtgcgtgtctgagtacatcagcttcatcacaggtgaggcgaacgagcgttgccagagggagcagcggaagaccataaccgcagaggacgtgctttgggccatgagcaagcttggattcgacgactacatcgaaccgttgaccatgtaccttcaccgctaccgtgaacttgagggtgaccgcacctctatgaggggtgaaccactcgggaagaggactgtggaatacgccacgcttggtgttgctactgcttttgtccctccaccctatcatcaccacaatgggtactttggtgctgccatgcccatggggacttacgttagggaagcgccaccaaatacagcctcctcccatcaccaccaccaccaccaccaccaccatgctcgtggaatctccaatgctcatgaaccaaatgctcgctccatataa

SEQ ID NO: 14626 - DNA, 1425 bp, Glycine max
  Peptide Sequence Number=SeqID_131404
atggagtatgtgaaatctggagagctctttgattacatagtagagaagggtcggctgcaagaggatgaagcccgtcatttttttcagcagtactgtcacaggaatatggtggttcatagagacctgaagcctgagaatttactcttggactcaaaatttaacatcaagattgctgattttgggttgagcaacatcatgcgtgatggtcactttcttaagacaagttgtggaagccctaattatgcggctccagaggttatctctggaaaattgtatgctggaccagaagtagatgtctggagctgtggtgtaattttatatgctcttctctgtggcactcttccttttgatgatgaaaacattcccaatctcttcaaaaaaataaagaagattcctgatttgatgggatgggtccaggttccaaaggatagactattggtcatagggacattagagaggaaatcaatatctctagacaaagagggtgggatatacactcttcctagtcatctatcacctggtgctagagatttgataccaaggatgcttgtggtggatcccatgaagaggatgaccatacctgagatacgccaacacccatggttccaagttcatctaccgcgttatttagcagtgccaccaccagatacactgcaacaagccaaaaagattgatgaggagattcttcaggaagtggttaatatgggatttgacaggaatcaattggttgaatctcttagcaacaggatacaaaatgagggtactgtaacatactatttgttattggacaaccggtttcgtgtttctagtggttatcttggagctgaatttcaagagacaatggattctggttttaaccgtatgcattccggcgaagttgcttctccagttgttggacaccacagcacagggtatatggattatcaaggggtaggaatgcggcaacagttccctgttgagagaaaatgggcccttgggcttcagtctcgagcccaaccacgtgaaataatgactgaggtccttaaagctctacaagaattaaatgtttgttggaagaagattggacactataacatgaagtgcagatgggttgctggcactgctggtcatcatgaaggaatgattaacaattctctgcatagtaatcattactttggaaatgattccggcattattgaaaatgaagctgtttctaagtcaaatgtggtcaagtttgaagtgcagggtccagggcccacagtttcttttcttggatctgtgcgctgctttcctttcacagctacgtgttctctagtgaagctcacaagtcgcaaaggagaccttgagctgcttgatccatgtggtggcatgtattgctatgtgatgactgatgagtatattttccgggaagacttaatgagttatatgattcaccaagctgcttga

SEQ ID NO: 14627 - DNA, 165 bp, Glycine max
  Peptide Sequence Number=SeqID_131405
atgaaggtagtcctttacaagacattggaaactggctttgacaggctgcaattaaagcgggctaggggtgagcgcaactggcgtggctttccaacacactccctcatgcccaaggctatgggtcttgagcatggcaatacaagtggcccaacgagtcttggatag

SEQ ID NO: 14628 - DNA, 1239 bp, Glycine max
  Peptide Sequence Number=SeqID_131406
atggcaaggaagagaaaggttgctgaagtcgtggaagagagagacctatgtgagggaaccttgggttgggatgagatgatgaaacaagctgcagcacttggaggagtgcaaagagccaggaagaggtttgttggtgtaaggcaaaggccatcaggtagatgggtggctgagatcaaagacaccattcagaagataagagtgtggctgggaacttttgacactgctgaggaagctgcaagagcctatgatgaggctgcttgcttgcttcgtggcaccaacacaaggactaacttctggccttgttctcaatcctccacaagtccagctctttcctcaaagatcaccaatctcctccttcaaaggcttaaagaaaggaacaacaacaacacttgttcctcgtcctcgtcctcctccacttcacttctcatcaaccaccaacaaatgcatcagcaagttggtgcatatggagaaggttcaacacaattctcaattgaccaattcactgatttcctcaatgaccctgaagattatagcacaagcaacaatgacttcatcaacaacagtgcacaaattgactacattactagtagctttgaatcatgcttaactgaaaaagatggtgggactaaaattgatatgcaatacaaatccaggaatgtgacaccacagacttcaagcaatgacagcaattcaggagtggaggatagtgaagaagaaggctctgatttgggtgtgcaaagcacaaatttggatgtccatgattttaagtttttggacaacattgctccacctagttactactctccctttgagatggctgaagagatggaggaggagcctgtggagcctgagaatgagaactatggcgatgagccttcaatgcttagagctgtgatgaagagaatgacttatgagaggaagttctcagcttctctctatgccttcaatggaatacctgaatgcttgaagttgaaacttgaatcagggaacatgaagggaagaggactagctgatcaattaacaagccttcaaatggcttgtagcaaaaacatactcgagaagaacaaggaggagaaagaatacattggaacaatggataggagacaggaagaagaacaccaacaaacatcacctgacatggattcttcaagtgttgatggggaactgttgctttggaattcacttgatcttcctcctatttgctttgttaacttgctagaaaacggttcattcaattag

SEQ ID NO: 14629 - DNA, 132 bp, Glycine max
  Peptide Sequence Number=SeqID_131407
atgaagctctcagatatttcagcacatgtagtgaaggaatcaatcaacagcttcgtcatcaagaaacttgtggcttcgtcatcagtaacttcactgtataaagaaaccaaacaaaaagaattgttaatataa

SEQ ID NO: 14630 - DNA, 300 bp, Glycine max
  Peptide Sequence Number=SeqID_131408
atgtctttctttgagaagtcagatctattatttgtgtgtctgttgcgccctctttcttttagcattcaaatacaagaggtagagatagaggttgcaaattggatgcccttcgacgaatatgcagcccaaacatttatggaaaagtttgagcttctgaagtacaccaatgatatctacttggcaaagattgatggacaatatttcggatttactcctgtatccattacatcgaacttctttgagaacaagaactatctttacttgaatgttggaggcctaaagatgtgcaaatctttgtaa

SEQ ID NO: 14631 - DNA, 321 bp, Glycine max
  Peptide Sequence Number=SeqID_131409
atgaacaaacggcatacatataacataaaaatcacctccttcagccagcgtgatctcgctctctcttcctttttcacctatggctcgaaacaagggtaccaacatgttgtggttttgaaaaatactaaagttgtggatgaagatactgttgaggctttacaacaactgcctcgacgaacaattagcggaacaaaccagcaacaatacagacagcaagcaggcacaagtgacattatgcagcaagcagacagggtgcttgacacgaatcagaggcctaaaaggaaaaccactaagcctcagcacctcaaggattttgtataa

SEQ ID NO: 14632 - DNA, 834 bp, Glycine max
  Peptide Sequence Number=SeqID_131410
atgggcaatgtgaacgtgactcctgaagaagaagaagtttctgcaagtgcaagggcaaccgatgagaacgccatgcctcagtctcctcccacctctcctacggctatccatttccccctcatattcgctcctcaggttccggtggttccgctacaaagacctgatgagatgcatgttccaagttgttcctggatggagacaacttcagggtatgaagatgtgtaccgcgaagtaggaattccaacagtgattacttggagttatgatggaaaggaagtagctgtggagggatcgtgggataattggaaaacaagattcttatattccttgttcatcagaatgcccctggagagatcagggaaggactttgcaataatgaaggttctgccatctggtgtttacctgtacagatttattgtggatggacggatgaggtacactccagactcgccttgggcccaagatgatgctggggatgcttacaacatcttggacttacaggattatgttcctgaagacattggaagcatttctagttttgagcctcctcaatcaccagactcgagttatgataacttatatcttagttctgaagattatgctaaggagccacctttagttcctccactcttgcaaatgacactgctaaatgtgcctgcaacaaatatgaaaatccaacctcctatgtcaagacctcgacatggagtgctgaatcatctttacgcacagaaaggaaagagcagtccttcagtggttggccttggtacaactcatcggtttctagccaaatatgtcactgttgtgctgtacaagtcgttgcaaggtaaaccataa

SEQ ID NO: 14633 - DNA, 99 bp, Glycine max
  Peptide Sequence Number=SeqID_131411
atgggactacagggaagaagtgtgtgcaacgggtttccaacaccaaaattttcgtggcaagtacatggcattagggttgctactacattttacggtggg

SEQ ID NO: 14634 - DNA, 1944 bp, Glycine max
  Peptide Sequence Number=SeqID_131412
atgggttgcataagctccaagaatgcggttgccagaacttgttctccgtcgcccgcagtactcgacattgcagagccgaaccccgcttatgccaagggccattcctggttgccggttttggaatccaaaacgggttcagaggatgagaggagcaatagcaagttcaggaagaacagttcaaagaagagtagtgggtctttcagcttcaggcatgtggaggctgaacagaatgctgctggttggcccccttggctcatagctactgcagcagaagccattcaaggatggatccctctcaaagctgattcttttcaaaagttggaaaagattggagaaggtacatatagcagtgtgttccgagcacgtgaagttgaaactgggaagatgtttgctttgaagaaggtgcgctttgacaatttccaacctgagagcattaggttcatggcaagagaaataacaatcctccgcaggcttgatcacccaaacatcatgaaattggaaggcataatcacttctcgcctatcaaacagcatatatcttgtgtttgaatacatggagcatgatcttgctggcctagtatcacgtcctgatattgtgttctccgaatcacagataaaatgttacatgaggcaactattaagtggacttgagcattgtcatatgcgtggcatcatgcatagagacatcaaattatcaaatatcttgttgaacaatgaaggtgttctcaagataggagattttggattagcaaatacaattagcacaaatagcaagcatcatttgacaagtcgcgtagtgactttgtggtatcgccctcctgagctcttgatgggatcaaccaactatggagtgtcagtggatctgtggagtgtgggctgtgtatttgcagaactttttcttgggaagcctatccttaaggggagaactgaggttgaacaattacacaaaatttttaagctgtgtggttctccacctgaggagttctggaaaaagactaagcttcctcatgcaacaatgtttaaacctcagactaattatgaaagctctcttcgggagaggtgtgcagattttcctgcatctgctgtaaatctactcgagactttattgtcgattgatccaggcaaccgagggactgcctcatctgccctaatgtctgagtatttcagcaccaagccatatgcttgtaatgcatcaagcctgccaaagtatccacctagcaaagaaatggatgccaaaagtatgggagattcatccaggtctagtcttaatgcaatgattagattgctaccttgtgacatgaaagtcatgggtttaaatcttgaaaagagccttttcatttgcgagaataagagcttgtgtactctcaggaaaaagactggaggtaaaatgagagaggttgcaacatcaagaaggcagcaaagacgggacacgcagaacatttctgaaaatgctcgtagagatgatggtaaagcacatcttacaaagggaaaaggaggggccatgcacaaagattatacaaagtctcatttggatgctatgtctgagacctcccaaatgaatgttgctaatggtaatggctatagtgtgggatctaataatacctttacatgggtaaaaaggagaaaacaagatgcatcttcaactctatcagatggatcaagaagcaaaattagtgcactggatccaaactttgcaaaacgcacatatgacttaaccacactcagggtgtccatggatttagatcctgaagaactgatgaatgctcagggtgacagagggcgtgctgttcgtaaatcaagatttggaagagttactattggcactactgatagagggttatccaaagagcataaggacctagaagtacttcatgagttgaagggtccaaagacaaggtccaaagtcaagcttctagaaagagatggtcaagaggatcaaggatga

SEQ ID NO: 14635 - DNA, 231 bp, Glycine max
  Peptide Sequence Number=SeqID_131413
atggcacacacaacggggatggaggtggcgtcattgccaccaacaacgatgggtggtggtggtttccctccacgagctttgtgttcttcccacataatgatgaatctaacttcaatctccaaatccaatggagctaagtctcatgctggagttttacctcgcatacaagaagcaagctactacagagcagttaaccaagacaagagattaaatcaaattgaaaatagttga

SEQ ID NO: 14636 - DNA, 588 bp, Glycine max
  Peptide Sequence Number=SeqID_131414
atggcttggattgcatcaactactcacgtgagtaagtttttagtccgctccacaacacatctttcccatgaagatccaagttcagatattgttttcttagggcactactattctgcctcacctctatcataccgatggccccaagatcttgacgggtggtgtgacgcacacgaatgggagggggattcaatctctacccagaaggtcttctgggagtgtcagaccctccaagactaccgccacacctcagatgtagacaagatcctcctcgacaacggcaatgccttcggcagcaatgatgactctgtcttcgtctaccgtgatgatgccaccaaggaagagatgcaagagcagtgcgagtcaaattggctaagcgagttttatccgcttagcgaggaagtcagctcgctaagcgagtacaaaaccctagagaatgcggagtcagtgagtagcacacttagcacgcaaccaacctgccaaatgaaaattttgtctcttctcgcgcttagcgcgtccaagccgcttagcagccagccactaactctcgctcagcgagacatgttggctgagcacgccttcgtaagctga

SEQ ID NO: 14637 - DNA, 558 bp, Glycine max
  Peptide Sequence Number=SeqID_131415
atgtggaactccgccgagaacgccttcgccagatcgccgtctttcagggaggaaggggaggatgaggaggcgctgcgctgggcggcgctccagaggctcccgacgtataagcgagcgcgccgtggaatcttcaagaatgtcattggcgacatgaaagagatcgacgtcagagatctccaggcgcaggagcagcgccttcttcttcaaaggctcgttgactgtgtcgacaacgatcctgagagagtagctttggagtttccgaagatcgaagttcgatttcagaacttgaccgttgagacttacgtacatgtcggtagcagagctctgcctacgattcccaatttcatttgcaatatgactgaggctcttttaagacagttgcggatatacagaaggaagagaagcaaattgacaattcttgcagacatcagtgggattattagaccttcaaggctaacgttgctattgggtccaccaagctctggaaaaacaacactactattggctcttgctggtaggctaggacctggtttgcagaagtcgacaatgacattgtaa

SEQ ID NO: 14638 - DNA, 669 bp, Glycine max
  Peptide Sequence Number=SeqID_131416
atgtctgagctgtttgttttcattgaaccaagtccatggttaacccaaaatctcaagcttccctctcggcgaccttctgttgtatgtgagaattgcctgtactctctagagagagatatgcgagcaagagcctttcacattttggagccaaaaggcactgtagatatgcttatcctcttcctagaggaaagaagtgatggggctcctcctctacttgatagttatagggatgcgaagagtaggattataccttttcttggtaaatggaaaggtcattccatcacaaaacgaagtggtgtgtatggatctacaattgctaatgctgatactgttgtgttgcacgatatggatgacaatggccaacttatgcaggatgttacttcaagttcaacttttgatggggaaaatgttactaccaatgtgcattggactggcacagtatcagactatttggttacatttgatggaggttatcagatgatactattacccggtggcatgtacatggggtgcccttgtgatgtagcaaaaagtgtggcagaatcaaaatcgttccatttggagttctgttggttggagacacctgacaagaggcaaaggcttgttcgcacgtatgatgtgcaaggcttggctgtctcatctacttattttcttgagaccaaattgtga

SEQ ID NO: 14639 - DNA, 246 bp, Glycine max
  Peptide Sequence Number=SeqID_131417
atggtgtttgcttgtcgggacactactcgtagtcacgaagttcctgctgaagaaagtggctttaaaagtaagttctactactcttttgatgctgggggcatacactttatcatgttgggagcatatgttgattacaatagcactggtgcacagtttgcttggctgaagaaagatctgctaagtgtagacggtagtgtaattatatatacacaccacaatgacacaaacaagagaatcaagatctga

SEQ ID NO: 14640 - DNA, 639 bp, Glycine max
  Peptide Sequence Number=SeqID_131418
atgaaaatctgcaccacctttttcatgccactggccatggttttggtgatgatggcagtggctgagagtcacattcccaccactttggatggcccatttgacccagttacccaccggttcgacccatcactgcgacaggacagtgaggacttgcctgtgactcatccaaggctcagaaagaatgtcacttcaaacttcgctgaacagattgctcttgcaatttcttcaccaacttccatgtgggtttcttgggttactggggatgcacagattggcctgaatgtgaccccgatagattctgcatctgttgaaagtgaggtgtggtatgggaaagagagtggaaagtacataagtgttaggaaaggtgattctgttgtttacagtctgttgtatccctttgaaggcctgtggaattacacctctggtatcattcaccatgtgaaactcaaaggtcttgaacctagcaccagatattattacaaatgtggggatagttctacaccagcaatgagccgagagtttatttttgagacttttccaaaacctagtccaaataattatccagctcgaatagcagttattggagatttgggcctcacaagcaattcaacatcaactattgatcatctaaaattctaa

SEQ ID NO: 14641 - DNA, 306 bp, Glycine max
  Peptide Sequence Number=SeqID_131419
atgattatgttaagagttttccttaattcagagcaaaagggacaaggggtgttcggtgacaggatcccatctaagctgaacttatccaagaggcaaatacatctcgaagaccaagatttattatgtgtgttttgtcatgagagagtggaggacacatctcacgtgttctttatttacactgtgactcaacaactttggtggagatggtacaacttgcttggcttctcaatggctcaccctcaatcagccgaggcacactttcggcagaattcgtgtgggctcttgggagctaaatctaaggattga

SEQ ID NO: 14642 - DNA, 795 bp, Glycine max
  Peptide Sequence Number=SeqID_131420
atgggtgaagaaaagaaagacgaaggaaacaaagaagaagccaaagaggaaaagaaggaagaagagaagaaagaggagccaccaccggaaatagtgctcaaagttgatatgcattgtgaggcctgtgcaaggaaagttgcaaaagcattgaaaggattccaaggagtggaagaggtgagtgcggatagcaggacaagcaaagtggtagtgaaaggaaaggcagcagaccccataaaggtgtgtgagaggctacaaaagaaaagtggtaagaaagtggagctgatttcacccttgccaaaacctccagaggagaaagaagaaccacccaaagaagaaccaccaaaagaggagaaaaaatatgagttttgcattgcaatccaatccagggtgagtgctgacatgaaagtaacgaaacaaagcgatgtccctccgaaaggcacacgtaacgaggggaacggcggagtagaatcagtggaaacagacttggcaaatgatcaagttatagtaaaaggtgtggtcgaccctgccaagcttgttgatcatgtatataagaggaccaaaaagcaagcctctattgtgaaggacggagaaaagaaggaagaagaaaagaaagaagaggagaaaaaggaagagaaagaagaagagaaaagaggtgaagaagaaaacaagggaggagaagataacaaaactgaaatcaaacgaagtgaatactggccatccaaaaactacatcgactatgcttatgaccccgagattttcagcgacgagaacccaaatgcctgctctgttatgtaa

SEQ ID NO: 14643 - DNA, 210 bp, Glycine max
  Peptide Sequence Number=SeqID_131421
atgaaagatggggtggatttgattccaatatcaagccgcaatgcaaagcctccaagtgttgaattgtgggcagttcttgatgtccctccattcactatcaggtctcttttgtgcttcaatcaacttcctggaatcttctaccacttattctgcaatgcaaagcctccaggtgttgaattgtgggcagttcttgatgtccctgtacattag

SEQ ID NO: 14644 - DNA, 255 bp, Glycine max
  Peptide Sequence Number=SeqID_131422
atggagactctgttggatgacgctttgtctataagcgtggcgttcagtgaatgcaacttatcactgttggagaaaaaactaccaaaggttcttaagtgtgaagtggtttttggggttccatgccaaacatataagcagcccccaacaaggttttgggcctgcaagtattacctaccatttgatattaggacaatgccatatttggaagttagtggtttaagtggtgacggtgaactaaagggacttgagttctag

SEQ ID NO: 14645 - DNA, 102 bp, Glycine max
  Peptide Sequence Number=SeqID_131423
atgcaagcaagagcctcactagtcatttctttaggtgagaaagtggatttggaatctcaggctactgacagaaacatggtacttgctaaagggaaccaatga

SEQ ID NO: 14646 - DNA, 246 bp, Glycine max
  Peptide Sequence Number=SeqID_131424
atgttaggaagaatgtacgtgatagtagtaaggaagaaacaagatagggctagcttcggatgtacggccaagagtggaatcttgttttgcagctctatgaccagtttggtttattcatcacaggaaggagaaatggaagatggaaacacttgctatggcatgctacgtgttggtgtatgtggaatgctaggaacaacatcgatatcatttgtccggaccaacagtttgatggctcacagattttag

SEQ ID NO: 14647 - DNA, 1815 bp, Glycine max
  Peptide Sequence Number=SeqID_131425
atggccgatttggagaatttgcttttggaggctgcggggagaactggtacagctggtagaaatcgtcattctcttccaccttcaaggagacgacatgatggcgcctattcagatggtgggagtgattatagggatgacgattcagatgatgaactcaattatgcaagcagaaagccctctggatcacaagttcctctgaagaaaagactagatccaacagaaagagatgatgatttaggcagtcaggaagaagcagatgatgatggtcgcaacgatcatgatggtgatagcagtgatgaatcaaatattggcgatgatctctacaaggatgaggatgacaggcgaaagctttctgagatgactgaacttcaaagagagatgatcttatcagacagggctacaaaaaaggatgataaaaatgtgttgggaaagatagcatcaaagcgtgagaaaggaaaggcagcagcacccagaaaacagtctccccccatgtcgtcatcgcgcatgtgtgcatcagccagatctgctgacaggtcagccaagaatgatgcgttaaatgaattgcgtgcaaagcgattgaaacagcaagatccggaagctcaccggagactgagagaggcatcaagaaatgcaggtccccggcatttttctccaccaaagcgcaaaacgttcacatcaacaagtctcagtagttcaagtcatagtgagagtgaaagtaggtcccatagtgatgatgaagggtcaattggggatggaggaattgctgacagtgatgatgacagggcactagctgggtctgagggtccatcctttcagaatataaaggaaataactattcgcagatcaaaacttgccaaatggtttatgaagcctttctttgaggagttaatagttggttgctttgtaagagtgggaattggtagatcaaaaactggaccaatctaccgactctgcatggtgaaaaatgttgatgcttcagaacctgatcgacagtataaattagaaaataaaactacctacaagtatttgaatgttgtttggggaaatgaaagttctgctgctaggtggcaaatggctatggttagtgactctgctccaattgaagaggagttcaaacagtgggttaaggaagtagattgcagtggcgtccggatgccaaagaaaaagtctgcctcaacaaggccactgaatgttgctgctgagaaggatcggctgaggagggaattggaaatagcacaaagtaagcatgatgaggcagaagtggagaggatcaagacaagactgcaagaattagaggcatcgagacaagcaaagcagaaggatgccaaggcattgaaactggctgagatgaatagaaaaaacaggtttgagaacttcaagaatgcttctgaattgaagccagtgaatataggtttgaaagcaggggaggcaggttatgatccattttcaaggagatggactagatcaaggaattactatgctgcaaaacctggtgaaaaggctgcagctggaaataatattgtcaatggcaatgtggctggtgctggcagcaatggaacaggagcaccagtgacagtcgaggctggcatggtggctatcgctgctgccgtggatacaagtgctcccgtggatcaagggacagagtcaaatatgctgcacaatttcgagctgccaatttcattagcattacttcaaaagtatggtggggctccaggagctcaggcaggatttatggcaagaaaacaaagaatagaatcaacagttggatttagagtctctgaaaatgatggtaggaggcatgcgttgacgctgaca

SEQ ID NO: 14648 - DNA, 228 bp, Glycine max
  Peptide Sequence Number=SeqID_131426
atggaaaccttcaaatccattttcagtggcttccacatacaagcatttacaaacaaccatcctagagcagcaacaagtagccagtcacacaatcttcaagaagttttggcactcagaggttccctcaaagcggtatggttattatggaatgctagaaatggcatcctgtttagagaacaaacttctgatggtgctgcaatcttagagactatcagatctttttcatga

SEQ ID NO: 14649 - DNA, 1632 bp, Glycine max
  Peptide Sequence Number=SeqID_131427
atggggtgtgtggttgcgaagcaggcggtgtcagtgacgcctgcaattgagcactcggttgagtcggagaagaacaggaagaagaagactgagtcagtgggggcaagtaggagcgagttgggtgagtcggggagagcgagttccaatggtggaagtgagtctctgagcttcaggttgggaaacctgagcaagtacgtggagggagagcaggcggcggcgggatggccggcgtggctcagcgccgtcgcgtgtgaggccattcacggttgggtgcctctccgagctgacgcgtttgagaaacttgataagattgggcagggtacatatagcagtgttttccgagcaaaggagattcagaccgggaagatagtggctttgaagaaggtgaggttcgacaattttgagccagagagtgtgaggtttatggcacgagaaataatgattcttagaaggcttgatcatccaaacatcattaaattggagggcttgattacttctagattgtcttgtagcatataccttgtgtttgagtacatggaacacgacatcacagggctcttggctagaccagaaatcaagtttagtgaatcacagatcaaatgctacatgaaacagttgttatctggcattgagcattgtcactcgcgaggtgtgatgcaccgggacatcaaaggatcaaatcttttggtgaataatgaagggatattgaaggtggcagattttggattggcaaatttctccaattctgggaacaagcagcccctcactagtcgtgttgtcaccttatggtaccgtcctccggaacttttgctcggttcaacagcttacggtgcatccgtggatctctggagtgttggctgtgtatttgcagaattactaattgggaagcctatacttcaggggagaactgaggttgagcaattgcacaaaattttcaagctttgtggctccccacccgaagaatactggaaaaagaccagacttcctcatgcaacattgttcaagccacaacaaccatatgatagttgcctccgagagacatttaaagattttcatgcatccagtgtaaatcttctacaaactcttctttctgtcgaaccaagcaaacgtgggactgcctcctctgctctctcattggagtatttcaaaacaaaaccttatgcatgtgacccatcaagtttaccaatatacccgcctagcaaggagattgatgcgaagaatgaggaagaatcgagaaggctaggaaaaatttggattgtcacatatcagccagtgtcactagcaatgtattaccttctgtctggctggaaaaagattggtgggcgagcttgcagagcagaatcaagaaaaccatcaagaaatccactagcactcagtaaattagccccagcagaggatttgtcaagtcaaactcaaacttcccaaaagatggatgatagatctgtccacatcattaaagaagagaacactaacacatgtgaggaggcaccaaagcagtctagtggtaaaccagaagatgcttcttcttatatgaagaatgcatctcaagtagatattccctttcctggaccattgcaagtttcaaaatcaggtggcttcgcatgggcaaaaaggcgtagagatgacacttca

SEQ ID NO: 14650 - DNA, 351 bp, Glycine max
  Peptide Sequence Number=SeqID_131428
atgcataatccgccatcttccgagtcgatccgagcctcgtccctgaaaagaaacatcaattcgaaatcgaaattggcacgcctcctcctcctcctcctcctcctcaaaaccctagattcgaaaaccctagatcaggctcggcgtcgcagatctcctcctccaatccgccatcggggaagaatttcggtgtttctgtgtgtgttcccaattatcaaggaaaggggttcttcttcttcttcgtctcgctccagatcgagcgatcgaggtagaaatagcggaaatccagcgatttcgtgcgaaggaaacgcaaccgatgagagagaaagagattggttgggagaaagagaatag

SEQ ID NO: 14651 - DNA, 159 bp, Glycine max
  Peptide Sequence Number=SeqID_131429
atgtcttacacaccccctacttttgctacaagaagtatagtcactgtgaaggaagacagagacatcattcaccaaattggcatgtatctgaagattctccaagaacaagaagctcaattaactgaacatgggctctctcatgaacagaattaccgctag

SEQ ID NO: 14652 - DNA, 4626 bp, Glycine max
  Peptide Sequence Number=SeqID_131430
atggtttcacaggatggacgcaagattcgcgctggtgattgtgcacttttcaaggcacccagggactcccctccttttattggaataattcgcaagttaacatttgataaagaagaaagtccgagtttagaagtgaattggctataccgacctgctgatttgaagcttgctaaagggattgtactggaagctgctccaaacgaagttttctactcctttcacaaggatgaaacacctgctgcatcattactccatccgtgtaaagtcgcatttcttcgtaagggtgttgaacttccttcagggatatccgcatttgtctgtcgacgagtatatgacattgagaacaattgtttatggtggttaactgataaggattaccttaatgaacgacaggaagaagttaaccagctattagacaagacaaaactagaaatgcatggggctgtgcagtcaggaggccgttctccaaagcccttgaatggtccaacatcaacacagtcattgaaatctggttctgacaacgttcaaaatagttcttcttttggtgcacagggtaaggggaaaaaaagagagcggggtgatcaggtttctgattcatctaaaaaggagcggttatttaaggtagaagatggagattctggtcaatttagattggaaagcatgttaaagtctgagattgctaaaataactgataataaaggtgggcttgtggactttgaaggagttgaaagactggtacagcttatgcaacctgatagtggtgataaaaaaatagatttggcagggcgaatgatgcttgtcgatgtaattgcacttacggaccggtatgagtgtctatgcgggtttgtacaacacaggggtttgcctgtgttggacgaatggctgcaggaggtccacaagggcaaaattggtgaaggaaatatgcctaaggaaagtgataagtcagttgatgagtttttgttagctttacttcgtgcattagataagcttcctgtgaaccttcatgcactgcaaacctgtaatgttggaaagtctgttaatcatttacgcacccacaaaaattatgaaattcagaggaaagctaggagtttagtggacacatggaagagacgtgtggaagctgaaatgaatatgaatgattcgaagtctggttcaaaccgtaccatgtcttggccagcaaagtcagcaaattctgagtctcctcaggttggaaataggaaaacaggaggatcctctgataatgttgcaaagagctcttcagttcaaccctcaatatctaaaaattcccaatctaagttaagttctggagaagcactgtccaagtcctcttcatctcctggctcaactaagctaatgactacctcagcggtcagtaactcaaaagatcaaaacagtaaagtcttggttggagctgcaacgtcagatctgcctctgacacctatcaaggaggagaggagcagcagttctagtcaatctcaaaataacagtatatcttgttctagtgaacatgctaaaactattggttccagcagggaagattcgaagagctccactgcagtgtcagcgagtgggggcaaaattcctggtggtgcttctcgaacacgcaagtccagcaatgggctacatgttactggtgttgcagtaggtccgaaggagcacagctctgcaaaaaattcagctaggaattcaccttctgaaaaagtttctccaactcgagtcccccatgaaaaatcagctgaccagccccttactgatcaagggaataatcagcgattgattctccggttgccaaacactggtcacagtccttcaaggggagctagcggtggctcttatgaagaaccaggtatcacgtgcagcaaagcttcttctcctgctgacaggaatgagaatcaggacagaagaatgaaaactagacctgagtgtttgctgacccatgtgtcaaatatgatgaatgaggcatgtgatgctagtgaagctttgcttggtgttgacgaaggtaagggccctcaaacggttgatgagcgatgcagggctaatgaagatggtgataaggtagcagaatcatcaaaaccggctagtttgtcatctggatttgtttccagatcagggcagacttatgatttaagccccatgaatgcattagttgaaagctgtgtgaaaatttctgaagcaagtgcatccgtgtcccatggagatgatgggatgaacctactagctactgtggctgctggggaaatatcaagatctgaaaatgcctcacctatggtatcccctgagagaaagtctcctcctgcagatgaattgagctcaggcaatgatttcaagttaaaacattctggtgaagcagctgtttgctctctttcacagtcggatggtggggctactgccgagcatcctttgaacatatttgattcattgcagataaaaaatgatttgaggcatcctgctacaacttcaggagatggtgacaccatttcatccagttgtgttgagagaagtggtgatgggagatcgcagataaatagctcccctacagatttcttacaagctgaaggtccatgcttacggcctgaaaccaaggaggatacttctgaaactatattgccagttaaaaaggagactaatgcagaccctggagactgtaaattaaagtcaaggacttcttttgatgatgatcagaaggttgatcacatgaatgaggaaaccgctgaggatgagaaaatgttggttccaaaagctgttgcaagtgttaagtctgaaaatgaatcgggtgaaaaacatcctgagttatcctcaggtgtggataatgagaaccagattagtgcagagaaatcaacaggtactggtatactagtgcaaaaggcctctccagtttctgaaaactgtgagtctttgtatttaaaaaaggagtcacctacttctggtaatgctgtaatggtatccagggatgaaaatgctgatgacacgaagtcagttgtgattgagcctgatgaaagaagaacagggcaggatttatcagtttcagatgatgttaatgaacgtgctgatactatgggtagaaaagaggctattggtcagtgttctggctcatcagttcattcagatttaccaacagtgcctagggaagagaatgatgcatttaaagcatctgagcgaaagttggatacaaataaatctgaggttgcaggagagaggcatgcatgttctgctgctgggtctgatactgctgtaaaactcgacttcgatttaaacgaaggctttcctgttgatgatgtaagccaaggggagattgctagacaggaagatcctaccacatcatctgcagttcatgttccttgcccaatgcctttccctatgacatccatctctggggtcttccatgcttcaattacagtggcatctgctgccaaagggccggttgttccacctgaaaacccattgcggattaagggggagcttggatggaaagggtctgctgctaccagtgcatttcggccagctgaacctaggaaaaatgctgagacaccgcccactactaatgatattgcttctgttgatgtcacttctatcaaacaaggtcgcgctcccttagattttgatttaaatgtggcagatgaaagatgttttgaggatgtgggttcgtgtgcttctttagaagctgggccacatgatcgtagcactgggggatttgatttaaataaatttgatgagactcctgaaattggtactttcttgataagcaaactggatattccttctttaccaagtaagccttcgttgtccagtgggttatctaatggcggaagtgtctcaagagactttgacttaaataatggaccaggccttgatgaagttgggagtgaagtcccaacacgtagtcagccaatgaaaagtactgtaccatttccaactgctgttcatggcacgagagcaaacaatgctgaatttgggaattattctgcatggtttcctcctggcaatacttattctgcaattactgtcccaccacttctgtccggcagaggggagcagagttatgttgctggtgctggggcgcaacgtataatgggtcctacaggtagtgctccttttggtcctgaaatctacaggggaccagtgcttccatcctctccagctgttgcttatccacctactacgccttttccctatccaggatttccatttgaaaccaattttccattatcttcaaactctttgtctgtttgttcaacagcatttatggattcgtcaactgtgggtggattatgctttcctaccatgccctcacagccagttgggtctggtggtgttgtttcatctacgtatccccgtccatatgttatgagtcttccaggtggtacaagtaatgtgattcctgacagcagaaaatggggaagtcaaagtctggatcttaattcgggccccggtggtacggatactgaacggagagatgatagattgccttctggattgaggcaaatgtctgtccccaattcacaggcctcgatggaggaccacttgaagatgtttcagatggcaggtgcattgaaaagaaaagaacctgatggtggttggggggagggagccgagagattcggttacacgcaacattcatggcagtag

SEQ ID NO: 14653 - DNA, 594 bp, Glycine max
  Peptide Sequence Number=SeqID_131431
atgttggagaagaccatgaagacatctagtacgatgtttcaggacaagtatcataatcatagcactggcaaaagggagagatgtctgagtctgaccttagggaagggagtgccttttgttttgacctctctcttaatggcttcaatttttagttttttcttcctctataatccataccctttaaccctcgcaccccatcaaggccatgacatgcttgaaaatccctctccaaagcaagaagaacatgtcatcacaacaacaacaaaggtttcaccttccaaaccacaaaaggaacagaaaacatgtgacctttctaagggtcactgggtaccagctttgggagggtcatcaacctattacaccaattcaagctgcaccacaatccctgatagcaaaaactgtttcaagcaagggagaatggacagtgattttctcaattggaaatggaagcctgaacaatgtgatcttccaaggttccacgccagaaccttcctccacatggttcgtgccaagaaaatggctttcattggagattctgtggccagaaaccatgtggattccctcctctgcctcttgtcacaggttagtgtctaa

SEQ ID NO: 14654 - DNA, 1134 bp, Glycine max
  Peptide Sequence Number=SeqID_131432
atggcgtggttggtggtacgggaagagggaaaagttgagggtgtttggaacagggacgcaaaatgggtgagcaatttggttatttctaggtattgggttgtatctaagggccaagggactttagccactgaacccccaagaccaagtccgctccgcaaaggggtaggacatggaggtccacagaaaatcggatgcatgggttgtgccttgagaccgagagaacgaactagtcgttcctgcacgaaattatccgtgcttcctccgtcgatgaggatgacaacgagtactggagtcaatattagggattgcgcctgggttgtccccttcctctttagggtccacgatgagaagaaagatatgagaggaacacttgtgccctcgagtaaacttctcatcgaaattgaagcaaaggcccttctcttggtgcatggggagggtaaaagcagagaggtaggaggtggcggtgatagcaaagtggaaaaagggtgggggcgcgcgcacggaggccaccgtgggtatcgcgacattggtccgccaaattctcctcctagagatgcgcaagacccgcctcctggaccagggtcagaggatgaagggcttgaacttaacgccggatttctggggccaaacccgatacaaagcagcttagaaggaacgatgtcgataagccgattattcgattggctaacatttcaaactggtccttccatggcgaaggaagcgataacaaggcattcaggctcagggattgagctagaaggtatggatggtgttttgggattggctgaggaagaggatggggccaatttggcaatggcttcctccattcgttccatactggttttggagcgagtagcttcggccatgacaacagtgctcaatgaaagcaccaaactgttatgggctgaacaatttcttgggattcgaggtcgaggactcctccagaagaataagataagagagaatgagattttatttctgcttgaatttgcattacatgagttcaaagatgtctctatagcagataggatattccctagtcactactcatgtaccagctcaacaacccttgtcagagttggttacgaaatccttgaggtaatgtggcctggtgctgtgcctcttgctccttga

SEQ ID NO: 14655 - DNA, 1206 bp, Glycine max
  Peptide Sequence Number=SeqID_131433
atgacagccatgaaaaagtggcgccaatatctattgggccatcacttcattattttgaccgatcatcggagcctgaaagagcttatgtcgcaagtcatacaaacgtcggaacaacagatttatctggcatgcctcctcggttatgattactccatccaataccaatcgggaaaggccaactcgattgtagatgccttatcacgggaccttaaaaaggagctacacaaccatgcgggttatcgggaactatggcagagcatcgtggataatcctcaagcccacccaacatacgaagttactcaggatttcatcctccaacaaaatcgaatttggcttccacaagggtgcaatttcatttcgctattattagcagagtttcattcaacaccgacagggggacatatatggcttaccaagaccttgaaccgtatcgatcaaaacttcacttggccgagaattaagaaggatgcccgtaacttcgtgctagcatgccttccgtgccagaaaactaagtacgatcatcagaagagcccaggactgttttgtcccttgccggtgcctctccgaccttgggaagacctgtcactggactttattgggggacttcccatttccagaggttacacggtcatcttggtagtggttgaccgtttctcaaaagggggcaaatttatcatttgggcagagtggtcgtacaatacctctgtccatgcggcaactgggctcactttgttcaaaataacctttggcgagaaaccttcgagcatccccgactaccttgccaacacctctaatatagatgttgtggatgatttcctcgtcaatcgcgatgcagtatttgccatgttaaggaagaagttgcttaaggcacaacaaactatgaagaagtttgttgatgagaaccgacaagaagttcactaccaagaaggagattggaacagggaagccccaaattggccaagagatactacgacccatttcaagtctcaaagaaaattggcccagttgcttatcagctcatgcttcccccagaatcgtgaatacaccatgtttttcattgctcactcctcaagcctttccaccaatccaaacactttgaccacacacattgttgacttgccccttcagttagaagataatgatgttgtcgtaacgcctcttaccatcctcaacacacagtgggttacttcagatattgggccataa

SEQ ID NO: 14656 - DNA, 240 bp, Glycine max
  Peptide Sequence Number=SeqID_131434
atggagaagtatgtaaaagaaaacaaagaaaaatatttagagggaaggatgagaggaagggacttggcacctttcatgagtgggactagtgatttgcctatatataggctatatggggtagttgttcacctggatatcatgaatactgctttttcgggtcattgtgtgtgctatgtgaagaatttccaaagcaggtggttcaaggttgatcacagtgtgtttacgctttgtctagtgaag

SEQ ID NO: 14657 - DNA, 771 bp, Glycine max
  Peptide Sequence Number=SeqID_131435
atgaattcccttagagaaacgttctacgaccaccaagatagtggtgtttccacgaaacaccagcaagctgacaatgaagtcgagagaaaggtcttcccacagttggaatgggaccggaggtgctgcttaagttcctccaaaaatggcaggcaaggaactgataaaaggaatatagagcttgaagcagggtctagaagtttggataaagcatttgcggccatattcaattttcctgaacgcaatttgggactgaaaggtttattgaagaaggcaataggatgccctccttttgatagtacgacgctcacacctatgctggaagcatcggtctccaacgtgaagggcagggagaaatctggcaaaagcagaacaagggttatgggcaaatgtgctccttctgcaacattgaatctacctaggcttcaatttcatgtttatgaaaatgagggtaacgataggggaagacgttcacaggtccagagtttggaaggaggtgtatatagtggttgggaggtctataggtataatgtgaatatgaaagtaggcattgccttcatccttgcgaaccaaatgacgaagttggggtggggtgatgagataaagagaagagggagtggttttgacgatgtgggtagcaaaggggaggaggatgacgccacagaaaaggaaggaggagacaaggtagtgaaagatggaattggagtagggcctgaacttcatggtgaatccttggggtcaggaaaagctgtgattgtgtctctttctccttag

SEQ ID NO: 14658 - DNA, 678 bp, Glycine max
  Peptide Sequence Number=SeqID_131436
atgtatttagctcaagatgaaagatttttcctttatgcttgttacagaaccattgacagtttagctgttacttatgggaaaggaaaattaaaatgcttccttggaaatataaacggagttgtggatgtggtaccagctgacatggtggtgaatgcaatgctagtggccatggtggctcatgcaaagcagccaagtgatattgtatatcatgtgggttcctctcttagaaatccactcacatacttgaatctccaagactatggactaaaatatttcacggcaaaaccatggataaacaaggatggaacaccggtcaaggttggcagagtaactgtattaaccgacatggatagctttcagagatatatgttcattcgctacctacttccactaaagggacttgagctggccaatactgcactttgccagtattttcgaggaacttatcttgagctccacaggaagatccaggttgtgatgcggatggttgaactttacaggccttacatgttcttcgatggcgtatttgatgatatgaacacagagaagttgcgaatggcagcaaaacaaagtgggacagagacagatttgttttactttgatacgaaagaggttaattgggatgattactttatgaagacccatctccctggtattgtcaagtacattttcaagtga

SEQ ID NO: 14659 - DNA, 177 bp, Glycine max
  Peptide Sequence Number=SeqID_131437
atggaatctttcagagcagaatgcaaacaagtttgtgacagtagtgttagctgggaaagtggcactaacaacagtgcagttattattggtagtgccacaaagaaagcaatcctatcttgggctgtattggaattgaacatggagatggagaaattgacaagaagttattccatctag

SEQ ID NO: 14660 - DNA, 546 bp, Glycine max
  Peptide Sequence Number=SeqID_131438
atggagtggacgtttgattttgggtcactgttcattgtcttttttccggctttccatttccctttcttcttcctccaacttccaaagggtgcaattaagaaacctatcatggatcgagaggtcatctcaataggcagttcctcgtctaaggatactcatcgaggtgcctctgatagtgagtcctcttcttctaagaaggtgagggcttcacgtcgaataggtaggggcgtttatcaccctcatggaggggcacaaccttatgaagctgccagggagcctgtcctagttattgtgatccttcccctatctaattttgggagcatgaggagaggtagtagtggtggagatcttaagtgttgggtggcgttgtccacctcgggccttgctggctatgagtgggtgagggacaacatgctaaagtataagtcctgtctgacctcggcgacgagtgtcgttgtgcttcagcgccatgtgaagctggcgaactctgaagactcttgcaagctggtcgttcaggcttataactatgacgagtgtcgttgttaa

SEQ ID NO: 14661 - DNA, 294 bp, Glycine max
  Peptide Sequence Number=SeqID_131439
atgggaactaagcttcttgacttacattacatggtttgctacaacttatgcctttatataggttacatagcttatgtatgtggtgagagaggtggactcatactagaagacccctatcactttggtgattcactaaatggagtgtctggactagacatcgaagcagaaaggacaatagtgtgtgacaaattggatgaactacgagagcaaggggctacagagcgtgaaattgaaatagctatgaagaacctgggtattagcaggtttgtgaaaatctacaagctaactaattaa

SEQ ID NO: 14662 - DNA, 300 bp, Glycine max
  Peptide Sequence Number=SeqID_131440
atgaacaaagaaaaaaaaaccattgcagctctacgtaacgagcttggtgatgacattcatgagggtgttaagtcaagccttaagcaactaatatcttcaagaccaaataaggaaagtaaaagagaagcttacctttgcgaacacttgcagggcaagacaactaaagggcacgaggccgaggtcacggtggtgcgaaagtcaagccaacacgcgacacgaaggtcaaggtggtgcaacaagctaggattcctttgcagaggtcgtgcgagagtcgtcaagccaaaacgtgacgccagttga

SEQ ID NO: 14663 - DNA, 810 bp, Glycine max
  Peptide Sequence Number=SeqID_131441
gttttcttgagaatgctacctggttactacaaacatgttcgggcttttgagaacactctagtcaccaagttctttggtctccactgtgttaagctaacaggaactgcacagaagaaggtacgatttgttatcatgggaaatctattctgctcacaatatgccatccataggcgctttgacttaaaaggttcgaccttcggtcgcacaactgacaaacccgagtcagaaatagagcctacaacaacactcaaggaccttgatctaaattatatatttcggttgcggaagtcttggtttcaagaattctgcaggcaagtggacagagactgtgactttctggaacacgagaggatcatggattacagtatgttagtaggtcttcactttcgaggaatgtcgtgtagtgataatgtcactccctctggttacagtccaggcactcaaaccccaactggccatggtaactttgatgatggagcccctcgtctttctggagtggatgttgatcatcttgtagtagatcctagtcggtgggttcaattaggtataaacatgccagcacgggctgaatcaacagtgcgaaaaagttgtgacactcctcagctggttggagaaccaactggggaattatacgagatcatcatctttttcgggatcatcgacatattacaagactatgacattagcaaaaagcttgagcatgcttacaaatcatttcaatatgatccaacttcaatctccgcagttgatccaaggctatactcaagacggtttcgtgatttcatcttcagagtttttgtagaggactaa

SEQ ID NO: 14664 - DNA, 2943 bp, Glycine max
  Peptide Sequence Number=SeqID_131442
atgggattcagttgtcctgagcgaaaaaatgtagcagatttcttacaagaagttacgtcaaagaaggaccaagagcagtactggtccattctcgatcgcccttaccgatacgtacctgttgggaagttcgcggaagcattttccttgtatcgtgagggaaggattttgtctgagaagctaaacatacctttcgatagacgctataatcatccagccgccttggcaactcttagctatggcgcgaaaaggctcgaacttctcaagactaattaccagtggcagaagcttcttatgaagcggaattcatttatttatgtttttaaatttgttcagctgcttttggttgcgttgattacaatgagtgttttcttccgaacaacgatgcaccataatacaattgacgatggaggcttatatcttggagcattgtacttctctatggttattattcttttcaatggttttaccgaggtgtcaatgttagttgcaaagcttccagttctttacaagcacagagatttgcacttctatcctagctgggcgtatacactcccatcttggttccttagtatcccaacttccctgatagaggcaggatgctgggttgcggtctcatactatgcaagtggatatgatcctgcatttactagatttttgcggcagttcttgctttttttctttctgcaccagatgtctatagaccgtatacctgtttggtgggtatggggtttttggatttctcctttgatgtatgcacaaaattcagcttctgtgaacgagttccttggacattcttgggataagaaagctggaaatcagaccacctattcattgggtgaggcagtattaaaagagcgaagtttgtatgcagaaagttattggtattggattggtcttggggcaatggttggatacacaattttgttcaacattctatttacaatcttcttggctaaccttaatcccttgggaagacaacaagctgtagtttcaaaggatgagctgcaagaaagagaaaagagacgaaaaggggaaagtgttgttattgagctgagagagtacttgcagcgttcggcttcaagtggaaagcattttaagcaaagaggaatggttctcccatttcaaccacttgccatggctttcagcaatatcaattactatgtggatgtccctttggaattgaaacaacaagggatagtagaggacaagctacagcttcttgttaatgttacgggagcctttaggcctggtgtgttgacagcattggttggagtaagtggtgccggaaaaacaacgctgatggatgtgttagctggaagaaaaactggtggagtcatagaagggagtgtatatatatctggttatcccaaaaggcaagactcttttgcaagaatttctggttactgtgagcaaactgacgttcattcaccttgtttgactgtctgggaatccttactgttctctgcttggcttcgattatcttcagatgttgacttggagacacaaaaggccttcgttgaggaggtcatggagcttgtggagctcactccgttaagtggagcactagtgggtctacctggaattgatggtctgtcaactgaacaacgaaaaagattgactatagctgttgaattggttgccaatccttctatagttttcatggatgaacccacttctggattggatgcccgggctgcagcaattgtgatgagaactgtgaggaatatagtgaatactgggcgaacaattgtgtgcacgatccatcagcctagcatagacatatttgaatcctttgatgagcttctgtttatgaaaaggggaggagagctcatttatgctggtccacttggccctaaatcttgtgaacttattagttatttcgaggcaatcgaaggagttccaaagatcaggtctggatataaccctgctacgtggatgctggaggctacttcttcagttgaagaaaacagactgggagtggactttgcagaaatctaccgaaaatcaagtttatatcaatataacctagagttggttgaaaggttgagcaagcctagtggtaattcaaaagaattgcattttccaacaaagtattgccggtcatcttttgagcagttcctaacttgtctatggaagcaaaatctttgttactggcgtaaccctcagtacactgctgttcgctttttttacactgtcataatctcattgatgctcgggtcgatatgctggagatttggtgctaaaagggagacgcagcaagatctattcaatgccatgggatcgatgtattctgcaatcctcttcattggtataacaaatggcacagctgtccagcctgttgtttccgtggaaagatttgtttcttatagagaaagagctgcagggatgtattcagctttatcatttgcatttgctcaggttgtgattgagttcccttatgtgttcgcacaggctattatatactcttcaatattctattccatggcttcctttgtctggactttcgataggttcatttggtacttattcttcatgtattttacgatgttatattttaccttctatggaatgatgacaacggctgtcacaccaaatcataacgttgctgccatcattgctgctccattttatatgttgtggaaccttttcagtggttttatgattcctcacaagagaatccctatttggtggagatggtattactgggcaaaccctgtagcctggagtctgtatggtctcctaacttcacagtatggtggtgatactcatttagtgaagctctctaatggaaactcgatgactataagagaggtactcaaacacgtgtttgggtacaggcatgatttcttgtgcgttactgctgttatggtggctggcttctgcatattttttgcaattatatttgcctttgcaattaaatccttcaatttccaaaggagatga

SEQ ID NO: 14665 - DNA, 2556 bp, Glycine max
  Peptide Sequence Number=SeqID_131443
atgtctcagttcaagtgggaagccgataaaatgttagatttgtatattcacgattatctcatgaagagacagttacatgctaccgcaagaacatttcaggctgaaggaaatgtttcaacgaatcctattgctatagatgcacctggtggttttctttttgagtggtggtctgtcttctgggacatatatattgccatggtaaatcagaagcacccagaagcagcagtttcttgcagtaagaatcaacaaattaaggctcgactaatgcagaatcaacaggagcaagagcttcagaatacaaaccagaatcaacaaaatgaacaaatgcaactcttattgcaaagacatgcttggcggcagcagcagcagcagcaatttctgcgtggatttcatcttattagtggtagtgctagatgtcctattagcaatgatcctttgatgagacagaacctggcaacttctaatgctatggcaacaaaaacatatgaagacaggttgaagcttccacttcagaaagatgctttagatgatgcaaacattcagcaaaaagtagttgatgatgttggtcagcttctaaacccaaaccatgcctcattgttgaaagcagcagtaacaactggtgaacaggctagaggacagatattgctcagtgcacctagcattttacagggggatattcaaaatgttcaaaatctgaaccagaaacttccagggtctacacaagacataaaaagtgatatgaatgcaatgatgaggtctcaagcagttgtttcagaaggatcctttatcggttgtcatgacttgttgacaattattctcattttaggttcaaatcaaggtggtagcaatttgactcagaaaggatggcctctagaaggactggatgagcttcgctcgggatttctccagccaaataatttaatgcagtcttcacaatctttcagtcaactttctctacggcagcaacttatgcttcaggcacaacaaaatttgatttctccttctgccagtgattttgagagcagaagacccaggatgcttgttaatgatcaaaacatggctcttttgaaagatggccaatcaaattctgtaggtgatttaattcccaataacaggtcacctgctcaagtttgttcctcagtgttgccccatccagactcagatatgtaccttaagcaacaaattcaaaagagcagtcagcagcttcaacaatattcacagcaccctcttttgagccatcaatctgagtctctccagaagcaaggaaaagatggtcctggaagcattacagtagagggcagtgtgtccaataccttacaaggaaacaaacaggtttccaaaagtataacagggcaaaagcgaaaaccagcatcatcttcagatcctgccaatagctctggaactgcaaacactacaggaccacctaccaattcaccttcaacagcatctacacaaacacccgcagacatgatgacagtgtcaactctgcatcagaatgttccttcctctaagtcgtcatttatgtttggtactgatggttttggatcactttcatcagtgcagaatcaattggctgatatggatcaccttgggggtgatggatgttttggtgacaatgtcgagtcattcttatctctcgatgaatcagatgttagcgaaaaagttggcaaagaagtcgcattcaagaatatgaagcatataatggcaagttcgcataaagttgagtgttgtcacttctcatcagatggaaaacttcttgctacaggtggccatgataacaaggcttctttgtggtgcacagaattgtttaacctgaaatcaacacttgaagagcacagtgaatggataagtgatgttcgattttgtccaagcatgttgcgtgttgctacatcctcagcagataaaactgttagggtttgggatgttgataatccaagttattctcttcgaacattcacaggacatgcaacaactgtgatgtcactagattttcaccctagccaagatgaccttatttgctcttgtgacaatagtgagataagatactggagtattaaaaatggtagttgtactggggttctcaagggtggtgcaactcagatgagatttcaacctggcttgggaaggcttcttgcagctgcagtggataattccgtatccatttttgatgtggaaacccagggttgcagacttaaattacagggccatactactgttgtccgatctgtgtgttgggatttgtatggaaattttttggcttctcttagtgctgatatggttagagtatggcgtgttgtgtctggtggcaaaggggaatgcattcacgagttgaacgcatccaggaacaaattcaacacctgtgttttccatcccttctatcctttgctggtcattggctgccatgagactcttgtgctgtgggactttggtgagaagaagacagtgactctgcatgcacatgacgatgttgtatcttccttggcgatgtctaaagttactgggttggtggcttcaactagtcatgacaagcatttcaagatctggaagtgtggctag

SEQ ID NO: 14666 - DNA, 417 bp, Glycine max
  Peptide Sequence Number=SeqID_131444
atggtgatagcaatattggtgataatggtgatagtgatagcggtgctagtgttcatggtggtgagagccggctatgatagtgacaatgatgacgatgatgacaatggtgtgagggtcgtaatcactgcggtggttgaagtgacaatgaccatgtatagataccatatcaccatagcaatagcattttcactgtccctttccttgctgttatatgcaccaccacgaattatgatcattctggcgtatttttggcctttgatagcttcaactacagtgtttttggctgcaataatagctttgggaggggtatccaaattctctactgaaggtcatggacatggtgaaaaagctggtgaagggctcttggattatgtaacaggcatgccagaacatactgaggaggctcgaaacttctaa

SEQ ID NO: 14667 - DNA, 1677 bp, Glycine max
  Peptide Sequence Number=SeqID_131445
atggtgagctgtgaagagaaatatggagaaaagcttacacttgtccaaccagacccggtggcgttggagattaatcgtttgcaaaaccaactcaaagaaaaagataaagaactagcgacttgtcagggtgaaatgaaagccttaaggtcaactgaagctctgaaggataaggccatagaagagttgagaaatggagccagtaaactggacgaaagacttagagttacagaggatcatcttaaacaaaagaatctagaaatcaagaaactgacagatgaaaagaaagatgcattggcttcacaatatgctgcagaagcaacacttagaagggtacatgcaaatcaaaaggatgaagattttgttccaattgagagtgtcattgctcctcttgaagctgagatcaaaatgtataggaatgagatcactgcacttcaagaagataagaaagctttggaacaactcactaaatcaaaagagtcagcattgctagaagcagagaggattctgcgaagtgctctagagagagctctagtagttgaggaggtggagaagaaactcttggagaaaaaccatcgtcaaaagattttggaagttgaaaagcttagcaaaaccattcaacaacttgaggaagtcatcttagctagtggagctactgctaatgctgtccgtgattgtcagcgacagatttctgaattgcaagaagagaagaggacattagagagggagctagcaagggtaaaagtttcagccaacagaattgcaaatgttgtggctaatgagtggaaggacgaaaatgataaggtcatgcctgtcaggcaatggctggaagaaagaaggattatgcagggagagattcaacagttgaaagacaagctagctatatcagagagaacagctagggcagagtcacaattgaagaacactagaggaggcttaaagcatttctccagttatccaatcactttgaatgtgtcttatgcatctccaaaagcagaaaagtctaacatactagctttcctaacaaccaatggtggacttagaaagagatccacatcacaaccaagggcatcttcggttggaagctctttgttccagacaccaaatataaaaaacaacacagacatcgtagctgggaatttaaagctggggagccctactaagaaatatggttctacagaaaatatgttgaagaaaggtatgtgggcattaagaagtaaagttgctaataatggtgaaaaggaaaatgaaatgcaggtgaagacagacatgactttaaacagatacactgatgaaagtgaagcaacagaaattaaaaccattgttaatttggatgaagatgccgaaagcaagaaaccaaacggttcaagcagggatgatgtggtttcaggttttctatatgataagctgcaaaaagaggtcatcaatttgaggaagtcttgtgaaattaaagacagtagtttactggctaaagatgaagaaattaagatgcttataaagaaagtcgatgtactgacaaaggccatggaagtagagtggaagaaaatgaaaagagaagcagctgctagagagaaggaggcttcatcaacaaagtcagatgataacaggaaaaaaagaagcggaaactcctctaaaaggttctttaacttcactttctgtagtgtggctaataactgttaa

SEQ ID NO: 14668 - DNA, 1059 bp, Glycine max
  Peptide Sequence Number=SeqID_131446
atgggtggtgatgagagtcgagaatcgttgctttcagaagcaagagatcattctcatctcaatgagataagtgacctccagaggagaaggccacggcgtggtaaatcttcagataaagagaacaacctcaaagaaaaaaatgtggtccaaaaccctttacactctcaatatatagatccaaaacaagaagcagaattccatttcaagacagtgttgttgtggctagctgcatacctaggaggaggaacactatgcttccttctcacaagtcatcagatcaagggcattaaaaccaatgggtttcttgatgccatttacttctgtgttgtgacgatgactactgttggatatggagatcttgtgccagatagccaattggcaaaacttcttgcatgcatttatgtcttcacaggcatggctcttgtagggttaattcttagcaaggcagcagattacattgttgaaaagcaggaaatatttctagttagaaccttattcaagggtgaaaattttggtccagaagagctttccaaagaggtcgaaactaacaaagcaaaatacaaattcattctcgcagcatccgtctttttggtgcttatgatttcagggactatttttctgcattatattgaaaatctagattttgttgatgccctatattgtgtttgttccacagtcactactttaggttatggggataagagcttctcgactactattggccgtgcttttgctgtgttctggatattgagcagtaccatttgcttagctcagtcttttgcttatcttgctgaattttatactgaagaaagacagaaagcaatggctaaaatagttcttacacgaaagttgtcactccttgatcttgaggcggctgatcttgatggagaccatgttgtcagtgccacagagttcgtattatacaagttgaaggaaatgggaaagatcaaccaagaagatattttagttgtgatggacatttttagaaaactagatgttgataaatcaggaaccctgacagaagctgatctaaaatattctgaatcatctaaaccatag

SEQ ID NO: 14669 - DNA, 2070 bp, Glycine max
  Peptide Sequence Number=SeqID_131447
atggcttacaatctttgctcctccccttcttctctcttccatgaccttccttccatttcttcttcttcttcttcttgtcgtaagttcaaacttcgaaactcgtcctctttctttcaaccctctccttctcccaccccccattccaaaacccttctccatgtctccttgcacgaacccattcccgaacacctaccaccccacgcaaattcctcgtcttcgtcgaaaagtaattacatctgggtcaacccccgaagccccagggccaaacaactcgagagaagatcctacgatgccaggtacacttctcttgtaaacctcgccctctccttggactcttgcaatccctctcaggaggatgtgtctcttgttttgaaggatttatggggtagggtcatagagcaagacgctgtaattgtcatcaacaacatgtccaatcctcgcgttgtaccctttgttctcaattactttcagcgtaggattagacccaccagagaggtcattctctacaacgttaccctcaaggtgtttagaaagagcaaggatttggatgcaatggagaagctgtttgatgaaatgctccagagaggggtgaggcctgataatgtctctttctccactataattagctgcgctaggatttgttctttgcccaataaggctgtggagtggtttgaaaagatgccatcattcaggtgtgagcctgatgatgttacctactcggctatgattgatgcttatggcagggctggtaatattgacatggctttgcgcctgtatgatcgtgcaaggaccgagaagtggcgacttgatagtgttaccttctccaccttgattaagatgtatggtttggcagggaattatgatggatgcttgaatgtctaccaagagatgaaggctcttggtgttaagtctaacatggttatttataacactctgttggatgccatggggagagctaagaggccttggcaggccaagagtatatacacggagatgactaataatggatttttgccgaattgggcaacttatgcgtctctcttaagggcctatggaagagggcgctacagcgaagatgctctttttgtttataaggaaatgaaggagaagggaatggagatgaacactcatctttataacacccttttggccatgtgtgccgatcttggcctagccgatgatgcatttaagatttttgaagacatgaaaagttctgcaacttgcctttgtgacagttggacgttctcatccttgattactatatattcttgcagtgggaacgtttcggaagctgaaagaatgttgaatgaaatgattgagtctggctttcagcctactatttttgttctgacatcgcttgtccagtgctatgggaaggttggacgtactgatgatgttttgaagacatttaatcaactcttggatttgggcatcagtccagacgaccgtttctgtggttgtcttctgaatgttatgacccaaacaccaaaagaagagcttggtaagctaaatgattgtgtggagaaggctaatccaaagcttgggtctgtgctaagatatttggtggaagggctggaggagggtgatggggagtttaggaaagaagcatctgaactctttaattcaattgctgatgaagtaaagaagcccttttgcaattctctgattgatctttgtgtcaacctgaatttgttggacaaagcatgtgaacttctggacctggggttgacacttgaaatatatacggatatacagtccaagtctcaaactcagtggtctctacatctaaagagtctctcgcttggagcttcgctgactgcattacatgcttggataaatgacttgtccaagactttggaatcaggagaggatcttccaccactgcttggaattaataccggtcatgggaaacacaggtattcggacaaaggtttggcaaatgttgtcgaatcacatttgaacgaactcaatgctccattccatgaggctccggataaggctggctggtttttgactacacaggtagcagcaaagtcatggctggagtctcggaaattggttactgcataa

SEQ ID NO: 14670 - DNA, 1146 bp, Glycine max
  Peptide Sequence Number=SeqID_131448
atgatgagtggttctccttctccaaattcaaaacagagaacatgcgactattgtggggacttcacggctcttctgtattgcagtgccgattctgcgaagctatgtttcttctgtgaccgcaaagttcactccccaaaccagcttttctccaagcacacgcgagcgcagctctgtgattcgtgtggagattcccctgcttcggtgctctgttctgcagagaactctgttctttgccataactgtgactgcgaaaagcacaaacatttggcgtctgaagtgcaccaacgaaaacccctcgaggggttctcggggtgcccttctgtgactgagttgttaacgattcttggtctttctgaaaaatctctgctttcaaatgaggggacttcccagattgattacgacctttcggatttgcacgtgtggagtgctccttctgttaacggtcttgaatatttgatcacttccacagcttcttctcataagaatcgtaagagtgcgtttgggagacacaaagaagagattcttagtcaactccgtgagctaataaagttggagcccgacttgattcatggagaagtagatgctgagcgacaagggcaatttggaaatttgcctactggctttgaacgtgacgtggaggctaaaatggggggaagagatacatcaaggaacaagataggatcccaactatgttggcaccccatctcatcctatcctctgaaacctccccgcaagaatttattgctcaaaaagggaaaaagactataccatgaggtgaagagttcattgcaaattgatcctacaaatcaaattgttccttccgatacgtcatcattgagagattttggcgaggtagtttcagctgaagatggaagttttaccatccctggaactggaactcaagccaattttaacaacgaagggaaaccatcaaactcttttaactctgaaaacttatctcctactcctaaagctactccatatgagttaacaagtcatgaaagagattcagcattattgcgatacagagagaagaagaaaaccagaagatatgacaagcacatcagatatgaatcacgaaaagttcgggcagaaagcaggatgagaattaagggtcggtttgtcaaagatgaaacacaaaaataa

SEQ ID NO: 14671 - DNA, 732 bp, Glycine max
  Peptide Sequence Number=SeqID_131449
atgtatatcatgcataatcctctaacatcaatctctgattcccagactctaaaactttcagctcctcttgcaactggtcttattttggttgcatgttgtcctggatgtcaggcatcaaatgttgcaacattcatagccaagggaaatgttgcactctctgttcttatgacaacgtgttcaactattggagctattataatgaccccactccttacaaatcttcttgccggtcaactcgttccagttgatgctgttggcctggcacttagtacctttcaggttgttttagtcccaacgattgtgggagttttggcaaatgagcttttccccaagttcacttcaaagataatcacgattactcctttgataggagtcattttgaccactctactttgtgcaagtccaattgggctagcttcagatgcattaaaagctcaaggagcacaactagtattaccagttgttttcctacatgctgcttcatttgctcttggttattgggtttcaagaatatcatttggtgaatccacgtcacgcactatatctatagagtgtgggatgcagagttctgcatttggatttttgcttgctcagaagcactttacaaaccctcttgtagctgttccttctgctgttagcgttgtctgcatggcgcttggtgggagtgctcttgccgtgttttggatgaacagaccaattccccttgatgacaaagatgatttcaaggaatga

SEQ ID NO: 14672 - DNA, 1521 bp, Glycine max
  Peptide Sequence Number=SeqID_131450
atggcagtcctatcttccttggcagtcatcaccttcttcctttcactcttggtgctttttcttgcaaagaactacaagcaaaagagtctccataaactgccaccagggccatggaagctacctattatagggaacctgcttcaactagcagcagcaagttcacttcctcatcatgctatcagagaattagctaaaaaatatggacccttgatgcacttgcaactaggtgagatttctgcagtgattgtatcatctcccaacatggccaaggaaataatgaaaacacatgatcttgcttttgcacagaggccaaaatttcttgcttctgatatcatgggctatggatcagttgacattgccttcgctccatatggagattattggagacaaatgaggaaaatatgtacgttggagcttctaagtgcaaagaaggttcagtctttctccaatattagagaacaggagatagctaagctcattgaaaaaattcagtcatctgcaggtgcaccaatcaatctcaccagcatgattaactctttcataagtacctttgtttctagaacaacattcggtaacataactgacgaccatgaagaatttttattgatcacaagggaagcaatagaagtggcagatggctttgatcttgcagatatgtttccttctttcaaacctatgcatctcataaccgggttgaaagccaaaatggataagatgcataagaaggttgacaagatcttagacaagatcataaaggagaatcaagcaaataaaggcatgggagaagaaaagaacgaaaatcttgttgaggttcttttaagagtccaacacagtggcaaccttgataccccaattacaaccaacaacatcaaagctgtgatttgggacatatttgctgctggaacggatacatcagcaaaagtaatagattgggcaatgtcagaaatgatgagaaacccaagagtaagggagaaggcacaagctgagatgagaggaaaggaaacaatccatgagagcaacctaggagaacttagctacctcaaggcagtaataaaagaaaccatgaggttacacccacctcttcctttgttgcttccaagagaatgcatagaagcatgcaggattgatggatatgatttacccaccaagaccaaagtcatagtgaacgcatgggcaattggaagagatcctgagaactggcatgatgcagacagctttataccagaaagattccacggtgcatctattgatttcaaaggaatagactttgagtacatcccttttggggcaggaaggagaatgtgcccgggcatttcatttggtatagccaatgtggagtttgctctagccaaattactctatcacttcaattgggaactccaacaaggaacgaaaccagaggagtttgacatggatgaatcatttggagctgtggttggaaggaaaaacaaccttcacttgattcccattccatatgatccttcaatccatgataatggcaaaggaggcaccttcatttaa

SEQ ID NO: 14673 - DNA, 633 bp, Glycine max
  Peptide Sequence Number=SeqID_131451
atggacaaagaatatgatcaggatgatataaagaagaaattcaacaagtttttgaaaagtactctgcagtttgttttatcagtttctgtattttctttctttgtatggtactcttctggcttctccatactccctcagtgtttcaatgcatacttctcctcgtgtcttttctccatgcttactcgcactcttgaaaggaaatacatgtttctcatctgtaacgccatccttgctcttctagccatgtcacctcattttgacttacgggtttctgaagaaccacttggtgcttttcgcttgctagagaatgctcctcttatggttgaagaagaagcaaaaaggcatgaagaatatcctgatcaacatatatcacaagctgaagaaaacgaaggaagactagttagtaaagtttctaatgcagaagaagaaggagcaggaggaggcacaggaagtagtactggagttattgtagcacaagatgatgatgaattagtagcagaaacagcaatggaaatggaaacaaacgaagaactggcaaatacagatgaactcaacagaaagattgaagaattcataaggaaaatgaaggaggagatgaggattgaggcacaaaaacaaccaattgcagtctag

SEQ ID NO: 14674 - DNA, 228 bp, Glycine max
  Peptide Sequence Number=SeqID_131452
atgtatgcgctggcttgcttctctggtactcaaacatgtgtgcttctttctccagcacttgcagtgggggatgtactaattcacaaggaaggtaggattgatgctggcattgaagagatgttcttttccagaggaaacagaacagtgatcacctttcggaagctgctgcaatctggtgatgaaggggttggagtgtacaagtgtgaggtgatatctcacctcgggtag

SEQ ID NO: 14675 - DNA, 279 bp, Glycine max
  Peptide Sequence Number=SeqID_131453
atggagacagaagagagagggggtggcacagggcagagaaggaagaaggagaggtggtgtgtgattcttgtgtcccagaaaagggtgcagcatatagtgcagaggggtgagaatcaaatgggtaaaacagaaccagattatgatgggaaagatagaagaatagggggcgactatgaaggctcctcgctatgcaaaggtatggggaaaggtcattgtaggcagccttacccttgcatatgcaaagacactgtttccaaattcgaaccaatgaccaactaa

SEQ ID NO: 14676 - DNA, 843 bp, Glycine max
  Peptide Sequence Number=SeqID_131454
atggggatgcctatgtggatttccattagccatgctttcaaaaagctgacaagattttttaaatccttgggagtgaaggcaatttttgatacaagttgtagtagagatttgacccttgtcgaatcttgtgtggagttcatcacaaggtatagacaaaatcaagtggttgaagatgagaggagtaaatcaagtctacctatgattgcatcagcttgcccaggttggatatgctatgctgaaaagcaacttggatcctttgttctaccttatatttcatcagtaaagagtccacagcaaacaattggagttatcataaagaactatgtgtgccaagaattaggactcaggccagaagaagtttaccatgtcaccgtgatgccttgttatgacaaaaagcttgaggctgctagggatgactttgttttccaatttgagtcccatgctgaagggcgtgagagtgaaattaacatgatttcagaggtagattcagtattgacaactggagaagttttggaattgattcagtcaaaagaagttgattttaaaagcctagatgagactactctggacaaaatactaacaaatattaatgaagatggatacctttatggggtcagtggaagctcaggtggttatgcggaaacaattttccgatatgctgctaaaacactttttggaagacagattgatggccctttgaccttcaaaaacatcaggaattcagattttcaggaagttactctggaggcaagtccttttgaactttataatattatttttatgctcgtgaggaaggttgttattagtatcttttgtgtgctgtatctaactataaaatgttga

SEQ ID NO: 14677 - DNA, 411 bp, Glycine max
  Peptide Sequence Number=SeqID_131455
atgagaaggaaaatccatcaccccaccgtgtttcgctcttccatcgttttgctacaagagagatttagacagttgcagagagtgaaagaaatgagaaagaagagagaactgctgaaaatgctcactactagtgaacctaaacctttcaattccaaccccactatgaggcagtttttccaccctgaattgatcatcccatcaaggtcatctcctcctcatgtttctctttctctagggccaacttcacagtgcatgcaagagtacaacaaaagcactattgaggccccagtcttaaataacatgctctccatagattctacacataatcagtccattcaggcttcatgcaagaacatctatgattgggattcgggctctgactctagtgttgatacttctcttcacctgtaa

SEQ ID NO: 14678 - DNA, 99 bp, Glycine max
  Peptide Sequence Number=SeqID_131456
atggcaaacgactcaattgaccttcatgcctcttccacctggaaatttgtatcatggcgtgctgtatatatgcctgtatccgaagacatacagaaataa

SEQ ID NO: 14679 - DNA, 241 bp, Glycine max
  Peptide Sequence Number=SeqID_131457
atggcgttgttcattactgttgtcgtgttcctgctgcatctgagttggagtgtccgagttaactctgagccgactcaggacaagcaagccctccttggtttcctctcccagaccccacactcgaagcgcctccaatggaacgcctcggaatccgcgtgcgactgggttggggtgaaatgcgacgcgtcacgctccttcgtttactcgctccgtttacaccgccgtcgatttagtgggtcgg

SEQ ID NO: 14680 - DNA, 408 bp, Glycine max
  Peptide Sequence Number=SeqID_131458
atgactcacagaatagtccaagagaatgtcgaaactagcacatggaaggatgtgtttggaggaataataagtcggttgatgctttgtcagtttgtcaatatgtccaaaagccctattcttcaggtttgtgctttgggaaatgaaagggcagatgccactattgcttggattgatgcttctcttatgcagcataataaccacccgccccttatcatatcgtctataagtccttcaagtttgaaacatgtactggccaatgaagactataaccataatgagtgctggctagttagtgctagtgtgtttgttactacgagaagtgccgcgttgtggccactggccaataaagcaaaaggcacttgggtctcagttagaatggacgtaacagcttcagaagaggttaaatga

SEQ ID NO: 14681 - DNA, 336 bp, Glycine max
  Peptide Sequence Number=SeqID_131459
atgacttcaacaatgctcaaaattttgatggctcagctccttttgtctctatcttttcaagcatatggacaatttgaggaatggtgcatagcagatgagcagaccccagatgaggagttacagagggccatggagtgggcttgtggaaagggtggggcagattgcagcaagatacaagtgaaccaaccctgttaccttccaaataccttgaaggaccatgcctcttatgctttcaacaactactatcagaggttcaaaaacaaaggaggctcttgctatttcaattctgctgcaatcaccactgatcttgacccaagtaagacctcagatttctag

SEQ ID NO: 14682 - DNA, 588 bp, Glycine max
  Peptide Sequence Number=SeqID_131460
atgagttacttgggtttgggtgttagtccaggtactgttccagtgtaccatggaacaaaacttaaagtgttggataggagggtgaggataacagagctggtgttaaggtgtgtgagccttggtcttggagttgttgcaattgttcttgtggtgactgattcccaagtcaaagagtttttctcctttcagaagaaagctaaatttacagacatgaaggctttagtgttcttggtagttgcgaacggactaactgttggctactccttaattcaagggttgcgctgtgttgtgagtatggttaggggaaatgtacttttcagcaagcccttagcttggctcattttctctggtgatcagcctgaggaactgggaaccactgctgcgggacctcatgaaaaccgtcgtacaggggagacactcaccacatatatcgtgatggcatatgtgacggtggctgcagtggcggctgcattgcaatctggggtgcttggaaggacagggcaagcagaacttcagtggatgaaggtgtgcaacatgtatgggaaattctgcaaccaaatgggagaagggatagcaagtgcttttgtg

SEQ ID NO: 14683 - DNA, 1638 bp, Glycine max
  Peptide Sequence Number=SeqID_131461
atgcaaacgtctcagaagcaccctagttcagctggtgcccatttctatcaccagcctgtgcaaggcatttaccaaatgttgcaaagcaatctatgccaagatagcagcagccagggaacaagtgtttcatttgaaacctgtaaggagcaatactttactctggaatcatgcccagcacccactaatgatttcatggattgtgatgattctccttcctatgccagtgtatcatctaaaaggactccattttctccacaaggttctcagtcatgctattcagatcaccaccagtcctctgacaacacctatggttcgccaataagtggcttgtctagtgttgatgaccggcatcaactaaagcacaagctaagagaactggagatttcattgttggcgcctgaggaatcagacattacagacagttgcggctgctgcgtcgtcaagggtggcctccatggatcatctcagttggccaaacataactgggatcagatagcagaaaatattgcacaatttgacttgaaaggagccctcaaggtatgtgcacaggctgtgtctgacgatgatgttccgacagcaagaggctggatagataatgtattggggaaattggtatcagtctctggtgatccaatccagaggttgggtgcttacttgttagaggggcttagagcaaggttggaatcatcagggaatctcatctacaaatcccttaagtgtgaacaaccaacaagcaaagagctaatgagttacatgcacattttgtaccagatttgcccatactggaagtttgcatacatatctgcaaatgctgtcatccaagaaacaatggcaaatgagtcaaggattcatataattgattttcaaattgcgcagggcacacagtggcatttacttatccaggctcttgcacataggccagggggacccccctcccttcgtgtgaccggtgttgatgactcacagtcgactcatgcacgaggtggaggactttggattgttggagaaaggctttcagattttgccaggtcttgtggagttccatttgaattccacagtgctgcaatatctggctgtgaggttgtacgaggaaatattgaaatccgagcaggggaagctctggctgtaaactttccttatgttttgcaccacatgccagatgagagtgtgagcaccgaaaatcacagggatagattgttgaggttggttaagagcttgtctcccaaggttgttacctttgttgagcaagaatccaacaccaacacttctcctttctttcagaggtttgttgagaccttggattattatactgcaatgtttgaatctatagatgtggcttgccccagagatgataagaagaggattagcgcagagcagcactgcgtggcacgagacatggtcaacatgatagcttgtgagggggttgagagggtggagaggcatgaactttttggaaagtggaggtcaagactttccatggctggatttaaacagtgtcaattgagttcttcagtgatggttgctacccaaaatctcctaaaggagttcagtcaaaattataggcttgaacatagagatggtgctctttatcttggctggatgaacagacatatggccacctcttctgcttggagatga

SEQ ID NO: 14684 - DNA, 1132 bp, Glycine max
  Peptide Sequence Number=SeqID_131462
gaagccggtggtggctgcgcgggccgtcgcgccggcggaggcggggacgtcgtcgtcgaaggaggatataaccgggggttcggcggaggcggagaggaacaagctcgtgttcttcgaagggggaatttacagtttcgatttggaggatttgttgagggcttcggcggaggtgttggggaagggtagcgtggggacttcgtataaggcggtgctggaggaaggaaccaccgtggtggtgaagaggctgaaggatgttgtggtgacgaagaaagagttcgagacgcaaatggaggttctggggaagattaagcacgagaatgtggttcctctcagagccttttacttctccaaggacgagaaattgctcgtttacgattacatgtccgctgggagcctgtctgcgctgctacacgcgttgatggggggcagtgggctgctttccaagatgataatggaggtgggtaggagcagagggtctgggcgaacaccactggactgggacagccgtatgaaaatagccctaggagccgcaagagggcttacatgcctccacgtggcaggcaaggtggtccacggcaacatcaaatcttccaacatcctcctccgagggccggaccacaatgccggcgtttctgacttcggcctcaaccccttgttcggaaacggagccccgtcgaaccgcgtggcgggctaccgggcacccgaagtggtggaaacccggaaggtgagcttcaagtctgatgtgtacagcttcggagtgttgctgctggagcttctaacaggaaaagcaccaaaccaagcctctctcggggaagagggcattgatcttccgaggtgggtccagtcagttgttcgcgaagaatggaccgcggaggttttcgatgcggagctcatgaggttccacaacatcgaggaggagatggttcaactgttgcaaatcgcaatggcttgtgtttcccttgtgcctgatcagagacccaacatgcaggacgtggtgcgtatgattgaggacattaaccggggcgagaccgatgatggcttcagacaatcctccgatgacccttccaaaggatccgagggtcatacaccacccccagagtcaaggactccacctagctctctcacaccataa

SEQ ID NO: 14685 - DNA, 498 bp, Glycine max
  Peptide Sequence Number=SeqID_131463
atggagcgggaggaagagagggaacggcgtcgtgtacgtgacaagcagaggagacaatcgatgaataaagaacagagggaacgacaccttgcacgacgccgcagaaactaccagcttcgaagacagagatctgcaaataatgctccattaatggctgaagccttgtccactccttctaactcatcatttcaaattcttcaaggatcgtcaattccgctggaagcttttccgagaaggttgcgtctaaatgcaattaaacgccttgcacgaaacctgggaactccaatgactgtgccaccttccattgccaaccaccccgtcgcaccagacttgatatcactatcagcttcaagtgctgatgatggtagcataataacaaaatcaaaacccttacgtttgaattgtgtcaaacgccttgctcgatcattaagttttccagcggaaaagacagcaccacagaataaccacaatggtattattgttagtgggatcctctag

SEQ ID NO: 14686 - DNA, 201 bp, Glycine max
  Peptide Sequence Number=SeqID_131464
atggagcacgcgcggctgtggctttggtggtgcgagtgtggtccgaattcacatgggcaccggaagtggtgggaaagaaatttagtgagagaattacaatgttgcccttggtgtggcgtgtccatttgtgaggaaaagaaaaagggcgtggagaacaggctggctggagtggacaatagtgttttgcgagttctgatctaa

SEQ ID NO: 14687 - DNA, 1278 bp, Glycine max
  Peptide Sequence Number=SeqID_131465
atggtttccgcggagaaagattccaatgaaactcatcgaaccatcatcgggaagtccatgcgaacggtgcgctccaaaatattccaacacgaccacgccacgtgcgtctccgacaacttaaccggttcgctaatggaactcgcatcgcgaaacaacaaatccgttaagtcttcaattacggaggagcaactcctcgagctctctcaagctctgagcgatttctccgcctgtagcagcgatatctccggggagctccagagactcgccaccgtctcctcctcccaacctcctgctgctgctgctgacatccacggccaaccccaacctgagcccgagccgtgcctagggtttctccagagggagagcttctccactgagatcatcgagagtatctcgccggaggatcttcagccgacggtcaagatctgcgtcgacggacttctctcgccgtcgttggccgtgaagcgatcggcggcggccaagctgaggctgttggcgaagaaccgagccgacaaccgcgctctcatcggcgagtccggtgcggtggctgctctggttccgctgctccggtgcagcgatccgtggacgcaggaacacgcggtgacggcgttgctgaacctgtctcttctggaagagaacaaggcgcttataacgaatgcgggtgcggtgaagtcgctgatatacgtgctgaaaagagggacggagacttccaagcagaacgcggcgtgcgcgctcatgagtctggcgctggtggaagagaacaagagatcgatcgggacttgcggggcgataccaccgctggtggcgctgctgttgggtgggtcccagagagggaagaaggacgcgctgacgacgctgtacaagctgtgttcagtgaggcagaacaaggagagggcggtgagtgccggggcggtgaggccgctggtggagctggtggcggagcaggggagcgggatggcggagaaggcgatggtggtgctgaacagcttggcggggattgaggaggggaaggaggccattgtggaagaaggtgggattgctgcgcttgtggaagcgattgaggttgggtcggtgaaggggaaggagttcgctgttttgactctttatcaactctgtgctgaaaccgttaccaacagagcccttctcgtcagggagggagggattccgcctctcgttgctctttctcagagctcccctgttcgagctaagctcaaggctgagacactccttggatatttgagagaatcaagacatgaagcttcatgttcaagtccgtag

SEQ ID NO: 14688 - DNA, 933 bp, Glycine max
  Peptide Sequence Number=SeqID_131466
atggcacctggaaccaggcgatggatgcttggggtggcaggaattcccgctttacttgggttcatattaatgttgtccctccctgagtcacccagatggctctacattaagaaagaggaggcagaggagatcctgttgagaatctatcggcctagcgaaattgaagaggagatgagagcgatgcaagattcggttgagactgagaaggaggaagaagagttgaatgggaagttgagcttaacgcagaaactaaagggtgcttttaagaatgatgtagttcgaagaggttcaagttgctcagcagtttgtgggcatcaacactctcatgcagctcaaaatgctccttgtattagtaaccatgacacctcgcttttggtcgaaactctacgtgctaggcttacccaaatgcccctactctctcttcatggaactgcatgcaatgcttacaggcagattgtgccaacagtgataatcaaaaatcagtcacgaccatggacacgtaatgatttgagactatctaatatatttcctccgggagcatgcttggctgcagaaaagagtgtaagaggtgtgtgccgtgcagcatatgctcctggaatgggaacagtgccttgggttctgaactcagagatatacccactgagatacagaggtcttggtggaggtatagctgcagtttccaactggtgtgctaatctcataatgagtaactcattcttaagcatgacagagtctttaggcgcggctggcacattcctcctctttgctggcttctccttggttccaatcgtagcaatctatttattagtgccagaaaccaaaggccttcagttcgaggaggttgagaagttgcttcaagatggcttagacctttcccatttgacaagaagaacaacgaaatcaagaaaaaggaggatgacaccaagtaattaa

SEQ ID NO: 14689 - DNA, 453 bp, Glycine max
  Peptide Sequence Number=SeqID_131467
atggcttccttttggccattcttggcaatgttcatggccttaatggcatgcaattgttcatcattggcctctgcttctcgacaaagcatgcatgtttcaaccatctcagcagcaccaacaacattgccaggtgcccctctatactactctcctaccatgtcaccagatattgagcctttgtttccaactcctggaggttctgctttctctccatcagagtcttcaattcccacaattccttctagtcctagccctcccaaccctgatgtcaccaatagtccagggtcagttttggcttttccaccttcagagtctatgccagctatggccccatcttccaagggtgcatctctgccagtttattcagttttacatcttgccattctgatagatgttggtgtttctggttatgttttggaagcatgttatgacagcattaactgttctgtgtaa

SEQ ID NO: 14690 - DNA, 1275 bp, Glycine max
  Peptide Sequence Number=SeqID_131468
atggagccacctcatgcacctactctgaaacgtcagggtaaaccgactaaaacactctggtcttctacaaaatcaagcatcagcatgctgaggctagtgttgggcttgtctgttttgagttgtgtgcttgtgacatcctcagctcaaacgtgcagaaaccaaacattctcaaacagggtgtttgccacatgtcgtgatcttccacagttgacggcttacctgcactggacatacgaccaggctagtgggaggttggagatagcattcaaacacgctggaatcacctcgaccaacaggtgggttgcatgggccatcaatcccagaaacaccctcgacccagccatgattggggcccaggccctggtggctatccctcagtcaaatggaagcccaagggcctatgcctcgtccataaccagcaccagcacaactttggaagagggagctatcagttatcccctgtccgggttgagtgctacgtttgagaacaacgaggtcaccattttcgccactctcacacttccaaacgggaccacctcctttgtccacgtctggcaagatggccctctctctggaactaccccacgagagcatagccacgagacttcccaccaaaactccaaggaaatcttggatcttctctctggttcctccactcagccaaccggaaattcacgccaaagaagaagaaacacccatggagtgctaaatgctgtgagctggggcatattgatgccaacgggtgccataatcgcaaggtacttgaaggtgttcaagtctgcagaccctacttggttttatctccacatcacctgccaagcctctgcctacatagttggtgtttctggattaggcaccggtctcaaactcggcagtgactcagagggtgttgactatgacacccacagagcacttggtattgtcctcgtctgccttggaactcttcaggtgtttgcgctgttcttgaggcccaacaaggaccataagtacagagtgtactggaatgtgtaccaccacttggtcggatatgctaccataatcatcagtgtcgtcaacattttcgaagggttcgaaaccatagaaaaatacgtaggggatcgctacaatagctggaagcatgcgtacattggtattattggagcattggctggcattgctgtctttttggaagctttcacatggatcatagtcttcaagaggaggaagtcagagaacaagattccacacggagcaaatggtgctaatgggtatggttctaggccacaacaggtgtag

SEQ ID NO: 14691 - DNA, 2655 bp, Glycine max
  Peptide Sequence Number=SeqID_131469
atgactctgaatatgactttaagggcactcaccaacacttcaaccaacccaattctcagaattagacgttaccaacttcactgccacgctaaccctcttctgcaatcccatgttgttgccctcaatgcaaggacccttttacgtgacagtgatcctcgctttgcacaacaactgttcgaccaaactccccttagagacctcaaacagcataatcagttgcttttccgttactctcgctgtgaccaaacccaagaagccctccacctctttgtctcactttatcgttctggtttatcccctgatagctataccatgtcttgtgttttgagtgtttgtgccggttcctttaatgggacggtgggtgaacaagtgcattgtcagtgtgtcaagtgtggacttgtgcaccatcttagcgtaggaaactctcttgtcgatatgtacacgaaaacggggaatgttagagatgggaggagagtttttgatgaaatgggtgacagagacgtggtgtcttggaattccttgctcacgggttattcatggaatagatttaatgatcaggtgtgggaattgttctgtctgatgcaagttgagggatacagacctgactattatactgtttctactgtaattgcagctttggccaatcagggtgcggtggctataggaatgcaaatccatgccttggttgtaaagctcggttttgagacagaaagacttgtgtgcaactctctaattagtatgctttcaaagtcagggatgttaagagatgctagagttgtttttgataacatggagaacaaggattcagtttcttggaatagtatgattgctggacatgtgataaatggacaagatttggaagcttttgaaacgtttaacaacatgcaacttgcaggggctaagcccacgcatgcgacatttgcatctgttatcaagtcatgtgccagccttaaagagttggggttggtaagagtgctgcactgtaagactctgaagagtgggctttccactaaccaaaacgtcctaactgcactcatggtagcattgactaagtgcaaggaaatagacgatgcctttagtttattctccttgatgcacggggttcaaagtgtggtttcttggactgctatgatcagtgggtacttgcagaatggtgacactgatcaggctgtgaatttgttttccctaatgagaagggaaggtgtcaaaccaaatcatttcacttattctactatcctgactgtgcaacatgctgttttcatttctgaaatacatgcagaagtcatcaaaactaattatgagaagtcatcttcggtgggaactgcacttttagatgcctttgttaagataggaaatattagtgatgctgttaaagtttttgagctaattgaaaccaaggacgtaatagcctggtctgcaatgctagcgggatatgcccaagcaggagaaactgaagaagctgctaaaatcttccaccaattaacaagggaaggtattaaaccaaatgaatttaccttttgcagcatcattaatgcctgtactgctcctacagcatcagtagagcagggaaaacaattccatgcctatgcaattaaactgagattgaacaatgctctgtgtgtaagtagttctcttgttaccttgtatgcaaagagaggcaatattgaaagtgcacatgaaattttcaaaaggcagaaggagagggacttggtttcttggaactcaatgatctctggatatgcacagcatggccaggcgaagaaagcattagaggtatttgaggaaatgcagaaacgaaacttagaagtggatgctataacattcattggtgtcatttctgcttgtgctcatgctggcttagtgggaaaaggtcaaaactacttcaatataatgatcaatgatcatcacattaatccaacaatggagcactactcctgtatgattgatctatatagccgtgctgggatgctgggaaaagctatggatatcataaatgggatgccatttcccccggctgcaactgtgtggcgcattgtcttggcagcttctcgagtacaccgcaatatagagcttgggaaacttgcagctgaaaaaattatttcacttgagccacaacactcagccgcatatgtcttattatccaatatatatgctgcagcaggaaattggcatgagaaagtcaatgtgagaaaacttatggataagagaagagtgaaaaaggaacctgggtacagttggattgaggtgaaaaacaagacgtactccttcctggctggtgatttgtcacatcctttgtcagaccatatttactcaaaactttcagagttaaatacccggttgagggatgttggttatcagcctgatacaaattatgtgtttcatgatattgaagatgaacaaaaagaaactattctttctcatcatagtgaaaggcttgccattgcctttggcttaatagctacacttcctgaaattccccttcagattgtgaagaatctcagagtctgcggagattgccacagctttattaagttagtatcactcgttgaaaagagatacattgttgttagagattcaaaccgatttcaccactttaaaggtgtgaccggtgagtatgatgatgttggctctccactcttggatagaccattgtag

SEQ ID NO: 14692 - DNA, 1404 bp, Glycine max
  Peptide Sequence Number=SeqID_131470
atgaacaaagagcttacaagctttgtgaaggcttgggaagcagcagttaggaaatcagcaggtccaaagaagagggctaatagcatcttcacaccaatgtctgttgcccatgttgatgatgatgatgatgcaaggaatgttattgttggtgaggttgagaagattctccccaatggtgacttctacacaggccagtggcttgacaacaatggccctcatggccagggaaagtatttgtggacagatgggtgcatgtatgttggggaatggcaaaagggtggcatcatgggaaaagggaggttcagttggcctagtggtgccacctacgagggtgatttcaagagtggttatatggatggaaaagggacttacatagggtcttctggggacacctacaagggttgttgggtaatggagttgagacatggccaggggactcagagttaccctaatggagatttctatgatggggaatggaggaaagggttgcagaatggacatgggaggtaccaatggaagaatgggaaccattacattggacaatggaggaatggtttgttctatgggaatggcaccatgatgtggagcaatgggaataggtatgatggttgttgggaggaagggttgcctatggggaatggcacattcaggtggggtggtgatgggagtttctatgttggggtttggagtaaggatccaaaggagcaaagtgggacttattacccttctggctcttgtgctggtcatttggaatgggatcctcaggagctgttctctgtggacttggtggagtgcagtgtttgttcccttgagaaggtggcaatttacccttcacagaagagtttgaacatgttggaggtggataagatgtgtaagaaggggactgatgggaatgggaggccaaagaggatgtcagtggatgcaaggattagtaattacagctctgaagatggttcttattcctcctatgatgtctcaaggagttctcaggtggataattctattccaagagtgccacatttgaggttgaaggctccaaagagacagggagagactatttctaaagggcataagaactatgagctcatgcttaatctgcagcttggtatcagacatgctgttggaagacctgctccaagtacatctcttgatttgaagtcttctgcatttgatcctaaagaaaaagtgtggactaaatttccaccagaaggatccaagcacacaccacctcacccttcttgcgagtttagatggaaagactactgcccagtagtgttcagggctcttagaaaactgttcaaagtagatcctgctgattacatgatatcattatgtgggaatgatgcccttcgggaactctcttcccctggaaaaagtggaagcttttttttatttgaccaatga

SEQ ID NO: 14693 - DNA, 789 bp, Glycine max
  Peptide Sequence Number=SeqID_131471
atggctcgagaaagtgccccttctatcatatttattgacgaaattgattccctgtgtggtcagcgtggagaaggcaatgagagtgaagcttcaagacggattaaaacagagcttctggtgcagatgcagcatttgtctctgttgtttaaacaattccaagtcatgattgctaataattacattcaccttagatttaaagtccctctttcagtgtacgcagcatgtcctgtcctgtcctgtgcttgtttgatgagatgttcatacttcacaaacaaagttgcatattttcaattgggatttggctcctctaaagtgagggagtgcactttagaggataaaggtgtaggacacaatgatcagaaagttcttgttcttgcagcaacaaatacgccctatgctttagaccaggtgcatctaggagatactccccataacttgactgaaagcgattttgaatacttggctagcaggacagaggggttttctggttcagacatatctgtctgtgtaaaggatgtgttatttgaacctgttcgcaaaacccaagatgcaatgttcttcttgaagaatcccgagggtatgtggatcccgtgtggaccaaagcaacagggtgcagtacaaacctcaatgcaagagcttgctgcaaaaggacttgcttctaagatccttccgccccctattacgaggacagattttgagaaggtactcgctagacaaaggcctacagtaagcaaagccgaccttgatgttcacgagagattcacaaaggaatttggagaggaaggttaa

SEQ ID NO: 14694 - DNA, 3129 bp, Glycine max
  Peptide Sequence Number=SeqID_131472
atgatagccgagaaacctagttgggttaggcatgagggcatgcaaattttctccattgatgttcaacccggagggcttaggttcgctaccggaggtggtgaccacaaggttcgcatatggaatatgaagtctgttagtactgacatagaaaatgatgcctcttctcaaaggcttcttgcaactctacgggatcactttgggtctgtcaactgtgttaggtgggctaagcatggaaggtatgttgcatcaggctctgatgatcaggtgatattaattcatgagagaaagcctggttcaggaaccactgaatttggcagtggagagccaccagatattgaaaactggaaagttgcaatgactttgagagggcacactgcagatgtggtggatcttaattggtctcctgatgattctgcgttagctagtgggagtttggacaacactatccacgtatggaatatgagcaatggcatttgcactgctgttctaaggggccactctagcttggttaagggagttgcttgggatcctattggctcctttatagcaagtcaatctgatgataaaactgtaattatttggcgaactagtgattggagtcttgctcataggacagatggtcactgggcaaaatcactctatttcctaattaacctgtcttcccatcagcttggatcgacctttttcaggcgtcttggttggtctccttgtggtcattttatcaccactactcatggtttccagaagccaaggcattctgcccctgtgctagagagaggggaatggtctgcaacatttgattttctaggacacaatgctccaattattgtggtgaagttcaaccattctatgttcagaagaaatttgactaatgctcaggaagtgaagcctgtgcctgttgggtggaccaatggtgcttccaagactggaagtaaagaaccacagccttataatgttattgccattggaagtcaggatcgaactataacagtttggactactgcaagtcctcgtcctctatttgtggctaagcatttttttactcaaagtgttgtggatttgtcctggagccctgatggatattcactttttgcatgttccttggatggatctgtggctacatttcattttgaggtaaaagaacttggtcagagattaggtgatgctgagctagatgagttgaagagaagtcgttatggtgatgtgagaggtcgtaaagcaaacttagctgaaagtccagcacagttactgctagaagctgcttctgccaagcaaacacctagcaaaaaagtggtttctgatgttcaacaaaaccaaactaaggcagcttatgttgatgcagtggttaatgcaaagaatgctgagcctcaaaatgatgatggcaagaaaagtggaggtccagtaggtgatgtgtcaaacaaagctgcaaccgctggccggatttctagtcctgttaagcaaagagaatatagacgacctgatgggcgtaaaagaattattccagaagcagtaggaatgcctgttcagcaggaaaacatttctggtgcagttcagcaagcactcgattttcctatagtttcttctgatcacagaaaggatactgaacgagctttatccagtgatgatggtgcaagagtaagcaccttgggaggagcacatggcagaaatactgatttaaaagagcgttctggggttactgctagggccacaatttcagagagcctgatgattgagaaggttccagcttctgctggtgatggaagtgtcaatgttgagcagtcaggcaatttgatgtcttccagttctttagctgcttgtagtggtacactttccattagagtatttgacaagaaaagtggagaagattcttctcctattcatttggaagcacgcccaagagaacatgctgtaaatgacattgtagggctgggaaatacatccataatgaaagaaacagaaattgtgtgctctaagggtcctcagacactttggtctgataggatatcaggaaaagtcactgttttagctggtaatggaaatttttgggcagttggatgtgaagatggatgtctgcagatttacacaaagtgtgggagacgagcaatgcctaccatgatgatgggttctgcaacaacatttgtagactgtgatgaatgctggacattactgctggtgacaagaaaaggatccctgtacatgtgggatttattcaaccaaacctgtcttcttcaagattcgttgacttctctagttgcttcaagtcctaactcatatggtaaagatgcaggaactattaaagttatatctgtgaaactatcaaaatcgggctcccctcttgttgtgttggctactcgccatgctttcttatttgacatgaatgtcaagtgttggctgagggttgctgatgattgctttcctgcatcaaatttttccagttcatggagtttgggttcgattcaaagtggtgagctggcagcattgcaggttgatcttagaaaatatttggctcggaagcctggttggactagagttactgatgatggagtacagacacgtgctcatttggaaacacaattggcttcttccttggctttgggatcccctaatgaatatcgccaatgcctattgtcatacgtacgctttcttgcaagagaagcagatgaatctcgtttacgtgaagtgtgtgagagtttccttggacctccaacagggatggttgaggaaacatcttcagattcaaagaacttagcatgggatccttttgtgcttggaatgaggaaacacaagctccttagggaagacattcttccatccatggcatcaaacagaaaagtccagagattgcttaacgaattcatggatcttttatccgaatatgagatcattgatgctaatcaagagcaaacaaaccccacagtaccaaattcatccttaccagaaaccaatccaattgagagcagttcactagcaacagatcgggagcacactgctccaccaaaattggaacacaatactccactggaaaaagagcaaataaatttccctccagcactcgcaaatgaagctagtgcagatacccctatgacagatcaagctaaccaggatgcacaagttaaggaaagtgcctaa

SEQ ID NO: 14695 - DNA, 591 bp, Glycine max
  Peptide Sequence Number=SeqID_131473
atgttcgtgatcagggcaggaggtgaggtggttgacaatgacaatccagggcttgacgtgggggaggtagccggagcggagcatgaagcggaggaaggaggtagcgtagagcgtgtggttgaccttggtgacggagatagcgaggaggtcgaagcagttggcgttgaggcggtgaagctggcattcattgcggaggcacatgatgatggactgggcacgcatgagaaaagagagtgtgttctggtaagagagctaaaagaccaagcgactgaggtgggtggagttagggaggtgcatggagtgggagtaagcgagccaagcttcttcagtgttgttgtcgtgaaggagggagagaaacttgtgcaggttccgaggaggttgttgtcgttggaagggagagagtgggggtttttgaaaaaagtgcaattaagagttggcagtggtgcaacgtggtgtacagattatttaggagcgtgggcacagaaaggtcgtttgtatttccgactcgcttcatctactattgaaacagttgatatcgagatcctgcgaggtattgatagttcatcctcttatgagattaatgtaaagtaa

SEQ ID NO: 14696 - DNA, 333 bp, Glycine max
  Peptide Sequence Number=SeqID_131474
atggagatattggaggttgtggctggtttaaaaaaaatgatgaaaaaaccagggatgacaaaggagtctataggagctgaaaagagaaaaggcaatgaagtggatgacattgataatgttggaattggaaacattttcaagagaagggcagttagctcccaagacacaaacaaccccatgtttaagaagggtttggatgtggccaacttggatttggatgctccaattcaagatgagaacttggttgaagaccaagagatagaggatagagatgaagacttagttcaagaccaagttggagaggaaacacttggtgatcatgatatgatatga

SEQ ID NO: 14697 - DNA, 1761 bp, Glycine max
  Peptide Sequence Number=SeqID_131475
atggttgagaaagataagaaagtgttgttggagaaagcccatagtgtgattatcttgagtcttggagatgaaatggttacacaagtctcaaaagagaagactgttaaaaatattggtgttattatcgatgatgaggaccaagctttgctactgttgtgttctttaccaagatcccatgtgtacttcaaggaatcactaatgtttggaagagactcattgtctcttgaagaagtgcaggcaacattgaactccaaggagttaaatgagaggaaagatttgaaggcttcctttatgcgtgaagggttagtagtgaagggaaaatctcacaagaaagagaataaaggccacaccaaaaagtattgtcctgaaagacagaatatcaatggtgggaatgacaggcaaaaagacctaagagatgttgccaataaacgtaatggatcatggactctagatgttcctggatttgtgttccttggtgccaataagtctagtaagattgctggtattggatcaattcgattcaaactccatgatggcaatgaaaggctgcttacagaagtaagtgcacatctgcctaagacattttgggcagaaactgttgtgattgcaacctatctgattactagatgttattccacaacttttgacatgaagacactagaagagatttggtcaagccatcctccaaagttagatcagcttcaagtgtttggttgcgttgcctatgctcatattagaaagcatgatcaagttgtagaaaattacttgctatctgatgaagatgatgaagaatctgagcaacaaacatcagagctagacaattatcaattagctagtgatagagtcagaatagaaactaaagttcctaagaggtatggatatgctgatttgatagcttttgcactcatttctgcaagtaaggtcttggaagaaaaaccaaaatcatatgaagaggcacatgctagcaaagaaaaaggaaaatggttgacaaccttgaatgaagagattaagtctcttcatgacaataacacttgggagttgattagaaaacctcatggctcaaagttggttagctgcaaatggatctataaaaggaaggaaggaattcttggtttcactcagaagaaaggaatcaactacaatgaggtttcctcacctgttgtaaaacatagatcaataagattgctattggccgtagtaacaaaacttgatatagaatttgagcagatggatgtcaaaacttctttcttgtatggagagcttaaggaaactattttgatgaagcaacttgaagggtttgtagtgaaaggcaaagagaattatgtttctaagggaacatttgtgattttattgttgtatgttgatgacattctgattgcgagcaatttcaagcttcaaattaacaaggtcaaagaatcatatctgaagaaggtgctggagaagtttggaataacaaacttgaaatcagtcatcactgcattgtgtcaacagttcaagttgagtgcatatcaatcccctaagacagctgaagaagtgaactatatggataatgttccatatgaaaatttagtagagtctttaaggcctgacatagctcatgttgtgagtctagtgagcaggttcatgtccaatcctagaagagcacaatggcaggccctaaagcggatactcagatatataaaaggttctctaagtagagtgttggtttatggtggagccaaagaaggagaacaggactataagtgtttgatgtttttttga

SEQ ID NO: 14698 - DNA, 267 bp, Glycine max
  Peptide Sequence Number=SeqID_131476
atggagtttccaaggagaatgaatatcaaggtagtccttaacttgccttatagtggcgatgttgaaaaagctttagaggaaaaagagaaaggtagaaaacaacaagaggtttgcaagaagaagactttgaatgtggaagagcctactactaaaggtaggaatgttgatgtgatccacccacaaaacaatgaggagccgatcactaatgttgatgttagtaacaagcacatggagaagtcaactactacaactccacctaatccataa

SEQ ID NO: 14699 - DNA, 492 bp, Glycine max
  Peptide Sequence Number=SeqID_131477
atggaaacaaagttcatggctagtttggaggataagaggaaattggtcaaagccctcaatgagaaaaactcatttatgattagaaagattgagatcattaagggtcttcaaaataaaattattgaccatgagaagatggtttccatgaaggttgtagaaaacgaaaagcttgttaaggaaattaaaagtatgaacatgaatttctattttgcagttaaggacttagcagaaaccaagaacattctgcaacaagcattcatgataggtcatgaagatggcttcaaaaacgctctccgccaacttggtttattcacctctaatataaatttagagaaattcaatgtattgaaagatgtaaaggatgaggagttagtgagagagtctcaaatggaaagttctgaggaggcttctaataatgagatgatttctaaagcagatgatgttgaggcgacctcaaactttgttctacctttaaatcctctaatgacttag

SEQ ID NO: 14700 - DNA, 231 bp, Glycine max
  Peptide Sequence Number=SeqID_131478
attttgttaagtctaggtctgcgagtagtctatttccgtccttccgacctcctttttcaatggtgggtagagtatctaaaaagagatacagtgcttgttttgggagaaggcagcatcgcagcatccgaggtagtaattgcccatgacattcacgaggatgttgtgtggacgacgttcatgaagatgaaagagcttaaagacaacatgagttatgccagcgaggcgacatga

SEQ ID NO: 14701 - DNA, 669 bp, Glycine max
  Peptide Sequence Number=SeqID_131479
atgataacaacattgaagttgggagcattcgtagatagcctgtgcaagaaaaggttgactagcatgaatgagctgagacgttatgcagctagttctattcacatggaggagttgtctgagtttcacgatagagataagattgaagagttggttcaaaggggatgtataaacaatttcgtcaaagaaattaactataaccatggcagttatagaggaggaggcagaggtggatacattggaagccggggcaacaataaccaaaaggttgtaagagaaggcgagcaaaggcaacagaaaaattctcctggtgttgttcgaggtgtgatcaataccattgtcagcggttttactggaggaggctacacaaactccaccataaaacgacatgtccaagccctcaagagcgtcaatgttgatgctcatgaatgctatgtgaaaagctacaaaattgaactgtacaatgtgatgaaagagacagacaaagggaaagcattgatttccagtatcaacgcaattgtcaccaccctggaggatctagaccccaatcaaattctgaagatcgacgaccaacacccattgaggatgttaacaccttctcaatcgacaaggatgtgcatcaatgcacacaaatcaacaagcaaaaagaagatgcaatgcgacaagaagtag

SEQ ID NO: 14702 - DNA, 393 bp, Glycine max
  Peptide Sequence Number=SeqID_131480
atgtcgttgacgaatctcagctggttggctctgggatctttgaagggatcgtcccaccacattcgtatggcgttgcatttgcactcggatgacctcattttcctcgcacagtgcttacagccatctttcagtcatttcgaactcattttccaatggtgggtggaatacctaaaaaggaactccaacgctaaagttagtgtttgttttggggagacaacgcccaaggtagtaattacccataatgtccacgaggacattgtgtgggtgagtggtagtcgtctagcggagtcagatggtggggtgcgtggatggttaagggttgtcatttggaccaaacccaaacatagtcctcgagcttcaagctataaggagtggaagagcttgatgagttga

SEQ ID NO: 14703 - DNA, 897 bp, Glycine max
  Peptide Sequence Number=SeqID_131481
tggctcaaaccatcatcatcttcctctctaactagtttaatttcttcatcacctccttcttattccttgactcagcatgaacaacttgcccaagaaaccatccagtttttgcccttcaaggaagatcagcatataagagtgcaaaaggaaggttttgaagtaaaggaagagaagaaggtggaacaggtgactgtggctttgcacattggattgcctaacacaggaggccatgaccctgatgatgataatgatcatgatgctgatgatgagaagaaggttttccatgttaaggaagaagaagaacccttgaagaaaggcttccagggtaattgttctttcaatcaggagagaagattttggattccaactcctgcacagatccttgttggaccgatgcagtttgcttgctccatatgcagcaagaccttcaatagatataacaatatgcagatgcatatgtgggggcacgggtccgaatttaggaaaggaccagactcacttaaaggaacacaaccagcagcaatgctaaggctaccatgttactgttgtgcccagggttgcaagaacaacatcaatcatccaagagcaaagcccttgaaggacttcagaaccctccaaacccactacaaaagaaagcacggtgcaaaaccatttatgtgccgaaagtgttcaaaatcctttgcagttaaaggggattggaggactcatgagaagaactgtggaaagttgtggtattgcacttgtggttcagattttaagcacaaaaggtcccttaaagatcatattagatcctttggaaaaggtcactctccacatccttctcttgaaggcttcgtcgaggatgagaaggaatgtgttaccggttctgatgatgaagatgatgttgctcatacatga

SEQ ID NO: 14704 - DNA, 354 bp, Glycine max
  Peptide Sequence Number=SeqID_131482
atggcttcgcagttgaagaccatgaaggttgaagctggtaaggctaagcaacttggcctagaattgacaaagtgtaggggaacggacatagacaagaagatagaggatctaaccttggagaagaagacgactgaggcagagttagggactgcgatggacaagatgactaagatgaaggaagctcttgcaaaaatggagaacgagttacgggagacacaaagggttgagtctgccttaaaggttgaattggatgagaccaaaagattgatcaagatgaaccaccgagaaggtttcaagaaggctcagcgcaaagtcaaagtgttgctttctttgacgctgcacaactcaatgtga

SEQ ID NO: 14705 - DNA, 294 bp, Glycine max
  Peptide Sequence Number=SeqID_131483
atggaaaaggccaatgttggtggagggtttgcctcagaaatgagaacagagaaaggcgcagagatggaggtagaaacaataattgctgaggatctgatggatgctgccaaggagaaaggggtaaaagtcgttaagaaatcggtctctatcgtatctggggatactccgagtgtcggcttgttgcgatcaaacaaagttatgttgcactatcataaggataatgaaagagtactacatcaaaggttcagtagaacttcccaaccaagaggcttagccttccattacaagaaatag

SEQ ID NO: 14706 - DNA, 408 bp, Glycine max
  Peptide Sequence Number=SeqID_131484
atggcggacgatagcaagaaattagccaagaaagatctcagtcgcatccaaactctccatcggacccacatagtccatcatatcgcgattggtttggctcaagaaagtgggccaatcaagtcgatgttccagagcgacataatgttaggagccacagaaatgtggcctattttcaagccaaaagaagagaaggttctagtagctgatgtctcgctaagcgaggcagatccgcttagcgagtggcatccactaagcgaggcttacaactcgcttagcgggttggaaaatcctagaaaaggatcagtcagagatgtgctcgcccaacgcaccatcagctcgcccagcgagtcggttgtcgcgcttaacgcgcccagctcgctaagccaaaattcacttactcttgcttag

SEQ ID NO: 14707 - DNA, 537 bp, Glycine max
  Peptide Sequence Number=SeqID_131485
atgaccgttgttgttatcgctgccaccaccgtcaatggcgacgatggtggtcatgacagcgatcatggtagtggtggttgcagtgattatagtaattatgacaccataaccatcaccatttccgcaaccacctccacaatgatcgtcgccatgaccactgtcgtcgctaccaacatgatcgccattgctgttgttggcaccatcgacaatgatggcgacgacaacaaccacagtaatgtaggtggtgatgacgatgatcatagtggcgatcacagtattggtggtggtggcagtaatgacaacaacaatcatgttggtgatgccaaagaagagaaggttaaagttgctaatgacttgctcagcgaggcagatccgctcagcgagatgcatctgcttaacaaggcatcgagctcgcttagcggatgggaaaccctagaagagaataattcaaagatctgctcgcccagcgcgcagccaatccacctagcgaggacgttttctcttctcgcgcttagtgcgcccatgctcgctaagtga

SEQ ID NO: 14708 - DNA, 711 bp, Glycine max
  Peptide Sequence Number=SeqID_131486
atggcggcatccttccagctggactgcgtctcgcccgtaacaatggcggcacccagccatgtcagcagctttctcgtcactgctgatggcggagctttgctttcctactttcttcaacctgtatatctttcttcaattactgttggtctgccccttgacattcttgagaattttcgtttggaggacagcttgaaaagagctttgtatgaacgtatgctgcccctatcgaatgaactgacatctccatttctagtgaaccagcctatatttcacgctgcaccagtacccccaaaggactttcagcaatctgagagtgctgctaacactttaacatgcggatattcaatatgttggaatgaatgtggcttgcatgacgtcatcatgggaactaccggaagaaagcaaggcacctctgcaaaaggggcactctacccatcaacacagtcatctttatgcaaaaagaggctgttggaggttttcttgtcactgggaccagaaaatttgattggttctctacccaatgggattacttatcgagaacttaaggcccatctttggttatgtaaattgaattggatgcaagaatccaacttctgtcaattggcacacgctcctagtctgagtagtccggtcgatcaccaagatgtttttagactagactcctccatggaatctattgtcactcataggtggattgtttcctcccattaa

SEQ ID NO: 14709 - DNA, 1227 bp, Glycine max
  Peptide Sequence Number=SeqID_131487
atgcctcagagggaccttgtttcgtgtaatgccatgattgatgggtatgggaagcatgggatgtgcgagcttgctgaggaggtttttatggacatgggtgtcagggatgtggtgacttggacgagtatgatttcagcttttgttcttaatcatcaaccaaggaaagggttatgtttgttcagagaaatgttgagtttaggggttagaccggatgcccctgctgttgttagtgtcctttcagccattgctgaccttggttttcttgaggaaggtaaatgggtgcacaattacatatttactaataaggtacatcaaagttgcagttttattggatcggctctcataaacatgtatgctaaatgtggtcgaatagaaaatgcctaccatgtatttagaagcctttgtcaccggcaaaacattggtgattggaattctatgatctctggtttagcactccatggacttggccgtgaagctattgagatttttcaggacatggagagggtggaacttgagcctgatgatatcactttcttggggcttttaagtgcttgcaaccatggaggccttatggatgagggtcaattttattttgaaaccatgcaggtgaagtacaagatagttcctaaaattcagcactatggatgcattgttgacctcttcggtcgagcaggtcgcttagaagaggcacttggggttatagatgaaatgccttttgaacctgatgttttaatttggaaggccattctcagtgccagcatgaagcacaataacgttgtgatggggcacactgctggcttaagagctatagaattggctccacaagattcaagttgttatgttcttctctcgaatatctatgccaaagcgggaaggtgggatgatgtgagtaaagttagatcattgatgagaaaaagaagggtaagaaaaattcctggatgtagctctattcttgcggatggtaaagtccatgagttcctcgtggggaaggccatggatgtggggtacaaccaaagcgttctctctatgttagaggagattgtgtgcaagttgaagtcggagggatatgaacctgatctcaatcaagtttttatagatattgaagggggtgaaaaagagagccaactaactcttcacagtgaaaagatggctcttgcttttggactattgaatagccatcagggttcatgcagctggtttcaaaaatctacaaccgtcgagttatag

SEQ ID NO: 14710 - DNA, 948 bp, Glycine max
  Peptide Sequence Number=SeqID_131488
atggtgattccaatagcagtgtcgctggtggtgattctcatagggttggcttataaggccgtaaagccgccacctcctaaaatatgtggatccgtaggtggtcctgaagtagcttcacccagagtgaagctcagtgatgggaggcatttggcctaccgagaatttggtgttccaaaggaagaagctaggtacaagatcattgtcattcatggttatgacagttccaaagacacaagtttaccagtttctcaagaacttgttgaagatctagggatatatttcctccactttgacagagcaggttatggtgaaagtgatccacattcgttacgttctgtgaagagtgaagcatatgatattcaagaactagctgataaattggagattggtcataagttttatataattggagcagccttggtggctccatttataagctattggtggccttcttatcctgaaaatctactaagagaagcatttctgatgctacctcactcagaccaatggacttttcgagtttcacattatgccccttggttgttctattggtggatgactcaaaaatggttcccttcattgactttgacaaatttgttgtctcctgatgatatagagatcgtgaagagcttgtcagaactccaaaacactggccaggagaggataactcagcaaggtgaatatgaatcattacaccgagacataatgagtgcttttggaaagtgggaatttggaccaacagacataacaaatccgttccctgataataatggttcggttcacatatggcaaggctttgaagataggatcattccctacacgctgaaccgttacatctctcacaaattaccgtggattcgttatcatgagcttcctcatgcaggacatctatttctcttcaagaaaaatgaatgtgagtctattatcagagcacttgtactcacatga

SEQ ID NO: 14711 - DNA, 1140 bp, Glycine max
  Peptide Sequence Number=SeqID_131489
atggcaacagatagacaaaaaaagatgctcctaatatggaacctttcaaaggatatcctcaaggaaatgacttcaaaaagtcaaaaacacaaatacaagcgcacacacaacacaatcctcttttattttaaggaggaaggcactcaactatctccaaaccacaacggttcatcagatgattttcccgtggtttcaccaagaatcaaactcagagatgggaggcaccttgcctatattgagagaggcgtccccaaagacatagcaaagtacaagatcgtcattgtgcacggctttggaagctccaaagagatgaattttctggcaccccaagaattaatagatgagttgggtatatatcttctgcaatatgaccgggctggatatggagaaagtgatccaaaccccaaacgctcactgaaaagtgaagcacttgacattcaagagcttgctgatcagctacaattaggaccacagttttatgtgattggagtctcaatgggttcatacgctacttggagttgtctaaagtatttgccccacaggcttgcagggttggcactgatagcaccagtgatcaattacaggtggccttcattccctaagagactgataagggaggactacaggaggaaacttgtccagtggtgtatgtggcttgcaaaccactggcctagactattgcattggtgggtcactcaaaagtggctcccttcaactgctgtcatagagaagaaccctgcatttttcaacaaaagtgatgtggatattctaaagacaattcctgggttccctatgcttccaaaggacagtttaagggaaaaggctgtttttgacactcttcgccatgactggagggtggcttttggaaaatgggaatttgacccaatgaagctaagtaatccattccctcacaatacaggttcgtttcacatttggcatggctacgaagataaggttgtgccctctgaactccagagatttgtttcagggaagctgccctggatacagtatcatgaagttccagatggtggccatttaattatatactataggggcttgtgtgaggccattttgaaggcacttttacttggacaagaaaatgttgcatatagatctaaagcaccattatttgaatcttaa

SEQ ID NO: 14712 - DNA, 753 bp, Glycine max
  Peptide Sequence Number=SeqID_131490
atgattttgttaaaaaggtcaattagtgaggactccctaagaaggtatgtgcagtttgcgagtgaaagctgcatacaagagttattggcagcttcggtcacaaacaaaggaaatggcaacgatggatggaaggtgctaactcttgaaaatggagtggagatatcaaaacgaaggtcagactcactccacacgtttcgcagccgttgggttcttagatctgtctctccccaacagttcatcacagtggccaatgccattgatgctgcaaaggtgaataccaattttctaatgggaggtgaaagggaaaaaagagggaaagaaaaccagcaatgggactctgatctggtggaagccaggtacataaaagatcttgaagacaacctcagcataattcgtcttaggtttggtgataactccaagcctctcttcaggaatagagaattcattgtctatgagcggcgtgagactatggaagatggcaccttggtggtagcagttgcttcactgccaaaggaaatagctgcagggttacatccgaagcaaagtaatgcaatcagaggactgttgctacagtcagggtgggtggtagagaagcttgaagatgattcatgtgtggtcacttatgttgttcagttggatcctgcaggatggctgcccaagtgctttgtcaatcgatttaacacaaaactggttatgatcattgaaaaccttaaaaaattagcccaagcatgtcctagtgaaggtgaaatttga

SEQ ID NO: 14713 - DNA, 1725 bp, Glycine max
  Peptide Sequence Number=SeqID_131491
atgtataagatctcagtgactgaatcgtattctttggctgtaatttctaatgcagggatcaaacttttgtctcttatggatacctggaagaacacccctcctaattgggtgggttcagatccttgtgatgattgggaaggaatcaagtgcaagaattcacgcatcacatcaataacattagccagcactggtttggctggtcagctttctggagatattggttcactatctgaattagagactttacttaaagataacccagtttgccaagaaaatggagaattagaaagctaccgctcctcttctcaacccaatttctcatattcaacaccaccaaataactgtcaaccttgtacctgcagttcagaacagattcctagtcccaactgtatatgcgcatatccatattcgggaaccttaactttcaggtcgcttcccttttccgactttgataataaaacttactcctcaatgcttgaagagggtcttatgcaatcttttaagtctcattttctacctgtggattcggttttgttgagccatctaaggaaggattcaactcagtatctcgaattgagcttacaaacttttaagcctcctgaagtatttggaccattttgttttcgtggagataaatatgaacactttggaaactctgaaggattgagtgaatcgagtaaatcttcaagcattggaatcataattggggcagcagttggtggtttggtcctgctagtgttattacttctatcaggtctctatgcattccgccaaaagaaaagggccgaaaaagcaattggacaaagcaatccttttagacgctgggatacagcttcgagcaacagggagatccctcagttgaaagaagcaaggatcttttcttttgaaaagcttaaaaaatacaccaaaattttttctcaagtcaatgacattggatctgggggttttgggaagggaaagcttgagtttaaaggggagattgagcgcctatcgagggttcaccataagaatcttgtcagccttatgggattctgctttgagcacgaagaacaaatgctggtttatgagtatgttcaaaatggaagtttaaaggatgctctctcagggaagtcaggaattagattagattggattagaaggctgaaaattgcccttggtactgcccgtggtttggcttatcttcacgaacttgttaatcctcccatcatacatagggacatcaaatcaaacaatattttgctggatgaccgcctaaatgccacagttgctgattttggtctctccaagtctatggttgattctgagaaagatcatgttaccactcaagttaaaggaacaatgggttacttggatcaagagtatgatatgtctcaacaattgactgagaaaagtgacgtttatagctttggagtgctaatgttggagctgatttcagcaagaaggccgttggaacgagggaagtatattgtgaaagaggttaagaatgcacttgataagacaaaagggttatatgagtcaggttctgacaggcctgaaatgagtgaagtggtaagagaaatcgagaacatattgaagtcagctggtgcaaaccccactgaggaatcaccctccatctcttctagttatgaggaggtcagcagagggagttcaagccatccttataataccaacgacacctttgatttcagtgcaggacctccatatccaaaacttggccctaagtag

SEQ ID NO: 14714 - DNA, 372 bp, Glycine max
  Peptide Sequence Number=SeqID_131492
atggaagatgtactagaatctcctgcttgccttgcgtttgaatgtgaaattcaaacagtgattaatgaattggttgcagctttaaaggaggatggttgccccaaagtctgggtagtcacttctgatcactgtcatcagcaagcagcacatggagctatttatactgctgctgactttcagggagcctttatttggagttgcaaggcattggttactgagatcaaggcatcacaaaaggaggttgaaaggatgcttcaagagcaaagatccacttcttttcaaggtagattattgaagcacaatcttgatgcagaagtagtggatgctctgaaggacctgaggctaaaattatctgaaaatgagttgaagtaa

SEQ ID NO: 14715 - DNA, 578 bp, Glycine max
  Peptide Sequence Number=SeqID_131493
tcgatcaacacctccaccgtcatgatcttgtcattgttgttgtgatggtggtaatgacgatagcaacgataatgatggtgacagttgatgacaacgacgatgatgacaaaaaggtgatggtgacagaggtgatgacaatgatgatttatggtgatgaatgcaaggatgctcatggtaatgataacgtcaatcatgatggggacggaaatatcgaaagagacagacagagcgacgtcggagaaagaaagaaaggaatgaatgaaagagggatggcggtgctatattcccctccggattcccccaccatgaagagcctcttcaagcccaagccccgcactccttccgatatcgtcaaacaaacgcgagatcttcttctccgtctcacctcccgagatgacgataacatgcccgacttgaccaaaaacctcagggacttaaagtcaatcctctatggtaacagtgaatccgaacccgtccccgaagcttgtgcacagctcactcaggaattcttcgccgacaacaccttacgcctccttatccaatatcttcccaaactcaacttggaggcaattcattaa

SEQ ID NO: 14716 - DNA, 303 bp, Glycine max
  Peptide Sequence Number=SeqID_131494
atgaggttgacacctgtccccgtgagactctggcgctatcccaaagagagggaagagaaagaggtcaccgcatcgaggttgacaaacagacatataattacgagggacaacaagcctcctaggatcacatacaacttgttgatttcagtgtttcttggagtcgaagaagaatggaagaacacctcggactgtgttctccgctcattttcgacacaacacaaaggtagaggaactaggaacaagctatatatgacgagctcgaatcaccagcacaatgagcaacacctcgcgaatgagctttag

SEQ ID NO: 14717 - DNA, 1122 bp, Glycine max
  Peptide Sequence Number=SeqID_131495
atgactaacaaagcacgtaatgagatatgcagattaagccctcaaaagcttatccatatcaaacacagtcgaggtaattttacaattggcatcctcatcacttgtgtcacattcttcattgcattgcacatccggttcttccttcaaacttcaccaccaccatcatcatgggaaagttctatcttcaacaccactcacaatgagctcaattccacggtccataagcttggttcctcggtcacgtttcttccactcaaggatctccgttatgcacgtgcacctcttgaaggccacacatggttcatgagttccatgtatgacacacatgaagttggtgaggtccaataccagcaattcccatcagaaccatcacatggtaagcttctatgtctcaaaggatgcgacacgcatgtcgggtcatggaactcctatgctttggcatggcctgaggcattgccttataacaccaccttcatgaggttcaagatgggcctgtgggttgacaccttgatggaggccatgtttaatgggccaccaattattgaaaggtttgatggagttgatgaagatgggccattgtgttttgaggaggctgtagttatgaggcacaatgagggtggcatgtcaaagaaagaagaatggaagacaggaccaagatcctttaagaatgacacaattgtggctgaaatctttcgaaaggagtgtgctaagattgaagtttgccggtttatggtagctcactccaataatctcaccttttgtgagcaggtgaagttgatgagtttgacagatattttgatatctccacatggtgctcaattgaccaacatgtttctcatggaaagaaacagcagtgtcatggaattcttccccaaaggatggctgaaacttgctggcgttggccaatatgtttaccgttggatatctagctggtcaggcatgaaacaccaaggaagctggagggacccaagtggggatgaatgtccatattcagaagaagatcggagatgcatgtcaatatacaagaacggtagaattggacataatgaaacccatttttcagagtgggctagaagtgttttggctgagatcaagacaagaaagattaagaaacttcgatga

SEQ ID NO: 14718 - DNA, 1215 bp, Glycine max
  Peptide Sequence Number=SeqID_131496
atggcaaatcttccggtggaagttgtcaccgaaatcctgtcccgtctaccggtgaagtcggttatccggctgcggtccacctgcaagtggtggcggtccatcatcgacagcaggcacttcatcctcttccacctcaacaaatcccacaccagtctcattctccggcaccgctcccagctctactccttggacctcaaatccctcctcgaccccaacccctttgaacttagccaccccctgatgtgctacagcaacagcatcaaggtcctcggctcctccaatggcctcctctgcatctccaatgtcgccgacgacatcgccctctggaaccctttcctccgcaagcaccgtattctcccctccgaccgctttcaccgccccgaatcctccctcttcgccgcccgcgtctacggcttcggccaccaccccccctccaatgactacaagctcctcagcattacctacttcgtcgatctccacaaacgcaccttcgattcccaggtccagctctacaccctcaaatccgactcctggaagaatctcccctccatgccctacgctctctgctgcgctcgcaccatgggcgtcttcgtctccggctccctccactggctcgtcacccgaaaactccaacctgacgagcccgatctcatcgtcgccttcgacctcacaagcgagaccttctgtgaagtgccgctccctgcaaccgttaacggaaatttcgacatgcaggtggctttattaggtggctgtctctgcgtcgtggagcataggggaactggatttcatgtctgggtcatgagagtgtacggatctagagattcttgggagaagcttttttcattaacagagaaccaccaccatgagatgggatcgggaaaattgaaatatgtgaggcctttggctttggatgatggggacagggttttgttcgaacacaaccgtagcaagctctgttggtatgacctcaaaactggtgatgtgagttgcgttaaattaccttctggaattggaaacacaattgaaggaacggtttgtgtacaaagcctggtcccgccaactttactgagcctgcgtgatgagagccaggagaaaaataggaagaaaagcttttttggcagggatgacttcctctctaaggggttcaaattgacattgattgaaggggaaccaaagtgctatagttcacaattttcaataccaagaaaacgatga

SEQ ID NO: 14719 - DNA, 2193 bp, Glycine max
  Peptide Sequence Number=SeqID_131497
atgtggggttcctcctcccttttcatcagctttctttctctcctcattcattttgctctttggtttaccccctctttgttctttttctctcacttagaagccactttccttggaaaaacaagcttgccttgtagttgtgttgtgagttctggtttggttttaagcatgtgggaatcagagagtgagtctggtgcaggaagggaatatgggagtggactcctcacttcaaccaagcacagtgtcaagactgagggatttcagcaaagaggcaactcttggtatgtttcagctgatattccaagtgatcttcttgttcaaattggagatgcaaatttccatttgcacaagtaccctttgctatctagaagtggaaagctgaacagaattatatacgattcgcgcgaccctgacttgagcaagatagttatggatgatctccctggagggcctgaggcttttgaacttgcatccaagttttgctatggaattgcaattgatttaacatcaggcaacatctctggccttagatgcgctgccgagtaccttgaaatgacagaggacctagaagagggcaatctcatattcaagacagaagcctttcttagctatgtggttttgtcctcatggagagactccatagtggtgttgaagagctgcgagaagctgtcgccatgggcagagaatcttcaaattgtgagaagatgcagtgagtccatagcatggaaagcatgtgccaatccaaagggaataaggtggtcatacactggaagggcaccaaaagttgcaagtccaaaatggaatgacatgaagaactcaagcccaagtaggaaccagcaggttcctcctgattggtggtttgaggatgtttcaatccttaggattgatcactttgttagagtcatcactgctatcaaggtaaagggtatgaggtttgagttgattggtgctggaataatgcattatgcaactaagtggctacctggtttgatgaatattggcacagcaatcccaggagaagaaggaagcaatagtagtactagtaacagtagttctagtaatggtggtggtggtggtagttggaaaggtggacttcatatgattgtggctggacctagagatgacacttcaactcttcaagctaaagatcaaaggatgatcgttgagagcctcgtcagcataatccccccacagaaggacagtgtctcatgcagcttccttctcaggcttctcagaatggcaaacaacatgttgaaggttgcacctgcattgattactgaattggaaaaaagggtgggaatgcagtttgagcaagctacactggctgatcttctaatcccatgttataacaaaaatgagactacttatgatgtggatcttgttcagaggctgctagagcattttcttgttcaagagcaaactgaaagttcaagcccaagcagaccacccttttctgacaagcatgtgagcagtaacattaatgcaaagacaagagtggcaagacttgtggacagttatcttactgaggtttccagagatagaaacctttccctcacaaagtttcaggttcttgcagaagccttgcctgagtcagctaggacttctgatgatggactctacagagcagttgattcatatcttaaggcacatccaacactaacggagcatgaaaggaagcgactctgccgtgtaatggattgtcagaaactctccattgatgcctgtatgcatgctgctcaaaatgaaaggcttccattgagggtagtggtgcaagtgctattctctgaacaggtgaagataagcaatgcactagccaacagttctctgaaagaaggtgctgaatctcactaccagccaatgattccaaaccggaaaacactactcgaagggacgccacaatcattccaagaaggatggacagcagctaagaaagacatcaacacactcaagtttgagctggagactgtgaaaaccaagtacttggagcttcaaaatgacatggaaaatctgcagagacagtttgataagttgctgaagcagaagcacacttcagcatggaccagtgggtggaagaaactaagcaaactcacaaaaatgactaatgaggaaaatcatgatatttcacctcagattccaacttcagaagaacagaacaggaagacaacaactagaaggtggagaaactcgatatcctga

SEQ ID NO: 14720 - DNA, 198 bp, Glycine max
  Peptide Sequence Number=SeqID_131498
aagcttcttccggaagacaatgaaaatcttccggaagaagcttcttccgggaacattccggatgacgttcttccagaagttgtctgtgagtacttccggaagacacaaattattcttccggaagaaggttcttccggaaaagttccggaaataatttttccggaaagtttccggaagaatcttcttccggaagaataa

SEQ ID NO: 14721 - DNA, 438 bp, Glycine max
  Peptide Sequence Number=SeqID_131499
atggtatcaaagctctctcatggagagagcaatgattccactgctgaatatgacaagagagaggctgagacagtggatgaagatccaacatccacatgggcacagtttgaagaagcatctatcacaattaggagtcatcagcctcaagggtggtgtttaggcccatatcaacttgagatgactaaaattgagcttataaagcttggacaatcctcactttacaagcccatttttgaggttgagttaagccctaagtctaaattcttagattttccaatgatgggcaaggattttagtttgactgtttgggaagcaaaagaagtccttgcaatgatggataatgaaaaggcaaaggaatctgccgttgcacttgagcttgtgctgcaaacaagtccagttttgggaatgcgaatggcatggcagtttcctcgtacttaa

SEQ ID NO: 14722 - DNA, 591 bp, Glycine max
  Peptide Sequence Number=SeqID_131500
atgagtgaaggctccattgctgccaccgaggatgaagatgaggacgttgagaggaggattgacttgggtccccagtgcaccttgaaagaacagcttgaaaaggataaggatgatgagagcttgaggaggtggaaggaacagcttcttggcagtgttgacatgacttctgttggtgatcatcttgatctcaaacaggagtctagtcaatctctggagccagaagtgaagatactgagccttgcaatcaaggcggccggtagagaagacattgttcttccaataccagagtcaggaaatcccagtggcttatggtttactttgaaagaaggtagccgttacagtctcatgttcactttccaggtcagccataatatcgtttcaggtctcaaatacaccaacactgtatggaaaactggtctcaaggttgacagcactaaagagatgattggaacattcagccctcaagcagagccttacacgcatgagatgcccgaagagacaacaccatctgggttattagctagagggcaatattcggctagatcaaagcttgttaatattcctacatacggtttgattaagaggttttaa

SEQ ID NO: 14723 - DNA, 1236 bp, Glycine max
  Peptide Sequence Number=SeqID_131501
atggtgtgccaagcagcgagccaaacaagattccgggcattaaagcatgagtatggcattgatggtgcagcaacaattattgttagagtgatagcatgctttcaacccttgcatttttgtcagaaaagcagcaagtttccaaagatctcatacaagagcaccataacatctactggtcatttgttttgttggatggttaaggctgacgagtctttgcctcgcccacaccatgtggcttggcaatcaccttcttctaatcacttcagtatactgcctaagcccagcttactcagtcttccagcatatctgaattcaagcacttccatcttgcctgctgtcagtacatttcatgggcttgcagctccttctatcccaagtctgaagagcatgctaaaaaatgaagtgcaaggattccttcagtattgcaatgctgacacaagtttgaaagaaacacattttggaggagctttacaaaatgcaaatccttctttgcagaagaggttactgatctttgaccgctctgataataagacaaggttgttttatggtcctgtcctccctcttgtccagagtccaactgttactgctacaaagtttgctcaaagttatggcataaatggggagggacaggccagtaatgtgggtcaaaagcatctaaccagatacagtttactgaaagagtctgttaaggatcatgcaattactgaagaaagtgaaaaccatgaagatacagaagaaataaatgcactgctttattctgatgatgaaagccctgaaggcgatgatgatgatagttgtgatgaggtaacaagtacagatcattctccattggcaactaataagacttatgtgatacaagagcaatttgaagacacgaaggaggaggttgctagctctgattggcctaacaaaaggctaaagctatttgatggtgactataatagatcatccacacctgcggacaggtatagtttgctaagaccaaatgaaacctgtgattgtgtaagcgatgctgaatcaaagaattcttgtggctgggcatattctgttgataaaactaaagtagataattcagtggcttgcgatatcaaatttaaaaaggataagatcagtgaatcattgaaagttcttgaaaatttaattcctggtgcaaaaggaaaggggccactgttagtcattgatggaactattgagtacttgaaaattttgatgtcccaaactggtgctcttgggtga

SEQ ID NO: 14724 - DNA, 633 bp, Glycine max
  Peptide Sequence Number=SeqID_131502
atggaaacgccgaagagatttgaaggtaaggtagccatcgtgactgcttccacacagggaatcggcttagcaatagccgagaggcttggcctcgagggtgcatctgtcgtcatctcttctcgcaaacagcaaaatgttgatgcggccgcggaacaactgagggccaaaggaattcaagtgttgggggttgtttgccatgtttcaagtgctcagcaaaggaagaatttgatcgacaaaactgtccagaagtatggaaagatagatgttgttgtgtccaatgctgctgcaaatccttctgttgatgccatcttgcaaacaaaagactcggtccttgacaagctatgggagataaatgtcaaagccactatacttcttctgaaggccctggctgctgagatggccccaaacactcgtgtaaactgtgttgctcctggttttgtgccaaccaattttgcttcattcattacaagtaacgatgctgtgaagaaagaactggaagagaagacattacttggaaggcttggtacaacagaagacatgggtgctgcagcagcttttttggcatctgacgatgctgcttatataacaggagagaccattgtagttgctgggggaacgccttccaggttgtag

SEQ ID NO: 14725 - DNA, 1125 bp, Glycine max
  Peptide Sequence Number=SeqID_131503
atgggaggctcatgtttccatgcgcttcgtttgaggaggttcaagagtaaggctctgccagaaccttcttcatcttccaagacaaggttggattctgacttggagaacatggagagaagaaggtttgatagcttggaatcatggtccatgatattggactctgagaatgtggagacatgggaagcttcaaaggaggatcaagaagaatggactgctgatctttctcaacttttcataggtaacaagtttgcttctggtgctcacagtaggatttaccgtggaatttacaagcagagagccgttgctgtcaaaatggtgagaattcccacgcaggacgaggagaggagaggcttgctcgaacagcaattcaagtctgaagtggctttactttcacgtctctttcatcccaacatagtgcagtttattgcagcatgtaagaaaccgccggtgtactgtatcataacagaatacatgtcacaaggaacactgaggatgtatctgaacaagaaagagccatactctctttcaacagaaactatattaaggttagctcttgacatatctaggggtatggagtaccttcactcgcaaggtgtgattcacagagatttgaagtcaaataacttgcttctcaatgatgagatgagggttaaggtggcagattttggaacatcgtgtcttgaaacgcggtgtcgggagaccaagggaaacatgggaacatatcgttggatggcaccggagatgattaaggagaaatcttacactcgtaaagttgatgtttacagttttggaattgtgctttgggaactcactaccgctcttcttcccttccaaggaatgacccctgtgcaggctgcttttgctgttgctgagaagaatgaaaggcctccactacctgctagttgccagccagcacttgcccatctgataaaacgttgttggtcagcaaacccttcaaagaggccagatttcagtgacattgtgtgtactctggagaagtacgatgagtgtgtgaaggagggtctacctctgacccatcattcaggcctagtcagcaaaaacgtcattatcgaacgcttaaaaggttgcgtccctatgagctcttccatacctgtacaagcttga

SEQ ID NO: 14726 - DNA, 2331 bp, Glycine max
  Peptide Sequence Number=SeqID_131504
atggggaaatcagggggtagaagaaagaagggtggttcgaactcaaaccaaggtggtgcggttgataattcgggttcaggtgcagcagcagccccaacggctaacggtggggtggaggtgttggattcgtcgatatttttgaagaaggcgaatgagctgaaagaagaagggaataagaggtttcagaacaaggactatgcgggtgctcttgaacagtacgagagtgctcttcgtttaatccccaaaacgcaccctgacagagccgttttccacagcaacagggccgcgtgtttgatgcagatgaagcccattgattatgaagctgtcattgtggagtgcaccatggcgcttcaggtccagccacgctttgtccgggcacttctccgccgggctcgggcgttcgaggccgttggaaagtatgaaatggctgtgcaagatgtgcagttcttgctggcagctgatcctggtaaccgcgatgccttggagattgcccagagattgaggactgcattggggccacgccaagaggcccagcaggacctccacagtcgcccctccccggctgcacttggcgcttcggctgtccgtggtgcccctattgctggattagggccttgtttgccagctcggcctgtgggaaagaagggagcaaattcggtggttggatctgttgtgttgcctaataataacaagccagacaagtcacagccagttttgccaaccgagaatggtcctgacaccaagtcccagttgccaaaactggtattgaagccttcaaatggttctgtgaagccacctaaccgtaaaaaggaagatcacaaggaactgtcatcgaccattcatgggcagcgtttggaggttgcagttcggtggagaccattgaaacttgtttatgatcatgacattaggcttgcccagatgccggtcaattgccattttagagtactaagggatgtagtaagcaaaagatttccttcgtcaagttctgttctgatcaagtataaggattgtgatggtgatttggttactataacctctactgatgaactcagattggcagagtctagtgttgatagccatctcatgaaagaacccggggaagataaaagtgattctgtagcaatgctgagactgcatattgttgaagttagtccagagcaggagcctcctttgttggaagaagaggaagaaaaaccagttgagaatgaaggggtcatgggagaagagagtggatctcattcttctctcagtgaatctgtctctgaagttgctgataccgaggttgataagactgcgaaggatactccaaaggaaaagccaggaaccacaggagatactgaatgcaaagaagtggagatggatgattggttgtttgagtttgctcaacttttccgctctcatgttggtattgatccagatgcccatcttgacttgcatgagcttgggatggaactttgttctgaggcacttgaggaaacagttactagtgaggaggctcaggatctatttgacaaggcagcttcaaaatttcaggaggtggctgctttggctttcttcaactggggtaatgttcacatgtgtgcagctaggaagcggattcccctggatgagtcagctgggaaggaggtagtggcagagcagcttcaagtggcttatgaatgggtcaaggaaaagtattctttagcaagagagaagtatgaggaagcactctcgatcaaaccagacttttatgagggattgttggctctggggcagcaacaatttgaaatggctaaacttcattggtcttttgcacttgctaagaagatagatctatcaggctgggattctaaggagacacttcaactttttgacagtgcagaggagaagatgaaagctgcaacagatatgtgggaaaaactggaggaacagagggcaaaagagctaaaggacccaaatgcaaccaagaaagaagaattattgagaagaagaaagaaacaaggtgctactgaaggtgagtcctcaagtgttggaggtcagggtgaaatatctgcagaagaagctgccgagcaagcagctgtcatgagatcacaaattcacctcttctggggtaatatgctttttgaaagatcccaagttgaatgcaaattgggaatgactggatggaaggaaaacctggatgctgcaactgaacgctttaagcttgcaggagcttctgaggctgatgtttcgatggttctgaagaatcattgctcaaatggagatgcaaaagatggagatgataaaaaggttgagaacccacagcacaataagactgttaaaccagagatcaacaatgctaatcaagtatga

SEQ ID NO: 14727 - DNA, 669 bp, Glycine max
  Peptide Sequence Number=SeqID_131505
atgacggggactaataagttccaacaaagccaacattctcatgtcccaaagtttggtaattgggactgtgacaacatcccatacacagtatattttgataatgcacgcaacaaaaagccttttataaatccgaacgacccagaacaaaatccggaggtcttcaatctttacatgagaggagttgaaaaaagtgacgaagcagtgaaggcttcttctactcgtatgcgcatgcgctcctatagtactagttctttagaacaaacaagccatgaacatgaccatgaggaggggagaagcaatactaaaagccattcccatcacacgacagaatctgtcagtgaaagaagcaattccgattactctgtcattcagagagtgaagtcagatttcattggtagcttctcttcatcaaatcacaatattaaaggcagaggtggaagccattcccttattaatgaccacgtgaaccatgaagcagcactagtaccagaatttggtgcttgggatgtcacagaccctaaatcaggagaaggatatactgctatattcagcgaaataagaaaagaaaaggaaattgcgtctggccgcatgcctagtaagacaccatcgataaacaactgttctagtatccagaatcaatgtggcagaccttcctccattttatccaag

SEQ ID NO: 14728 - DNA, 156 bp, Glycine max
  Peptide Sequence Number=SeqID_131506
atgggacttgccagagacaccttctatgccttgtcacatgatcttgtaagagaaaactccattatcttgaaagttcatatgattattattcttgagcccaatataaactacattccccctctgatgagcaaggaaccaccacatttgcttatctaa

SEQ ID NO: 14729 - DNA, 534 bp, Glycine max
  Peptide Sequence Number=SeqID_131507
atgttggagggtgcaagaagaacagcacactttaggaagtacaaaaaggctattcagaccagagatgtgtttactttgtggggcatattgcaactattgagaatgtaccctgccaaagtgcatgatttggattgtgatgataggcctgttatctcgaaggagaggtttcaaggctcaaatgctcccactccacccttgttaaggtattgctcggatcagtggaacttggatattgtgttccctgattggtccttttggggatgggctgagataaatataaaggcatggaaacatgtcctaaaagaaatcaaagaagggaacgagaagaccaagtggaaggacagagtaccatacgcctattggaagggtaacccttttgtgactccaactaggaaagacctcatgaaatgcaatgtcacagaaaaagatgattggaacactcacctatacatacaggattgggatcaagaatcaagtcaagggtacaagaaatccaacttaggagaccaatgcacccataggtatgtaatttaa

SEQ ID NO: 14730 - DNA, 462 bp, Glycine max
  Peptide Sequence Number=SeqID_131508
atggtgccattagagcactattggcccattagagacaatagcaagtgcaggtctcttaagtttgcagtggaatggggcaacaacaacactgataaggcacaagcaataggggaagctggtagcaaattcattcatgaggacatggacatggactacatatatgattacatgtttcatctactgaatgaatatgcaaaactccaaaggttcaaaccaactatacctccaaatgctgtggagtattgtccagaaacaatgacatgtggtgtagatggtacacaaaaaaggttcatggaggactcattggtgaagtctcctagtgattcaaatccatgcactcttcctcctccatatgagcctattaacctacaagactttctagagaagaaagctaattcaacaaggcaggtagaaacttgggaagaccaatactgggagaataaaaaaaggggacaattatag

SEQ ID NO: 14731 - DNA, 713 bp, Glycine max
  Peptide Sequence Number=SeqID_131509
ggtgtcacatccacaatacttcatggaacattggaatagggaccacttcgtatgagattacgtttggccacaagccctttaattttccagaatacctctctagatcatctaatcttgatgtcgttgacgagatgttaagtaaccgggaagaaatatttcacactattcgtaagaagttgcttaaggcgcaggctatcatcaagcaccatgctgatgttaagcgtagggaggtaacttaccaacctggggattgggtcctcctgaaacttcgaccttaccaacaaaggtcagtcaaaggagcacatgcagtttccggcaaattggctatgcatttctacgacccatttcaaatccttgaccgggctcgaatacaccctgtctttcactactcaatgctcaagccgtttcacgggacaccaaacaaagctaatttagctgatatgccaaatcacttcatcaatgatcaacctcacattactcccttggctattctagactatcgtcgatcgtccccagccatgaatgctccgtgggaggaccagttgcaccgggatcatcactttgaggacaaggtgatccttcaagggccgaaggatgatagcatatcagaagcaacaccagaaacaaaaactacaacattagaagcaggagtgcaaagagaaaagactaagagaatgatttccaggcctttgtacctcaaggatcatgtctga

SEQ ID NO: 14732 - DNA, 1017 bp, Glycine max
  Peptide Sequence Number=SeqID_131510
atggcagataatgatgctttttgctacccttatcatattgatggttgcatgcctctagagaaatggtccaagggacctcaggattcagaaatgcttcccagaagaaagggagctggttctacatcagacaaaccacttgatgcaaagacattgagacgtttggctcaaaacagagaggctgcaaggaaaagccgtctgaggaaaaaggcttatgtgcagcaactagagtcaagtagattaaagcttaaccagatagaacaagaacttcaaagagcacgccctcagggcttgttcgtggattgtggtggtgttggaagtactgtaagctcgggagccgcaatgtttgacatggaatatgcaagatggttagaagaagatcacagactaatgggggagctgaggaacgggttgcaagcaccgttatcagacagtgatatgagagtgatggtggatggatatctttctcactatgatgagattttcaggctcaagggtgtggctgctaaatctgatgtcttccaccttatcaatggcatgtggacttcccaagctgaacgttgtttcctctggattggtggttttagaccctctgatctcatcatgatgctgattcagcagttggagccactagctgagcaacagataatggggatgtatggcctgaagcattcctcacagcaagcagaagaagcactctctcagggacttgagcagttgcagcagtcacttgtggacaccatagctggaggcccagtggttgatggtgttcaacaaatggtcgttgccatgagcaagcttgccaatcttgaaggttttgttcgccaggctgataatttgaggcagcaaactcttcatcagctatgtcgattactcacagttcgtcaagcagcacgatgctttattgttattggagagtactatggacgtcttcgtgcccttagttctctttgggcatcaagaccacgagatttttatgtgcatgatgaggaagctcctactttagctgaagagaaatag

SEQ ID NO: 14733 - DNA, 344 bp, Glycine max
  Peptide Sequence Number=SeqID_131511
ctttattcacagccagacctgcagctacactggaaatgttcccttcatggccaatgagattccagcaaaccccaagagttggttcaaagtcaggaggagaaagcactgattcaggtctctctagcaaaactgagcccccctttgaggcagaatctcccataagtaaaaaggcatcttcttcagatcatcatcaggcttttgatcagcagcatctgcagcatagacagcaacttcaacaggagatggcaagtgatgccccaagagcagcctcttcacagaatcaatcagcagccaaatcacctcaagaaaaggtctctctctctctcagggtctttttcttttaa

SEQ ID NO: 14734 - DNA, 261 bp, Glycine max
  Peptide Sequence Number=SeqID_131512
atgtcaaaatacattaagcatgatacatattgcaaaaaaaatctcttcaagccttgtgaaacttcagatgccaatgccatacttaatcagctacaaaagagaagaggttccaacggcgaattccatctttcagtcgcggggactctgggggcagagccgccattaaaggaggctccgccgtcaccgtccccgctgcgagtgaaaggatcggaaagggaacaaccgcgccgtggcttcctctgctcagataagatcaagtag

SEQ ID NO: 14735 - DNA, 603 bp, Glycine max
  Peptide Sequence Number=SeqID_131513
atgaagtttaaaaagttgtctttccaaatttatccttctaccttctccgaagctccaccgtcttcgatcacaacgactccaagtcccgccctccctcctccaccatcctttttatttgttctggctaggttatgcgctatgcaacacagtgccatggaagcctccaaattcagtaacagtgatcaaaacgttcgatgccatcactgcgcaggacccctttccaaagacatggaaaccagtcactggaccgtttcgcctctcattagggatagcttctccatgattggttctgccgttggcggcgtggcaagtgcattttatggattcaatcttgttatgccaattgtccaaagaaggatcaaaggacccatgtggttgcattttctcattggttctaaaccattttacagtcatactgacataaacctttctgcaattcaggcaccacctgtgatagtattgtcttcagcctgtgcaggcctggcaggtggggctgttcctgctgcagcacaacttgtttcctcttcttatcatgcagcctactcatctcctatctcacctccgccatcaaaggatgaaaatattcaaaggtcaagaaaatga

SEQ ID NO: 14736 - DNA, 156 bp, Glycine max
  Peptide Sequence Number=SeqID_131514
atggcagcatttcggaaggctttgccagagaaccagccagatgcaaaatgtgacctgatattaggttggaactattgtagcaggagcgactggttggccatcattagtaactcttgcaataaggttgctaggtacaccatcatggaccgtggataa

SEQ ID NO: 14737 - DNA, 747 bp, Glycine max
  Peptide Sequence Number=SeqID_131515
atggagggtatttcttctagagtgatgggttttggagagaatacaagtagtagtgggatccccaacaacaactatggaggctcctcttcttccgctatcaaggccaagatcatggcccatcctcactatcaccgtctcctggcagcctacgtcaattgccaaaaggttggggctccgcctgaagtgatgggaaggttagaagaagcatgtgcatctgctgcagtgacaatggcaggtggaacagctagcataggcgaggatccagagctggatcagttcatggaggcttactgtgagatgctgatcaagtacgagcaagagctctccaaacccttcaaggaagccatgctctttcttcaaaggatagagtgccagttcaaatctctcactatttcttcttcgttggacactactgtcaagagtgttaattgcgaggtagttggtaatttttgtccggttggaaatgtcaaattctcagtgcagtcaaaggagttgcttaaaagagcttgtaatgaagctattgataggaatggatcatctgatgatgttgatgttcagaccaacataatagatccacaggcagaggaccaagaattgaaaggtcaactcttacgcaagtaccgtggatacctaggcagtttgaagcaggaattcaccaagaagaggaaaaagggcaagctgcccaaagaagcaagacaacaattacttgaatggtggagcagacactacaaatggccttacccatct

SEQ ID NO: 14738 - DNA, 972 bp, Glycine max
  Peptide Sequence Number=SeqID_131516
atgggagggaccattcttaatcttaacaaggtcgatggggtgttaaataagtacacccaacattatcaatacgcaagacaaacacaagggagagtaagagagacatcttgcatatgtcatgagctggaggaaagggatttaggaaggccttcattggttcaagctagcagaatagaggaaattcgggttggttcaggctatcagagggcttttacagtggacgggggaaggtcgaggtggaggattggcgatgatgaggtgggtggtgagttttttcatgcttcaatcactgggaggagaaaaaggaacaagttggtttccacagttaaagaagatggggttgttgttcaaactcaagaagagattacagaggtagctgaggactatttcaagaatttgttcaagagtaaacattataatcctatccatgttgttgacatggatgaattcaaggtggctttgtttcagatgcaccccgataagtcctcaagacctgatggattaaacaccgcattttatcaaaggttttggagcttatttggggatgaagtttcagcaaaatgtgtgaaatggctggatgaaggctcattccttcaaaagatcaatgatactaatatagttttggtgcctaagtgtgatcaaccaacaagcatgaaagatctaagactgaaatctttatgcaacgtgatttataagattttgtccaaagctttattaaaccggttgaagaaggtaattggtcgttgtatatctgaacaacaatatgctttcatccaaggcaaatctatgctagacaatgcattgattgcaaatgaagttatacaccatatgaagtgtaaggttcgagggaaacaaggagaaattgctttgaaaaaggaaattattaaggcatatgatcgagttcaatggtactttttaaaagatatgatgaagaagatgggtttccacaacatggataatgatgtgtgttag

SEQ ID NO: 14739 - DNA, 462 bp, Glycine max
  Peptide Sequence Number=SeqID_131517
atgaacaactcaaagcaacagaagcagctccaacaaagaggatgcaagaccttctgttgcagttgcaggttcagtgtttcttccactgaggaagcagaaagctcatcagcctccgataggttcccttctgtttcaagccttgcacatgccatggtgcaagagaggcttgaccaaatgattagagctaggcatgtagagagaagaaggcagcacgacagagaagggaccaagtttgttgtaatggtagcaatggagaagagctcttatgatccaagagaggattttagggagtccatgatggagatgattactgccaagcaccttcaagacgccaaagatcttcgtagtctattgaactattatatctccatgaactctgatgagtaccatagtcttatccttgaggtttttcatgagggagcttgctatttcacagataaaacaagagaatgtggtcgttaa

SEQ ID NO: 14740 - DNA, 255 bp, Glycine max
  misc_feature (40)..(40): n is a, c, g, or t
  Peptide Sequence Number=SeqID_131518
atgctacccctttggggaaccgacacgtgtgcagtggtgntggttcgggttatgtttttgcggaggaggaggagcggctggtggtgggaaaacggcgccgtttgcgatggttcctcgatgtcaggtggagggatgccacgtggcgctggtgaacgcgaaggagtaccacaggaggcacagagtttgcgatatgcattccaaggcacccaaagcagtggtgttagggttggagcagagattctgtcagcagtgtag

SEQ ID NO: 14741 - DNA, 354 bp, Glycine max
  Peptide Sequence Number=SeqID_131519
atgtgcctcgcagaccaacatcagcagctcctcattgcaatcgatgaagttgaagaggaggagaaaggacctcatggcatcgaggggaggaagaagcattggagcataaacatagagggaaagtggatgtataacggtaagtctgtaatcctcctagagttcatcaagatcatcgttctcctcctcgtggcggtcatgacagcatgtttcactctccccatcgaaaaggtttgctcccctttcgcggttattgcttaccattcccgcatgcctcttcacttcaactcgaaagcttctgccggtgccgtcgaggatgatgcgcatgcgaaggcaatgtttcaaaactcgatttga

SEQ ID NO: 14742 - DNA, 462 bp, Glycine max
  Peptide Sequence Number=SeqID_131520
atggaaaagaaaaaggtggcagttcccctcgtgtgccacggtcattctcgccctgtggttgatctcttctacagtcccgttacgcctgatgggtttttcctcatcagtgccagcaaggattcgagtcctatgctcagaaatggagagactggagattggattggaacatttgaagggcacaaaggtgctgtgtggagttgctgcttggataccagtgccttacgtgccgcaactgcttctgctgatttctcaacgaaagtttgggatgctttaacaggagatgaattgcactcttttgagcataagcacattgttcgagcatgtgctttttctgagaagacatggagatttgttttgttgccagaaatgcatgctgaatcaccagaatcatgctggaagtttaggaattttgattctgttgcagttccaagttccaactatacagatcttgtaaacttgtaa

SEQ ID NO: 14743 - DNA, 167 bp, Glycine max
  Peptide Sequence Number=SeqID_131521
atgtcgttcctaggcattttcatttccatgtcgttcttggttgttgctataacttgctctcaagaagagcaatcaatatacttggtcttattggaaggagacgcgcttgcttttcatgaaggttcgcgggaccaagattcatcaacaattcaccccaacaccaacag

SEQ ID NO: 14744 - DNA, 2328 bp, Glycine max
  Peptide Sequence Number=SeqID_131522
atggccacactttcagatattggggttgcagctggcttaaacattttgagtgcatttattttctttgtggcttttgctattttgaggcttcaaccttttaatgatcgggtatacttcccaaaatggtacctgaagggtttaagaacagatcctgtccacggaggagcgtttgttcgcaagtttgtcaatttagattggagatcatatcttaggtttttgaattggatgccagctgcacttagaatgccggaacttgaactcattgaccatgctggattggactctgttgtttacttgaggatttacttggttggacttaaaatctttgttccaatagcatttctggcatgggcagttctggttcctgtcaacgccacaagtaccgggctagaaagtgctggtctggacaacataacttcgagtgacattgataaactctcaatttcaaatgtccatagtacatctgaaaggttttgggcacacatactagttgcttatgcatttacattttggacatgctacattttactaaaggagtatgaaaaagttgcctcaatgagattgcaatttcttgcagcagaaaaacgtcgccctgatcaatttacggtgctcgttagaaacattccaccagatcctgatgagtctgtcagtgagcttgtggagcacttttttctggtcaatcatccagataactatctttctcaccaggttgtttataatgcaaacaaacttgcaaagttggttaaaaagaagaagaagttgcagaattggcttgtatattatcaaaacaaagttgaaagaacttcagaaaggcctcaaataaagactggcttccttggtctttgtggaaacaaagtagatgctattgatcatcacaacactgaaattgacaaactgtcaaaggaaatagcgttagagagggataatgtcagcaatgatcccaagtccatcatgcctgctgcatttgtttcgtttaaaacacgatggggtgctgcagtctgtgcacaaacccaacaaactagaaacccaacaatgtggttgactgagtgggcgccagagccacgtgacatctattggtcgaacttggcaattccatatgtttccctcactgttagaaggttgatcatggctgttgcattcttttttctcaccttcttttttatgatcccaattgcaattgtacaaggtcttgcaagtattgacggaatccagaaaagagcgccatggttgaatcctcttattgaaattcctttcattaagtcattcattcaaggttttctaccgggtattgcattgaagctttttctcatctttttgccaacaatattgatgatcatgtcaaaatttgaaggcttcggatctatttcatctctggagagaagagcagcatctagatactatcttttcaattttgtgaatatatttcttgggaacatacttaccgggacagcatttgaacagctggactctttcattcaccaagcagccaatgaatatcccataacaattggcactgcaattcctttgaaagcaagtttcttcatcacttatataatggttgatggatgggctggtatagctgcagaggttttgatgttgaaacccctaatcatatatcacttgaagaattttttcttggtgaagactgaaaaggatagggaagaggctatggatcctgggagtattggtttcaacactggagaacctcgaatacaattgtactttttgctgggtctagtctatgcttcagttacacctactgttcttcctttcataatagttttctttgggctcgcctatgttgtgttccgtcatcagattatcaatgtttataatcaagagtacgagagtggtgcagcattctggcctgatgtccattttcgtgtcattattgcactgatagtgtcacagatagttcttatgggacttcttaccactaaaaaggctgcttcatcaactccatttctaattgtactcccagtactgacgatatggttccatatatactgcaaaggacgtttcgaacctgcgtttgttagatatcccttacaggaagcgatgatgaaagacacattggaacgagctacagatcccaactttaacttaaaagcttaccttcagaatgcttatgttcatccagttttcaaagctagcctttttgatgaggacgaggacgaagaggtaatgagtctaaagttggaaactgagagtttgactgtacccacaaaacggcaatcaagaaggaacacaccattgcctagcagaattagtggtgcatcatctccttctctgcctgatcatggcattcgaaatcatccagagccataa

SEQ ID NO: 14745 - DNA, 783 bp, Glycine max
  Peptide Sequence Number=SeqID_131523
atgaagggggaagtgcagcttcagcctccagcggttatgcaaaaccctagtgattcggaccctttgctccataaccaggaggaagaggatgggtctccgggaagctctggtgagatcaagaatgaggaagaagacgttgaggctggattactcccctgttgtcgaatttgcctcgaaagcgattccgacccagaggatgaattgatatctccgtgcatgtgcaaagggacccaacagtttgtccatcgttcatgtcttgatcattggcgctcagtaaaggtgattgcagctattggtggcttttcatacatcatggacaaagatggttccttcaggaactcatttgatgatggttgggataggatactgtcaaggcatcctattccattttattattgcatcggagtgctggccttctttgtactgattgggttttttggtctcatactgcattgctcctccctcaatagcaatgaccccagaatggctggctgtcaaaactgttgttatggttggggcatcttggattgctttcctgcgtcaatggaggcatgctttgcccttgtggttgtttttgttgtcatctttgcaattcttggtatagcttatggttttcttgctgccaccatggccattcaaagaatatggcagaggcactaccatatcctcaccaagagggagcttacaaaggaatacatagtagaggatcttggtggctgttatttcccacccaagttggacccagaacatgaaggtcgcttgaaaatgcttaagctcttgtaa

SEQ ID NO: 14746 - DNA, 2647 bp, Glycine max
  Peptide Sequence Number=SeqID_131524
tcacgagcttccatctggcagtagtcaaactatgaagtttgactttgtttccttggatatgaaacatcccgagatatgggaaactttccttgttattctggtggtttacactgcttgggtttctccctttgaattcggattcctgaagaaaccacaagcacccctttccataaccgataacattgtcaatggattttttttcgtggatatagttctgaccttcttcgtggcttacattgacaaaagcacttatttgatcgtggatgaccgaaaacagattgcttggaaatatgcaaggacttggttggcctttgatgttatctccatcattccctcagagcttgtacaaaagatatcaccttctcctcttcaatcttatgggctattcaacatgcttaggctttggcgtcttcgaagagttagtgccttgttttctcggcttgagaaggacaaaaactataactatttttgggttcgatgcgcaaagctcattgctgttaccctcttcgctgttcattgtgctgcatgtttctattatcttattgctgcacgttatcatgatcccaaaaagacatggattggtgcaaccatggataatttccttgaacgcagcttgtggtcaagatacgtgacatctatttattggtccattactaccttaacaactgttggttatggagatttgcatcctgtgaattcaagggagatgatctttgacattttctatatgctctttaatctggggttaactgcgtatctgattggtaatatgaccaacttggttgtccatggcacaagtcgaaccagaaaatttagggataccatacaagctgcctcaaattttgcccaaaggaaccaattgccgcatcggttgcaagaccaaatgcttgcacacttgtgtttgaagtatagaaccgactcagaagggttgcagcagcaagagacacttgattctcttcctaaagccatcagatcgagcatttcacattatcttttctattctctgattgacaaggtctacttgtttcatggagtttcaaatgacttgctctttcaattggtgtcagagatgaaagcagaatattttccacccaaagaagatgttatcttgcaaaacgaagcccccactgacttttatatactggtcactggtgccgtggttgttggagaggccaaaactggtgatctttgtggtgaaattggcgtgctttgttataagccacagcttttcacagttcgaacgaagcgactaagtcagttgctcaggctaaaccgtacttcgttcttgaatattgttcaggccaacgtgggagatggaaccataataatgaataatctccttcagcatttgaaagagatcaacgatccaatcatggagggagttttggtggatattgagaacatgttagctcgtggtaggatggacctaccagtgagtgtgtgctttgcggcagcaagaggagatgacttgttgttacatcaattactcaaacggggcatggatccaaatgaatccgacaacaatcgaaggacagctttgcatatagcggcatctcaaggaaaagagaactgtgtttcgcttctgttagattatggggcggatcccaacattagagatttggaaggtaatgtgccactatgggaggctatagtggaaggacatgagtcaatgagcaagctgttatcagagaatggagcaaacttgcaatgcggggatgtgggtcaatttgcatgtaatgccgttgaacaaaacagtctcaacttgctgaaggaaataatgcgctatggaggagatatcacgcttccaaacagcaacacagggaccacagccttgcacgttgcagtctctgaaggcaacgttgagattgtcaaattccttttggatcacggggcgagtattgacaagccagacaagcatggctggaccccaagagatcttgcagatcagcaggcacatacagaaatcaaagccctttttgattccactggggagcctaaggttcagtcttccttcgctattcccgagaggaacagcaagatcaggtaccttggtaggttcacaagtgagccaaccatgccattgcctcttgatggctcgtttcatgagagccagagccagagccagagccagagccggccgaggcgtcggagcaacaactaccataactcactctttgggataatgtcagcagtacacaatggggaaaaggacctgctttcagctgttgacatgaataacaatgcaaggaatggtatgaagagtagtagtgctagtagtagtgcacttggtccaactagagttatcattagttgccctgagaagggtgaggttgttgggaagcttgttttactacctggaagctttcaagagctagttgagattggagccaagaaatttggtttctatcctaataaggttgtatgcaaagatggaggtgaaattgaagatctggaggtgattagggatggtgaccatcttgtttttcttggtgcaagtggggtgcttgaatccaattgtccagctccagcaccactaaccaatggtcctgttacttggcacaaagctttactgacttggaagttagcaattgccaattactgtcaagagggaagtgtgacgcaagggagtcctcccagtcataattga

SEQ ID NO: 14747 - DNA, 1065 bp, Glycine max
  Peptide Sequence Number=SeqID_131525
atggaaatatcttttccttggattctggtggtcacagtggtcatggcaatgccactttcatttcgcataaaagcaaaccaactttcatacgactactacaagttttcatgcccaaacttggaaagcgtaatcaagagtgagttgctaggcatattcttgacagatgctactgcaccagctgcatttctcaggctcatgtttcatgactgccaagttcaaacaaacagtgttcttgtttcattcaaggtttatacaaaagcctcacttgttgttgttgttgttgttgtgtttattttcatgcaaggatgtgatgcctcaattctgttggattccaactacctagctcacagtcacagctctgaaatgaaatcttcaaggaactttggtatcagaaagcgggaaacgatcagctacattaagtcaatattagaagaagaatgtccgggccaggtttcttgtgcagatattattgtattagctgctaaggaatcagtgtcattctctggaggacctcatattgagatcccacttggaagaaaagattccagaacttgtagtttccatgaggctgatgctaagcttccttcaccaacaataacggttgatgaatttatatcgattttcatgtctaaaggaatgaacattgaagagtctgtatccattttaggtgcacatacactagggattggacactgcttcaacattgttggtagattgtatgatccacagctaggagacaagatggattttgggtttgaagcctctctaagactagcatgcccaactgagattcctttgacaaacttcacatttgtgcctaatgacatgaccccagttatatttgacaaccagtattaccgagacattatgatggggagaggcttgtttggtattgactccagcatttctagagatcctcgaacagcaccctttgtcatgcggtttgctatggatcagaactacttcttcaaggctttctcatctgcatttcttaaactttcttctaccaatgttctcacagatgtgcagggtgatgtccgaaggcaatgcaaccaggtaaactaa

SEQ ID NO: 14748 - DNA, 2280 bp, Glycine max
  Peptide Sequence Number=SeqID_131526
atggctgcagaatccgaaactcggcggagaatgacgtcgtcagcgaaacggagcatagtaagctaccggtcactagggcgtatcctttccacgaaatcgagcccaagtgacagcgtttttgggagtacaatcgcactttccgaacccccgatgacgatatcgacacgtcgaaacctaaatactacgttctcgacatgttcccttatcctagcttatttttgcagtggagctgggcttcacgttggccatccactgggatatactgccacagacattcttgctagatacaaacgcatgcagggatataatgtgttgcatccgatgaggtgggatgcttttggattgccagcagaacaatatgctattgagacaggaactcacccaaagctcaatacggtgaggaacatcaatcgctttcgcactcaggccgaagttccagttaattggtgccctgcacttggcactgtgttggccattgaggaggtgattgatggtgtcagtgaatggggcggccatcctgtaataagaaagccagtgaggcaatggatgcttaagattattgcatatgctgactgtcttcttgaggacttagatgaccttgactggcccgaaagtgtaaaagaaatgcagagaaattggatagggaggtcagaaggggcagagatggaattttgcattcttgatagtgatgtaaaggagagagacaaaaaaattattgtgtatactgcaagacctgatacgatctttggtgcaacctacctagtcatggcaccagagcatcccttgttgtcatcattggtttccattgcccagagcaaacatgtcgaggattatgtagactttgcctcaaggaagagtgaccttgagaggactgaacttcaaaagacaaagactggcgggactgaactccaattcgctgggttcttgtctagcaaagaagctgctctaaaagtcattgagtgggcagggaaaagtggaaatggaaagaggaaggtgaactacaagttaagggactggctttttgctcggcaacgttactggggtgaacctatccctgtcatcttcatggatgataatggtgagactgtcccactgtgtgacactgaactgccccttactctacctgaattgaatgatttttgtccctctggaacaggggagcctcctctgtctaaggcagtgtcttgggtgaaggccacagatagcttatctggaagaccagctactcgtgaaacaaataccatgccacagtgggctggttcatgctggtactatttgagatttatggacccacataattccaaggaattggttgataagacaaaagaaaggtattggagccctgttgatgtgtatgttgggggtgctgagcatgcagttctccatttactgtatgctaggttctggcacaaggttctctatgacattggtgttgtatccaccaaggagcccttccaatatgtcataaaccaggggattattcttggagaggttcaatatatggcttgtagagatcaagatggaaatctgatatctgctgattcaactggcatgttgaatgatcataaactagaaataattcctgtggaaaaggtcatgaaatctggggattcttttgtcctgaaagaacatcctgacatacgtttaattgcccgtgcccacaaaatgagtacaagtagtggaaatgttgttaatccagatgatgttgtctctgagtatggtgcagattctcttcgattatacaaaatgttcatgggaccattgagagactcgaaaaaaacttggaggctcattgttggttcacctttgtctgatggcacatttaaggatagaactgtatcagttgatgaggagcctactatagaacaacttcgttgtcatcataaatgcattgctaaggtaacagaggaaattgagggcacacggttcaacactggaatttctgcaatgatggagttccttaattgggataaacatccaagatcggttattgaggcatttgctttgctgctttcaccatatgcgccacatatggctgaggagctatggtcttggctagggcacacaaaatcattagcctacgagcctttccctaagatatttcaggctcttataccttacaagagtataactttaaaattatttacgtcaaaggcaaatcctgcttacctgaaggattccacagtagtccttccagttcagattaatggcaagacaagaggtaccatccaggttgaagaaaacatgtacagaagaggatgcttttgtactagcatctag

SEQ ID NO: 14749 - DNA, 2070 bp, Glycine max
  Peptide Sequence Number=SeqID_131527
atgtcagtagaagaaattgcttcaagttgtccattttgccggaaaaattgcaattgcaatgcttgcttgtgttcaaaaggaatgattaagacagctaacagggatatcagcgattatgaaaaagctcagtatctgcaatatatgattaaattactcctaccgttttttgaacaaatttgtcatgaacaaagtcaagaggagcagattgaagctaaattactaggaaaatcttcttttgagattgagatacaccaaagtctttgtggcgatggtgaacgtgtctattgtgaccattgtgctacttcaattattgaccttcatagaagctgccccaactgttcctatgaactctgccttagttgttgccaagaaatacgtgatggaagcattacaccccgggctgagctgaagttcccatatgtaaataggggctatgattatatgcatggtggggaccctctacctgtgccttgtgatttagagacatcagaaggtcatattgagccgtctactgtgtggaaggctaagagtgatggaagcattagttgtgcgccaaaggagttggggggttgcggtagtgctgtattggagctgagatgcatcttcccagatgggtggatatctgacttggaaaccaaagcttgcaatatgctgaaattatgggaaattaaacacaccactcttcagcaaaaagcagcaagttcaagctacacctttttgagaaaggaagctattaaagaaggcataaatgacaataacatatactgtccagactcaagtagcactaaaaatgaagggctgttgcttttccaaaagcattgggctaatggtgaaccaattatagttcgtgatgtccttaaacagggaacaggactgagctgggagccaatggtaatgtggcgagcattatgtgaaaatatggtttcagaaatcagttcaaaaatgtcagaagtgaaagccattgattgcctagctaattgtgaggtagaaattgatactcacacattctttaaaggttatacagagggaagaacatacagagatctctggccagagatgctcaagctaaaagactggcccccctccgataaatttgaagatcttttgccccgccattgtgatgagtttattcgctccttgccatttcaagagtacagcgatcctcggactggaattctcaatcttgctgtgaagttgccagcccacgtcctgaaacctgacatgggtccaaaaacatatattgcatatgggattaaagaagagcttggtagaggagactctgtaacaaagcttcattgtgatatgtcagatgcggtgaatattttgacccatacagctgaggtgatattaactgatgagcagcactttactatatcaaagttgaaagaagcacacagggcacaaaatgagagagaacagtgtgcccaagagagggttgctgaccacctggaggatcgaccttacaaagacaacaaagaacatatagaaaataaggaagttcttgaagccaaaagcatgaagaaacaacctattgaaattgatggaaacatctttccaaataatgtgcttgagaggtacacttctcctgctacagagaatgaatcaatggaaactggtagtgccctatgggatatctttcagagagaggattctgaaaagttagaaacatatcttagaaaacactcaaaagaatttagacatacttactgttctccagttgaacaggttgtacatccaattcatgaccaatgtttttatttgacatgggaacataagaagaagctgaaggaggagcttggtgtagagccatggacttttgaacagaaacttggggaggcagtatttattcctgctggatgtccacatcaagtcaggaatctcaagtcatgcacaaaagttgctgtagactttgtgtccccagaaaatatccatgagtgtctgcgtttaactaaagagttccgccagcttcccaagaaccacaaggctagagaagataagctggaggattatatggtgacgtgttttatccttgacggaacagataaagaagatgatagtttatgccgttga

SEQ ID NO: 14750 - DNA, 1083 bp, Glycine max
  Peptide Sequence Number=SeqID_131528
atgggtgacactgagatcaagccatcagttgaagtagtcgtatgtgcttccatgaacaataataatagcgcaaacaaccacaccctcccaaccgacatcaccaagccatcacaattaccaatcttgaccaggctccatgctggttactttttcatatgcctttcctttggagcacaagctttgctctggaagagtttgagtaaacacaacaaggactcacaaagtctctggcatggattcaacttgatgccttccattgcatttctacttctttggtgtgtgtcactgctgactgccactagtttgtctttactttacgtgctcaagtgcatctttcacttggaaatggtgaaggaggaattctcacatcatgttggagtgaactgcatgtatgctccttggatttcttggcttctcatgcttcaatcagcacccaccatccttcattcaacttcttgctaccaagttctttgcttggccttttcgtttgtaatattgctgcttgacataaaactatatggacaatggttcacaactaaaaagaggttcctgtcagttgtggcaaaccctactagccaggtgtcggttatagggaacttggtgtctgctcaagttgttgcagaaattggttggaaagagagtgcagttttaatgttctcactcggattgcgtctgacaagtggcagccagttccccacagtgctaaggccaacttacttgttgttttttgctgcaccaagcatagcaagtctagcctggaaatccatcacaggtgcttttgtcaccccatcaaagatgctcctctttctgtctttattcctgtttatgtctcaggcttgcaggccagccatgttcaagaaatccatgaagaggttaaacgttacatggtgggcgtattcattccctttaaccttccttggactagcttgtgctgaatatgctcaagaggtggaaagtggcatggcctcttggttaatgctggttatatgtatggtctccgtgctggtttttattgctttgatgatcatcactgtactcaaaattgagaggctgttccataaaaatgctccgattatgacttga

SEQ ID NO: 14751 - DNA, 1773 bp, Glycine max
  Peptide Sequence Number=SeqID_131529
atgggtttctgcccaaaatggataggctggatcaaagtgtacatggagtcatcaaccttatctgtcttggatggtttaggtggcttgatgaggatggcttgttcgaagggactctctgaaggatatagggtggattatggaaatttgaggatcctgctattgcaattcgcttatgacgcattatttttctgtgagcctactatgaagaatgtcttagccttgaaaagcatgttgagatgctttgaattagcctcagtgctaaaggaatggagtctcactcttgattcctctctctcttcctcctcctccactaaccacaacatgttccctgccttaggatttccggtcaaccttagcccctccgatcccaaccatcggacggtccttgctgaagttgacttcctctccgctagaaacaattcatcacctcacactaacgatcatggaacccctcctaagtcttatccccatgtaaataccggtttacaacttctcaccgcaaacgctgggagtgaccagtcgacggtggatgatggggcctcgtcggatgctgaagataagcgtgccaagatgactgaggaccttcgaaacatgaatgcagagaaccaaaagctgaaggagatgctcagccatgtcagcagtaactacgcgaacttgcaaatgcatcttgcagcagtactgcaacagcaacagaaccaacgcactgagagcacggaacaagaggttgttcaaggaaaattagctgaggagagaaagcatggagttggcggaggaacggtgcctagacaattcctgagtttagttccaagtgaaatagatgatcaagtatctaattcttcttccggtgaaaggactcgatcaaccacacctcccagcaataaaaatgataaggataacaaagagactgatgacaagttgaacccttccaaccctacgacggatccatccactagtccagaagccgctatgagaaaagctcgtgtctcagtccgtgcccgatcagaagcacccatgatcagtgatgggtgccaatggcgaaaatatggacaaaagatggctaagggaaacccttgtcctcgagcatactacagatgcactatggcagttggctgcccagttcgcaaacaagttcaacgttgtgcggaggacagaacaattttgacaacaacgtacgaagggacccataaccatccactgccaccagctgctatggccatggcatcgaccactgtagctgctactagcatgttgttgtctgggtcaatgtccagtgctgatggaaaaatgaaccccaatttgctaactggagctattcttccatgctctaacatggcaacactttcagcttcagcaccattccccacagtgacattggacctcacacacaacccaaatgcgttgcagcagtaccaattaagacctcaaactcaaaccccattcctcccgtcaccgcctcagaactttatgtctggacccacaacaccacaactgccgaaactgattgcacaagtgctctataatcaatccaaattctcaggccttcaactttctcaggatgtggggcctaataattcccaagctccaacaccgtccttgttgcagccaagccaacaggtctcactcactgacaccgtcagtgccatcaccgcggatccaaacttccccgcagcgctcacggccgccatctcctccattatcggtggtgctaatccaaacaacaacaacaacagtagcaatcccaatgtcataaatagtgctacaattaatcaatag

SEQ ID NO: 14752 - DNA, 291 bp, Glycine max
  Peptide Sequence Number=SeqID_131530
atggcccgcacaaaaaaaactggccagatgacgtctgaggcagcaaaggaaattgctgagaagattgattcgttggagcagcaggcgtcacagggttcgtttgtcccccatggacgtcaggatgtcctgactgctaccattgggcgaccagaacaccctggtcgtgtgcgtgctactggagtcggtgtgaccatcaaacaatactttggaccggctcaaaggacctcccgcacttcttcctctatcgctcccgaagaactagagcagttgactcaacaaatcaaggactag

SEQ ID NO: 14753 - DNA, 1197 bp, Glycine max
  Peptide Sequence Number=SeqID_131531
atggccacgtcaacctcactcctcttgctttcatgcttcatgctacaccttgcttcaaccttcgttattgtccattcaacagataacaagtactacaacactttacctacctcaaagtatatgatcccggagagtcctaagaaagcattgctcaatgtgatagactcttgttggcgtacaaagccaaattgggcttcaaatcgccaagccttggctgattgtgcaattggctttggcaaagatgccacaggtggcaagtatggtgcaatataccgagtcaaagatccctctgatgaccctgtaaacccaaaaccaggcacactccgttatggtgcaatccaaacagagcccctctggatcatttttgacaaagacatggttattaggctaaaaaatgagcttatcatgaatagctacaagaccattgatggaagaggggctaaagtggaaattactgatgggccttgcattacaatacaaggtgttagtcatgtcattatacatggcattaacatccatgattgtaaaccagccaaacctggccttgtgaggagtactcctgaccatgttggtcatcgtctaggctctgatggagatgccattagcatatttgattcctccaatatttggattgatcattgctttttggctcgttccactgatggcctaatcgatgttattcatgcatcaaccgccattgcgatctctaacaattactttacccagcatgacaaagttatgttgctaggacataatgaccaatacacagcggataaaataatgagagtaacaatagcattcaaccgttttgctagtggcctaactgaaaggatgccaagggtaagatttggttatgcccatgtggtcaacaacaaatatgatgagtggaagatgtatgctataggcggcagtgctaacccaaccattttaagtgaaggcaatctttatgtagcaccaaatgacccaaatgcaaaacaggttaccaagagggaagggaaggaaaactggaagagttggaaatggaggtcttccaaggatttattcctaaatggtgcttattttgtaccatctgggtttggaagctgtgccccaaattattcacctactcaatctttttctgctgctccagcgtacttggtgcctgcaatgactctcaatgctggccccacaaattgtgttgttgggagagcatgttag

SEQ ID NO: 14754 - DNA, 1272 bp, Glycine max
  Peptide Sequence Number=SeqID_131532
atggcttcctttcaaaccacagctatattctcctcttccttttcttcttctccaggaaaagtcaacgcctctatccatgtccctaaccctccccgagtgacttatcctgttccaaaagtaccaacaagaaagttgcaaattgaggaatttaatggatcgccggtagactcaaccccattagagaagaatggcatcaccacacacatatatgaaggtttattcagccctggcaagaaatctaataaggccactactgttcaactctattcaattctggaggcagtagctgacagaattgaaatgcacagaaacattggcgaacaaagaaacaactggaacacccttcttctaaactccatcaacatgatcactctcactgcaacagccatggccggtgttgctgcagccaccagtggtgacactgagccgcttttggccatgaaactatcatccacactcttgttttctgcggccactgggatgtcacttatcatgaacaaaattcagccctcacaactcgctgaggagcaacgcaatgctacaaggttgtttaaacagcttcatagccaaatccaaaccataatcgctcttggaaatccaaccgaagaagatgtgaagggttcgatggagaaggtgttggcacttgatagagcttaccctcttcccttgttgggagctatgcttgacaagtttcccgcaaaatataaacctgctgtttggtggccttcatctcatcagttccaaagaagaagtaaaacacaagagagcaacaatggatggagtgaagatctagaaatggaaatgagggaagtgattgaagtggtaaagaataaagacttagaggactatgataggcttgggaacatagcgttgaagctaaacaagactttggctattgcagggccattactgagtggcattgcagcagtggggtcttcatttgtgggtaatggatcgtgggcagcattggtgcctctcatggctggctcattggcttcagcagttaatgcttttgaacatggtggccaaataggcatggtctttgaaatgtacagaaactgtgggggattcttcacgcttttggaacagactattcaagccacacttgaagagaaaaacttggacaacagagaaaacggtcaagtatttgaaatgaaggtggcaatgaagttgggaagaagcgtttcggagctgagacgacttgcctcaaaatctgcttcatgtcgtatggaaggaattgccgtagatgaattctccagcaagcttttctaa

SEQ ID NO: 14755 - DNA, 363 bp, Glycine max
  Peptide Sequence Number=SeqID_131533
atgaagctttgcttctacagatttgagtccattcatttacataaccgattacagttttttgataatgcatatggctactccacccagctctcctcctcccactcctcctcctacagaagcagcatcatagctgaatttgatatccctgaagcatctaacattaggacaaagaataaaatacttcagactgtgggggagcggtggagacagtttaagtttgacttgacgtcaaaatgggcacttgcagtcgacaaggacagtgtcgatgacactgtatgcgaaaaatatggatgtgtgaaaaaaggcacaggtcatctagaagcaaaacattatcccccacgtgttgtctcgtgggggttatga

SEQ ID NO: 14756 - DNA, 948 bp, Glycine max
  Peptide Sequence Number=SeqID_131534
atgttattattactactattgctgattcactcattgttgatcactcaatccacgccatgcagaacttcttgtggtgacattcccatcgaatacccttttggcattgacgatgggtgtggaagcccatactaccgttacatcctggtttgttccgactccggaaaactccaagtcagaaccccttctgggagatacaatgttcacaatgttagctatgctgatccacacattctaatcactgatccattcatgtggaactgtgacgatggtgagaattaccgtcccacaaggccattcagtttggacaccagcacacgcttcaagctttcccctcataatgagtatctattcttcaattgcagtgaggatcatgtgatcgttaagccaaagccaattttctgtgagcgcttccctgagcgttgtgactcttcgtgtgacagtggtagttatctctgcaggcacatgccagggtgctcctttgctatgagtggtagctcttgctgctcttactctccgagagccactgaatcgttgaggttgatgctcaagtattgtactagttatactagtgtttattggagaaacgttggtgctcctcagccttatgatcaagttcctgaatatgggatcagaattgattttgacattcccgtaactaggcgctgccttcagtgccaggatccttacaaaggaggtggaacttgtggatttgacactgggactcagagtttcatgtgcctttgtaaggaaggaaattccactacccattgtaaagattatgatgcaacacggcacaacagaaaggtccatgtgattgcagggacagttagcggtgtttcagctgcaggggcatttggaattggagctggtatttggtacttgaagaaagtgagagctaaagcaccagtaacatgtggagttcaaagcaatgagaatagacttttttga

SEQ ID NO: 14757 - DNA, 1260 bp, Glycine max
  Peptide Sequence Number=SeqID_131535
atggcttctttacaaaccacatcttccttttcctcttctctaagaaaattcaacgcctctatccatctccctaaaccttcacgagtgacttattctgttcctaaagtaccaacaagaaagctgctcgttgaggaatttaatgcttctatacaaacaagcccattaaaaaagaatgcggtcaccactcatatacacccagatttattcagccctagcagtagcaagaaatctaataaggccattgttcaactctacgcagttctagatgaagtagctgacagaattgaaatgcacagaaacattggcgaacaaagaaacaactggaactcccttcttctaaactccatcaacatgatcactctcactgccacagccatgaccggtgttgctgcagccaccagtggtgacactgagccgcttttggccatgaaactatcatccacactcttgttttctgcggccactggaatgtcacttatcattaacaaaattcagccatcacaactcgctgaagagcaacgcaatgctacaaggttgtttaagcagcttcatacccaaattcaaaccataatcgcactgggaaatccaacagaagaagatgtgaagagttcaatggagaaggtcttagcacttgacagtgcttatccacttcccttgttgggagccatgcttgacaaatttcccgaaaaatatgaacctgctgtttggtggccttcatctcatcagttccaaagaagaagtaaaacacaagagagtaacaatggatggagtgaagatctagaaatggaaatgagggaagtgattgaagtggtaaagaataaagacttagaggattatgagaggcttgggaacatagctttgaaggtaaacaagagtttggcgattgcagggcctctattgagtggcattgcagcagtggggtcttcatttgttggtaatggatcgtgggcagcattagtacctctcgttgctggctcattggcttcagcagttaatgcttttgagcatggtggccaagtaggtatggtctttgaaatgtacagaaactgtggcggattcttcacgcttttggaacagactattcaagccacacttgaagagaaaaacttggacaaaagagaaaatggtcaagtgttcgaaatgaaggtagcaatgaagttgggaagaagcgtttcggagttgagacgacttgcctcaaaatctgcttcctgtcgcatggaaggaattgccgtagatgaattcgccagcaagcttttttaa

SEQ ID NO: 14758 - DNA, 366 bp, Glycine max
  Peptide Sequence Number=SeqID_131536
atgaagtccttgaagaccctcttccttctagccatgctaatggctttggccgtttttgtgtctggaatatctcccggaagtggagaaccaaaagggaaaattaatcgattcctttctgaccgggtggtgctgaaatgtgacaaatacccaaaggtatgtcacattaaaggaagcgcaggatctgattgctgcaagaataaatgtgtcaacctgtccacagatgtctccaattgtgggaaatgtggaaagaaatgtagctatggtaagatatgttgcgaagctatgcgtagtacatatatgaaatggacgagcatgtctgtgttacttttggggccaatgcacgcaacaacatctttgtgtgattaa

SEQ ID NO: 14759 - DNA, 1533 bp, Glycine max
  Peptide Sequence Number=SeqID_131537
atggggaacaagatgaatgcgatcgcgttgtgcttgttagtgtcgaccctgttggtttctgcggtgtattgtgcaccgaatgctgggctccgtaggattgggctgaagaagattaaattggaccctaaaaacaggcttgctgctcgagttgggtccaaggatgttgattctttccgggcttctattagaaagtttcatctccaaaacaactttggtggcactgaggaaaccgatattgtcgcgttaaagaattacttggatgcacagtactacggtgaaatagctattggaacttctcctcaaaagttcgctgtcattttcgacactggcagctctaatttgtgggttccatcatctaaatgcaccttctcggttgcatgctactttcatgctaagtataagtctagcaaatcaagtactttcaagaaaaatgggactgctgcggcaattcaatatggtaccggagcaatttctggtttctttagctacgacagtgtcagagttggtgaaatagttgaatttattgaagcaactagggagcctggtgttacatttttggcggccaagtttgatggtatactgggacttggatttcaagagatatcagttggaaatgctgctccagtgtggtacaacatggttgaccaaggtcttcttaaggaaccagtattttcattttggttcaaccgcaatccagaggaagaggaagggggtgagattgttttcggtggtgttgatcctgctcactataagggaaagcacacttatgtgcctgtgaccagaaaaggatattggcagtttgatatgggagatgtacttattggcggtaaacccactggatattgtgctaatggctgttcagccattgcagactcagggacttctttgttggcaggtccaacgactgtcataactatgataaaccatgcaattggagcatctggagttatgagccaagaatgcaagaccattgttgcagagtatggacaaacaatattggatttgcttttggctgaaacacaaccgaagaagatctgttcccgaattggattgtgcgcatttgatgggactcatggtgttgatgtggggatcaagagcgttgtagatgagaatgaaagaaaatcattgggtggtcatcatggtgctgcttgtcctgcatgtgagatggcggttgtttggatgcagaaccagctgagccgaaatcagacacaagatcagatactaagttacatcaaccagctttgcgataaaatgcctagcccgatgggagaatcagctgttgactgtgggaatatctcttcattacctgtagtgtcctttactattggtggaagaactttcgaccttagcccagaggagtacgtactcaaggtgggtgaaggtcctgtggctcagtgtattagtggctttactgctatagatattccacctccacgtggccctctctggatccttggtgatgtcttcatggggcgttatcacacagtgtttgattttggtaaactcagagtgggatttgctgatgctgcatag

SEQ ID NO: 14760 - DNA, 471 bp, Glycine max
  Peptide Sequence Number=SeqID_131538
atggataaagctctaactaaactgggtagcgcttggatctccaagaaagccaaggcagagatttcccacataaccgatgacctgtcatgtaaacattttaatattttgtgtacaagaatgtttataccgtgcttgcaatttcagtctctcccaaatacagtcgaagagaaggcaaaactttttatcaacaagctcaaaggtaaaacccagaaagccttgcctgatctccttcgagagtacaaccttccaaccggtctgttccctcgcaacataacaagctacgaatttgatgcatcaaagggaaagttgatagtgtacttgtcctctccgtgtgagggtcattatcaaaggggaagctcactgttatatatagatggaatgaaaaccaaggttcttgtctgggtcaaggtgactagtgttgctgttgagagttacaagtctgacaaagtatggttcgctaccattgagtaa

SEQ ID NO: 14761 - DNA, 699 bp, Glycine max
  Peptide Sequence Number=SeqID_131539
atggcaagcgcaagtgttggtaaagaactgacgctgtattcgtattggaggagctcttgttcccaccgagtccgaatcgctctcaacctcaaagggcttaaatacgaatacaagcccgtcaatctgctcaagggagaacaatctcgccctgagtttctccagctcaatcctgttggttgtgtccccgttctagtggatgaccacgttgttctctatgactctttcgccattattatgtatttggaagataagtatcctcacaatcctttgctccctcatgatatttacaagagagcaatcaatttccaggctgctagtgttgtttcctcaacaatacaacctcttcataacttgagtttactgaactacattggggagaaagttggccctgatgaaaaacttccttgggcccaaagtataattagaagaggctttaaagcactggaaaagctattgaaagaccacacaggaagatatgcaactggagatgaagttttcctgataactccttttcaagggtacaatagccttaatatcttgactggcattatcagaattcctatgtctgagtctgaccatgggatgggacaccataataaatgtttttatgctctgatattttgtattacaattagaatgtcattcaactccaaagtcaatgataacaagattttgaaaattagtaggattagctgttga

SEQ ID NO: 14762 - DNA, 204 bp, Glycine max
  Peptide Sequence Number=SeqID_131540
atgagcaacagagtgggtttgagaaggagcaggagatcgatttttttgggggagatctctggtgtatcttttagccctgacacagaatcactttttgttggtgtctgggatcgcacctatggaagccttcttcagtacaatcgacggagaaactatatgtatcttgactgcatgaatttgagaattgtggcaccacctgactga

SEQ ID NO: 14763 - DNA, 373 bp, Glycine max
  Peptide Sequence Number=SeqID_131541
atgagtttctctgccgcctgcagttatcttggtgggttgatgtacctcatgtacagactgccttttgtcgagtgtctaatgtttggtgcacttatatccgccactgatcctgttactgttttctccatatttcaggagcttggcacagatgtcaatctatatgccttggtttttggagaatctgttttgaatgatgcaaattttgagggaaacaatggttatttatctcctgatgatcaagagccgtcatcagggaacaaaatcaagatgaagcttcaagaattccaaaggagtgctgcatcttttacagcattagataaaaactaccccaccccattcttaactagtcaaaatggagacgaggaagatgaag

SEQ ID NO: 14764 - DNA, 1044 bp, Glycine max
  Peptide Sequence Number=SeqID_131542
atgggaagtaaggagacaagatttgtggttgtttggttggggaaggaaacattggtaaaagcaaagctttctggcatctcaatgatgacacaagaatcatcagaggtgttgggaaaacatgcaagctcaggttctcatgtgagggggagtagtgaatatattagactggtcatatccgatgaacaaagggtggttgaagctgaaaccttgctgactcgagcagaatcaagaatcaagtctttctggtggtggatgaaatcctttttatggtgtgttgtctttgtgatacttgtttttattcttgtcaaatggggagtgccacttttttttgtaaaggttctttacccaatcatggaatgggaagctactgcctttggccgtccagttcttgctttagtacttgttgcctctctggctttattcccagtgttcttaatcccttctggcccctccatgtggctggctgggatgatttttggttatggccttggcttctttataataatggttggaacaaccattgggatggtcctgccttacttaattgggctactgttccgtgaccgcattcatcaatggttaaagagatggccccaaaatgctgcaatgattaggcttgctggggaggggaactggtctcgtcaatttcaagtggttgcactgttcagggtttctccttttccctatactatattcaattatgccgtggtagtcacaaatatgaggttttggccctacttatgtggatcagtagctggaatggtaccagaagctttcatctatatctacagtggtcggttaataaagacattggcagacgcacagtatgggaagcaccacttgactactgtggaaatcgtatacaacattatttctttcattattgcaatagttaccactattgccttcactgtctatgccaaaaggactctaaatcaactcaaaatggcagagttgaatgatgaagttacctttgtttctgtagagatggagaagcttccccttgaaaggcctaaacagcttagtttgtcaaaattttcgtga

SEQ ID NO: 14765 - DNA, 189 bp, Glycine max
  Peptide Sequence Number=SeqID_131543
atgaacttaatttatgtctctcaactgtgtcaaactaataatgtgtacaagctctccccacgatcacccaccccccacacctcacttgctacaacagccaactccattcaactttggcatcactgcctctcaaattcttcatcatgcactcaagaccaacaacatctcctttactggcaccttcagtaa

SEQ ID NO: 14766 - DNA, 816 bp, Glycine max
  Peptide Sequence Number=SeqID_131544
atgtctgatgagtttacaactttaattgaaaatgcaaggctagttgctaaaggttttcatcaatgtcggggcattgattttaaggaaacctttagtcctgtcattaagcctcagaccattaaacttgtgctctgcattgctatctcaaatcactggactcttagccaaatggatgttaacaatgccttattacatggaacactgactgaggaggtctacatatctcaacctaccggctttgttcatcctaactttccacatgtttgtaaaatgcataaagccctgtacggtctcaaacaggctccgcgcgcatggtacaatgagcttaaatcatttttggtagcctatggattcttcaactccaggtttgagccgtttcttttcatctacaagcaaggttttgttactgcatattttttggtgtacgtggatgatcttctggtaataattcccattttcttatcacctttaaaagtgccctggctaagcaattctccctcaaatacctggggaccccaagtcacttccttggtgttgagctattaccgtcacaatctgaaagcttctatgattgatgccaagcctgtttgcacacctctgtccacttcgtgctctcttagctcagttggagatgactccacctgtgatgtcacctcttatcgcagcatcacaggctcacttcattacttatccatcactcgcccgaatgtagccgttgttgtcaataaactcacaatttatgaagactcctattgccacccacatgcaggctctcaagcgagtacttcgctatctcaagtctacaatatcacatga

SEQ ID NO: 14767 - DNA, 3273 bp, Glycine max
  Peptide Sequence Number=SeqID_131545
atgtcagagcaggaaacacattcttgtggcttactcttattctttttctggatccttctttcaggtaaagatgttgtaggggaatctttggacaaagacaaagaggttctgctgaagctgaaattgtacctggacagcaaaattcttgcagacagaggagggtacatatattggaacaccaatagctccaatccttgtgaatggaaaggaatttcatgcagtgctacgaagagggtggttggcatagacctttctaatagtgacatcactggtgagatatttaagaatttctcgcagctcactgaactcacacatcttgatctctctcagaacacgctctctgatgagattcctgaggacttgaggcactgccacaagctcgtgcatctcaacctatcacataatattcttgaaggggagctgaacttgactggattgataagcttgtgcacattggacttgtcaaataacagattttatggggatattgggttgaattttcctgccatttgtgccaatttagtcattgcgaatgtctcaggtaataaattgactggtaggattgaaagctgctttgatcaatgtgtaaagttgcagtacttggatttgagcaccaacaatctgagtggaagcatatggatgaagtttgcgaggctcaatgagttttatgttgccgagaaccatctaaatgggactattcctttggaagcttttcctttgaattgtagccttcaagaactagacctttcacaaaatggatttgttggtgaggcacctaagggggttgctaactgcaagaatttaaccagtctgaatctttctagtaacaatcttactgggactattcccattgaaatagggtccatttcaggccttaaagcattgtacctgggaaacaacagcttttcaagagatattcctgaggcccttctgaacttgaccaatttgtccttcttggatttgagcagaaaccaatttggtggggacataccaaagatatttggcaaatttaagcaagtaagctttcttctgttgcactcaaataattacagtggaggattgatatcctcaggaattctcacattaccaaacatttggcggttagacctaagctacaataacttttcaggtccactacctgttgagatttctcaaatgacaagtctgaagtttctaatgttatcctacaaccaattcagtggatccattccacctgaattcggaaacattacccaacttcaagcccttgaccttgccttcaacaatttgagtgggcctataccctcaagccttggaaacttgagctccctcttatggttgatgcttgcagacaattctttaaccggagaaatccctctggagttgggaaactgttcaagcttgttatggctaaaccttgccaacaataagctctctggaagtttgccttctgaactgtccaaaattggaaggaatgccacgaccacatttgaatcgaataggcgaaactatcaaatggctgctggatctggtgaatgcttagcaatgaggagatggatacctgcagattaccctccattcagctttgtgtatagcctcttaaccaggaaaacttgtagagagctttgggacaaattgctcaaaggatatggtgttttccagatttgcacgcctggtgaaagaattcgcagaactcagatatccgggtatattcagctaagttcaaaccagctcagtggtgaaatcccttcagagattgggacaatggtgaacttcagcatgatgcacttggggttcaacaacttctctgggaagttccctccagagattgcaagtattcccattgtggtgctaaacatcacaagtaaccagttttcaggtgaaattcccgaagaaattggcagcttgaagtgcttgatgaatcttgacttgtcatacaacaatttctctgggacctttcccacaagtttgaacaacttgacagagcttaacaagttcaacatctcatacaaccccctaatatccggtgtggttccatcaacacgacagtttgctacctttgagcaaaattcatatttaggcaacccccttttgatccttcccgagtttatcgataacgttaccaatcatacaaacaccacctctcccaaagagcataaaaagtccacaagactgtctgtgtttttggtgtgtatagttataacactggtttttgcagtattcgggcttcttacgatcctagtctgtgtatcggtgaaaagcccttcagaggaaccaagatacctcttgagggatacaaaacaatggcatgattccagcagctccggatcctcatcatggatgtctgacacagttaaggttatccgtctgaacaagacagttttcacacatgccgacattctgaaagcaactagcagcttctcagaggacagagttataggaaaaggagggtttggaacagtgtacaagggagtgttttcagatggcagacaagtggcagtgaagaagcttcaaagggaaggtcttgagggtgagaaggaattcaaggctgaaatggaggttctgagtggtcatggctttggttggccacatccaaacctggtcacactctacggttggtgcctaaatggttcagagaagatactgatttatgagtacatagaaggtggaagcttggaggatttagtcactgatagaacacgtttcacatggaggaggaggctagaagtggcaattgatgtggcacgtgcactaatctatttgcaccacgagtgctacccttctgttgttcacagagatgtgaaggctagcaatgtgttactagacaaagatgggaaggccaaggttaccgattttgggcttgctagagtggttgatgttggggagagtcatgtgagtactatggtggctgggactgtgggctatgttgcacctgaatatggacacacttggcaggctactacaaaaggggatgtgtacagttttggggtgttggttatggagctggcaacagcaagaagagcagtggatggaggggaagagtgtttggtggagtgggctaggcgtgttatgggttatggacgacatcgcgggttgggtcgttctgtgccgcttttgctaatgggttctgggcttgttggtggggctgaggagatgggtgagttgctaaggattggggtgatgtgcacaactgatgcaccacaggctaggcctaacatgaaggaggttcttgctatgctgattaagatatccaaccccaagggggactcaagttatggaccctaccttatttag

SEQ ID NO: 14768 - DNA, 1171 bp, Glycine max
  Peptide Sequence Number=SeqID_131546
atggctcaacaacaggaggacgaaatggagtatgttgctgatgataatgaaatggcggaagtagaagatgacatgtatttccgtggtagagtgtttggtgattcagagtccgaatcagatgacgatgatgaatatgactccatggaaaatcggatgacagatacctctgctgcagaagccaggaaaggaaaggatatccaaggtattccttgggatagacttagcattagtcgtgagaagtatagacaaactagactagagcagtacaagaactatgaaaatataccgcaatcaggcgaacagtcagaaaaggaatgcacaccaacacatagaggaggaaagtattatgatttctggcaaaacactcgatctgtgaaatcaacaatacttcatttccaattgaggaacttggtttgggcaacatcaaagcatgatgcatatcttgtttcgagttactcaattatacactggtcgtctttaaattccaagagatcagaaatcctgaatgtatcagggcatgtagctccatgtgagaaacatcctggaagccttttggaaggatttactcagacacagattagtacactggctgtgcgggataagttgttgattgctggggggtttcaaggagaacttatttgcaagtacgtagatcgacctggtgttagcttttgttctagaactacttatgatgacaatgcaataacaaatgctgttgagatttatgatcatccaagtggagctgttcatttcatggcttcaaataatgactgtggagttagagactttgacatggaaagatttcagctttccaagcatttctccttctcctggcccgtaaatcatacttcattgagcccggatgggaaactggttgtgattgttggagacaacccagaagggatactagtggattctcaaactggaaaggtggtgttctcttttggtttgtgttacaaattccgtatgcattgtgtctggactgtcaagcctttatgtggacacttggattactcatttgcgtctgcatggcatcctgatggccgcatttttgctactgggaaccaagacaaaacatgccgtgtttgggatgttaggaacttgtcaaagtctgtcactgtgcttaagggcaaccttggagctatacgttctatacggtttacatctgatg

SEQ ID NO: 14769 - DNA, 1374 bp, Glycine max
  Peptide Sequence Number=SeqID_131547
atggcttccgaaacaaaccagtccaagaatgtgtgtgtaattggagctggaccctcggggctattggcagcgagggagctgagaaaagaaggtcacaaggtggttgtgttggagcagaaccatgatattggaggtcaatggctatatgacccaaatgtacaagaggaggatcccttaggaagagacccttggctaaaggtgcatagcagcatctatgagtctttaaggttcatgtctcccagagagatcatggggtcaactgatttcccctttttagtcaagaaaggtagagacacaaggaggtttccaagccatacagagttccttctctaccttaaggacttttgtgaatggtttaagttgagtgagatgatcaagctcaatacaaaggtgcattatgtaggaccattaaattatggtgtccctagtgaggatttgaaatgggttgttagaagcaaagagaacaagagtgaggaggaagttgaacaagtctttgacgcagtggttgtggccactggccatttctctaatcctagattgccctgcattcaaggaatggacacatggaaaagaaaacaaatgcacagtcatatttacaggtcttcagagccattccgcggggagatagtggtggtggttggaaattttttaagtggacaagaaatatcaatggaacttgtgaaagtagcgaaggaagttcacctcagttcgaaatctcttatcatttttgagggtttatccaaagtcatatccaaaaacgagaattttcaccttcgtccacagatagacacccttcaagaggatgggactgtgattttcacggatggttccaacattatcgctgacactattttatactgcactgggtacaattattcttacccctttctcgacaccaaaggaatagttgttgtggatgataacagagtgggtcctttgtatgagcacactttcccaccatcacttgctccttcactttcttttgtaggcatcccccgaaagatcctggggatcactttctttgagtcccaaggaaaatggatagcgcaactactgtctgggaaaaaagttttgccatcatatgaggaaatgatggaatccatcgaggagttctatcattcaaatgaagtagctggcattcctaaacgctacacccatgtggttgatgcctttgattattgtgacaaatacggagaaaatgttggattcccaaagacagaagaatggaggaaagagttgtgcatatcagctggaatgaacgcttttgccaacttggagacatatcgtgattcgtggaatgatgatattgatgagaagcttcaggaggcccttcgaagtccttacttcactcaacttgaacaactttctctgtaa

SEQ ID NO: 14770 - DNA, 5097 bp, Glycine max
  Peptide Sequence Number=SeqID_131548
atggaggataatgaagtcgttgatgatcagaactcaggatggttccaagtcaaaaagaagcacagaaatacttcgaaattctctttgcagagctgggtggggggattgtcggggaaaaatgcctctaactctctgcacactcagcattccatgactaaaactgatgacaattcacatagccagcagaaaactcatctttcaaggtcaggggagaatttttcacagaaccctgtccctgggagtgttgcaagttctatttccgaatcaaatgaaaaagagggcacaaactgtcttaatactagtgtagttagacataatactggaagtcagaaatcatctacattacttactatggattctcaaggtaaacatgaagaagttaggaaattagaccaaactgataagcctgacttagcccagaaaacacgatggggtgatttagaggaggggggcttggcactgccccatgaaaacttgattggagttggaatcaaatttggtagtattggagatgatagtttacttagctgtagaaaaaatgggaatattcctgatccttgtgattcatatcatcctcctgaaaaaaacttgacagcaactactattgatgcagaggctgtttctggtcagatccctccagtgagatgtgaagacgaaaagcttggggagaatggtaaagatgttaagaacatatctttggaacatttgaacattcaagaaacaaatggggaaagaattggtccagaagatgatatattacactgtgttatgaaaaatgatgatgtgaataaaacgactgatagtgccattaacaatgatattttgtctgccaaagatgctacagcggttgcaaatcaagtgcatgcctctatcaatgtggtaagtgatataaacatttctgaagtggcagaacaaaatggcagcttgagtgtagcacttactgcccagggtactgagtcacaagtgcctgaaattgttaatgattctgtggcttccgctgaagtggttagtgatccacaggatgatattgtggaaaatgttgtttcaacctctcataatatgagttctcttgaagaaggtggttccaatgaaagcaaagaaaggtttaggcagaggctttggtgctttctgtttgagaatcttaataggtctgtagatgaactttatcttctttgtgagctagaatgtgatttggagcagatgaaggaggcaattcttgttcttgaggagtctgcgtctgattttagagagctaatcactagagttgaggaatttgaaaaggttaaaaaatcttctcaaacaattgatggagttcctgttatcttgaagagtgatcaccgccggccacatgctctctcatgggaggtccgaaggatgacaacttcaccgcatagggcagatatactatcttcatctcttgaggcttttagaaagattcaagaacagcgtgctagcttgcaatccggtaccacagaaaatgccatgtctaaatgtttgacttctgaatctattggcaatatgaacaagtcaagggtcaatgatggaacagatgatgccaaatattcagtgacaaagtcaagaaagcatgttggatcttcagatgcgaagcaagggaacccgaatgaaaaaaatcatagtattgatggagggaaaccctttgactcggtcacagtgcaaaatggatgtaacccaccagaaagcatattaactgcagaaggtaagttatctaaattatctctgttggagaattcttctgcttctgccaccaccaagggcaaaagagatcaacttggatttggatctgacaagacactttataagaaagataaagcaccaacagaagttgttaatgagaaaaatgccagatgcacagataatcttaggaggcaaatgccagtgcctgaaaaagataaggagaaaaggagttctgccccaggaaagtctttgaatgcttggaaggagaaaaggaactgggaggacatactttcatctccatttcgtgtctcttcccgtgtgccatattcaccaagcctgagccgaaaaagtgccgagcgtgtacgtactctgcacgataaactaatgtcgcctgacaaaaagaagaaaacaacttcagacttaaaaagggaagcagaagaaaagcatgctcgtgctatgagaatcagaagtgagttagagaatgagagagtccaaaagcttcaacgtacatcacaaaagttaaatcgtgtcaacgaatggcatgctgtccgtcatatgaagttacgagagggcatgtatgcccgccatcaacggagtgaatctcgtcatgaagcttttctagctcaagtggtgaagagagctggtgatgaaagtagcaaggtaaatgaggttcggtttattacttccttaaatgaagaaaataaaaaattgatgttgcgtcagaaacttcacgaatcagagttgaggagagccgaaaagcttcaagtgctaaaatctaagcaaaaggaggatttggcaagagaagaagctgttctagagcgtcgaaaactcattgaggctgaaaagttacagcgtcttgctgagattcagcggagaaaggaggaggctcaagtcagacgggaagaggaaagaaaagcgtcaagtgcagcacgggaagcaagagctattgaacagcttcgaagaaaggaagaaagagccaaagcacaacaagaggaagctgaacttttggcccagaaattggcagagagacttaatgaaagtgaacaacgccgtaagatttacctggaacaaattcgggagagagcaaatttgagggatcaatcatcccctttgcttcgtcgatcaataaataaagaggggcaaggtagatccacacctacaaacagcagtgatgattctcaaacaaacattgtttctggcattggttctagtcttagaattggcaatgtcacattgcaacactcaataaagagaagaattaagagaattcgacaaaggcttatggctttaaagtatgagtttcttgagccccttcttggtggtgaaagtgctagcctgggatatagagtagcagtgggtgctgctagggcaaaagttggccggtggcttcaagaacttcaaagacttaggcaagcaagaaaagaaggggccacaagtatcgggctaataatttccgaaatgatcaagtatttggagggaaaggatcccgagttacaagcatctcgtcaagctggactacttgattttattgcttctgccttgcctgcatctcacacatcaaaacctgaagcatgccaggttatgttgcacttgttaaaacttctgagagttgtgctatctacacctgcaaataggagttatttccttgcacagaatcttttgcctccgatcatcccaatgctttcagcagctcttgagaattatataaaaattgcagcatctttaagtattcctggcaatgtcagtttgccatcaagtaaagcattagttgagaacttcgaatcaatttctgaaatattaaataattttctgtggactgttactgctatttttggtcatataagctcggaagaaagacaacttcagatgcgagatggcttgctagagttactgatttcctatcaagtgattcaccggttaagagacctttttgcacttcatgataggccacagatggaagggtctgcatttcctacccctattctcttaagcatacaacttttggtggttttgacctccagatctggaagattgagttatattgactgggaatcttcccttgtggcgatggagcaggaaattggtagtgaaggggctaagtttgcagatgctgcacattttgtagtgaataactcctgggaaaatttcaatcccttatcagtgaccactggaagctcagttgtgcatttacctgatgtccctgaggacagaccattggaagaaatgattaaggtgaacaagagtgatgaatctatttctattgggaaggactgtgaattggagcatgatagttctgttaaattgaaaaatgatgatatggagaagatagatgatctagatgaatccaagaaaaatcagaatggggatattactaatttgtctgttctccaaaaggatgagaaacatacagtggtaagcgttacagtacagaaaaatgaaagaatatcaaatttggctcagccggcagtatttcttctttcagctatttctgaaacgggacttgtcagtctcccttctcttttgactgctgttcttctgcaggcaaacaatagatcatcctctgaacaggcctcatatatccttccatctaattttgaagaggtggcagctggagtactgaaggtgctgaacaatgtggctcttttggatcttgtatttttgcagcaaatgctggctaggccagatctgaaaatggaaattttccatttgatgagcttccttctttctcattgtgcctgcaagtggaaagctcctaatgatcaggttggttcacttgtgcttgaatctctatctcttcttggtcactttgcattgtttcatcctggaaatcaagctgtccttcgatggggaaagagtcccacgatcctccataaggtttgcgatctgccattcgttttcttcagtgacccagagttgatgccaatcttggctggcacgttagttgctgcatgctacgggtgtgagcagaacaagtttgtagttcagcaagaactgagtgttgacatgctactttccttactaaggtcttgcagaaatgctgcgcctgcaacccagcttaattcaaccttagacaattccactacagatgaatctagtgaatgtaatcaattaggtactgaagttaaaaagcctcaagtggacattcctgtaaaaaatagtcgttcaaatggcaaaggccctcgggcttcctcgggaaagagtggtgcttcgggaaataacataaaaaatggcagaatacgaagccaacgggatggcaaaacaaccaagaattctgaagaagtggctcctaagcacggcgagccgtcaaatttaatgttgcactgtagatttcctcccagcttcattgataaagtagagcagtttttttcagcggaaattgctaacagggttgatgaactctga

SEQ ID NO: 14771 - DNA, 1758 bp, Glycine max
  Peptide Sequence Number=SeqID_131549
atggcagaggaaagtgatgttaaccagttaaagtctgagaaaattgagcctgaagatgttgatgaaaaagcaaatcctaatgagagattaaccatcacaaaagttccaccaaagagtctttcgcgttatcttagtcctcgaaaaagttcctgccatgatctttgcaaatatggcatcccacatgaagccaaaccatggagtccaacacagaaaagggttaccaaaaaggaaagaaaaaccaaagttccacaagagatgacttctttggaaggtacaaagaaatcaggaagcagttcaaagccttctcaaacttcaaaaattgaaaaggccaatattcctgttgacaccaaggaagtaacatatgaaaaaacagtcacgtcagggaaaaactcaccaccttatgaagaaacacatgtttcctcggaacataacaacagtgacctaaagcaagaacagtctgagccatctctcccagtgaaggaatctgccgagagtcaaacaaaaagggaaatagtaaaaaataagagcccttctgattcaagcagcagaaagaaaactgaaagcagaagcaaacagaaaaagacatctttaactggagtcaaggaaaaaccaactccaccaagtcttcccttgtctccaaaacacaatgtcaagaaatctcaaagcctaagctccaagagtttcatgaacatggcaagagagtcctctctgaaacctcaagacaatgttgaagaagtcacacctgaactagccagcagtgacaatttaccagacaatatcttgcatgtcactgaacctgcctcagcaaattcatctgaggaccctactgtggcttgtgatgcaactaggttgtcttcaccctcgccttcatcatcagaggaaaaaagcttgaagcataccaatgaaaaaactggcaagtctgcagtgtctgcatcttcaaggaagggtcttggatctgtggctgggaacaaagagaaggtaaatacgcgtagtgtttcacgatcgccatcggtatcatcatatgtttcctcttccgtgtcttcccttcggaaacaaaacaatgctacatctaagtccaacaatagaatacatcatcatcaaggtgaaaatgtgaagatggggtacaaaatcaggccaaaaatgagcaccaaagttggggcagctaataaagctgttgttacagcccgaaaattgaattttaggagaggaaaagtgattgaacttcagcctcagtgcaacaacgttccaaggagactcaaattcaagccgacacgcattcttggtgatgacatgaggaaagacataaatgttgctagaaaaaagaccattgtggataataaagttggtggtgatggtgaggtaaatgctgctactacaaaatcagagaaagatgtggccaaactccaaactgtggaaggaagtaaaaggagaattgtcgggaggaaggttggtggggataggagcaagatacagggttcaaaatcaggttctgatgagaaagttgtcttgagacatcaaaaagtggaagggaagaaacaaaatcctcgtttgtataataatgtgattgaagagaccgcaagcatgcttactgagctaaggaagagcaaggtcaaggctctagttggtgcatttgaaaccgtgatatctcttgattctcttagagaggccactgccacggaaagtgataatttacacatgggacaaagaggaagacgtggttatgaaagtaactttggtcttaagccttggcctttgtga

SEQ ID NO: 14772 - DNA, 678 bp, Glycine max
  Peptide Sequence Number=SeqID_131550
atgatcaagttcaacacaaaggtgctttatgtgggaccattaaattatggtgtccctagtgaggatttgaaatgggttgttcgaagcaaagagaagaaaagagaggaagttgaacaagtgtttgacgctgtggttgtggcaaccggccatcactctaagcctagatttccctgcatgcaaggaatggacacatggagaagaaaacaaatgcacagtcacatttacaggtctccagagccattccgcggggagtggacaagaaatatcgatggagcttgtgaaagcagcgaaggaggtacaccattacttagggtttatctaaagtcatatccaaacacgagaactttcaccttcatccgcaggtacaactattcctttccctttcttgacaccaaaggaatggttgttgtggatgataacagagtgggtcctctgtatgaacatactttacccccattacttgctccccctctttcttttataggcatccccaaaaagatcctgggactccctttctttgagtcgcaaggaaaatggatagctcaactgctttctgggaaaaaagctttgccatcatgtgaggaaatgatgaaatccatcgaggagttttatcattcaaaagaagtagttggcattcctaaacgtttcacccatgaaattggagctataggctttgaa

SEQ ID NO: 14773 - DNA, 845 bp, Glycine max
  Peptide Sequence Number=SeqID_131551
gtctacaaccatttgtgaccctttttcattgggatcttccccagactttggaagacgagtatggcggcttcctaagccctcgcattataaatgatttccaagactatacagaactttgtttcaaagaatttggagatagggtgaagcattggattactataaatgagccatggagttatagcatatttggttatgcaactgggatgatgccgccaagtcgatgctctaaatggctaaatccaaattgcatggatggtgattcagggaaagagccttatttagtttcacatcatttacttcttgctcatgcagcagttgtcaaaatgtacaagaaaaagtatcaggcatctcaaaaaggagtgataggcataaccatagtgtctaattggtttgaggcatattcaaataacaaattagataaatatgctgcccaacgagcaattgatttcatgtttggatggtttatggaaccattgacatcaggaaattatccacaaagtatgcgttctctacttggtagacgattgccaaagttcactaaacaacaagtcaagcttatcaatggctcatttgattttcttggcctaaactattatacctctaactatgttgtcaatgcacctaagttaagcaatggcaaacctaattacgctacagattctaatgccaatcttacaactcaacgcaacgggactcctataggtccaatggcggcttcaaattggttatatgtgtatcccaaaggaattagagaattgttgctctataccaaagaaaagtacaacaatcctttaatttatatcactgaaaatggtaattacactaaatcatatttattatcttga

SEQ ID NO: 14774 - DNA, 1572 bp, Glycine max
  Peptide Sequence Number=SeqID_131552
atgggagggaggaagaagaagttcatcgacaagaagaactctgccactttccaactcatcgctcgcgacacctccgacccttctttctcccaatccgaccgcgtcttcgtccgcgtcgacaacaaccccgtttccttccccgtcgccgatgactccgcttttgatgacgcccccgacgactactactacgacgacgacgccggagttagcggtggtcccttgccggaggacgtgaggagggagattctggagctagggtttccggatgatggctataactacttgaatcacttgagggaaatcaagaacagtggcgctggtgctgctttctaccacaaccccaagttcaagctacaacacctccctcgcgatgttaaggcatttgatgcttctagattgcaaattgctgaggcggatggagagcctgaggagaacactatatacagtgttgcgtccaagactaccagcgtaagggtgcagaaagcagttgatcctgaagtggctgcactgcttgatgatgacgatttgtcacggttgggatctgatgtcgaggatttggaagaagactttgttgttcaggcgaatctccttgaagatgaagatgaagatgaggaagagaaggattgtatatttaatgaaacgagtttttccgaggaatctgcgatacatagaaacgggaacagtgcacatgcactgcaagtttcttcctattccagagtcacagatgattctggacctttggatggggtgacagatggtgtaccaggagaggactgtgttggtgagaagcaaagagctcgtcgtttgctggacgagcaatttgatttgctcgaacgccaagaatatggaactgatgatgatgatggtgattattatgaaaattatgaagccgatgaagatgagtcccttgctgagaagctcaaacactctcttaacaaccatgtattggatgatctagaacttgatgatgacaagtataaggttcctgcagacttattgaagaataaagatgctccacatgaggaacaagaggattctgctgctgatgtgattcgtcgctgcaaggaatatgctgaggagtatgaagttgaagatgatcacaaggatgttgtacttgtacaagaaagtagtgatgaatcagaagtttgggattgtgagactattgtttcgatgtactcaaatttagataaccaccctggaaagattgaagcacctggagtaaccaggaaaaagaaattgtctgaaaccgtgtctgcagtcttgagttcctctagtcaaataataccccttagaggaaaagagaaactccccgtagacttcttgcctggtggtaggaaacctgccaccgaaaaggttaaaggccagagcattgcaaaaactgagcagtacaagagaaaacaacatggccttgagtcaaaggaggagaagaaagaacggaaggctgctgtgaaggaggaacgacatgaggcacgtcgcaataaaaaagaaatgaaagagctttataaatgtgaagcacatcgggcacagagagctgctgctgtgtctggtccttcttccattcatcttttgtag

SEQ ID NO: 14775 - DNA, 774 bp, Glycine max
  Peptide Sequence Number=SeqID_131553
atgaaagtgcagttaggtatgaaggttttggaagaggttggtggccatgtacttaacccagaacaaggttccgcagtcgcatctgtattctctggtaccgcaagttttcatatgagccttccaatcggagtgtacggcgtatttcttagaacagcgttcgcattgccactttttctcaccgtgttttctgcagaagtgcttcttgatgccggtgaggtcgccgagcgcccttgcggggttgtggtggacgcaggaaggttcgggacacacgttctgatcgcgctggaagcctttgttgcagatttgagtgcgtcgagaacctcgggctttgaagggtttttagggttccaaggagctgaatggacgcgtagaggagaggaacagactccaagaaatgaggaagcagtgactcctacaaggagactcaacattgagtacaatggcagtgacctatgcgactcatttgagttcaaacagataactttacaactcaacgaggccattcaaacctcaaacgaatcttcaccagcttacaaagaaatgacgcacaggcacaagcttaaaaaggcaattcagggctctaatggctcgtcgccatcattagtcttccacctaaattcacctatttatcgtcgccacctgaagcgtctctacaaagaaagcacaaaggcaccaagaagaattttcagtccaccagtaccggataaaccagcttgcgtaagaggaataagagaaaaaggttttgttactcgcctgtggttaaaggtttactag

SEQ ID NO: 14776 - DNA, 1161 bp, Glycine max
  Peptide Sequence Number=SeqID_131554
atggaaatgaactatctgttgaatctgggaatagtgagagcattggtgaagtgtccacagaaagcactggtgattctcatcaaatacagaatggtcatcatgaagtgggtgaaaaaagtagctcgaataagggggttcaacatcaagataatgaatcttagacggaattcatcaatcaaccagaaggatgaatcccactcattaggagtgaagcagaaatatgatttgattgatttgcctctggatgcaagaccattgttagtttttataaacaagaagagtggtgcccagcgtggagactcacttagaatgcgtctgaatatccttttaaatcctgttcaggtgtttgaattgagctcaacacaggggccagagatgggactttatttgtttagaaaggtgtctcacttcagagttcttgtatgtgggggagatggtactgttggttgggttctgaatgcaatagacaagcaaaattttgtttcccctcccccagttgctattcttcctgctggtacaggaaatgatctcgctagagttctctcctggggaggtggcttgggtccagtggagaggcaagggggtcttactacatttttgcatcacatagaacatgctgctgttacagttcttgaccgttggaagggggttgggtgggttatagatggagagaaagatgtctttaggagtctggagcatggtctggaattggttgtgatgcaaaggttgctttggacattcataatctgcgtgaagagaatccagataagttttataaccagcttgtctagtagtgatcttgatctgtctgacacccttccatgggagatgaatgacctttcctttcaatttatgaataaagttctatatgcaagagaaggtgctaaaagtattatggataggacatttgcagatttaccttggcagattcgagttgaggttgatggagttgaaattgaggtccctgaggatgcggaaggtgtgcttgttgcaaatattggaagctacatgggaggtgtagatttgtggcaaaatgaggatgaaaattatgataattttgatcaacaatccatgcatgataagatacttgaagttgtgagcatatctggaacatggcacctcgggaaacttcagctaaagggtctactgcttgagttttga

SEQ ID NO: 14777 - DNA, 189 bp, Glycine max
  Peptide Sequence Number=SeqID_131555
atgcggatgaggcgcactcgatgtttccatttgctgcatgctttggtgctgacgattggttcctgtgttgcctacctaccaaacggtattcgtgtggctagtcagacccattccatccaggcctctttgttggggacgctggaggatttcaaagtcccacacgtgaaccacgttagtcgtccatcataa

SEQ ID NO: 14778 - DNA, 820 bp, Glycine max
  Peptide Sequence Number=SeqID_131556
atgtccaagacccacctgttcgacctcgacggcaagattgccttcgtttccggcgccagccgtggcatcggcgaggccatcgcccacttgttggcgcagcaaggtgcccatgtgatcgtgtccagccgcaagctcgacggctgccagcaggttgccgaggccatcatcgccgcgggtggcaaggccacggcgatggcttgccacattggtgaactggagcagatccagcaggtgttcgccgggatccgcgaacaattcgggcggctggacatcctggtcaacaacgccgctaccaacccgcagttctgcaatgtactggacaccgacccgggcgcattccagaagaccgtggacgtcaacatccgtggctacttcttcatgtcggtggaggccggcaagctgatgcgcgagcagggtggcggcagcatcatcaacgtcgcgtcgatcaacggggtttcacctggcctgttccagggcatctattcggtgaccaaggcggcggtcatcaacatgaccaaggtcttcgccaaggaatgcgcgccgttcggcatccgctgcaacgcgctgttgccgggcctgaccgacaccaagttcgcctcggcactggtgaacaacgacgctatccgcaatgctgcactgcagcagatcccgctcaagcgcgtagccgaccccaaggaaatggtcggcgaccgtgttgtacctggccagcgatgcctccagctataccaccggcacggcgctcaatgtcaatggcgagtatctgtcctgatcatgctttggttgccgtcagcgtatagctcagtggcaagcgcgcaggccg

SEQ ID NO: 14779 - DNA, 366 bp, Glycine max
  Peptide Sequence Number=SeqID_131557
atggtgggttacacaccttccagctttgcagatatggtcttcgccggcaaaaggatcgaagtgggtctaaaaagaggcaaatttggtcatcctgctttgataaaaactggggcaaatgaagaggatgagaatgagggagaaacccatgttgtggctgccattcctatatggccaagtttcccaccaatccaacaatgtcattactcagccaataacaacccatctccttacccaccacaaaacccacctaccacacgaccaatgctaaacaccacctttagcacaaaccaaaacaccaaccaagaaatgagttttgcagcaaaaaaaacctgtagaattcaccccaattttggtgtcctatgctga

SEQ ID NO: 14780 - DNA, 399 bp, Glycine max
  Peptide Sequence Number=SeqID_131558
atgggtatagcagaggaggtgcaagagaaggtgaaggccgacatggaggccatgaaagagcaaatggccacaatgatggaggccatgatgagcatgaagaagataatggaagccaatgcggttgcagttgccgctactagcgctgttgctaaagtgaacccgatgcccccatctgatctcaaccaaatgaatcatccaacctcagatatggtggacaaagatttgggaagtgcggacgaccccatgatgtgcaaattcaaaacaagcacgtcttcctgccatatggcttgcctcccaactatacaccacccaatatggcgtacactcccaataaggatatcaataactcctctcccatactcattgaaatgtctctcaacccatgggggaggcacatga

SEQ ID NO: 14781 - DNA, 519 bp, Glycine max
  Peptide Sequence Number=SeqID_131559
atgttcaagatagaatcaagaacacttcaagactcaagaggaaagttgaagaacacttcaagattcaagaggaaagttaaattcaggaatcaagaatcaagaatcaagattcaagactcaagattcaagaatcaagaatcaagaaaggacttaatgaagataagtatgaaaaggtcttttcaaaaactgagtagcacatggatttttctcaaaacatgtttaccaaagagtttttactctctggaacacgagatggaacttcaacgaattaatcaaaatgaagaaaatgacaaaaagaagagaagtataacccttaaagcctcatcatcaatgcaagaagaaaaagaagaagaagattcagatgatgaagaatatttttctttctttgttaagaaatttcagaaattcatcaagaaaagaagaattgacaggcgtcagaacttcaataatggaagaaaatcacaagatgattctcaagttcttaggtgttacaaatgcaaccaaattggtcacatcaag

SEQ ID NO: 14782 - DNA, 540 bp, Glycine max
  Peptide Sequence Number=SeqID_131560
atggaggtcaacatggctacagtcattgccgcaagtaccgccactgaggtggacccgactcacccatctggtctcaaccaaagcaagcattccttcccaccatatggcttgcctcccaactatacaccactcaatgttgcacacgcttctgatgagaatgtcgataactctgctcccatacccattgagaaccaacaaccccaatctgatcatgcacatgtctctcaacccataggggagacacatgaagtaccccaccacactttagccgactttgagcctcacctcggatatgccactgaggggcaagcatttggtggcatacccctcccaaacactttgggggggcctcaatatcacccacaaccacaacccttgcattttgcattggaaagactgcctcctgccatagtggaaagggagaaatttaatcatatagaggaaaggctgaggactattaaaggaggcggagattatgcctttactgacatggcaaaactgtgcctagtgcccgatgtcattatccctccaaagttcaag

SEQ ID NO: 14783 - DNA, 927 bp, Glycine max
  Peptide Sequence Number=SeqID_131561
atggggacaaatcaaatcggaaaaagattctatcaagtcaagattaagggcctatatgtcaccagcctgaaggagttagggcagttgatgggtcagctccagcggcaagcttttcgcaaagcttacggtaaaatctgggacctagccatggtagaagtctccacagaggccattgtctccctcgcccagtattatgatcagccgttgagatgctttacctttggggacttccagctgtcacccatggtggaagaatttgaagagatcctaggatgtcctctagggggaaggagaccatacctcttctcagggttctatccctcattagctagaatttcaaagatagtccaaatcccggcgcaggaattagaccatggaaagcaagtcaaaaatggggtggttggaataccgagaaaatgtttggaggcaaaaacaagaaccttggcaggtagaggcgaatgggccccgttcatagacattctcgcactgttgatcttcggaggagtcctctttccaaatgtggatgggttggtggatctagcagcgatcgacgcttttctcgcctatcatgaccacaaggaaagcccggttgtcgctatgctagccgacctatatgataccttcgaccgaagatgtgagaagagcagtacgaggattgtttgttgtactccagctctttatgtatggttggttttgcacctttttcgccaagaggtgaggcatgcttgcccgctagaaagccaccgttcatgcacagagaaaggaggggcaaattgggatcgactcttagcaatcaaagaaggagcgtctgtcaactggttccctcgatggaaagaaggaagaactggggttcttatttcgtgcagaggatttctgaatgttcccttgatggggacaaggggttgcatcagttacaatcccgttctt

SEQ ID NO: 14784 - DNA, 186 bp, Glycine max
  Peptide Sequence Number=SeqID_131562
atgcaacagggacaggcagatatcctcatagctaggttccctgaccctagctatggtgttaaaacgataacgtttacaaagtctctttctctagagtttttcaaaggaaacgtaaaacatgcaatgacggttccaaagtcagaaaagatacaaagacaagctgaaactaacaagaaacaagcgtag

SEQ ID NO: 14785 - DNA, 296 bp, Glycine max
  Peptide Sequence Number=SeqID_131563
gatactccggggaacagatatccagtggagatgacggggtggggcctgtagctcagaggattagagcacgtggctacgaaccacggtgtcgggggttcgaatccctcctcgcccacaaccggccaaaaaagggaaggatttttccctctgggggtaggaaaatcatgatcgggctagcggacccaaagctatggaacttccccggactgtggaacaaaggagtatcccgaacctacaccgaggtattgacggcgattctcaaatatcgcagaacagaacagaatgggatacgatga

SEQ ID NO: 14786 - DNA, 555 bp, Glycine max
  Peptide Sequence Number=SeqID_131564
gggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacgg

SEQ ID NO: 14787 - DNA, 180 bp, Glycine max
  Peptide Sequence Number=SeqID_131565
atggcagaaatcaaccaaggtgagacgatgaccggtcacgattggtcgcatatcatttggctcttacttgcaggggatggccttaggcctagggtgcatcctgaagcaatggggcataccacattgcccccactctcttgctattcatgcctaaacatgtgcccaccaagtgctcggtga

SEQ ID NO: 14788 - DNA, 912 bp, Glycine max
  Peptide Sequence Number=SeqID_131566
atggcaccatcatcagggataacaaaagggtcaagagaacccagtagtaggaatagcataccaaaactccacttcagagatcacatacggacttacactcaaagatatctcgcagctgaacccgtagaggaggcatcagaagatacaaacagttcagaaagtagtggaggcgaagaagatgggtgtgctgatggagtgaggcttgttcagcttctaatagcgtgtgcggaagcggtggcttgccgcgacaagtcacacgcttccatattactttccgaacttaaagcgaatgctttagtgttcggatcctcattccaaagagttgcttcctgtttcgtccaaggcctcaccgagaggctcaatctgattcagcccatcgggtccgcgggcccgatgatggcacccgccatgaacatcatggacgccgcctcggacgaaatggaggaagcatacaggttggtttatgaactgtgtccgcacatccagttcggacactatttggctaattccacagtattggaagcctttgagggtgagagttttgtccatgtcgtggacctaggcatgagtcttggtctaagacatggacaccaatggagagctctgatccagagtctcgccaaccgtgcaagtggcgaacgcgttcgtcgcctgcggatcacgggggtgggactctgtgtcagacttcaaaccattggagaagaactctccgtatatgctaacaatttgggtatcaacttggagttctcagtggttaataagaatttggaaaatctgaaaccagaggacatagaagtgagggaagaagaagttcttgtggtgaacagcattctgcagcttcattgcgtggtgaaggagagccgcggggctttgaattcggtgctgcagatgattcacgggcttggacccaaa

SEQ ID NO: 14789 - DNA, 1301 bp, Glycine max
  Peptide Sequence Number=SeqID_131567
gctatcactgggagtcatgctggcaactagattatgatgataaagcagaaggagttattaatctggatgacctgctaatgcaatttaaagatacagtagagtcaatgcaacaggcttttagaagaactacaactcatattagtaagttggtggatgacatggctaacactgcggccagagaagaggaagagcgtatagagattgaaacgtatcaagaaagcatttttcaagttacctccatccataatcagatgaccactgaagaggaaacgtctataatctccagtactccagaatactcctgctcggcctttgctggctatgttagaggaacagagaaaggtagattgaaactcactgtagaggatcaaaaagagtcttttgacctctttgaggccatgaaacattcagatatgggtgatgcttgttctgaggaggaagaggtggaacaggaaatagtattaacaacttcaaccatgaaacaacattttcctttcgaaaaagaattgggtggtgagatagacagcttagtcgataatgaagagtgtgatgatccaaaagacaattgtgttgatcgtgtggttttcgaaaaattggagaaaataagaccaccagtaaagcccaaagcagaattaaaaacccttccagcacatctaaagtatatattcttagaagatgacgagactagatcggtcataattagtaactctttaaagaaggaagaggaggatcaactgcctcagagaaggttgaatcctataatgaaggaagaggtaagaaaagaggtgctcaaattactagaggcgggcctcatttatccaatttcagatagctcatgggttagtcctgttcaagttgttccaaaaaagggaggaatgacagtagtgaagaatgatcaaaatgaactaattcctaccagaacagtcacaggatggcgtatgtgcatcgactacagaaagcttaatgaagccacaagaaaatatcactacttgcttcgcttcatggatcaaatgctcgaaagacttgtagggcagtctttctactattttttggatggatattcaggttgtaatcagattgttgtagacccccaagaccaagataatacagctttcacatgtccattcggtgtttttgcttatcgccgcatgccattcgggttatgtaacgctcctgctacgttccaaagatgtatgatggctatctttgctgacatggtagagaaatgcattgaattctttatggatgatttttcagtctttggtgcatcttttgagaattttttagcaaacctagacaag

SEQ ID NO: 14790 - DNA, 288 bp, Glycine max
  Peptide Sequence Number=SeqID_131568
atgtatacggatagccactcgggtatctccgcccatcagcgtgactccaaagtcagtatgacagatcttgtgagcgcggaagatgacgtaaatctccgcgtgtcaacgggcttgtcggccgcgattgacgaagggcgcaggagacgacgtgcggataaccgtaaggtgtctccgcgggctaccagattcttgggtcatggtaacaaaagcggtgtggtcgacaaaagcgaagctgttgctcctacgtatcctcaaatgaggaactcagacctacgtagttctggataa

SEQ ID NO: 14791 - DNA, 126 bp, Glycine max
  Peptide Sequence Number=SeqID_131569
atgataaaagcctcgagggtccgtcccatccctgaaaatgctatgaggtgttgggaaatggttgaagttggtccggtctattactcttcccttgcgcctatttcgccttggggggttggttcacag

SEQ ID NO: 14792 - DNA, 276 bp, Glycine max
  Peptide Sequence Number=SeqID_131570
atgcctaaacttcttatctttgtgctattgtgcgcaagcacccagtgcggctcgatgacagagatgcaagccttgatgtcgatcaagcttaatctcttgataattattgttcatacttacaatttcattctaaattcaaaacaattatgtcactttcttcttaattattgctatgtttggccccatttagttaggatttacttattattaggaactgctcactcaatgagtagaccagttgctcatctgctagctaagcggacatctactagttaa

SEQ ID NO: 14793 - DNA, 318 bp, Glycine max
  Peptide Sequence Number=SeqID_131571
atggagacttatgaaccagaaactgagattgaagaagaaaagagtatttctaggaaggatagtcttaatactcctatgcaaaatcaaactccaagtaaagtggaagctgattcttttgaaaagatagcatctaccaaccagaccttaagtacaacaaaacagtccctatggaagatggatcttcatgctcttggaatatcctacaagatcaagaggctaaagcagcaacttgttcttgttgaaaggttaataggaaggcaagccaatgacgagctagcagaaattactgatgatagcaaagttggtatgaaggaatga

SEQ ID NO: 14794 - DNA, 735 bp, Glycine max
  Peptide Sequence Number=SeqID_131572
atgcaagataaagcacagattgtgcctgggccagtggatgggaatttcatagaaggggttttgtctggcagaaagagggttggatacatttctatactcttctatgcttcctggtgtcgtttttcacgcagaatgcttcctgaatttgagattcttagttccatgtttcctcaagtacaacatgtagcacttgagcaatcttctgctttgcccagcttatattcaaaatatggaatccatagcttacctgcaatcttactggtgaaccagacatctagggtgagatatcatggtccaaaaaatctcaactcccttgtagaattttatgagagaaacacaggattagaagccaaggacaatgctgttgttggtcaaccgagcaactttttgagtgatgaacattcaactatgaagggcttctccctcaaagaaatatttaacagggaaccttacttggcattatctatattgtttctctgtttaaggattattctctttgtatttcccacgattatgccacgcctcaaagcattctggacttcctatgcttctcatttgaacttgcaaatatttggccaagtgatggaacgtgttcttaatgtaattgatgtcaagaggatttggaccaagctaagactatgcaagaccaggaactttcatgaaagggtgaggagcgcccgggtttgggcatcatcacttgcttctgtttctcttggtggctcatcagctaggtga

SEQ ID NO: 14795 - DNA, 1230 bp, Glycine max
  Peptide Sequence Number=SeqID_131573
atgaagaagttaggaaggcagcagtttcaggtattttcttggctctccatgccggaactgttgtcctcggcaaaatcagctgtagtgaagggacaatcacaaggtcgtgatgagacttatgtgaaacagctttctgattatataataccaaatttggtggaggctttacacaaggagccagaagtagaaatttgtgcaagcatgttggatgcattgaatgaatgcatacagctggctaggatttgctctcaggtctctggatcacatctagatgaaaagcaagttcggagcattgttgatgagattaaacaagtccttacggccagttcatcaagaaaacatgaaagagcagagagggccaaagaagaggactttgatgctgaagaaagagaactactcaatgaagaaaatgagcaagaagaggagctttttgatcaagttggtgattgcttgggaactttgataaaaacattcaggacatctttcttgcctttctttgatgagctgtcctcatacctaacacctttgtttggtaaagacaaaacctcagaggaaaggagaattgccatttgtatatttgatgatgttgctgagcacggtcgtgaagccgctcttaaatattatgattcttttcttccattcttactcgaagcttgcaatgatgaatatcccgatgttcgacaggctgctgtttatggtgttggtgtttgtgctgagtttggtggatctgttttcagcccccttgttggagaggcactttcaaggttagatgctgtgataaggcatccaaatgcactacatgctgataacataatggcatatgacaatgccgtctcagctcttggaaaaatatgccaattccatcgtgatagcataaatgcagcacagctaaacctaaggattaaggttgttcctgcctggctaagttgcttgcctataaaaggtgatttaattgaagctaaggttgtgcatgaccaactttgttcaatggttgaaagatctgatagagaacttataggtcccaacaatcaatatctttccaaaattgttgcagtttttgccgagattttatgtgcgggaaatgatctggctaccgaacagactgttagtaggatgattaatttattgaggcagcttcaacagactttaccaccttctacccttgcttcaacctggtcatccttgcagcctcagcagcagcttgcacttcagtccatcctatcatcctag

SEQ ID NO: 14796 - DNA, 786 bp, Glycine max
  Peptide Sequence Number=SeqID_131574
atgcttccgagtccacaaaatctcctccgactttccaattggggtatggcctcggaccgcaaagtcaacggggtctgcctctgccaccgcaattcagctcaaagggagaatttgagaatgttagtaggaccagcagatacctgcactatgctgtacttggaacctggattttgtttgacttctgcatggtattgtgtattctatggtgtagatgaaggaaaatttgagaataacgacgtgttccatgatagagatgtctttctggaagactataaagaaatgaataggagcttaaagatatatgtttatcctcacagggaagacgatccttttgcaaatgtgcttttgcctgtggaatctgaacccggtggcaattataccagtgaaagttacttcaaaaaggtacttatgaagagccatttcattacaaaagacccaccagaagcagatcttttctttcttcccttttccatggcaagattgtggcacgatcgaagagttggtgtgggaggtatacaagacttcattagagactacattcataatatcagtcacaggtatccatattggaacaacacaggtggtgccgatcacttttatgttgcttgtcattcaattggaaggtctgccatggacaaagcacctgatgagaaattcaatgccattcaagttgtatgctcatctagttattttctaaccgggtactttgctcacaaggatgcatgtctaccacaaatttggccaagaaaaggaaatccccctaaccttgtttcatcccagaggtaa

SEQ ID NO: 14797 - DNA, 2031 bp, Glycine max
  Peptide Sequence Number=SeqID_131575
atggcgagcgattcgattcagcagagcgaagcccaagtggcgctaatcctgggcccggactcggcccacctggaatccctaatctcccaattgatgtcttcctccaacgaccagcgctcccaggcggagtccctcttcaacctctgcaagcaggcccgccctgaggccctcttattgggcctggcccacctcctccactcctccccgaacccggagacccgcaccatgtccgccatcctcctccgccgccacctcacgcgccaccacgactccttcctctggcctctcctctcccccccggcccgctcctccctccactccctcctcctctcctccctccacaacgagcccctcaaatccatcaccaagaagctctgcgacaccgtctccgagctcgccgccgccaccctccccgacgactctgccgcctggcccgacctcctccccctcctcttccagtgggtcacctcccccgaccccaggctccaagaaatctcgctccttattttcgcccaattggctcattacatcggccaaaccctactccctcaaatctccactctccactccgtcttcctccgctcccttcactcctccacccccgccgacgtccgcatcgccgccctcgccgccgccatcaacttcatccaatgcctcacgaattcctccgacagagaccgcttccaagacctcctccctctcatgatgcagaccctcaccgaggcgctgaactccggccaggaggccgtcgctcaggaggcgcttgagcttctcatcgagctcgctggcaccgagccgcgcttcctccggcgacaaattgtcgacgtcgtggggtccatgttacaggtcgcagaagctgagactttggaggaaggaacacggcacttggcgattgagtttgtggttactctcgccgaggcaagggagcgtgctcccggcatgatgaggaagtttccacagtttgtgaggaagctttttggtgtgttgatgaatttggtgcttgatatcgaggatgatcctgcgtggcacggtgcagtggatgaggatgaggacgccggcgagacgagtaactatggctttggacaggagtgtctggataggctttcgatttcgctcggtgggaacaccattgtgccggttgcctctgagttgctgcccacctacttggctgctcctgagtgggaaaagcaccatgctgcgctcattgctcttgcgcaaatcgccgagggttgttccaaggttatgataaagaatctggagcaggtattgtcaatgattttgaattcatttcgtgatcctcaccctcgagtgcgatgggcagctataaatgcaattgggcagttgtccacggatttggggccagacttgcaggttaaatttcaccacttagtgcttccggctttggctggagccatggatgattttcaaaatccaagagtacaggctcatgctgcttctgcagtgctaaatttcactgagaattgtaccccagatatcctaacaccttacttagatgggattgtgagcaaacttttggtactcctgcagaatgggaagcaaatggttcaagaaggggctttgacagccttagcatctgttgcagattcttcagaggtgcaatttcagaagtattatgatgctgtgatgccatacttaaaagctattttggtgaacgcaaatgataaatctaatcgtatgcttcgagccaaagcaatggagtgcattagtttggtaggaatggctgttggaaaggagaagttcagggatgatgccaaacaggtcatggatgtcttgatgtcactgcaacaatctcaactggatgctgatgatccaactgcaagttacatgttacaagcatgggcacggctttgcaagtgccttgggcaggattttctcccatatatgggttttgtgatgcctcctttgctccagtctgcacaacttaagcccgatgtgaccattacatcagcggattctgatactgaatttgatgaagatgatgacaggtgccctttcagttattattactga

SEQ ID NO: 14798 - DNA, 222 bp, Glycine max
  Peptide Sequence Number=SeqID_131576
atgtggctccgcatgccaccagactcttgggtcacggtaacaaaaagtggggtggtcgacaaaagcagggcttttgctcctaagtatcctcaatttgtgatgaggaactcagacctacgaaagagacaaaacttccaactgatcagagcaacatatgctttttggatgaaaaacaatgtgtctatcggggaaggagagtatgctgatgaaattttctcataa

SEQ ID NO: 14799 - DNA, 1251 bp, Glycine max
  Peptide Sequence Number=SeqID_131577
atggaaatctcccatgacatcaagatcaaggatgacaagctaggtggtgtgaaggaagagaagattaaggtagaagttgaactgaagaataaatcagttgagaaagagcatacaaaaagtaaagaagagaagaaacataaagatgaagataaatcaaagaaaaaaaagaaagagaaaggggaagaggaagatgaagagggagagaagaaagaaaaagatgtaaaagataaaggggaggatggtgaagagaaagagaaaaaggagaaggataagaaggagaggaaaaaggaaaagaaggacaaggatgacaaaactgatgtagagaaggttaaggggaaagaacatgatggggaggatgctgaagagaagaaagaaaagaagaaaaaggaaaagaaagacaaggatgacaaaactgatgtagagaaggtcaaggggaaagaagacaaagagaagaagaaaaaggaaaagaaagtcaaggatgacaaaactgatgctgagaaggtcaaggggaaagaagatgatggggaggacaatgaagagaaggaggaaaagaaaaaaaagaaaaagaaggaaaaggatgacaaaattgatgtagagaaggtcaaggggaaagaagatgatggggaagatgaagggaagaaggagaagaagaaaaaggaaaagaaggacaaagatgaagaaacagacacattaaagggaaagggaaaaaatggtgatggtgaagagaagaaggaaaagaaagagaaggagaagaaaaaggaaaagaaggacaaagatgaagaaacagacacattaaaggaaaagggaaaaaatgacgaaggcgaggatgatgaagaaaataagaaaaataagaaaaaggataagaaggagaaagagaaggatcacaaaaaagaaaagaaggaggatggaaaagaagagggtgagaaagagaaaagcaaggttgaagtttctgtaagggatattgatatagaagaaaccacaaaggaaggtgaaaaagaagataaagaaaaggatgatgggaaggaagtgaaagagaagaagaaaaaagaagacaaagacaagaaggagaagaagaaagttactggaaaggacaagaccaaggatcttagtgcgctgaagcagaagcttgaaaaaattaacggaaaaatacaaccactccttgaaaagaaggctgatatagaaaggcagataaaagaagctgaagctgagggtcatgtagtcaatgggaaggacaaggatgaggtacagtag

SEQ ID NO: 14800 - DNA, 549 bp, Glycine max
  Peptide Sequence Number=SeqID_131578
atgaagcttcatcacaacaatgattttttttttcagtatatcaagaaaaggctagctttctttgctggaggagtaaattccccagtacgtgtaaaacttcttgagacatggaaaaatgattcagaaatctttgtgcaccatggaagacttaaaacaccatatgcagatgaattgctaggtagcaagttctgccttcatgttaagggctttgaagtgaacacagctcgcattggagattctctatattatggttgcgttccagtgatcattgccaactactatgaccttccatttgctgatgtgctaaactggaagagcttttcagttgttgtcactaccttagatattcccttgctgaaaaagatcctcaaggatatcatcagttccaataaatatttgatgttacaaagcaatgttttgaaggtgaggaaacacttccaatggcattcacccccgcaagacttcgatgcattttatatggttatgtatgaattatggcttagacgaagttctataaaaaatacgtgggtagattctttcagagtttaa

SEQ ID NO: 14801 - DNA, 204 bp, Glycine max
  Peptide Sequence Number=SeqID_131579
atgactcacgctagcttatattgcatacaaataacatgtgatgatgatgaagagagatcaagtctgaaagcaagcaggggctgttctcgttcttcaacttgccaaggctgttcaacttgttactatgaagggtgcatcaagtgccgctttgaggattgcaattgccaagaatgcagagactttatgctatatgctgaaccttaa

SEQ ID NO: 14802 - DNA, 462 bp, Glycine max
  Peptide Sequence Number=SeqID_131580
atgattggtacctcaaagccttacactggggcaatgaggggcatcgtgcatgagcctcaaggctacacgccctcaccttgggtactagttaccctcaccgttgagaggactacacgtcctcgccttgagaggactacacgtcctcaccaccatagggctgcacgccctcacctccagaggactataagtcctcgccttgagagggctacacgccctcaccttggaggactacacgtcctcgccttgagaggactacacgtcctcaccatcagagggctgcacgcccttacctccagaggacaacatgtcctcgccttgagagggctacacgccctcaccttgggtactagttaccctcaccgtcagaggactacacgtcctcgccttgagaggactacacgtcctcgccttgagaggactacacgtcctcaccaccagagggctgcacgccctcacctctag

SEQ ID NO: 14803 - DNA, 1058 bp, Glycine max
  Peptide Sequence Number=SeqID_131581
atggtgatggtgaaaccgggcatgccgtacctcgacgttgtgcgccgcgtaaaggataccttcggcgtgccaaccttcgcttatcaggtgtccggcgagtacgccatgcatatggcggcgattcagaacggctggctgcaggagcagcctgcggtgatggagtcgttgatgtgcttcaaacgcgccggcgccgacggcgtgctgacctacttcgccaagcgtgtcgcccagcgcctgagggcgccttttgcattacatcttctggaactgtcggttgtcgatgctttggctgacctgtttgttgatcaggttcagcaacaacatggagcgggcctcgccgtccggctcggtgtagatcgcctgcagcccttcgaacacgccgtcgacgatcaggacggtatcccccggctgcggggtttccggatcgacataggtttcgctggcgtgcgtgcgcagctcatcgatcaccttgctcgggatgacgctcggcagcgcgccgaagcgcacgaagtggctgacgccgcgggtggcgctgatggtggtggtgtgaatgcgctccgggtcgaactccacaaacagatagttgggaaacaggggttcgctgaccgcgatacgcttgccgcgcacgatcttttccagcgtgatgatcgggctgaggcagtttacctgctgccgttccagatgttcctgcgcccgcaacagctgaccgccgcttccggatacatagtgatgcaagtttcagcgtgtaacatcacctatctctatgaatatgcggctattagcgaggggtcacacacttatcgatacggcgctgtatggcaaggcgttgcgccaccggctgtgacgctattcatcgtttttgaccgagggaagataaatggagctgtttctgttgagcaacggcaagctgtctggcgaagccgagctgctggggtatgccaaaagccaactgctggcgatgattgcgcgtcgcggcatcaaatccgccgtttttatcccttatgcgctgatccgttacgactacgaccagcgtgcgcaggagctggcgcaaacgctgg

SEQ ID NO: 14804 - DNA, 311 bp, Glycine max
  Peptide Sequence Number=SeqID_131582
accaacgtcttggggctaatgtaggatctgctcaaggacctacaggtttagaacctctaaggggtccgaatggtttagacttgagtagactgaaaaaagatatacagccttggcaagaacgccgttctgcggaatatatgactcatgctcctttaggttccttaaattccgtgggtggcgtagctacagagattaatgcagtcaattatgtttctcctagaagccatttatggcacgcgggaagagctcgcgcagctgccgcaggatcgaaaaaggaattgatcgagattttgaaccagttctttccatga

SEQ ID NO: 14805 - DNA, 633 bp, Glycine max
  Peptide Sequence Number=SeqID_131583
atgaccacaaagcaatctgttttgccagagaacgcaatttcaaacttgagttctcttgaacatttgagtattgaattttgcaataatgtggagtctttattctcagggataaaactcccttttcttaaagcattgtatgttagtagcggtaacagattaaagtctatgcgacttgaaagtaaacattttcctgcattggagattttggcagtaaggaactgtgagaagttggaattgtccaatgaccaagaagatcaaaatttcaacttgaggctaaaaacaatatttttttattctttgccacagcttgtgactttgtctcattggcttcaaggatctaaacactttaatatccttggtactaacagagtgctacaatcttgcaatcttgaggtgcttccggattggctgccagcactaacttctctgaaattactttttatcaaagattgtccaaagttgcggtctcttccagatggcatccattgcctcactgcccttgaacatttgaaaattgaagattgtcctgaattatgtaacaaatacaagccacaagttggagagaattggaaccaaatatcacacatcaaacagattaggattggtgaacagaatatctggaagaagagttag

SEQ ID NO: 14806 - DNA, 1896 bp, Glycine max
  Peptide Sequence Number=SeqID_131584
atggctaaaatctccatcttgttggtggggctttggctactaggtagctggacagggttgttggatgcagaatacatgaaatacaaagacactaaagagtcaatcgatactcgagttgaggatcttgttagcaggatgactcttgaggagaaaattggccaaatgttgcagattgagcgcaagtatgcatctgctgatttggttaagaagtattttatcgggagtgtaatgagtgagggagggagtgttccagctcctcaggcttctgctgaaacctggattgacatggtgaatgaatttcagaagggtgctttatcaacccggctcggaattccaatgttttatgggattgatgctgttcatggccataacactattaacaacgcaaccatttttcctcacaatattggtcttggagccaccagggaccctgaactagttaagaggattggagctgcaactgcccttgaacttagagcaacaggaattcaatatacttatgcaccttgcatagcagtctgtagagatccaagatggggtcgctgttacgaaagctacagcgaagatcctaaactagttcaagctatgactgaaattataccaggattgcaaggggacatccctgacaatttaccaaagggtgtcccttttatgactggaaaagaaaaagttcttgcttgtgctaagcactacgtgggtgatggtggaacaatcaatgggattgatgagaacaacactgttatagatagagatggattgatgagaattcacatgccaggctacttcaactcaatcagcaagggtgtggcatccattatggtctcttactccagttggaatggagtaaaaatgcatgctaacaatgaccttattactggctacctcaagaatactctccatttcaagggctttgttatttcagattttgagggtattgataggatcaccttaccacctcacgcaaacttcacttattcaattgaagcaggagtttctgctggcattgacatgttcatgaatccaaagctttacatagaattcatagaagatctaatcatgctggtgaagaacaagttcattcctatgagtcggattgacgatgcggtgagaagaattttatgggttaagttcatgatgggcatttttgagaccccttttgctgattacagtttggtcggatatttgggaatccagaagcatagacaattggcaagggaagctgtaaggaaatcaatggtccttctgaaaaatggtgaatccgctgacaagcctttattgcctcttcctaaaaaggtgccaaaaatacttttggctggaagccatgctgataatctaggatatcaatgtggtggttggaccatagaatggcaaggagttagtggaaacaatcttctcaaagggactacaattctcactgctgtaaaaaacactgttgatcctgaaaccacagtagtctacaaggagaaccccgatgcagaatttgttaaatccaatgaattttcctatggcatagttgtagtaggagagaatccttatgctgaaatgcatggtgacaacatgaacttgacaatcccagaccatggtcctgagaccatagcaaatgtctgtggagcaataaaatgcgtggttatcgttatttctggccgtcctgtagttattgaaccatatgttgattcagtagatgcacttgttgctgcatggctcccaggtagtgaaggccaaggtgtggctgatgttttatttggtgactatggttttaccggaaagcttctaagtacatggttcaaaactgttgatcaactcccaatgaatgttggagatcctcactatgatcccctcttcccatttgggtttggtctttctaccaaacctactaagggcttttactctgagtag

SEQ ID NO: 14807 - DNA, 1850 bp, Glycine max
  Peptide Sequence Number=SeqID_131585
atggctaaaatctccatcttgttggtggggctttggctactagttaactggtcagggttgttggatgcaaaaaacatgaagtacaagaaccctaaacactcaactgatactcgggttgaggatcttgttagcaggatgactcttgaggagaaaattggccaaatgttgcaggttgagcgcaagtatgtatctgctgatttacttaagaagtattttattggggctgtattgagtgagggagggagtattccagctccacaggcttctgctgaaacctggattgacatggtgaatgaatttcagaagggtgccttatcaacccggctcggaattccaatgttttatgggattgatgccgttcatggccacaacacggttcacaacgcaactatttttcctcacaatattggccttggagctaccagggaccctgaactagttaagagaattggagctgcaactgcccttgaagttagagcaacaggaattcaatatgtttattcaccttgtatagcagtctgtagagatccaagatggggtcggtgttatgaaagcttcagtgaagatcctgaactagttcaagctatgactgaaattataccaggattgcaaggggacatccctaatgattcaccaaagggtgtcccttttatcactggaaaagaaaaagttataggttgtgctaagcactacgtgggtgatggtggaacaatcaatgggattgatgagcacaacactgttatagatagagatggattgatgaaaattcacatgccaggctacttcagctcaatcagcaagggtgtggcaaccattatggcctcttactccagttggaatggagtaaaaatgcatgctcaccatgatcttattactggcttcctcaagaatactctccatttcaagggctttgtcatttcagattttgagggtcttgataggatcacctctccacctcgtgcaaatatcacttattcaattgaagcaggagtttctgctggcattgacatgttcatggttccaaagcattacacagaattcatagatgttctaaccatgttggtgaaaaataagcacattcccatgagtcgaattgatgatgcagtgggaagaattttgtgggttaagttgatgatgggtatttttgagaacccttttgctgactacagtttggtcaaatatttaggaatccaggaacacagaaatttggctagggaagcagtaaggaaatcaatggtccttctgaaaaatggtgaatctgctgacaagcctttattgcctcttcctaaaaagtcgccaaaaatacttgttgcgggaagccatgctgataatctaggatatcagtgtggtggctggaccatagaatggcaaggagttagtggaaacaatcttctcaaagggactacaattctcactgctgtgaaaaacactgttgatcctgaaaccacagtggtctacaaggagaaccctgatgtagagtttgtcaaatccaatggattttcctatgccatagttatagtaggggagcacccttatgctgaaatgtatggtgacagcatgaacttgacaatcccagaacctggtcctaagatcataacaaatgtctgtggagcaataaaatgcgtggttatcattatttctggtcgtcctgtagttattgaaccatatgttggtttaatagatgcacttgttgctgcatggctcccaggtagcgaaggccaaggtgtggctgatgttttatatggcggctatggtttcactggaaagcttccaaggacatggttcaaaactgttgatcaactgccaatgaatgttggagatcctcactatgatcccctcttcccatttgg

SEQ ID NO: 14808 - DNA, 354 bp, Glycine max
  Peptide Sequence Number=SeqID_131586
atgcaggtagtggtggggtggaatactggcaacgaagacgacaatgatgatggaggcagcggaatggtgaatggtggttgtggtggtgatggtagtgatggaatggtggtggtagtggcgacaacgacaataggtggaattgtggtagaggcagtgcacgacaacgacaatggaggtgacataatggtggtggcggtggcagcagcagggatatggcgatggtggtggtggaatagtgacgatggaggtggcaacaatggggtgtggtggcagtggaagtggaatggtggcgttggaggtgacgacaacaatgtggtagtgacaacaacagtgttggtgggggtggtggttgtg

SEQ ID NO: 14809 - DNA, 351 bp, Glycine max
  Peptide Sequence Number=SeqID_131587
atgaagaacacaatctccagcacagaaactacattggacacacactgttcattattgctgaatgctgacagaaccccatcaatgcattactttgagactcagagtcagagacttacagagaaacattataaaacttatctaagctgtataatactagtagtcattattcataccttgagtctatgtggaaagggaagcttgcctaagatgtcactgcataaaatgaagcaacaaccatcactgaaaacactgacatttattgtgaaagcatggaaagaagaattggtggcagtggcagagtttagaaaagaagacgactttcctgttacggaatcggttaaaacttattag

SEQ ID NO: 14810 - DNA, 252 bp, Glycine max
  Peptide Sequence Number=SeqID_131588
atgaaggtccaagtgcagaaggacaaagccctcgagtggagaatgataaagacttctcaaagtaatccttgtggcatctaccctgacttatcttacttcactggaagtggcgtctaccctgacttatcttacttcactggaagtggcgtctaccttgacttatcttccttctttaaaagtgacgtcatccaaatctccgtagtctgtatcaaacgatctgctcctacgtttacatcaacaaactatgattag

SEQ ID NO: 14811 - DNA, 246 bp, Glycine max
  Peptide Sequence Number=SeqID_131589
atggaagctccatgcgtaatccggggcgctcaagattcggaggtatcatcagaaactctctccgtcattggatatctggctactgtgttcatgcatacttaccgtgaagttaacgtatgcgcagaccctttagcaaagatggggtctctctcgaaccggcattttgttgcactggaagtttgtccagcttctcttatttgtaaagtagcagtagatgctgcaggaactattttccttggtttgtag

SEQ ID NO: 14812 - DNA, 1029 bp, Glycine max
  Peptide Sequence Number=SeqID_131590
atgaattgggaggaagttgcagggttcgaaattttagatattggccgtgactattatatgtcactttcgatttggaggattgaaaagaccttggtttggattcaattcccatggttgaaccttgtttactatgatgaaagtatactattagcccttgctcgtgcagtagggaaacctgtgaaggttaacattaacaccaaggatgcgtctggagaggcaagcttacataggatatgtggatcctgtggttgctatggccatctaacaagagactgcaaaaaagaacttgtgatagcacaacctagtcccagcgcagagaagttcagttttacggagcaaccacaacaaccagctattgatacaattgtaagaggttttatttggggctctaatgcttctcactgggttgactgggtaactatcactaagcctaaaagcaagggtggtttgggtattaggaaggcaaggcaaaaaaacatttctctactaaggaaacatgcaagggcttttatgaatgatccgggcaaattgtgggtttgtattcttagtgacaaatacctttgtaattcttctattttccaagctactcaacatccacggagttcaattcttcaagcttttgatatgctcaaaaatggtttcagttttcgtattgggcatggtgatttttctttgtggttcaaatattggtttgagggcaaaaagctatgtgacatggttctttacgttcacactatggacaaccagttacgcctttgtgatgttttccacaatgggtcttggaattggaaaaggaaaacacttgctatagatattcccaatgaagtgcgacagaagacccaacatatttttgtcttcatgaaaatatcgaggaggcctacatttggtgtccccttcgggtgcgatggggtggaggaaactcggacccatactcttagggatttccctaaagctaaagtcatttggtgtcagctacactttgatgacaacaatgaattcttctctattgttagtattttagaggaatag

SEQ ID NO: 14813 - DNA, 2970 bp, Glycine max
  Peptide Sequence Number=SeqID_131591
atgaagtttaatcatttgggccaagcaatagagcttcgcgcggacgtcaagaacgggccagaaccagtttcagcgcctcaagttaaacatctcattcggaccgggtctacatcagcgttattccacttaagccttttacccacaagccgcctcgacccaccaaatcatcatcttcctcacccagttcccgctatagaatccttactccaccattaccaacatatattccagacaccacccactctcccccccccccccccgagagaagtaacccatcgcattaatctccttccttcgacttccctggtaaacgtacgaccctacaggtacccgtacttccaaaaaactgagatagaaaggcaggtctccgatctcctttccgccgacctgatacgaccaagcacgagctcgtactcctccccagttcttctggtaaagaagaaggacgacacttggcagatgtgcgttgactatcacgcactaaatgtagttatcatacgtgaccattttttgatacctaccattgacgagttgctggatgaactcagtcaggcgtcatggttttccaagctcgacctaaggaaaggattccatcagatccttatgcatgagcccgatatcgagaaaatagcctttagaacgcatcaagggcactatgagtatggcgttatgcccttcggcttgagcaacgcaccctccacctttcaagccgccatgaacaacttgctcacaccattcctgaaatgctttgccacagtatttttcgatgatattttggtatatagcaagtccttatcatcccacattcagcatctagaaatgatctttcaagcactgttacaagggcagttttacccaaagcacacaaagtgtatcttcgcacgaaatcaggtagaatatttgggacacgtggtttccggcagaggagtcgaaccagaaccctccaaggttcaggccatggtacaatggcctacaccaacctcagttaaggaactcaggggttttttgggccttactggattctatcccaagtttataagaaattatgcctccataacaacacctcttactacactattgtgtaaagatgcgttcgaatggactgaagattctcaggcagctttcgaccaactaaaaatggcaatgactcgcgcacccgttcttgctcttcccaacttctcagaaccatttgtcatcgagacagacgcatcgcgaaccgccatgggagctgtttcgatgcagaaggatcatccaatagctttcttcaacaaagtctttggccctcggttgactcatgcttcaacatacataaggaaactccatgccatcgtgaccgcagtgcgaaaatggcgtcaatatctcctagggcgatctttcaccatactgacagatcacaagagcctccaggaactcatgacgcaagtgattcaaaccctcgagcaacactattacctctttaagttacttgggttcgattacactattcgttacaaggccgatgcgtctaatatcgtcgcagacgcactatctcgattgccttctacctcaggccagctgctcttactttcagttccccacttggatttcatcgaggatctccgacgaacgttacatgctgaacccgaattccaggctctactgtccaaggttcgagccaaccctgcatcccacattgactatcaaatccacaatgggttattattctttcaagggcacatctggatacataagactaatccctacatttccactatcttgctcgagaatcctgctacaccgttggacggccacatgggcgttgcgaagactactcatcgacttgagtcgagcttcttctggcacggcctcaaggatgatgttaaatgcttcattcgagaatgcaagatttgtcaacaaaaaaaatcaagcactcgctggccaacaggtcttctgcagccgttaccaattctggcagggatatgggaagatatatccatggattttgtcatccatttgccaccatctcacgggttcaccgtcattctcgttattgttgatcgttactcaaaaggtgttcacttgggcacactacccacacacttctccgctttcaaggtcgtaactctatttctggacttggtctgcaaacatcatggcttccctcacagcatcgtctccgatagggaccccgtattcttaagctcattctggcgagagctttttcaactcagtggcaccttcctccgcatgagtacggcctaccatccgcagatcgacggccaaactgaggttatgaaccgtgttctagaacaatacctacgttctttcgttcattctcaactgacaaattggttccgatacctagccctaacagaatggtcatataacatgtcgctccacaccaattcaggattcactcattttgaagtgatttacggcaaaccaccgttggcgctaccccactatatccctgggatgaccaacaacgaggcggttgaaactctggtaagctcccgccaggagatccaaaccaagcttcagcaaagattgatgaaagcccaggctgccatgaaacaacaagcaggcactaagcacgatgatataacctatgcagtgggacaatgggtttatgtcaaactcaagcccttctgtcaacaatcaataacaggaaccacccatccaaagctttcgaagtaccaagtcgcgtatcgccttcagctaccagacaatgcacgtatccatccagtcttccattgttcgcttttacgtgctcaccacggccctccacctttgtcattggatacctggcctttacaggttgtcgatcacaagccagtaccacgacccttttgctttctggactctaaacttgataactctacctcccctctaactcatttggtccttactcaatgggtgggacaaccaccagaggatactacttgggaaccctggccggagttacgtggcgcctaccaccttgaggacaag

SEQ ID NO: 14814 - DNA, 3234 bp, Glycine max
  Peptide Sequence Number=SeqID_131592
atggaagtagctctttcccctcaagtacaaaagccgaatttgcagacaacaggtcgcaaaatttcatgtactggatctcagaaggatctgtggcttgttgtgcgagagggatctctaagtgatgtagagctggccttggcatcactgaagaagagtgggggcaatatcaatttgaggaacacctttgggctgactcctcttcatattgcaacttggagaaaccacattcccattgtagggaggcttcttgccgctggtgctgatcctgatgcccgagatggagagtcaggatggagtagccttcacagggctctgcattttggtcatcttgccgcggcaagcattcttcttcagcatggtgcctctattacactggaagactctaaatctcgaatacctgtagatctcttatctggctctgtatttcaggttcttggaaatgaccacagttcagtggccactgaggtctttagttggggcagtggtacaaattatcagcttggaactggaaatgcgcatattcagaagttaccatgtaaagttgattcactcggtggttcattcataaagctaatttctgccgggaaattccatagtgtggcactcactgcgcgtggagaagtgtatacttggggatttggaaggggtggccgtctagggcatcctgattttgatatacacagtggtcaagctgctgtcatcactccccgccaggtgacttctggtctgggttcccgcagagtgatggcaattggtgcagctaagcatcatatggttattgctacccagggtggggaagtgttcacttggggatccaatagagagggacagcttgggtacccttctgttgatacacaacccacacctcgtagagtatcttctttgaggtcaagaattgttgctgttgctgcagcaaacaaacacacggctgtagtttctgatttaggtgaagtttttacttggggttgcaacagggagggacagcttggttatggaacctcaaactcagcatctaattacaccccacgtgtggttgaatccttgaagggaaagactttgaccagagtttctgctgcaaaatatcacacaattgtattaggatctgatggcgaggtatttacctggggtcatcgacttgttactccaaaacgtgttgtagttagtaggaacttaaagagaagtggaagcactctgttaaaatttcaccgcaaggaacggcttagtgtggtttctatagctgctggaatggtacacagcatggctcttacagatgatggcgcattattttattgggtctcctctgatcctgatcttagatgccaacagttatatgctatgtgcggaaggaatatggtgagcatatcagctggaaagtactggactgcagcagttacagctacaggtgatgtttacatgtgggatgggaagaaaggtaaggataagccccttgttgcaactcggttgcatggtgtaaagaaggctacatcagtttcagttggcgaaacacatttactaatcgtggcttcactgtatcatcctgtctaccctcccaacatgattgagaattctcagaaactcaagttggataacaaggatgatatggaagagttaaatgaagacattttatttgaagatatcgattccagtaacatgatatctagtgtacaaaatgatacttttagccagagatctatacctagcttaaaaagcctttgtgaaaaagtagcagccgagtgtctagtggagccacggaatgccgtacagctgcttgagattgctgattctcttggagcagatgatttgaagaaatattgtgaggagattgtcatgcgcaaccttgattatatatttgcagtttcatcacatactgtagcaagtgcctcaccagatattctggctaacctcgagaggttgttcgaccagagatcatctgagccatggagtcaccgtcggctgcctactccaactgctactttccctgccatcatcaacagtgaagaggatgatagtgagatagagtttcaaaggacttgcgacaaacccatgaaattggagaaagtccacagactagattcttttctacacccaaaggatgatcctaataaagaaatctccaaagtagtccgagctataaggaagaagttgcagcagattgagatgcttgaagataagcagtctaatggacatcttcttgatgaccagcagattgcaaagcttcaatctaagtcagctcttgagagctcacttgcagagctaggtgttcctgttgagacatcacagaataaagaatcatcttctatgttaccagaagggaaaggtagtaagaagggtaaactatccaaaaaacaaaggagaaagagtggcaaatcaaacatagagcagacagaaatagaatttgtttactctaaaagtgaagccattcccaaatctgaggacctgttggatattgacatcatggggtttcctgattcaaaggttgaagaggatgccgtgtgtgaacagatcacagcagaccagggtgcaaaagatttagcttttgttgtgcagaagaaagatgcattagagttgctgaaagccaagggtccatcaccaaaggcttcaaagaagaagagcaagaagggtgggctttctatgtttctgagcggtgctcttgatgaagccccgaaagaggtggctacccctccaccaacaccaaaacatgagggtcctgcatggggtggggccaagttcatgaagggttctgcttctcttcgtgaaatccaggatgaacaaagcaaaataaaggtaaacaaaccagctgggagcaaagataaggtggaagatcttcctgattttggcagtggcggcaaaataaagttgagttcatttcttccttccagcccaatacctgttacctcatctcgaagttcccaggtatctgatggagaaacaagcacccctccttgggctgcttcaggaacccctccccaaccttctcggccatcgttaagggacatccaaatgcaacagggaaagaaacaacaaagcctttcacacagtccaaagactacaacagctggattttcaatccctacctgtcaaggctcgccgtccgaaacaaccggagtgagtcgctggttcaagcctgaggtggaaacaccatcctcaattcgttctattcaaattgaggaaaaggctatgaaagatctcaagcgcttctatagtagtgtcaagattgtcagaaagcaatcttga

SEQ ID NO: 14815 - DNA, 1017 bp, Glycine max
  Peptide Sequence Number=SeqID_131593
atggagtttatctctaatgcaatgatactttcattctcaatactattgttgctaccaagtgcatcatattcactatatcaaaagcctgaaaatcatattaagacagctatttttgtaactgggagttttgaaatgggacccggatcaattgcaacaaaaacatttgagaatataaagtttccaaaaggtcatgttggaattaagagttttgatgcggaactagttgaccaagaagggaactctataccttcgtatgaaacttaccttcatcattggtttgcaataaagtaccaccaaaatattaccatgtcacctaatcctaagcttcgtcgtcctgaggatgcttttttccaaagaaacgaaggcacatgtaatggtggcattcttccacattattggggatttggagtagaatcacgaggaacaacctcaaaaattcctgatccttttgctatagaacaaggtaacccaacaaaaattaaaaatggatatgaggagaaatggttgctcaacatcatggtcattgatacacgtggtgcacaagataagaaagcttgcactcaatgtagatgtgaccagatgaatctcccgaaggacttttataatgtcacaagggatatacataaccaaaaattgactacaaattataaaggaggtttattttgttgtcaggacaacttacaatgcaagcaaatagagggttttcaaggttcaaggagaatggtttcctttagatacaaaattagttgggttgattggaacatataccaaattccagttaaggtttacatacttgattccaccgacaaagtgaggtcaaatggttccaaaatacttcatgattgtttggtagataagtttttcaagacagcagagtataccattccagcaactggtggtggtggtgattctcctcatgtccaaaaagcaaacatcccaatggaaaaaggaggttatctaatttatggcactgctcatatgcattcaggtgttgtaaatgcaactttatatggacag

SEQ ID NO: 14816 - DNA, 609 bp, Glycine max
  Peptide Sequence Number=SeqID_131594
atgttggctactagtaatcgattactgccttctgtctttggcatcatcaaaataatcttggaaagcattgcttccacaaaatgcgttgtggacataggggatcacaacttggagatgagtgtggaggaccagaaggccaccttcaacttgtttgaggcaataaagcatcccagtgataacaagacatgctttaagccccttccattatctcccggggccaaggcgagtcaaggctcaaacctctctaagcgctccacctctggtaatctctcctccagccacctcttctacagtcgacaagcctttttcctcctcttcccagcaagagcatcaagtctagatgatgtagatcctccatcatggtcattgcctcgttatccaaaacctacaccaactatccattcatctttctatggagcctccactaatgatgccaaaggctcttctacagagggttgtctggccaaaagtccagctctcttctgtaggggggagacccctctggcatgggtaatgatggagctaatgatgatcacattacggacatcactattgcataagaagcttgggatccagggccagcatagaattggcgccgattttgattag

SEQ ID NO: 14817 - DNA, 303 bp, Glycine max
  Peptide Sequence Number=SeqID_131595
atggagacgtgtcttatgaagttgaagaccaaatttcgagaagatccaacggttaacgaaggctgggaagcgttttcaccgagaagcttcattaagaggcttctagaacactccagatatcttctcgaagatctcaacggtcagatcatagacaagtgtcttgtgaagtcgaagaccaaatttcgagaagatctaacggttaacgaaggctgggcagcattcttaccgaggcagctgcatgtagctttctctagaagcttcattaagaggcttcctccaaaagcttcctcgtggcttctttga

SEQ ID NO: 14818 - DNA, 456 bp, Glycine max
  Peptide Sequence Number=SeqID_131596
atgaattataaaccaaaaagtgtagcaaacaaacctcagtatctgcaagattacgcaagggaagtccagcaaacaaatctttgtatctgcaagattatggtttttgtttccttttatttccattacaacatcaccatacttttctttgcaaaagaaggggaaggttgcatactaactccaatgaaagaaaatgttcttccacccgtgactgtaaatttccagcaaggacttggccagaagtttaaacagccagctggaactggtatttatttttcaacatttgaggactctgagttattgaaagtaggggacatggatatctatcctgttgcaattaaagcagatgcatcctctagcgaccatgatgaatcaaaatcaaatgaaactccatcatccggtagctcaaactctcagataactcaagcaatgtttgagaaggagaaaggacaattctag

SEQ ID NO: 14819 - DNA, 438 bp, Glycine max
  Peptide Sequence Number=SeqID_131597
atgtctggtgctttggctccttccatctgtaatcttccaaagcttcttgagttgaatttatcaaaatatttcatctttggccccattcttaatggttttgttgactgttttgatttagaggttttggacctttgcacaaatagggttcatggaccccttctgacccctatttggaaaattacaacacttagaaagctttacttgtgtcaaaattacatgtttggtgaagtgccagaggagcttgggaatttagtatcacttgaggagttagtcatttatagcaataacttaaccggaagaattccatcatcaataggaaagttgaagcagcttagagttataagggcagtgagtgtgagagcttggagatattgggaagattcctctaggaagattctagaaacaatacagctcatctcagacgctaaacaggagtaa

SEQ ID NO: 14820 - DNA, 387 bp, Glycine max
  Peptide Sequence Number=SeqID_131598
atggctacaccaccaagctctgctccccacttgtcattagatgcttcacagtctacgtataaaaagagtaaacaatccagaacgactaagaagattgtctgtcaggcgtttggaggagcagaagctactgaaaaggttgatatcctttatcacaattggaaacaagtgcctaaagttaaaggaacaactgatttaggacgacattctgaaatccctgcaagagtagtgcaccctgggtacctttgtacccccaaggatgtgaagatgtactcactgctgccattggatgaccaaagcaccctgattgtgttcgtgctgctaaagtcagtgtcaccatcaaccattactttagaagatcatgtggctcctagacttcatcattgttga

SEQ ID NO: 14821 - DNA, 225 bp, Glycine max
  Peptide Sequence Number=SeqID_131599
atgtcgcaacctacccttttgcgggtgagcgaggcgaggctcacgggtgcgtcttccatgggaggaaaatgcgcggagtcgccaccaacgtttattgaaaggaaaacgttggaaaaaaaccaaaggaaactggtcataaagaatattctagattcgggagttatgtttacgcttgaggaagatattaacacctctcacgtttgtcccaaaggacaacaaccttag

SEQ ID NO: 14822 - DNA, 747 bp, Glycine max
  Peptide Sequence Number=SeqID_131600
atgactaatagcgagaaagaacgtgtttttcactctttctctctctccaaaactctcacgaaaaccctagaacctcctcctccaccacccacgaccaccaatgaccgccatgaaccacctccgcttattgccagaccgccgcatggagaggaacactttaatcagagaggaatctccaaaactcaacttgaggattcgaggagtcatcatgtggagaagaaagggtatcctgggccggctgaagtgtatcctactctgaagcctaccatgggtctcaagaactctttgctgctaccaaatttgttgcataatccatatctgcagcatcgtcctcctcctcagaaagctccagcacaacctctacaatgtcctcctgagaaactggggtggcctctggaatatcctctggatcagcctcttgagcagcggcctctggctctggctgaggctcctaggctatggaggcctcacctcccccaaaagaagaaggctggacacttggtcaggccacctaagatgaaaactccttcatgctcacaatgggatgatgctgagccaaagcatggatactctgcatcaccagaggtgccaagagtagctagtactgatggtggtaagggagttggtgcagtagaagtagggggatcagatgaagatgggccctcagatcctctagccctggccttgtgggtccctggaaatgtgatcgaagggtcatccaggttccagcaattcttctttatgtag

SEQ ID NO: 14823 - DNA, 198 bp, Glycine max
  Peptide Sequence Number=SeqID_131601
atgactctgagttgggctaagcgtgcatccatcgctaagcacaacctcagcgcgcttagcgtgacagaagaatctggaagagcattaatatcaagcctgcgcgctaagcacgagattagtgcgctaagagcaacagttgtcttcagccaggttcagggcatgactggcactaagctcaaatccacttactcgtgctaa

SEQ ID NO: 14824 - DNA, 435 bp, Glycine max
  Peptide Sequence Number=SeqID_131602
atggcgcctactaggcaccctctggaccaagagaagtccaacagggccctggggttttcgactctaatcacgggcctctgccagtcctacggagttcctgtcacccccagcacgataatccgaccactgatcacccaagccttcatcaagaagtactgcatgcctaggcaggcgcagggcgacgcacatcaggacgtcggcgcactgccgccacctcggcggccaaccactgtggacaggtgcagatacatgagtgtctctactggttcagcctcagtcagtaggggccaggttccgccccttttgtatgccctaccccggagcagtttggggctgaggtcgcatggcctggagactggcccgatgcccaggccggggaggagcctgcaggaacccccgatgaggcggatgaatcccatatggatgaggatatga

SEQ ID NO: 14825 - DNA, 255 bp, Glycine max
  Peptide Sequence Number=SeqID_131603
atgaaggaaagtggaaggaaacaaggtaccatgtcgccatgtgcggcatgcaagcttcttcgaaggagatgcacgcgagattgcgtgtttgctccttattttcctgctgatgaaccccagaagtttggtagtgttcacaaggttttcggggctagcaatgtaaacaaaatgttacagcactcttatgatgatgacagctcttttgccaagttgcgtaactttgttattaagaaagacagtattttgcctatgtaa

SEQ ID NO: 14826 - DNA, 192 bp, Glycine max
  Peptide Sequence Number=SeqID_131604
atggttacctcaaagaaaaccgcgaagggttcctctcggtgtggggtttcaacggagaactacggtagttcatggtggctactagtggttgtgggtggtgaagaagaagcttgggacgttgcaaatggttttggaagaaagaaggagaaaggaatggttgttttccaaggctacacgaaaaataagacttga

SEQ ID NO: 14827 - DNA, 834 bp, Glycine max
  Peptide Sequence Number=SeqID_131605
atggcttcaatcccacaattctatcaaaactacacgttcaccactcacgatctttccgactaccctacccctcttctcaatggcggtggtggcagcaacgacatcgttaatgcgtcggttatggacaccaccaccgtgtggggtggtgggcaagatagcttgattaatattcctgtgctggatatgaacaatggtgcacttgatcatattgtgtcgcttgattgcgacaccatggcttgtgctgctaattggatgccatctttttctgagcagcttggggggttttcggatttggccatttcggactgcaaaatggggttctatggagggtttcagagtttcaacaacagcagatcgtaccaacctcatgttggggagtttggagatgaatgttgtgggtttgtggaggatgttaagccacctgcttatcctaatgctgccagagaaaattggggaattcaaggtaatcaaatggcagcaattgaagagcctaacataaaggtaggaaggtactcagaagaagagaggaaagaaagaattctccgatatttgaagaaaagaaatcaaagaaactttaacaaaaccatcaagtacgcatgtcggaaaaccttagctgataggcgagtaagggttaggggaaggtttgcaagaaacaatgagctttgtgaagaagacatggcaacaaaaaagcatcagaatcatcatcaccacaaaggagatttttatggtggcgattcaatccagttccagttaaagaatgatgaggaggattggcttcaagaggccatggcaagtctagtgtatttatctcattcttcaccggaagatatgtaa

SEQ ID NO: 14828 - DNA, 183 bp, Glycine max
  Peptide Sequence Number=SeqID_131606
atgtcctccaactttgaggatttctctattccagtggtggactgggaggccatgaagccctgctccttgtcggacaatcctctgtggaggcctaatcatagcagtgacagggagttcaatgatgaggtgaacgagaagcagaaagaggaaattggagtattagagagcgagggttttggatga

SEQ ID NO: 14829 - DNA, 261 bp, Glycine max
  Peptide Sequence Number=SeqID_131607
atgccattttataggtgcatgaggtctccgacgacgtcgcctccatccttcgactcctatctgaccgctcgatcgatgttgaggcatgacaattctccccattcgagaccctgcggtcaggaaaaaattccccacgggaacgaggatggggatgaaaaaccccccacagctaatttggggacggggacgggactatgctccctgccccgcagggtccccgtatccccgagtatacagaattttacttatatacccttataa

SEQ ID NO: 14830 - DNA, 1047 bp, Glycine max
  Peptide Sequence Number=SeqID_131608
atggcagcgccgaacaggatcgaacgcgcccaccagatgtaccgcgacggacgttacgaagaggcgttagggttctacacggaggcaatcgccatggccaagaccaaccctcagaagatcgctttgcatagcaaccgagccgcgtgctatctcaagcttcacgatttcaaaaagaagtccaaattttcattattatggaatcctggtgtatgtgtaatgtgtagttacgaggccctgctcaagagagaggaactgtttgattggttaaaagtggaagcagcagaagagtgtacttcagtgcttgagcttgatcacaagcacagtggggcattgatgctgcgggctcaaacgctagtcaccctgaaggagtaccattcagcactttttgatgtcaacagactcttagagttgaatccatcttcagaggtttatcaaaatcttcaagctcgtttgaagacacaattggtgggcaatgctatctcttctgttttatattttcattgcacttgcacttgcatgcattgcacactgctagcaggaaggacccttattaagcatagaaaggcacttactccaataccagaatcagaagaagaggagtttgaagaacaggaagatgaggagcctgaagtgatatcacaaagggagaatgaaaacaaagagatgggagagaaatattcgtcgatttctaatattgggacagatcaaaaggttgagcttggcaaaggtattattattgctgattgtgctccccatgaaacagacctcaagttttcatccaagcaaggaagaaaccaaaacaatgagcctaagaagtccacagcagatgctatagctcctaaagcaccaaacaaggaatctaccgagcaacattcaaaaggatggcaaacaattccaaaaccaaaaggacattcagctctagactacgcacggtgggacagtgttgaagatgattccagtgatgatgacgatgaagatgaagatgaagagtctctgcctcagtaccgatttcgtgtaagaacagttggtgtccgtcctgtaaagtga

SEQ ID NO: 14831 - DNA, 2085 bp, Glycine max
  Peptide Sequence Number=SeqID_131609
atggctggattgttgcttggtgatgcctctcatcatggaacttctcaaggtgtttctcagagatactctgaagagaagctggaggatggttcgaggtggtactttgctaggaaggagattgaagaatactcaccatccaaacacgatggcatagatttgaagaaagaaacttacctacgcaaatcatactgtacatttctgcaagacttaggcatgagacttaaagtgcctcaggtaactattgcaactgcaataatattttgtcatcgattctttctccggcagtcccatgcaaagaatgaccggaggctgaaatttggtattaagaaggtggtgcactatatgatacatatggtgcaagttgtcatgaaattaaaatcccaaaatagcactccgaaaaagtccaaatgtgtctgttcagagggttttttttggaatcaatacatagtgcctgctacaactgctattcagcctgctatttggtctgctacaataaactgctccagtacggcagttacactaaactgctccgctattcttctgagtgtgcttgggaagaccattgcaacagtatgcatgtttcttgctgggaaggttgaagaaactcctcgcccactaaaagatgtaattcttatttcatatgaaattatacataagaaggatccagcggcaattatgagaataaaacaaaaggatgtgtatgaacagcataaagaattaattttactgggagagagggttgttcttgcaactcttggttttgatctgaatgtgcatcatccttataaacctcttgttgaggcaataaagaaattcaaagtagctcaaaatgccctagctcaagttgcgtggaattttgtaaatgatggacttcggacatcactttgcttgcaatttaagccccatcacattgcagctggagccatattccttgctgccaagtttctgaaggtgaagctaccatcagatggggagaaggtctggtggcaagagtttgatgtcactccacgccaattggaggaagttagtaatcaaatgttagagctgtatgaacaaaatcgaatgccaccttccaacgatgtcgaaggaggtgggacttccaatcagaccactgcaaaagctccaattactaatgatgaaactgcagctgcaaagagtaattcccagtccggagccacaagactggaaacatcaaagcctgtgtcttctatggccatgtttgattcatcagtcccaaatcatgtggggcgccccatctcaaaccatggtagaagtggtgattatgggagcacagaaatgaaacacagggtggaaggtgatgccaaaggcaatcaatatcctgagagggaatctctaccatttaaggaaaactcacatgaagctcaagacgtggtgaaatctcgatctgataatggtgaaaaagagcacgaaagcaatgctggagggactgaaacaaaagaactgactgaattgaaagacaaacataatagcagaaacctagatcacagagaggatgcatttagccggcctcctcaggaagccgttaagaaaattgatacagacaaggtaaaggctgcattagaaaaacgaaggaaagcagctgttcatataactaagaaaacagatgttatggatgacgatgatctcattgagagggaactggaagatggaattgaactggctcctcagaatgagaaaaataaggagaagaggcaaagctggtctaagccctctgacagatcagattatgataacatgcatggaagacatcaagaccatgaagatgagcaatatcatggagtaaagggtttgtcatcatatgaaccagatctaagtgctgttgaagaaggggaggtatccgcacttgatgacattggtgtagggcttccatcacctaagtcaagcaatcgcaagagaaaagcaggaagctcccctgaaagaggggtggaggggaaacgtcataattatggccccgggcctcaccacaataatcgatttgattacatggaggatcgaaacaaggtcagtcggctaggccatactgagagggacagcaaaaggcatgtacaggaaaaccatgtttga

SEQ ID NO: 14832 - DNA, 348 bp, Glycine max
  Peptide Sequence Number=SeqID_131610
atgaactgtaagagcgaacctttagctctcaaaaccgctctcatgtttcacggagtgtccgccaatgaactgggattcactgtccacggagaagggtttgtccaacatggccttctagaacaacgtctctgtctccagcgggcccagacccgagccagagcttgggcccttcttggaatggcgtttgaggtatgtcttctcgaaggacttggtcttggactcgaactcatcgaaggtgtagcgattgccgctctgccagacgggacgctggacgggcctgggcctgcgggggcagaagccgatctgccgctggtgcgtgctgaatgtagagccgacttccgcgagtga

SEQ ID NO: 14833 - DNA, 381 bp, Glycine max
  Peptide Sequence Number=SeqID_131611
atgcaatcacagggactcgttctgcctcctgaggctaaggttggtccttctgctgctcatgtcagcacaaaggaaagttgtgtcaatccctcaggaggtttagttagagggcgggcacttaacaccttccttgcttggttgacacatcttgtaaagccatactcaaaacatgataaacaggtagctgagggactggagaaacctgtagatatgctggatcctgatgtcgatcccttgtacctgataacattgaccattccacagcttttcctcaagccgttgcaggtgtcgtgggattctagcatgtttggggtgtataatgataacttcccattgtacataaaacatgaagatctttctgaaatagctcatggtggttaa

SEQ ID NO: 14834 - DNA, 456 bp, Glycine max
  Peptide Sequence Number=SeqID_131612
atgccaccaacgaatacacgcggcagggcaaggaagcggcatccgaggacagcatcgagctcgttgcagaagcaggtgatgctcttgtgcgggcgtgagctagtggccaaagcaagagttaagggaagctcgagagaaaaagaacctttgctcggacgttggagccctatcaagaacatcaacgaccctaaagtgatagagatcgcaaattacgccattgcaacttttgataagcgattcggtacaaagaagaagttagagaagatgatagagggtgagactcgaacagtagaagggttaaagtataagactcggatagtagcagggatggactacttcctcatcttcagagccaatgatgagtacggtgaatttcaaaattacggagcaactgtgcgagtaatcgaatcgctccatttcagaaacctcactggctttgttcctgccaattcttaa

SEQ ID NO: 14835 - DNA, 824 bp, Glycine max
  Peptide Sequence Number=SeqID_131613
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatccaaaaatgggtctgtttctgtgttggatattgcaatagtactcgatgcggcaaaagattgcaaggatgcatcggatcgatcaggcgatccgctcgagattgccaaatctaaattgcttttattgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14836 - DNA, 729 bp, Glycine max
  Peptide Sequence Number=SeqID_131614
gatgcggaaatcgtcgtcaacggcacgaaaatcaagcgcagcaccaactcgatcgccgatgctctgcagggcgtaacgctcgatctgaaaaccaccaccaagcccggcgaaccgcaaaacctggtgatcggcatcgacaagagcggcagcgccgacaagattaaagagtgggtagataactacaactcgctgctggacaccttcaattcgctgaccaaatacacgccggtcaaaagcggtgaagcgcagaatgccaaaaacggcgcgctactgggcgacaacaccctgcgcggcatccagtcttcgatcaagagcgccctcagttcggcacaggacaacccggagttgaaaggcctgggcaacctcggcatcaccaccaacgtcaaaaccggtaagctggaaatcgacagcaccaagctgaacaaagccatcgacgaaaaaccggatcaggttgccaacttcttcgccggcaacggtaaagacaccggcatggccaccgaaatccacaacgagatccagaactacgtcaaatccggcggcatcatcgagaactcgaccaagagcatcaacaccaacctcgatcgcctgaacattcagatcaccacggtcacggccagcattcagaacaccatcgaccgctataagcagcagttcgttcagttggataccatgatgtccaaattgagcagcacgggtaactatttacaacagcaattctcgacaaagtga

SEQ ID NO: 14837 - DNA, 567 bp, Glycine max
  Peptide Sequence Number=SeqID_131615
atgggaaacgactcgcagaccagcaacctgattgaccgctatctggcggagcgtcgggccaaaggatatgaagatcagatcgtcgaacacgatctgacggcgttggatctgccggtattggacggcgagctgttcagtgcgctgcgcggcgcagataacatcagcccacgcgccaaagcggcggtggcgctttccgatcggttgatcgccgaactgaaagggagcgatctgctgctgatcggcgcgccgatgtacaacctcaacgtcccgacccagctgaaaaactggttcgatctggtggcccgcgcccggctgacgttcaactataccgccgcctacccggtcgggctggtggaaggcgtcaatgcagtggtgttcagttcacgcggcggcgtacacgccggccagccgaccgacgccgtgacgccctacctgcgctcggtactggggctgatggggatcggcgaggtgcagtttatctatgccgaagggctggatatgaaaccgcacggcctcactcaggggctggcgaatgcccaccagcggatcgtggccttggtgggctga

SEQ ID NO: 14838 - DNA, 519 bp, Glycine max
  Peptide Sequence Number=SeqID_131616
atggcgattcagggcattgaaggggtgctgcagcagatgcagaccatggcggttcaggccggcaagatggggcagaatacggcgccgcagggcgtcagcttcgccagcgaactgactgcggcgctcggcaagatcagcgagacccagcaaacggcgcgcaagcaggcgcaggatttcgaactgggcgtgccgggcatcagcctgaatgatgtgatggtcgatctgcagaaatcatcggtctcgctgcagctgggcgtgcaggtgcgcaacaagctggtcgcggcctaccaggacatcatgaatatgccggataggatgatgtgcaaatcgctgtatcttgctgtgggcatcatggcgctgtctggatgcgccgggcaaaacgatgactattcatcggcccataaaaacgcggctcatcaggaagcaggcaaggaatggaaagcgtttgttgcgccgctgtccgtcaaaacgcagtcgcccggcgagcgagaaatgaaacgcgctgcccgccacgattga

SEQ ID NO: 14839 - DNA, 462 bp, Glycine max
  Peptide Sequence Number=SeqID_131617
atgaagaaactgctcccccttcttatcggactgagcctgggcggcttcagtgcaatgagccaggcagagaacctgctgcaggtctacaaacaggccagggaaagtaacccggatctgcgcaaaagtgctgctgaccgcgacgccgcattcgaaaagatcaatgaagcgcgcagcccgttgctgccgcagctcggtttgaccgcaggttacgattacaccaacggttatcgtgacagcaatggcgttaacagcaacgtgaccagcggttcgttggcgctgacgcaaactattttcgacatgtcgaaatggcgccagctgacgctgcaggaaaagaccgccggcatctccgacgtcaccttccagaccgctgagcagcagctgattctcaacaccgccaccgcctacttcaacgtgctgaaggcgatcgacacgctgtcctacacccaggcgcagaaagatgcg

SEQ ID NO: 14840 - DNA, 418 bp, Glycine max
  Peptide Sequence Number=SeqID_131618
ttcctcggctccttcaccgctgcgtcagccacaaagtggccggaaacaaaggcggtgctggtcgccggagttgcatagccggtttgttaaggctttagaggagcttggaggttctcaagcaactactccaaagcaaattagggaactcatgagggtagatggcctgaccaatgatgaagtaaagagtcatttacaaaaatatcgacttcatacacagcgagttccagttgctaaagctgcaaattctaatcgctctgccgtagctcttggaggcttgtggatgcacaatgaatccttaaagggtagaagttctggttctcctcaaggccctctccaattagctacacaatcgggggaagcgacatcccgaactgaaggtgacaacatgatagatgatgatgtaaaatcagacttataa

SEQ ID NO: 14841 - DNA, 979 bp, Glycine max
  Peptide Sequence Number=SeqID_131619
gtgtccaacgccgctgttgaaggtgatcactgccgccgtcgaaggtgtccagggcagccgttgaagcttccttccggagaagaaggttattggttacatatgggtgacgattctcgcaccattgagaacacgagggaacacgacgagaccgtttgcaagcccgacgatgatgaggaaccaggctataacgcttcaggttttgctgccgcctctacaccaggagaagcgaagcttggtgtcgtgtcgccattgatcgaaggcatgccgcttccggtgttggtagaggtgtctcactggctggcggtggatgaggcttatggggtcgtgggtctgaggctgatatttcagggcagagtgaggttgaaggctggggccatcaaaattgcgcactacggattctatgttaagcggacacctaagactggtggtgagcacctggcatttgaagatatgatctcttggatgcgagaaggtggccaggttgggatatttgatgccacaaacagtagcaaagaacgaagaaacatgctgatgaaattggttgaagaagatgcaagatgcaaggtactaggttcagtggaggatcgacttcacaagtgtttaacaaccaagcgcctcaatttgcaagcttttaaggctatagtatatatgttaacatttattaccattactagtcctgaaagagcaccgggggtacaacaacagcaagtgccccctctttctgtgaacacattaatcactccacaatgtgctggcaatgaccttgcagccctagctatatcttcatcttttagtatgcgggatagtgagaagaagttaaacaacaaaggatctaaaaaatccaggcctttgaaggtgcataagaagggacaagggaagaaggaagaagtgaaagtgggatcaaaatctcacacaaaaactgcttgcactgatatatcaaggaagagagttatctcttctctcaaggtcaaagggccac

SEQ ID NO: 14842 - DNA, 339 bp, Glycine max
  Peptide Sequence Number=SeqID_131620
atgagcaccttctcacttggaactcacaaatttttgctaattgtggttttcttcactgtgatttctattggttggagccttagagtgatcccaaatcatgataagttggccagcttgcaagaagagaaagcaacgattagagataaaaaggaagaagaaaacatgggaatggaactctacccaactggctccacaataccagattgttcccatgcatgtggaccatgctctccctgcaagagggtgatggtgagcttcaagtgctccattgcagaatcttgccccatagtttaccgatgcacttgcaaagggaaatactaccatgtaccctccaattga

SEQ ID NO: 14843 - DNA, 1599 bp, Glycine max
  Peptide Sequence Number=SeqID_131621
atggtaggagaagaggcaaaaaatattagtgtcactgaaggaaaagatttgatcagcgctcttcccgatccactcgttggagctatcatttctctccttcctaacactgaaggtgtaagaacctgtgttttttccaagcgatggaaaaaggcgtggatgcatatgtcacatcttaacattgatcaggtccaaatgatgaaaccttttatccaagctaatctctgtggggtacaccataagaggtgtgttgatgtgccttttcaacatcaaagggtagatcccaacgaaaattatgacttggatgtaattgataaaacagaaagattgattatctcagtgttgaattcacactctcatcccttggaaagttgcaatattcgacacctacccgaaagttgtgcgagtggtaatgttgttttgttgatgaagaagcttctcaaggaaaaaaatttgaaaaaactttccatggagcaaactgatcctattcattgggacatcttgcaaaatgctccacaaggtgtgaaataccatgaaatgactatagatttgccttttgagattttctcaagttttgaggaacttgagttgaagaactattacctcaagacaaaaccatcaagtggtgattttgctcaagttctaaaaaaattgacctttaagaatatgatggttgataaagatgattgggaaggaattatgtcttattgcttgtgtctcgaaaatttaaccattgataattgtatgatggaaattattaagataaataacccaagactcaagtttttaagaatttgtagaatggaggtgattaagattgatgtctctgctattaaccttgagatcattgagattgatactgttgtttgtaagcctcaaaaggttacttttgagaccccaaaagttcatttccttcgttcttgttttgatgcaattggagggcaaaatgattgctgggttcgaagcaagcttttgcaatcagaaaatattctacatgcttgctgtagcaataagatacctcaaggttcaacttcaagttttgccaatatatttgagaaccttgctacgttatgcattggtttagatttggagaagcttaataatgccatgtctctctactcaactctgaagtcatgccctatgttgcaaactcttgaaattaatattcaggctgatgatgatgcatgggattatcatggtgatgaagatgaggaggaggctgatggtgatgcaagggattatgatggtgatgaacataatgaggagggttattttccttaccctaaaatcttcttttggatgaacatggacccctgtgattgtataaatcacaaactaaagacccttagcataaagggatttgcaggagaagaacttgaggtggagtttcttaaatacataataacaacagctaaagtgatgaagaaaattactatttggtttgttgataattgttcatgggcacaagccactaaaacaaggtgtttgatgtcatttaagagtatctctccgaacttgtccatcattctcaatcctgggccaatatacatggcaaatggggacggaaactttgaaacatggatgtctactctaagaaactag

SEQ ID NO: 14844 - DNA, 2301 bp, Glycine max
  Peptide Sequence Number=SeqID_131622
atgcgctcttcctccaccctcctccactctctcgctctctctctctcccatctccaccaccccttcctctccgctcctccgctcttcccgcgcctcgccgtgacggtgccggaaagggaggttctcaggtcggcggaggcggaggcgagggggctgcgggggccggaggtggaggtgggggagctgagcgcggttccggaagagtggcggagggcgagggtggcgtggctctgcaaggagctgcccgcgcacaaggcggggactctggtgaggatactgaacgcgcagaagaagtggatgtggcaggaggacgccacctacgtccttgtccactgcctccgcgttcgcgaaaacgaaaccgcattcaagcagttcaattcccgagtcagtgtgtatggaaaaagatctgatggaagaggaattgataagaaccctaggctttcaactggaggatacttatgggtatacaagtggatgatgcaacgtaattggtatcgatttgattttgctcttgctaccaagctagcagattacatgggtaaagagggaaagttttcaaagtgccgtgaggtatttgatgatattattaatcaaggccgtgttcctagtgagtcaaccttccatatattagttgttgcttatctcagtgctcctgttcaaggttgtttggatgaagcatgcagcatttacaatcggatgattcagttgggtggttaccaaccccgtcttagcatacataattccgtcttcaaagctcttgtaagcaatccggggatcttgtcaaagaattaccttaagcaagctgagtttatatatcatcatttggttacaactggacttgatgtgcataaagaaatttatgggggcctaatttggctgcatagctatcaggattccatagataaagaaaggatagcagaattgagggaagcaatgctccgtgctggatttgaggaggatagagaggtgctattatcaatcttgagggcttgtgcaagggaaggggaggtggaggaagcagaaaagagttgggtcaaacttctcgagtttgaaaatgaccccccagctctggcttttgtgtataaaatggaagtctactcaaaggttggcatgccgatgaagtcattggatatattcagggaaatgcagtcaaaactaggtagaacagatgttgcagcatataatcaaataatagagatactatgcaaagcacaagaatcagaattggccgaatcaatcatggcagattttgtcaagagtgatctgaagccccttacgccatcgtatgtttatttactaagcatgtacttcaatttggaattacatgacaaactggaagagtcattctacaagtgcttggagaaatgtcgtcctaattgtgctatatacagtatatatctgaattctttggtgaaaataggtaatattgacaaggccgaggatatatttaaccaaatgaatcatgatgcgaccatcggtgttaatgctcgatcatgtaacatcatcttaagtggatacctgtcttcaggaaaacacttaaaggcagagaaggtctatgactttatgtgtctaaaaaagtatgaaattgaatcctcattaatggaacagcttgactatatcctgagcttgaaaaggaaagttgttaaaagaccaataagcatgaagttaagcaaagagcaaagagaaatcatgattgggttgcttttaggtggtttgcgaattgattctgatgaccgaaggaggaatcacattattcgttttgattttgatggcaattccggcagccattatgtcctgaagagtcatatatatcacctgttttttgagtggctgcatcctacttgtaagccaggtgacaatagtgaaaacataccggataagttttgcaccattgcaagctctcattttggcttttatgcagatcagttttggtcaaaaggtgaacctagtattccaaaactagtccataggtggttgtcaccatgtgttcttgcatactggtacatgtatggtggccatcgaaattcatcaggggatattttgctgaaagtaaagggaagtcgtgagggtgttgagaacattgtcagaaaatttaaaggcatgtccatggattgtaaagtcaagaggaaaggaagggttttttggattggtattctgggaagcaattcaacttggttctggaaattggttgagccatatgtcatagaaaataaagattttgctgaagcaggtgatgagacaaaggagcaggatgcaaaggaaactgaagatattaacttcaatagtgattcagatgaatga

SEQ ID NO: 14845 - DNA, 863 bp, Glycine max
  Peptide Sequence Number=SeqID_131623
ccagaagagggcgcagaaccgcctacgctgacgccggtggatgcgcagcacgtgctgattgccgcgctgtgctggcgcggggcttacaacgaaggctacggtttctggctgctggataacgcgttgcagggcacgccgcagctgatcaccgattccggatctgattatcacgacggcgtgatcagcgaagcgcagaaagggcgcggcattggtgactgctggagcaccgctgcatgggtgtgggatggccgccagttcgtgcagagcagcgaggccaccaccggcatgtgtcgtgccatccgcgccggcggcgcatggcaactgccaacgctggtcaccgaagtcaaaccggcgggattttgccgcatcccacacggccatgacgtgggcgatggcggtatcgatctgcgcgccgttgacgccatcgcgcaccagcaccgacacgcccagcagaaaagcgtcgagggcgatggcgagggcggcggcatcggtgtcggcgcgcagttcgccgctgtcgatgccgcgctgcacgcaggccgtcatgcctgccagcgccgaccatacatcccagcggatggccagactcacactgcatgctggccgagcgccgcagcgcggtctccattgcggtacggggcggcaggctgttatcccatagcggctccaccacctgcgcgtaagtcgacagatagcgctgcacacactcctgaaacagcgcctgcttcgagccaaaggccgcgtaaaagctcggtgcggaaataccgccggcaattcccgccttcagctgcgttaacgatgtcgactcatagccgtgctgccagaaaatcttcatcgcctgttcaatggccgcatcacgatcgaac

SEQ ID NO: 14846 - DNA, 518 bp, Glycine max
  Peptide Sequence Number=SeqID_131624
atgactggttctcaaagcatcactacaacaacgacaacctcattgcgtggcatcattgaacttctcgaaggccacccttcacgcaacgttgttgaaatcatctctcacacaagttggggccccaagccattcccaggtcgggtcaaactgattttcaaggtgcacaacgtgccgcgcatcgtggcaatgaagtcacatgccactgcggggctcgtcgagggcaacaacggcgaggagaacgcacgatacatcatcgacaggaacgaggttgagggtttagaggaatgggaggttgttgttgtggtggtggtgatggtttatgatgagtgggctcgtgtaacccactgggtcgaggacgagttcggtgacatgagtggctcccgaaacgacgaccttgcacctgaagtcgtaggtgaacttgtcgttgaagaggttgtcgcattggttgagggagaatatgttgcagattcaacaatgacgaataatgagattgttgaagctgcgaggaaaaggaatag

SEQ ID NO: 14847 - DNA, 1101 bp, Glycine max
  Peptide Sequence Number=SeqID_131625
atggctctaagtttcaacacttcaaattccttgtatgactttgtggttagagagggcaatggtgtgaagggtgtgtcagacttaggtttaccagaggtgccagataggtacatacaaccccccgaggagcgaatcaacaagcaagaatcaaggacatgtgatgctccacccattgacttgtcaaagctcaatgggttagagcatgagaaagtggtggatgagattgttagagcagctgagactcttggcttctttcaggtggtgaaccatggtgtgcctttggagttattggaatcacttaaacatacagctcacaaatttttcagcttgccactagagaagaaaactttgtaccgcgccggagttagcccagcagggccagtcacaagacttgcgactagctttgtacctgagaaagagaagacatgggaatggaaggactatatcagtatgatatatagaagtgacgaagaagctcttcagtattggcctaatctgtgcagggaactagtgcttgagtatttgaaattatcatccaagatggttagaggcatcgtggaaatcttgatacgtaaccttggggtaacaatagatgactcaaaaactgaacaaattatgggtgataaggtagttaactttaactactacccaccatgtccaaatccagagctcacagtaggactagggcgccactcagacttgggaactattacagtgttgctccaagatgaaattggaggtttatatgtcaaaatggaagaagacaatgatgctggaaaagaagagtggttattaattccacctatccccggagccctagtcatcaatattggtgacattttacagatactgagcaatgggaagtacaagagtgctgaacaccgaacaacaacaactagcaccagagccagggtatcagttccattatttattctgcctatagctacagagaggattggcccatttccagaggcagtgaagaatgttgggtttgctcgatacagggaagttctaatgcaggattacatgagcaagtactttggaaatgctcatgaaggaaagaagaagattattgattttgcaaggatcaactctgcctaa

SEQ ID NO: 14848 - DNA, 1437 bp, Glycine max
  Peptide Sequence Number=SeqID_131626
atgtctccaagtttcaactcctcaaattccttgtatgattttgtggtgagagaaggcaatggcgtgaaaggtttggtagacttgggtgtatcagaggtgccagaaaggtacaaacaacatccacaggaacgaatcaacaagcaagattcaaggacatgtgatgctccacccattgacttgtcaaagctcaatggaccagatcatgagaaagtggtggatgagattgctagagctgctgagactcttggcttctttcaggtggtgaatcatggtgtgcctttggagttattggaatcacttaaagatgcagctcacacattcttcagtttgccaccagagaagaaagctgtttactgcactggggtcagccctagccctagggtaaaatatgggactagctttgtgccagagaaagagaaggccttggaatggaaagactatattagtatggtatatagtagtgatgaagaagctcttcaacactggccgaatcagtgcaaggaagttgcacttgagtatttgaagttatcatctaagatggttagagacattgtggaagccttgataagtaagctcggggtagccctagatgattcaaaaatcgagggccttcttggtctgaagatggttaacatgaattactacccagcatgcccaaatccagagctcacagtgggtgtagggcgtcactctgacatgggagctatcacagtgctactccaagatggcattggaggcttgtatgtcaaagtggaagaagatgaggatgctggaaaaggagagtgcaatgggaagtataagagtgctgaacaccgagttaggacaactagcacccaatccagggtatcagttccagtgtttactatgccaatagctacagacaggataggtccattgccagaggtggtgaagaaagatggtttggcccgttacagggaagttgtgctccaggactacatgaacaacttctttgggaatgctcatgctggaaagaagtctcttgattttgcaaggatcaactacaaagccataaacaaacttcacttagccatggctctaagtttcaacacttcaaattccttgtatactttgtggttagtgcctttggagctgttggaatcacttaaagatgcagcacacacattcttcagtttgccaccagaaaagaaagctgtttactgcactgggatactgagcaatgggaagtacaatagtgccgaacaccgaacaagggcaactaacaccaaagcaagagtatcagttccagtgtttattctgcctatggctacagagaagattggtccattgccagaggtggtgaaaaatgatgggttggcccaatatagggaaattctgatcaaagattacatgaagaactactcagcgaatgctcttgatggaaagaagtttgattttgcaaggatcaactctgcctaa

SEQ ID NO: 14849 - DNA, 264 bp, Glycine max
  Peptide Sequence Number=SeqID_131627
atgaggtggcacgatgttgaggacaaggtcgttgctgttgcatgtgaaggaggtgttgtgacgacaccaacagtatacgattcaaatgactcaataaaaagggaatctgtaaaactaaaagtagagcccaatgcaacaaacaggatgcatccattaaaaagaatagaaaaatgtggagcagaccatgcgaatccggaaaacaacagagcccagaattttagcagcggacaatccatgcaagggtcttggcccttgggccgttaa

SEQ ID NO: 14850 - DNA, 912 bp, Glycine max
  Peptide Sequence Number=SeqID_131628
atggctctaagtttcaactcttcaaattccttgtatgactttgagattagagagggcaatggtgttaaaggcgtggcagatttaggtttatcagagttgccagagaggacatgtgatgctccacccattgacttgtcaaagctaaatggacctgagcatgagaaagtggtggatgagattgtaagagcatctgaaactcttggcttctttcaggtggtgaatcatggtgtgcctttggagctattggaatcacttaaagatgcagctcacacattcttcaacttgccacaagagaagaaagcggtgttccgcacagcaattaggccaggcctagtcacaaaacttagtatggtacatactagtgatgaagatgctcttcagaattggcctaatcagtgcagggaagtagcacttgagtatttgaaattatcacacaagatgatagttaacatgaactactacccaccatttccaaatccagagctcacagtaggtgtagggcgccactcggacttgggaaccattacagcgttgctccaagatgaaattggaggcttatatgttaaaatggaagaagaaaatgatgctggaaaaggagagtggttggaaattccaccaatccctggagccctggtcatcaacattggtgatattttagagatactgagcaatgggaagtacaagagtgctgaacaccgaacaaaaacaacaagcatcaaagccagggtttcagttccattgtttactctgcctatagctacagagaggattggcccattgccagaggcagtgaagaatgatgggtttgctcaatacagggaagttgcaatgcaggattacactaaaaacttctttgggaatgctcatcaaggaaataagactcttgattttgcaaggatcaactctgcataa

SEQ ID NO: 14851 - DNA, 144 bp, Glycine max
  Peptide Sequence Number=SeqID_131629
atggtggaggatgagtctaaagattgtgtcaactacttgttttgtagaagcaaccaaaacatcttcaacattggctttgatgattatgatgagatggatccttcgactctaccggacagaagggtccaaggaggtagaatgtga

SEQ ID NO: 14852 - DNA, 705 bp, Glycine max
  Peptide Sequence Number=SeqID_131630
atggcaaggttcctatgtgggcttaatagagacattcgatgctttgtgaagttgcaacactatgagagcttggaggatatggtgcatcaagccaagaaagctgagaggccacttgagaggaagcattcctacaagaagacctatcactatgactcttctagtgataaggacaagtccaagaaggagggatattccccatctaagcaacaaggttcaaagtctcaaagtggtaaacatgttcctaaccatgacacttcttctacttctagaagtggttcaattaaatgttttaaatggttgggtaaaggtcatattgcattacattgtccaaacaagaaaaccaattttttgagggaaaatgagattgccattagtgatttttcttctattagttcatcttatatctctagtgataatgatagtagatgtggtaccaaatatctagatgatggattgatgatgtgtaagaggttgttgggtatccaatttacattaatgtgtccaacacaaggttggttagcagacttaaccttaaaaccacccacatgccataatccttattgcttaaaatttccatgtaaagaagcatctaaccatgcaaagtcttatgttttgatgcctaaggaagaattgtacatcaaggatcaatggacaagacaatttggagaagaggtggatgtatatgaggatcaagtcaaccattag

SEQ ID NO: 14853 - DNA, 651 bp, Glycine max
  Peptide Sequence Number=SeqID_131631
atggcatcaaagaagagaaaggcacctaccacaccttcccaggcctgggaaaggtacactgacattgttgtacctaggaagctacttccagaaagaaatgttgtaatctaccacagtgagtttgatgagttcaaggaagaattggagagaagaaaatgggataaggagttgaccagttttgatgaaggcagcattgatgttgccattgtgaaagagttttatgctagcctctatgatcccgaggataaatcacctaagcaggtgagggtgagaggccatttggtgaagtttgatgaggacacgctgaataccttcttgaagacccttgtaatcatcaaggatagggatacattattagcttactctagatttgcactcttgaggcctgatcctcaggagttggcagccatgctctgcatcccagggaggggatttgagcttaatgttgacggcttgccactgaagatcctcaggaagaacatgaccacactcgttcagacttggagttttctttcttactccaacttggtccctacctcccatacttctgatatcacactagatcgggccaagttgatttatggcattatcatgaagatggacatgaatctgggctacctcatctcccaccagatttctatcattgcctag

SEQ ID NO: 14854 - DNA, 330 bp, Glycine max
  Peptide Sequence Number=SeqID_131632
atggtggagaagttcagacttcaatgtcgatgggggcacgatggtcttgagaagacgacggtgatgaaaggttcaatacgacgaggtttaaagctagtcacacttagacacgacatcattctcgccgccaccgtcgtgctatgcagcggcaacattgactgcatcctaaatgaacgtcgtaggacaaaggagaacctggtcaataaggattggcaaataggagaagaggaggaagctggtttggagaataaaattgatgttcgttgcacaattctgctgcacgcggaagccattgacgatgagatcaaattagaagaggaaccagaatag

SEQ ID NO: 14855 - DNA, 1265 bp, Glycine max
  Peptide Sequence Number=SeqID_131633
aatgccaatcccctctgagaggcacatgttccttcaaacaggaaatggatctggtgattctggacttgtgctttcaactgatgctaagcctagattaaaatggacaccagatcttcatgccaggtttatagaagcagtcaaccagttagggggagctgacagtgagtatacacatcagcttttggatcatcaaattttgaggaacatagaatttgagttcactaatgcaatttacaatctctccattgcagaggcaactccaaaaacagtaatgaaactcatgggaattccagggcttaccttatatcatctaaagagccatcttcagaagtatagattgagcaagaatctgcatggacaaagcaacaacgtaacatacaaaatcacaacaagtgcatcaactggggagagactttctgaaacaaatggaactcacatgaacaaattaagccttggaccgcaggccaacaaagatttgcatataagcgaggcactgcagatgcagattgaggttcagagaaggctcaatgaacaacttgaggtacaaagacacttgcagcttaggatagaggcccaaggaaaataccttcagtctgtgttggagaaagctcaagagactcttggcagacaaaatttgggagtagtaggaattgaagctgccaaagttcaactttcagagctggtatccaaagtctcatcacagtgcctcaactcagcattcacagagccgaaggatttgcaaggatttttccctcagcaaacacaaaccaacccgccaaacgattgctcaatggacagttgcctcacatccagtgacagatcacaaaaggagcaagagattcaaaatggcttaagacacttcaacagccatgtgttcatggaacataaggaagccacagaagctcccaacaaccttaggaaccctgaactcaagtggtgtgaagatgggaaaaagaacaccttccttgccccattgagcaagaatgaagaaagaagaaactatgctgctgaaagcagtcccaacaacttatccatgtccattggacttgaaagagaaacagaaaatggaatcaacttgtatcctgagagactaatcacagaaagccaatcagatggtgagttccagcataggaacagaatcaagccagaaacattgaaaccagtggatgaaaaagtttctcaagattataggttgcctgcttcttactttgcagcagcaagattggacctaaacactcatggagacaatgaagctgcaaccactt

SEQ ID NO: 14856 - DNA, 723 bp, Glycine max
  Peptide Sequence Number=SeqID_131634
atgacaagtgaaaagctggctggaccaaatctgaactctttatgtggatttgaggtcatagataagataaagtatttggttaaagaagaatgtcctattactgtttcatgtgttgacatccttgccatggctgcacgtgatgttgttgaattgagaggaggaccaagatgggatgccttgcttggaaggaaggatgctctcgagtcaagttttagtggagctaacatattaattcctgctccaaattcatctttggaggttctcatagataattttaagcaacaaggcctcgacatagaagacttggtaactctatctggtagccatactataggaagagcaagatgtctaagcttcaggcagaggatatataatgcaaaagaggaatatcattatggctatgatcactacaaacgatacacaagtttcaggagaatcctgcggtccatatgccctgttgagggaagggacactaaatttgcacccttggattttcaaaccccaaaaagatttcacaatcactacttcataaacattcttgaagggaaaggcttgttaggttctgacaatgttcttatcagccatgacttagatggaaagactacagagcaggtgtgggcttatgcctctaatgaaaaacttttgattaagatgggaaacatcaatgttcttacaggaaatgagggggaaattaggaggaattgtaggtttgttgatgcttag

SEQ ID NO: 14857 - DNA, 209 bp, Glycine max
  Peptide Sequence Number=SeqID_131635
atggaagagtttgaagagatcctgggatgtccactaggaggaagaaagccgtatctcttttatgggttctatccctccgtggcaagaatagccaaggtagtcaaaatcatggcacaagatttggaccgagtaaagaaaaatagaaatggaatagtcggaataccaaggaagcatttggaggaaaaggcgaaaggcattggcggatcaag

SEQ ID NO: 14858 - DNA, 192 bp, Glycine max
  Peptide Sequence Number=SeqID_131636
atggaggatttatcattattcccaaacactgaatgtttggcagaatatacagatagtagggacctttggaattggaaaagagaagcgggacctgcttatagtttttgcatagatagctcatggacagctcccaggcacggactaaataaagatgtgtatgtcaaagaagctaagaataataagaaacaatag

SEQ ID NO: 14859 - DNA, 237 bp, Glycine max
  Peptide Sequence Number=SeqID_131637
atgcatgcacgtatatcgccatgcatgcttgcgatatacgcctgggaccggacacgtggttgttccgccagtgccactggcgaaatagttggcatagtggttttcgccactttgactggcgatttaggtgcagagggcacgtatatgatgaattcagttataacagtgttgtatttcaatggaagggaaaatatgttgctctgcaaatttgtgatgacgaagatgttgaaactatga

SEQ ID NO: 14860 - DNA, 159 bp, Glycine max
  Peptide Sequence Number=SeqID_131638
atggcagggaaccatggtttagaggtgaagacgaagattatatactcggttcatcatctgagaagggagagaaaatcatcacggtttcatcatcaagtgaagggagataacactatgggtcaaaaaggcaagaaactggtcatgaggggttcttcatga

SEQ ID NO: 14861 - DNA, 225 bp, Glycine max
  Peptide Sequence Number=SeqID_131639
atggcatttgggaccatggcaactcacccaggcgagctcatgcttactcctacagtaactggctcgcctcggcgagctgaaaactcattgaaaagaccctttagccccaaccttttggtatcttttgcatccttgacaaaaacaccgaacgatctttcgtcttgtgcggtaactggtgtcgaacaacacagttcggctagcgagaatcaaaacatcagtgaatga

SEQ ID NO: 14862 - DNA, 264 bp, Glycine max
  Peptide Sequence Number=SeqID_131640
atgcagatcttcagggttcttctacaagaaccaaacctccagcatggagatcttgagagtgtctctagccacatgccgttttggaagtacaaatttctagcgggagttcaatttgaaaaagagtttaagcttctaagcgaagttgacaggccacatgccattattcacctggcaaatgagaatcttcaagaagaattagatggactaaaacttgaagtagcccaacttcaagcagcattagatggactaaaacccttgaagtag

SEQ ID NO: 14863 - DNA, 390 bp, Glycine max
  Peptide Sequence Number=SeqID_131641
atgaaggccggtgcagttgagtctggtgaaatttcaaaaggagcacccccaagaaaagggttgattagagggctctcaataatggactttattttgagaattgttgcagccattgccacactcggaagtgcattgggtatgggaacaactaggcaaacacttccattttccacccagtttgtaaaattcagagctgtatttagtgatgttcccacattcgtgttttttgtgacctccaattctattgtatgtggctacctagttctttcacttgttctgtcattcttccacatagtaaggagtgctgcagtcaaaagcagggtactccaggtctttcttgacacggtaaacacactgattcttcttgaattttcaagccatagaatgtag

SEQ ID NO: 14864 - DNA, 354 bp, Glycine max
  Peptide Sequence Number=SeqID_131642
atgaaggctcctacccttatttataatactccaccttcacactgttgggaaaaactcgatgggaggaaatatcggggagattcttttacccgatgtgggacttcatctcacacttgtactccaacacatctccccctcaagtgtgagtctcttccacatggaagcctcccccttcgagcgaaagtcatcatccacgactacctgcggtacttgcaccgccgctccatctgcgggacacgctgcctggactcaccgccaggaagactttcgatacaagggatccccaaagctgagatccatcaccgccatcttactcgtctgagccgatcaccaagtcgaacaacctggctctga

SEQ ID NO: 14865 - DNA, 309 bp, Glycine max
  Peptide Sequence Number=SeqID_131643
atggttaaagcccccaagcaattcaagtccaagaattctctcaaatacttgtcattcaatttctttgaaattcacaccaagatagaattaattaagcgtaatgggtttcagtttgcgttgtgttcaaagacatgtggatgtctcgaagggctgtgtagcagtgattgtgcagctgcaagatcaaagcgtaaggggcgcctttatggtattggagaccttgctcatacatgcaaatgcagaaatgacaatttcatgcaacatatgcaaggatcttttagtcgcgttgaagatgttgcaaagattaactga

SEQ ID NO: 14866 - DNA, 780 bp, Glycine max
  Peptide Sequence Number=SeqID_131644
atggccaacaacaaatcctggctaagctacttctacacaaagtaccaaacactggctagcaagaagggcatggcaacatgtgggagcctgcatcacatcttcgacacccttttgccagaaaagtcaaccctgcttgaatccctctcatggaaccaaataaaacccctaaaatccacagaccaaacccactccttcactgagatatttggagaactccatttcaaggagagtcctatatcatcaccattcactccccacgtttctacttcatcatcatcatcgtcaactgagataacaaacaacaccaacaggcacaagaatagtgacagcttctcatccttgagttctgagagtttgcacctttgcactgagggtcttggctttgagagttcagatgatgttgaagacttcaaggatggaatgagtgagagttgtgaagtgtataaggagaaagagggtgtcaaaaggtgtgtgagttcaagggtgagtgagtaccctcctcctatttcttgcatagggaggagtgggaagccttgggtgtgtttcaggtcctacagaagtgaagggaggtttgttcttgaagagataaggattccaacacatgagttcttgcatgcttgtagagaggatggaaggctgaagctgcattttgttcatcatgaggatgaacccatagaagaagaagaagaagaagaagatgatgatgatgatgatattggtgtagaaacaatggatgaagaggaggaagaagaaaacatggaagagaaaaatgatgattaa

SEQ ID NO: 14867 - DNA, 819 bp, Glycine max
  Peptide Sequence Number=SeqID_131645
gcttggtttagggaacttcctacaggcattctagattcattatcacccgagcaggtaatgcaatgccagactgaggatgaatgttctgaactagtgagacatctacctcatactgaagcttcactcttggactgggccatcaatctgatggctgatgttgtcctacatgagcatgttaataagatgaatgcgcgtaacattgccatggtttttgcaccaaacatgactcagatggcagaccctatatctgcattgatgtatgcagttcaagtaatgaacttcttgaagacacttatattaaggacagtgcgggaaagaaaggattctgtggtagaatcatgtcctagattttatctacaaccttctgtagataatgaaaaccgtagaattttggagtccttccggcaagatactcctgcagaaaatgaagaggctcaagaaaactttgttttagagaaaactgccttagaccgttcccctgaatcactccaaaacaactcaactggaggagaacctggcagtttgacaaactcttctgagaatcttgtttgcaatgaggatttgtattgtgagtttccacccgtaggaaacatggggaagagtaaaactggccaatcaagatcgtccaataagttttggtcagatgatagcaatgagacatgctacgcgtttaggcatcaggtccacaaaggtagaccaatggcaaggagttttatggagggtcacgagacacttgtatataagcgtgccacgttgcctgcaatgttcaatctagcagagccacttggacagttacaacaagtgaaaacggttaattga

SEQ ID NO: 14868 - DNA, 421 bp, Glycine max
  Peptide Sequence Number=SeqID_131646
atgtctccccccatctttaaagtactcacattgatcatatctgtttttgccatcatgcaaatatcaacagctggtgacccagatattcttactgacttcatagtcccccccaacaccatacctgatggcaacttcttcaccttcactggcttccgtgtcattttttcacccaacaacactgtctcagatttcaaagtgttgaaggcaaccaaggtagaatttccagcccttgatggacaaagtgtctcatatgcaatccttgagttcccaggtggcagcatcaacccaccacacacacaccctcgttctgcagagttactcttcaccgttgagggttcccttcaagtggggtttgtggacacaaccaacaagctcttcactcaaacactacaaaccggagacctctttgtgtttccaaagg

SEQ ID NO: 14869 - DNA, 927 bp, Glycine max
  Peptide Sequence Number=SeqID_131647
atggagaagggtagaaccgtggtggtgtctgctttgcagtttgcatgcaccgatgatgtctcaactaatatcgccaccgccgagaggctaattagagctgcacataaacagggtgcgaacatcattctgattcaggagctctttgaaggttattacttctgtcaggcacaaagagtggatttctttcaaagagctaagccacataaggaccatcccacaatcctcagaatgcagaaacttgcaaaagagttaggtgtagtcataccagttagcttctttgaggaggcaaacaatgcacattataattcaatagccataattgattctgatggaactgatcttgggatttatagaaagtcccatattccagatggaccaggttacgaggaaaagttctattttaatccaggtgacactggatttaagtgtaacattgaggcttttgctgaacaggttttccagactaaatttgcaaagattggagttgctatttgctgggatcagtggtttcctgaggcagcccgagcaatggtgcttcaaggtgctgagattctattttatcctactgctattgggtctgaacctcatgatggaagcattgactctcgtgaccactggaaacgagtaatgcaaggacatgctggggccaatttggtacctcttgtggcttcaaataggataggaaaggagataatagagactgaacatggaaaaactgagataacattttacggaaactccttcatagcaggacctacaggagaaattgtttcagttgctgatgataaagaggaagctgttcttattgctcagtttgatctggacaagatcaaatcaacgaggcattgttggggggtattccgtgataggcgtcctgatctatataaggtgcttttaacattagatggcaacaatcccgtccaatga

SEQ ID NO: 14870 - DNA, 429 bp, Glycine max
  Peptide Sequence Number=SeqID_131648
atgcgggggtccggggaatttgtccccttcttagatacgacgtctaggggtagcaaaatgccccaacgcacgtttttaagaaggcgacacggaccctccgttggatcaagacagaacccatatgcaatgcctgtgcaaaagacacaatgcgggaacgtacacagtataaaaaggaaacagtccccagtggagtcgccaactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaaggtattagcaccccacacgcccgtcccaagggacggcagcctttaa

SEQ ID NO: 14871 - DNA, 243 bp, Glycine max
  Peptide Sequence Number=SeqID_131649
atgcatggctccaaactccaaggtggaggacacacgaatgaaaacgcaattcatggggctccgaaaaagggtagagaatggagagttgcactaagcaatcactacgcatggctgcaaactcgaaggtggaggacacatgaacgaaaacgcaattcctggggctccgaaaaggggttgagaatggagaattgcactaagcaatcactacgcatggctccaaactcgaaggtggaggatatatga

SEQ ID NO: 14872 - DNA, 387 bp, Glycine max
  Peptide Sequence Number=SeqID_131650
atgttccatccagcgaccacaataccgatctccccctacggaaggatcgcgcccacaagacaccccgtggactcagagaaacccaacaaggccctagggtttccagctcaggttacgggcctctgtcagtcctacagggtgcccgtgcccccagcaaggtcatgccatcgtgacatagggatcgcacccataagacacccagtggactcgaagaagtccaatagggtcctggcgtttccagctctgattatgggcctctgtcagttctacggagtgcccgtcgctgtcaacaaggtcatcaagccccttattaaccaagctttcatcaagaagtactgcgccccccaggcaggcgcagggcgagacaccacagcagcctggggatag

SEQ ID NO: 14873 - DNA, 1044 bp, Glycine max
  Peptide Sequence Number=SeqID_131651
atggatgatgtattgtctaaaccaagtatctctgattcaaagtttatttcatggatgaacaccaaccaaaattctgttgaagggagaaatcttacttatgcagaatttgtttcaaagtttgtatacaatcagaagaaaagatgttggcaccttaggaagaaaggctataccattggcagattactatgggttccaccaattacaggggaattattttatttgagaatgatgcttaccatttgtaaaggacctacctcatttgaggatttaagaacagttgataatgttcagtattctacatataaagaagcatgttttgttgtgggatttttacaagatgataaagaatttattgaggcaatcaaagaagcaaaagattggggttcagcacattatataagaaagctatttgtgttgttacttttaactgcaacaatgagcaaacctgaacaagtttgggaccaaacttggcattggatggctgatgacattgtctataattataaaaaatcatcaacaagtccagcattgcagcttgatgatagaactcttcaaaatttggtcttgcttgaaattcaacaattgctgcaagcaaatcaaagatcgctaagagactatccttcaatgccatatctagaggatgcgaattgtccaacttatctagacaatagccttatattagctgaactgaactacaacaatgaagaacttagatcagagtttgaacatctattttctcacatgacagatgaacaagcttcaatttacaaccagattgttgaagctgttaataaagatgaaggtggtatgttttttctctgtggatatggaggtacaggaaaaacatacatttggaaagcacttgcaagttcattgagagcggacaataaaattgtaataatggtggcctctagcggcatagcttctcagctattgcctggaggtagaactgcacattcaaaatttaaaattcaagttccagtttttgaagactcaacttgcaatatccatcaacgaactcaattagctaagctattaaattag

SEQ ID NO: 14874 - DNA, 823 bp, Glycine max
  Peptide Sequence Number=SeqID_131652
atgcaggttgaatcccacccgcatcaggcgcgcgcgccaggccggcgacaggcgtttgaaccaatagggcttcaccgctttacatcgcctcggtcacatggcctcgaacaggccggccgcgcccatgccggtgccgatgcacatcgtcaccatgccgtacttgccgccggtgcggcgcatgccgtgcatcagcgtggcggtgcggatcgcgccggtcgcgcccagcgggtggcccagcgcgatggcgccgcccagcgggttgatcttggctggatcgagcttgagttcgcggatcaccgccagcgactgcgcggcgaaggcctcgttcagttcgatccagtccaggtcgtcctgggcgatgccggcgcgcgccagcaccttggggatggcggccatggggccgatgcccatgatttccggcggcacgccggccaccgaatagctgacgaagcgcgccatcgggctgaggttgaactcgcgcagcacgcgctcggacaccagcaccacggcggcggcgccgtccgacatctgcgagctgttgccggcggtgacgctgccgcgcgcggcgaacacgggcttgagccgcgccagcccctcggcgctgctgtcggggcgcgggccttcatcgacctcgaccaggcggcgggtttcgcgcacgtcgcccttggagccgccgggcaggcgcgtcaccacctcgaacggcgtggtctcggcgcggaagtggccggcggcgatggcggcgttggccttctgctgcgaggccagcgcgaaggcgtcctggtcttcgcgcgacaccttccattgctcggccactttctcgccg

SEQ ID NO: 14875 - DNA, 180 bp, Glycine max
  Peptide Sequence Number=SeqID_131653
atgctcttgtgccactgcctcgccgtcgcacctgaacaccatgttcatgaagtacggtctcagcccaccattgctaaaaatataacaactaaaggatgggaagaggaagaggaagaggaagcgtcaaagcgtgaaggagtaaacctctcggagcaggaaaaatctctcatgacaacttaa

SEQ ID NO: 14876 - DNA, 1020 bp, Glycine max
  Peptide Sequence Number=SeqID_131654
atggatctactcgacccgaaccgtttccgcaaccgcaagcaacccaccctctcctcgcgggaacgcttcctcggcgtcccatcccacgcgccgcgactcgaaaacccttcctccgacgacgtcgttttctccaacaacgacgacctaatcgaagacgacgtcgttttctccaacaacgttgactccaccgaaccctcttcttcctcttctccaatccctaatcaccacaaccacaaccacaatagccaccacaaaggctttgcatacggtccctccgacgcgtcgttcggcatcctcgccgcgctgccggagaacgaccacgcttctccgaacggttcgcacttcttccaccacaaaccctccgtctctgtctccgtctcgctctcctcgtcctcctcctcctcctccgcgcgcctcattccggcgattccgaagcccccgccggaccgcactccctcctcctccctcaagttccaccagtccgcgccggtgaacgtgccgcttatgccgatgagaagacaccaccaccgcgagttcgacgatgacgacggtaacgaggacgcggcggaggaggagatgctgccgccgcacgagattgtggcgcggaattccgctcagtcgccgatgctggcttattcggttcttgaaggagtagggagaacgctaaaggggagagacttgcgtcaggttcgcaatgcggtttggcgccaaacagtgtttggtaaaagtcaagtcattgaaaacgaaactaacgtaaaagaagaattgctccttcaggcattggaactgggcaagccgctatggccccaccatggcggaatggtgtggtggtggattgccaaccaccataggcaatttgtgaaggaagacctgctatggcggcgccataagatgcaatggcatgtttatatggcagaatttcggccttccaccatccgccatcaatcaacactgtttgagacttgggtattcattttgtgcatgttaggaatggcaaaggatggaactgaagatgagtaa

SEQ ID NO: 14877 - DNA, 423 bp, Glycine max
  Peptide Sequence Number=SeqID_131655
aagctactaggagccaaaccccactcccgaggcaacggaagatcaaagcttttggatgaaccgaactggttagaagcattgcattctgtgtattggggtcacgacgtgaagaaactaagaggagtggagatgttcgatgagggagtttttgtatggtctgagggaaggtcaaccttgaagaagcccttatcttctgtggtcgccatagccaggtttttcacaccttcacacttcactgagaccttaatgcctgaaaacatgaaaagagttgtacatttcaaaatgattgttaaactctctagttctgtaagagagtattttgatgagggggctaattctggctatgagaacaaaatgttagggttggaagatatgagagaggtagagggagttgagcaagtcgtgaccttgagtgagtgttag

SEQ ID NO: 14878 - DNA, 447 bp, Glycine max
  Peptide Sequence Number=SeqID_131656
atgaaaaacaaagaaaaagacaaaacgacgtcgtttcagcttggagacgccccaaataatcgagacgcaccgttttgttacgttcatcacacttgtctcgaatctctcacgaagcacaaacccgaacccccaaatccccttatctctgttctctcatctcgccgccggcctccgcgcctctggtgtctggattctcgaactcgccaccgttcgtcgcattgcacggagctatttcttcgccgcgccgccgcactcgtcgcctctggtggttttcctcgccgcagcacccccttttctggtctccgcaactttgtttttcaggaggagttttactgctcgcttatttcgtatgttgtttcttcaataatgaaggaggagactatgtctgcattgaaatttgttatgcagaactatactgctctgttattcgatatgttttttctttaa

SEQ ID NO: 14879 - DNA, 1089 bp, Glycine max
  Peptide Sequence Number=SeqID_131657
atggggcactatttcatgttattttcccgcaccgcctctgttgatcaagcctcaccaacccctcacccctccattccctcttcctcaaacccatcacacagtatcaagaaaactcatcagaggcggcaagagggtccacagcaccagcaagcacaaggctcgcggagcaagtgtccctctatggagttaagggttagtaggaggaaactgaaggagagattggttgaagggtgtgtctccaatggggttaggtttcacaaggcaaaggggagtttggttgttgatgttagtggatttggtagtagttttgtagcatatgacaaggtgaaaaaccatggttttcagattgctcatagtgttttggctgaagtggatgatcacccttttgatttggacaagatggttttggtggattggagggattctcatttggggaatgagccctacttgagagctagtagttcaaggttccctactttcctctatgcaatgccatttagttctaatttgatatttcttgaagagacttcccttgtgagccgtccagtgttgtattacatggaagtgaagaggaggatggatgagaagtgtttgattccaatgggaggacctcttccaaggaccccccaagaagtgatggctattggtagcacttctggggtagtacacccttccacagggtacatggtggctagaacaatggctgtggctccagttgtggcttttgctatagctgagtgccttggttccaccagaatgatcagaggaaaacagctttctggtaaagttttgaatagcatgtggccaattgagaacaggctagtcagggaattttactcttatggaatggagactctcttgaaggttgacttgaatggaaacaggagtttctttgatgcattttttgacttgaaaccttattattggcaagggttcctctcttcgaggttgactttgaatgagcttgtttggttaagcatatcactgtttggacatgcctcaaatccatctaggtttgatattctcacaaagtgtcatgttccattggctaagatgatgggcaatatcgctttggagtacattggatga

SEQ ID NO: 14880 - DNA, 276 bp, Glycine max
  Peptide Sequence Number=SeqID_131658
atggttataaagggatttgtctctggttgcttctttttcttcaccctaccgacatcatcgttgcttctcttccaaccaccatcgccgcttcaccaaaagtgctttcctctttactggatttattgtataccaaaatcatgggatcctctcatcacgacacggttgcaacatgacctcaaaggtgagcaagaatgctcttcttccttagtggcagtgatggatgagaccataaggtacatgtgcgacgtgactaggtttgggattgcgattcagtaa

SEQ ID NO: 14881 - DNA, 648 bp, Glycine max
  Peptide Sequence Number=SeqID_131659
atggtaactcgtgtacacttcttttgcctcttggctctcaccttcactctagccttggaagctgatcacagtccacttcaggatttctgtgtggcagacaccaaaagtcaagtactagtaaatggattctcttgcaaagaccctacactagtagaggctaatgacttcttcttcagaggacttgacatagagggaaacacatcaaacccagtaggatccaaggtgactccagttacagtttcacagctaccaggactaaacactttaggcatttcacttgcccgcattgactatgcaccgtggggcacaaaccctcctcacactcaccctcgtgccaccgaaatcctcaacgtgatccaaggcacacttgaagttggttttgtgacatcaaatcctggaaaccgtcatgttaccaaagtgctgcaaaagggtgatgtgtttgtcttccctgtgggacttgtgcactaccagagaaatgtgggttatggcaatgcggttgccgttgcagctctcagcagccaaaaccctggggttataactatcgctaatgctatattcggggccacgccagacattgccagtgatgttcttgtcaaggcttttcaagtggacaaagatgttgttgctaatttaaagtccaagttctag

SEQ ID NO: 14882 - DNA, 1203 bp, Glycine max
  Peptide Sequence Number=SeqID_131660
atgtctcagaacgggaagctgatgccaaatctagaccagcatagcaccaagcttctcaatctcactgttcttcaacgaatcgacccttttgtcgaggaaattctcatcaccgctgcgcatgtcaccttctacgagttcaacatcgacctcagccaatgggttcgctttctctctatatatcatttttttttcattcattccatctccattccctatcaattctcatcatcgctctcttccgcgattgcttcgcagagccgcaaggacgttgaaggatctctcttcgttgtcaagagatactgtattgatactaaacttggtggtggagaactgcctaatgtccatgcatcagaaaatttggtggagaatctcttgggcgatttcgagtatgaagttcaggttccatatttgctgtatagaaatgctgctcaagaagtgaatggtatctggttctataatgcacgtgaatgtgaagaggttgccaatctttttagcaggatccttaatgcgtatgctaaggttcctcccaagtcgaaggtttcttccacaaagagtgagtttgaggaactagaagcagtaccaactatggcagtaatcgatggtcctcttgagccatcatcatctactacttccaatgtggctgatgttcctgatgatccatcctttgtaaatttcttcagtgcagccatggctattgggaatacttcaaatgctccaattaatggacaaccttgtcagtcttcggctacaatttcttcatcttcagtgccaactaatgctgctacacccactgtaccaaccttacagatacccactctttctgcatctactcctctaatacctcagcttgatgctgctgaactcatcagcagcagtaaccgaactgcaaaacttgtgaagccatcttttttcgtccctcccccttcttcagcaatgatgataccccctgtatcttcatctacaccttcagcccctccacttcatcctgctgttaatgtacaacgcccatatggtgctccactgctacagccatttccaccaccaaatccaccaccatcacttgctcctgctccctctccctctccaagctatggtccagttatttccagagaaaaggttcgagatgctcttctggtgcttgttcaggacaatcaattcattgacatggtctatagagcgctgctgaatgctcatcaatcatga

SEQ ID NO: 14883 - DNA, 816 bp, Glycine max
  Peptide Sequence Number=SeqID_131661
atggcaaccatgtccattgccctgtctctcctcatcttcctctctctaatctctctcttcacaatggagaatttctcgaacctctctttcgctttctccgcgtcaagtttttctctcttcccattctccatcgcgtcttgtaaaattacgacgccgtccctgcccatcacgtgcctcccctcggtgtcctccatgcacctcgagctccgccgtgagccagtggcgccgcgccgaaaccgggcggcggctggagaggttcgcggcgcgttttcgggtcgggtcgatgatgatccagctgagggcgagattctccacgaggtggttgagcaattcgatttcgtcgttggtttgggcgaatttcaggggagtggggaccacctcggtggggtcgaggaggtccacccagaggggggagcagaggaaccaccccttgtgggtttcggttcggatgacgcgggaaaagacgggtttgcccttgtagtatatgtccacggcggagatgagctccggcggcggaggtgtcggtggttgtgttgggatgggattgggaggggagtggtggagggaggggaaggagtcggagaagatggagcggtgggtggcggggaaggtggcgatggtggccgcggcgaggggatcgttgagagaaggccacgtggcggcgcagatgttacgccagaggtggtgttcggtgcagaggccgcggaggtgagaggtggcggaagcggcggaagcgagggtggggccgtcgaggcgattaaggatgtgggattgaaagatgtcggggtggacggtggtgatgtccgacgaggatga

SEQ ID NO: 14884 - DNA, 705 bp, Glycine max
  Peptide Sequence Number=SeqID_131662
atggaaggggtttcgagggaggctcagatgtcgattgctgcttcttccatgtttcctggattcagattctgccccactgatgaggagttgatttcttattaccttaggaagaagatggatggccatcaagagagtgttcaagtcatttctgaggttgaactttgtaaatacgagccttgggatttaccaggtctcttgggtccttatttaggccgtccctctccctcgagtagtaacggctcctgggtgaccgttactgctgtcaagattggagacgttatggccaaatcattcattcaatcagataacgaatggttcttcttctctccccgaggaagaaagtacccaaaaggttcacaaagtaaaagagcaactgaatgtggatattggaaggcaactggcaaagagcgtaatgtaaagtcaggttctaacgttataggaacgaagcggactttggtgttccacttagggcgtgcacctaaaggggagaggaccgaatggattatgcatgagtactgcatcaatgaaaagtctcaggattctttggtcatttgtcgcctcaagaagaacacagagttccgtttgggcgattcttcgaatagagcttcatcaagtcaaaggcaccccgtgaattcacatgaaagtggttgtgccatctcagagggtggtattgatcaaagggatgcttgtgagcaagacaaatag

SEQ ID NO: 14885 - DNA, 648 bp, Glycine max
  Peptide Sequence Number=SeqID_131663
atgacgggtaaaagagaagttttaggaaaaaataatgaggaaacaagaagttattttacatggaatttggagatgaaacgtgtattgggtgatgtactgagatatcaaaggaatttgggaaacaagggtgacgaaggttggaaaagtgggtttgattgggacggcactaagcacatgatcatagttgaggatgaaaatgtttggaatgaatattgcacgattggatttgacttttttcttttttttgtcccgtcgcataaatcggctaaaccgtttcaatgcaaggtgcttcaaaactgggatgatatagtggatttgtgtgctaaagatagagccacgggtcatggagctgaaactgctatggatgctgatgaagcgatgggtgtcactgctgttatagacttagaagaaccaagctctaatacaaaagaaaaaagacaaggttcaacttcttatggcacacattctcacaagagaaagattggagaagaagaaggaataacaacttctttggataaaatggccaactcttttgaccgaatggtagaaaaaatgaatggtaaagttgatgatgaagatattcaagaagtgttacgtggggcagctttgagaccagacaacaatgggctaaagctattaaatggttag

SEQ ID NO: 14886 - DNA, 210 bp, Glycine max
  Peptide Sequence Number=SeqID_131664
atggatgtgagcgaggtaaccccaaattcattatcgataggtaacgacgagttccgagtgggagttacttggaagatcaaggctgttattcgttgcggttgggagcacccaacgctaccctatgcctcaattcttataaagaggaaccctagtttaacaccgccatcaaatgaatctaaatatgtaagtatgttcagtgatatactttaa

SEQ ID NO: 14887 - DNA, 570 bp, Glycine max
  Peptide Sequence Number=SeqID_131665
atgtcgaggcccatgttgcttgttttcttgctgattatacttataatcacctcacagttcgagtggaagcagcagcttgtggccgatgttgactctaaccccagcgtgtcgcagaagcagcatcagatttccaaggctggagaaaccgttaaggagaagcttgagttgtttgatgtagcgtctgtttctgtgttgtgtggttatttgggtcatttgtctgcagttttgactcatgctgctttttatcctgcaccttgcattaggttacatttcaattataaccgagtgaagaaaatttcccagaatatgagagaggtgttgatcgagattataacacaaatgcgtacagtttatatgcttgctttcatagctgtgttatcaaaggcagatggcggaaaatggtggaaggctgaaattcggccatataaacacgccattgcgccttatggtgccgccatggtgagcctcccttcacaaattgcctatggcagttggcaaaaaatccaccatgccattccaccatggtggcaccatgacactgatctacagccatcggtctttctgtgctaa

SEQ ID NO: 14888 - DNA, 498 bp, Glycine max
  Peptide Sequence Number=SeqID_131666
atggttcaaggtgcaaagaatgtcataagtgcttgccaggaatgtagagtgagatgcttgatatataacgattcagtagatgttgtagatggtggtttgcatgatattcatgatggagatgagtggttggtgtctacgtggaaaactaacaacacgttaaatgaccttaaggctcaagtggaagctttgatcctgagtgccaatgacattgatggcgtattgacatgctctcttcgtcctagtaatgtttttggacttggtgacccagaatttgtgccatactttctcaaattatcaagatatggtttttcaaagatttcacctttttctgaaaatgttactcatgcctatatttgtgcagaagaagccttaaatttccaaaaattttttgtagcaggaaagacatttttcatcacaaatcttgagcctatgaaattttgggaatttttctcacttttgtttgaaagtcttgaatatcaaagcttatggaagtattag

SEQ ID NO: 14889 - DNA, 201 bp, Glycine max
  Peptide Sequence Number=SeqID_131667
atgtcattaaaagcttcccttgccttaaagaatctcctaggtttccaagctcttgaagaaggaagaagcaaggaggaggattttggagaatcaagccaccattgtctgggtttcaagatgcaagctctagaggaaaggattcttgagcaccaaaggagtggagagaaggaagaagaaagaaaatggagaaagaaactctaa

SEQ ID NO: 14890 - DNA, 798 bp, Glycine max
  Peptide Sequence Number=SeqID_131668
atggctcttatgttaggctatgatccttgttcccatttaagtagggccttttcccattttccttctgtttcttcctctgaggctaacagaaacgttggattcactcttaaagcctgttttgatgccaatagcggtgataatgccaatagggtctttgtgaaggaaaagaaaaaacccaatggttttgcatgtgttcctcaccctcccttgttaggtggtttagagaagggtattgatgttgaagatagatctttgggtggaagtcccaccaaacccttttgtttctctgatcaacaattgccccagaaacttgttgttgctgttgatgttgatgaagcaaatacccgtgttcatgagttttttgagacaccatacttcaagtcagggatccaacctatcccaggtgctcagacatccctgcagaagttatcaacattttgtagcctatcagttgtaacatctcggcaaaatgtaatcaaggatcatacacttgagtggatagagaagcatttttcaggattgtttcaggagattcactttggaaaccactttgcccttgatgggatgtctagaccaaagtcggagatttgtaggtctataaatgctacggttctcattgatgataacccaagatacgccatagagtgcgctgaagccggaattagagtcctactttttgattatgaaaactcgtacccttggtccaagaccaattcagctgatgagcatcccctggtgatcaaagttaagaactgggaagaagttgaacaacaattgatgtcattggtagctttgtag

SEQ ID NO: 14891 - DNA, 200 bp, Glycine max
  Peptide Sequence Number=SeqID_131669
tttccgaaagaacttcttctggaagaagcagtgtgcactaccggaagaagttcttccggaaacttctttcggaagaagctcttccggaagctgacacaccttattacgaaaaacgttcttccggaataagtagcatcaacttccggaacaacttcttctggaagaaggaacgtcttccggaagaagtttttactgaataa

SEQ ID NO: 14892 - DNA, 949 bp, Glycine max
  Peptide Sequence Number=SeqID_131670
atgtgggaagcactttctcaggttttgtatttaaacctctctcgtaatcatatccatggtgagattgggactacattaaagaatccaatatctatcccaactattgatctaaggtcaaatcacttgtgtggtaaattaccctatctttcaagtgatgtgcttcagttagatctttcaagcaattcactctctgaatccatgaatgactttttatgtaacgatcaggacaagccaatgcaattacaatttctgaatcttgcatcaaataatttgtcaggagagatacctgattgctggatgaattggacatctcttgtggatgtaaatttacaaagcaaccattttgttgggaacttaccccaatccatgggttccttggcagacctgcagtctttacaaattcgtaacaacacactctcagggatatttccaaccagtgtgaagaagaataaccaattgatatccttggaccttggggaaaataatctttcaggaactattccaacatgggttggagaaaagctcttaaatgtgaaaatcctccgccttcgatcaaacagatttggcggccacattccaaatgaaatatgtcagatgagtcatcttcaggttttagaccttgcacaaaacaatctgtctggcaatataccgagctgtttcagtaacttgagtgccatgacactaaagaaccaaagtacagatcctcgtatctattctcaaggacattatggtacgttttactcttcgatggaaagtttagttattgtgctactatggctgaaaggaagagaagatgagtaccgaaacattctgggtttggtaacaagcattgatctgtcaagtaacaaattattaggagaaatacctcgagaaatcacaagtctaaatggattgaactttttgaacttatcccacaaccaagtgattggtcatattccacaaggcattg

SEQ ID NO: 14893 - DNA, 522 bp, Glycine max
  Peptide Sequence Number=SeqID_131671
atgtggtaccgaatcagatgtctccaagattgcctatctgcgatgaaagcaagaacaaaagcttcaagctttccttcaatgaaaaaatgcccaacagacaacagaaagtccaacttggagctagatgttgatgatgcttggactttctggaatcagactatgtggaatgaaacaaagaatattggtccttctaactctgataagagaagttggaagcctgtgtcaagcacttgcatgaacaatagacgattgacagggctcagtataaggatacttggaaagcaaggttggcaacttaggaaaaatagaaatctgatgcagaagccagatgctaggccattgctaagaaaaaggctaaagaagaggttgcaaaagctagacccagaagtagatgtgtccattcctacccctattgttgagaccccaatggagaaggctaatgaggctattactgatcccacctcacataaagccacatccaaggacactactgttgtcattgtccacacaaccacttcttga

SEQ ID NO: 14894 - DNA, 162 bp, Glycine max
  Peptide Sequence Number=SeqID_131672
atgggggaggaggttgccgcccaagcgagctcagctcgcccacactcgcccagcagaactttacggattgcgcaacaatgcttcttttttacttccgaaatgttgcggaaccttacaggttacctagcgatgggtgttaagtaccttgaggcggttgagtga

SEQ ID NO: 14895 - DNA, 720 bp, Glycine max
  Peptide Sequence Number=SeqID_131673
atggtgggcattgtaagtgacatgatcaatgttagcagatcaatgaagtgttttttcaaaggatcaaacaatagtccgctgttacaattttcttacaactctgcagaccagagtgattctggagagggtggagagggtggtggaattccagtatttacattttattcaatcacttcgcatgagaaatttgctgaggaactgattcagatgtttagcttggaactatgtttgaagcgattacttgttcttgaatttatgtccattggttatgacacttcagcagtaaaacagttgcattggtcaactcagctttatgatgaagaatttaaagatttgagagactgcaatctgtactgtgaagagactcatgggccagttccaccaagattaagggatgggaaatctgacattgatgctttaagatttgacaaccaacccaaccctgaggttttacaggtttatttaacaacatggcttgcagaggcgaacatagacactcccaaatcacaaggcagacaaaatcttcatatgcagatggaattagttcaaaggaaaggcaaacctaacaaaattggtgtctgcaaggatagtatgctcaataatatatgcaaaaatgtgggagagttccaagaatgtcccctaaaggccccacacatgctgatggttgtttcttccatccccatgagagtgcaggttatgcgtgggctgagagcttattag

SEQ ID NO: 14896 - DNA, 237 bp, Glycine max
  Peptide Sequence Number=SeqID_131674
atgaagcatgtaactgatgtgcacaagggagttcttccaagcaatgcccttgcaggaacattgatcatggactgtgatggtcaatggtatagtggagaatgggttaagaagatggaagaggctgcgactttgtttaaaaagattaatgtagagatcgcattttttggagtcaataatgtgttttggttagtgcttgagtatcgtctaaatgcacataggttgttggtgcttcaataa

SEQ ID NO: 14897 - DNA, 5322 bp, Glycine max
  Peptide Sequence Number=SeqID_131675
atgcctggaaacgaagtaggagacagggtccataatttttttggtcaagaaaacttatcccagggtcagtatcattcacaggaagttgacgggaactggccagggctaagcaacaatttatgggctggtagccagagaccaactgttgcaccttttatttccaatttgaagaactttaatctacaacaatcagattttgagcagggacacacaagcactccacatttgcgacatggtttgaacctggctcaatcaaatttgaggcctgactctggcagaaatcaacccccaaaccaacagacaactgtaaatggctatatgcaggggcatcaggtttttcagtcaaggcaaagtgaagcaaacattttgggaatggatacagaaactgatttgcatggcatgtcaaatctgtcaagaggaatatcagtactagattcacaacaggggtctggtcttgaacactataagaaaaacttgactaggtctggtgcatccgagtctcctgtcaattatgatttttttggaagtcaacagcaaatgagtggtcggcattcaggaatgcttcagtcttttcctagacagcagtcagggatgaatgacttacagcttttacaacagcaagcaatgctcaaccagatgcaagaacttcaaaggcagcaacaatttcatcaactagaagctaggcaacaaagttctatgaatccagcttcctccatttcaaaacagacaattgccagccattctgcatcccttattaatggcattcccatcaatgaggcatctaaccttgtgtggcagcagcctgaagttatggcaactaatgcaaattggctccagcatggtggatctgcagttatgcaagggtcctctaatggacttgtgttatctcctgaacaactgcgcctgatgggtttggttcctaatcagggtgaccagtctctttatgggcttccaatttctggctcaagaggtacacctaacctgtattctcatgttcaagcggataagcctgcagtgtctcaggtttctatccaacatcaacatcaacatcagtattctcgcattcaaggtgacaagccatcattgccacacatatcagccagtggtcattcatttccagttcatcagtatggttcaatttcggatcaaactaacacaaatgatggaacttcagtttcaagacaagatattgaaggaaaaagtatgtttggttctcttgctcaaggtataaacagtggactaaacatggagaacttgcagcaagttaattctgaacaaagagacatacctattgaagattttaatgggaggcaagaacttgctggatcttctgacacttcacaggacaaggtgttagcacaggttcctccttcacagaatgtggctaccctagatccaacagaagagaagattttatttggttcagatgacagcctctgggatggattaggttggagtgctggtttcagtatgctggatagtacggatagttttggtggagttccatcagttcagagtgggagttggagtgcgcttatgcagtctgctgtagctgaaacttctagtagtgaaatgggtatacaggaagaatggagtggtctaagtgtccggaatactgaacgttcatctggaagtgagaggccttcaaccatggattgcaccaaacagcaatcaggttgggctgacaataacttgcagtcagcacccaatataaattcaaggccttttcttcggccggatgatctcagcaggcccagtaccactgcaaactattctggtcttcctggatttaatcagtcaggtgctgatactgcacaggaacagcaagataggttacagactgattcttctcaaagatcaattccacagtttttagaaagaggcaaatggttagattgcagccctcagcaaaaaccaatggctgaagggagtcatagttatggaaatgctactaatacctcaggcatagaagtaaatgagaaggttatttcaggttcttgggcgcatcaacagatgctatcatcccctaatagtaggggcgacccattcaatagatctaatggatggaatgctatcaaatcatccacacccagtaacaattctagtatgaaaattcgtgaaaatgaaaatgtgttgcagcctcatcatgacaaagctatgcaagagaatatgggccaggttcctgcaatttgggagcctgattctgatacttcatctgttgggttggaacatgcaaagtcatcaggtaatatgcaggtctgtggggaggattctggtatgaatggtatagctgccataccaaattcaggtgctacatgggtcagcaggcaaagcagccagcaattccctaatgctgatgtatggagacatacagatactgtggggagctatagaggaaatgaaggtgcaggaaaatataggcatcatatggagaagaatcctttagttttggaatcattaaagaatgaaaagtcagaaggagaggcacatgatatggaaaactctaacaaaaaggataaatcagcaactggtggtttgagagaaaatcccagttttgatggtgatttgcatagtccaaagttatccggtcagggaaatcgaaggcctcctgtaactcgtaaatttcagtatcaccccatgggggatgttggtgttgacacagaaccttatcgaaataaacatgccataaattcacagcctatgccccatcaacccattggaggacttaaaggtcaggaccaaagctatactggccagtcaaaatacagtcattctgatgggaattataatgaaacggagaagggtgactcaaaaaccatagatgataatgcttcaaaaagcatgctgcctggtcatacgcccaaaacattgactccatttgatagaagtgttggtaattatgcgctgaacaagactgcttcacccagtcaaaatattcttgagcttcttcataaagtggaccagtcaagggagcatgttgcaacaaacacaagcacttctaaccgccctttatcttccagggtgatggataccgaatcttctgatggatctgctgcacatcctcaacgaaatcaaagttctttgtctcagggctttgctttacaattggctccacctactcaaaggcatcctatgacatcttctcatgctacaccacatgttgcatctgagacaggggataagggtcatacttggttggctgctactcagacttttccttctcgagagtcatctcatgagtttagaaataacatttctggttcctcaggacaaatatttgacaaagcctcacagtatagtgctctgggaaattctccgcaggcttttacttcgggctttcctttttcaagaatccgtagtcaaaatcagaatgtggctaatcttggtggacaagtagcaaatacccaatgtgataattcaacttttgttgatcaggctgcttctactaatcaggtacatgaatattgtgatagagctcaaaccggtcagtctgaattgcaatctgctcaggacatgtctcagatggatagtatgagtcaaattcgtgctggagatcctaccatgaaaatttcctcattggaggctggcactgctcctcatgcttctgttacatcatctctacagagtgccccttcaaaagttctacacaatgtgtggacaagtgtttctggcaagcaacatcctaatgcttataggattccatctcattcccaaccaaataatatttgtgaaactacaacagggccacagaagccaggtattgaagattcagagaaaggcaacctttctgagcagcgggtattgcctgagagtgttgatgctgttgaagagactgcaagtgcttcacaggtgaaggaacatgtgaaatatacacccgatgcatctcaatcaagcccagctgctacctctaaagatattgaagattttggcaggtctttaagaccaaacaatttcttgcatcataatttctctatgctaaatcaagttcagtccatgaaaaatatggagattgatcctagtaatcgagatgtcaagaggttcaaggtttcagataatgtgatggacaaacaacaggtagattccatttccaactgtggacaacagtcatatggatgcaataacatagtcaatgatgtgtcagataatagttcttcagtgccaccatcagatccgaatttgctaagcttttcaacgaagccaggtgatgcacgagacactagtgcatcttctcaggaggtggttggatatggtcagagaaatgctcttaatgttggtaataataacaaagtaacttctgttagaagcgagcattctgtgataaatcctcagatggctccatcgtggtttgagcagtatggaacttttaaaaatggtaagatgttgcaaatgtacgatgtagggacaatgactcctcaaaaagttatggagcatcctttaattataaggaaccaatctggtagtttgcatcttgctaattcaatggagcaagctaatagtctcagtgaggctgggcaaaatccaatgcttgcttcagttgcaagtgagcatctgccttccaagttattgcttcctcctgcagttgaacctgatctgtctagtatgcgaccaaagaagcgtaaaacttccacatctaaactcataccatggcataaagagctgagtcagggttctgaaaggcttcaagacatcagtgtggcagaattagactgggcacaagctgcaaatagattggttgagaaggttgaggatgatgctgaggtagttgaagaattgccaatgatgaagtcaaaaagaagacttgtgttaacgacacagcttatgcagcaactacttaacccccctccagctgcaattctctctgcggatgtgaagttgcatcatgaaagtgtggtctactctgttgctagattagcgttaggtgatgcatgcagttctgtctctcggtctggaaatgacactttcattatgtcccctggcagcaaaaacctcctgcctgataagcccaaagcatctgagaaaattgatcagtacattttgaaggtggaagactttgttggtagagcgaggaaactggaaaatgatatattgagattggatagcagagcctcagttttggacttaagactggaatgtcaggatttagaaagattttctgtcatcaatcgatttgccaagttccatggtcgggggcaaaatgatggggcagaaacctcatcatctgatgcaactgcaaatgctcagaaatcatgcccccagaaatatgttactgcagttccaatgcctagaaatctcccagacagggtacaatgtctttcactttga

SEQ ID NO: 14898 - DNA, 588 bp, Glycine max
  Peptide Sequence Number=SeqID_131676
atggaaaccctagactcagcagtatcaactccttcaagaacctccgattctaagcctcaaacttcatctccattgccaccatcggtgctcagactatggaggccagccgcgcaacggaatttgcggaaccagtggtcacaattggtttcgtgcaaaaatcgatggttctctgcttcttccgtgggaagatctcacgcaactgcactagtcaattttcatctttcccaaaggtacatgcctgatatgaaattaggtgttctgagtgatatgcctgatataaaaaagagagcttgtttgaaactatttaagcggcagaaatttgcagtggcctctcttattttaggacctcttggttctaaatgtctccaagtgtttggatggtcagaaggatcccagttggggttggggttgtttaagatgattaagattctaagggaattgtttttagtctggtatggaagaggagaccatcttggtagtagggagattagctataggtccaagaaggagcgattggggtcttggaagttggaaatctgctgtccaaaaacattgctttggctgatttgcttaatcatcaggaattaa

SEQ ID NO: 14899 - DNA, 504 bp, Glycine max
  Peptide Sequence Number=SeqID_131677
atgtttagtgcagggatagatacatcatcaaacacaatagactggataattgcaaaacttataaagaacccaagaattatggtccaagtccaacaagagttgaatattgttgtgggacaggataggcttgtgactgaactagatttgccccacctcccttacttgcaagttgtggtgaaggaaacgttacatctccacccaccaacccctctttccctcccacgacttgctaaaaatagttgtgagatattcaattatcacatccccaaaagtgcaactctcttgattaatgtttgggccataggacgtgatcttaaggaatggcttgacctattggagttcaagcctgaaaggttttttctcgatggtgagaaggttgatgttgacgttaaaggtaataactttgagcttctaccttttggtgttgggcgtaaaatatgtgttggtatgagcttaggcctaaagctagttcaattgctcattgctaccttaacacacatttga

SEQ ID NO: 14900 - DNA, 999 bp, Glycine max
  Peptide Sequence Number=SeqID_131678
atggcaaggataacgataggacgccgaattttcaacgacgatagttgtaactgtgatccaagggcagatgagtttaaatctatggtggaggaacatatggcattgcttggagttttcaacattggtgacttcattcctcccttagattggttggaccttcaaggattgaaaactaagaccaagaaattgcacaagaggtttgatatacttttatcctccattcttgaggaacacaaaatttccaagaatgccaaacatcaagacttgttaagtgtattgttgtcccttaaagagactcctcaagaagggcatgaactcgttgaagaagaaatcaaatcaatacttggggatatgtttacagccggaacagacacatcattgagcacaatagaatgggccattgcagaacttattaagaacccaaaaattatgatcaaagtccaacaagagttgactactattgtaggtcaaaataggcttgtgaccgaactagacttgccccaccttccttacttgaatgctgtggtgaaggaaacattacgtctccacccaccaacccctctttcactcccacgagttgctgaagaaagttgtgagatattcaattatcacattcccaaaggtgcaactctcttggtcaatgtttgggccataggacgtgaccctaaggaatggcttgacccattagagtttaagcctgaaagattcctccctggtggtgagaaggctgatgttgatattaggggaaataactttgaggttataccctttggtgctgggcgtagaatatgtgtgggcatgagcttaggcataaaggtggttcaactactcattgcttccctagctcatgcatttgattgggagttagagaatgggtatgacccaaaaaagctcaacatggatgaagcatatggtctcaccctccaaagagcggtgcctctttccatccacactcaccctaggctttcacaacatgtgtattcatcattgtcattgtga

SEQ ID NO: 14901 - DNA, 207 bp, Glycine max
  Peptide Sequence Number=SeqID_131679
atggagatatggttccttatattgaaaaccgcaagagacgaatggaaagaactcttattgttcgtcatgacggtgagaagaaaaagaaataagagatggagggaaggtaaggacatgattcttgatgttggagacaacaagagaagtgtgaaagatagagtttgtaatatgagaggcctgtgtgtgaaagtcaaaggacggtgctag

SEQ ID NO: 14902 - DNA, 849 bp, Glycine max
  Peptide Sequence Number=SeqID_131680
atgtcaacgagcatcgaagaccaagctctgtcgtcaactggcagcgatctgaagtgcgacgggtacggcatctcccttgtcgtttcgtcggttttgttcgttctgtatcttgcggtgcacgccaagaagaacctcaacagcctctgtcgtcgaggctcctatgttgtcgtttcctattttgccctcctctggctcgtcacgctgttgaacctcgcatggtcttttcttcaggcatggcagtgctctcctggaaaggaggttgcatggaatctcctgtcattatttacagcatctggtatgttgtgtctagagataagcttgatggctttcttgctgaaggataactacatgaatggcatggaagctctagcacactctttccttgcaacaggaattattgtctttgtggacacccttcttaaggcaatatatgtttttggagttggggtcccattgttcaatcacaatgttagaagtactcatacgatcaagtggagtttgtggataatacataaattattgcttgctgcagcatatggcttcattttatttgcaaatttctccaaatggagagagaagctgcctccaaggccatctttccacaactatgttgctgtaatgtttgtcttcagtgtgattaccctgtttgcttgtggactagcagcaattgacgctggacttggcaattggttgtatgatctcactgtgctttgttatcactctttgtatcttccatttctttacgtaacttttcttgcagattttttccaggaggaggatttccttttggacaacgcatattactccgagatgaaagatgccggattctttgatgctgactgggaataa

SEQ ID NO: 14903 - DNA, 588 bp, Glycine max
  Peptide Sequence Number=SeqID_131681
atggcgaaagctgtaccacgtttttctctccatctcgaaacaccatctctgcctcagtcccaacccatcaccattctcatggctgctctagctctagcacttcttcttctggctttcaccggcacttcaagtgctacatggtgcgtttgcaaggatggaagcgacgcgatcctgcagaagacgttagactatgcttgtggagctggtgctgactgtaaccctcttcacctaaacgggccttgttttcagcccaacaccgtcagggcccactgtaactacgccgtgaacagctacttccaaaagaagggtcaagctcaagggtcatgcgagtttgcgggaacagccactgttactgcatctgaccccagctctagcggttgtgtctacccttctagcgtcagattaaataattgttcaaaaactatcaacaatgcttcttctaaaaaccccactattctatctcaacctaaacctcccaaacacaccccatccatggcgggagccactggcagaacctcttcactctcttccctcacgcgcctctctcatcccccaagcgcgtccaatccccaaacccttagtctttaa

SEQ ID NO: 14904 - DNA, 1542 bp, Glycine max
  Peptide Sequence Number=SeqID_131682
atgtctacttgggttataggctttgctactattatagcagcggtccttatttaccgggttctgaagcccataagcaggccttcttcttcattacctcttccaccagggcccaggccatggcccattgtcggaaacttgcctcacatgggccctgcgccacaccaaggcctggcaaacttggctcagactcatggaccgctcatgcacctccggttgggctttgtcgacgtggtggtggcggcttccgcctccgtggcggagcagttcttgaagatccacgacgccaatttctgtagccggccactgaacttcaggaccacatacttggcctataacaaacaagaccttgtttttgctccctacggcccaaagtggcggttcctgcggaaactaactaccgttcacatgttctctgccaaggccatggatgattttagccaactgcgacaggaagaggtagcaagattgacatgtaaattagcaagatcaagttctaaagcagtgaacttaagacaattgttgaatgtatgcaccaccaatgcattgacaaggataatgataggacgacgaattttcaatgacgatagcagtggttgtgatcctaaggcggatgaatttaaatctatggtgggggagcttatgacattgtttggagttttcaatatcggagactttattcctgctttagactggttagaccttcaaggagtgaaagccaagacaaagaaactacacaaaaaggttgatgcatttttaactaccattcttgaggaacacaagagttttgagaatgacaagcaccaaggcttgttgagtgcattgttgtcacttacaaaggatcctcaagaaggacatacaattgttgaaccagaaatcaaagcaatacttgcaaacatgcttgtagctgggacagacacatcatcaagcacaatagagtgggcaattgcagaacttatcaagaattcaagaattatggttcaagtccaacaagagttgaatgttgttgtaggacaggataggcttgtgactgaactagatttgccccacctcccttacttgcaagctgtggtgaaggaaactttacgtctccacccaccaacccctctttccctcccacggtttgctgaaaatagttgtgagatattcaattatcacatccccaaaggtgcaactctcttggttaatgtatgggccataggacgcgatcctaaggaatggattgacccattggagttcaaacctgaaaggttcttgcctggtaatgagaaggttgatgttgacgtcaaaggcaataactttgagcttataccttttggtgctgggcgtagaatatgtgttggtatgagcttaggcctaaagatagttcaactgctcattgctacgttggctcactcatttgattgggagttggagaacgggactgacccaaaaagactcaacatggatgaaacatatgggattaccctccaaaaggcaatgcctctttctgttcaccctcatcctaggctttcacaacatgtgtattcatcatcatctttgtga

SEQ ID NO: 14905 - DNA, 505 bp, Glycine max
  Peptide Sequence Number=SeqID_131683
atggccctattttcacgtaatgttacaatgcatatcattttactgatgatgataatcattgggacaatagaaggacgaaaagttcaaaattgtggtagtataagaaatggtggaggagctgggggaggttttaatagtgataagaatgatagtcaaagtggggggagtggaaacaatattggtataggtggaggaggaggtggaagtgttggagcaggtggaggcctaggaggaggtgttggtggaggaggtgctagagctggtggagatgtaggtgcaggaggaagtgtaggtgttggtggaggtggaggaggtgccataggtggtggaggaggagctggaggaggaggcactggaattggtggaggtgcaggaggaggtggaggtgctggtcttggcgcaggtggaggtgttggtggtggtggaagtataggtgcaggaggaggtggaggtgcgggtgcaagaggaggtgtgggaggaggtggaggtgttgtcttgggcacag

SEQ ID NO: 14906 - DNA, 1764 bp, Glycine max
  Peptide Sequence Number=SeqID_131684
atggaacgtgaaaacgacaacagcgccaaaagcagtgtcaacggtcagcgccgcgtgggtttactctacgacgagaggatgtgcaagcaccacacaccagacgacgaggaccatcccgagacccccaatcgcatcagagctatttggaacaaactccaaagcaccggcgttccccaacgatgcgtgattttggaggccaaagaagctgaggacaaacatctactgttagtgcattctgaaaatcatgttaatctgattaagaacatcagctcaaagcagttcaattcgcggaggcataagattgcctcaaaattggattccatatattttaatgaaggttcatcggaagctgcgtaccttgctgctggctctgcagtagaggttgttgaaagagtggcaagcagggaattggattctgctgttgccattgttaggcctccaggtcatcatgcagaacaaaatgaagctatgggattctgtctgttcaacaatgtggcagttgctgcaagatatctcttagatgaaagaccagaattaggtgtgaagaaaatattaattgttgattgggatgtccatcatggaaatggtactcagaaaatgttctggaatgattctcgagttttattcttttccgttcacaggcatgagtttgggagtttttatccagctaatgatgatggattttataccatgattggagaaggagcaggtgctggatataatataaatgtcccctgggagaatgggcgatgtggtgatgcagattactttgcagtgtgggaccacatcttgcttcctgttgctaaagaatttaatccagacataattatagtttctgctggatttgatgcagctgttggtgaccctctgggaggatgccgtgtcacaccatttggttattctgttctgttagagaagttgatgaattttgctgaaggtaggattgtactgattttagaaggaggatataaccttgattccatcgcaaaatcaatgcatgcctgcttggaagttttgctagaggacaagcctgttattggatcctcagaggcctatccatttgaatctacgtggcgtgtgattaaagcggttctcctggagttaagtcccttttggcctacacttgcatgtgaattaccgcaaaagttaatctcacaaatggcaccacctccgcatactcttgtctcaagctctgactctgaggctgaggatgataagggtgcaccaagttcagaaaattttgttgaacttcttgaggatgtcataaaaccactttccaaactgaaagttgatgctgatgaagatactgatgtttctagtacttggcgatctgaattgtcaaatgtttatatatggtatgcctcatatggatcaaatatgtggaaggcaagattaaattgctacctagcaggtggacagattttgagaaatgacattcaggtggaaggtatgcagaaggggtgttctggttcagtgaatagaactctgccaaaagagatcctgtggaagactttcccttgtcatatattttttggtcgtgattcatcacattcatggggtatgggaggcgttgcatttcttaatcctgagaaaagttttcagcacaacacctatatgtgcctgtacaaaatttcgctagagcagttcaatgatattttgtttcaggaaaatggtttaagccttgatgcgggctctcctttatttgatataactactctgaatgctatctcttacaaggagttccactctctggaggttgtcaag

SEQ ID NO: 14907 - DNA, 192 bp, Glycine max
  Peptide Sequence Number=SeqID_131685
atgaatttattgcctagcgctgttcatgcatcctccaccaacgagtctggtgccccgcgaattcattgcctagcgatgttcgccaattctccattctccaatcttatttggagacccatgaattcattgcctagcgctgttcatgtgtcctcagttatccagcgcagagcctctgaaaaaaagaaggagtag

SEQ ID NO: 14908 - DNA, 213 bp, Glycine max
  Peptide Sequence Number=SeqID_131686
atgtcattgcctagcgttgttcatgtgttctcccttatcaagtgcgaagcttctggtgactgggaagcacgttattctgttgttttccagatcggttccttcgccaaaagaaaaaaaaaagaagtagagatgagagtcgtcattgcgaaaagggcaggacggacgaaatcagtgtcctatctttgctttcctcttatctccgatgagaggtaa

SEQ ID NO: 14909 - DNA, 699 bp, Glycine max
  Peptide Sequence Number=SeqID_131687
atggcgaacgcaccctgccttcgttgcagctcccttgttcttccctccctaacacccacttcttcttctcagagcctatcacttgcttcacacacttatcttccctcctggaaattgatagggaataaatatagtactaagaaatctctcgggaaggtgaaggccgtgtacgctaatgaattttgggcgccagagacgagttcaagtcagggaatttgggatgatttgcgagtcccatcttccccttattttcctgcatatgcacaaggacatgaaccaccaccaatgagaataatacgttgtgggggagccgtagatgatgatatgtctaacatcttagtcgcccagcttctttaccttgatgtcctaacaaggatattgtcatgcatggcaatatttgatacaatgaggcatattcgacctgatgtgtccactgtttgcattggactggcagctagaataacttataaccttaactcccttcctcactatctttgtgccatgatgttagaaaggaagccaactcttgttcgacttagtgtagactgtagagtcacttatttcattccctgggatcataatattcatgtggaagggttccaggatttcaaattcctcattatatttgcattgataatacagcaaccaagcctttgcttactaggtggggtagggcacatagatcaaatgacgccataa

SEQ ID NO: 14910 - DNA, 1731 bp, Glycine max
  Peptide Sequence Number=SeqID_131688
atggaaattgaccaattttcttccacagatttaaatttcaaaggagtccaggtgggttatggttctacacaagaggatgtgttccaagggaaagagagattctctggaatggaatttctgggagagattgatcctcttcctactgaggatggaaaaggagccaaattgttcaatgatcaagatcagaaacagctacaagaacccaaaattgataacttcatgttagaagaggttaactttaaccctgatatgcaaatgcaaccaacacaactatttcaggaaaccacaggactaatgaaacatgttagggtaaattcagaactagttgaatacaataagcaggtgccaccaacaccatcattagcatccttagagctcctgagaaattacggaagcaggttcaagaggctaagcgagcaaaacataagcaccttaagcaatattgaaacttcctttgatcgccagaagatgtcaactgaagaaataataagagtggctggagcaaggtatctccaatattctgcacattggaatgatagtttttacatccctatgcatccatacgggttagatctagttggtttctctgaggaggaaaacagagacatagaacttgctcaatttctccttgctgcagccgagagggtaggttgccaacaatttgaacgtgcaaacgggttacttctccattgtgaatggagttcatctggcagtgcaagccctgttcaaagagttatctttcatttcgctcgagcacttcgagagagaatatacaaagaaacaggaaggatgacagttaagggatcagggaaaaatgaagaaagggagttaattcagaagatggacactaacatttccattaaatgccatctaaaaattcctttcaatcaagtaatgcaattcgctggggtacaagctatagtggaacatgtagcatctgagaccaaaatccatcttatagatcttgaaataagaagtggtgtgcaatgcacagctttgatgcaagcactgtctgaacgccgggattgcatagtgcaacttttgaagataactgccattggacttaactcattgaaaatcaagatagaagagactggcaaaagtttaactagttttgctgaatccttgaacttacccttttcatataatgcagtttttgtggccgacattgccgaaataaggaaagatcatttcgaaattggagaggatgaagctgtggctgtttactctccatattttctaaggagcatggtatcaaggcctgattgcatggagaacttgatgaggattataagaaatatcaaaccagttataatgatagtccttgaagtagaagcaaaccataactcaccctccttggtgaaccgtttcattgaagcattgttcttctactcagcatattttgattgccttgaaacatgcataaaacatgagattgagtgcaaaatgacaatagaagcagtattatctgaagggataagagacattgttgcaatggaaggaagggaaaggactgtcagaaatgtgaagatagatgtttggagaaggttctttgcaaggtatagaatggtggaaaccgggtttagtgagtcatctctgtaccatgctcacttggttgccaaagggtttgcttttgggaaattctgcactatagaaaaaaatggcaagggtcttgtagttggatggaaggggaccccaatgcattcaatctcagcttggaggtttctttga

SEQ ID NO: 14911 - DNA, 867 bp, Glycine max
  Peptide Sequence Number=SeqID_131689
atggttgccatgggtaataatttgcagcaaaaagccaaagagatcttccacctcttcaccttcactctcctcacccttctcttacccctctcgtttcttctcctagccaaattctccgatgcacaatactatctccaaaccctcacttggtaccattcaccacaacactttccctacgttttaactctcgcccttcacatcaaccctctcatcctctacgtcctcttgtccattatcagcatggcttccctagtccacggcttaacggggaaaatcatcattttgagcgactcattatcatcatcaagcacttttcttcaacctcgtatattcacagcgtggattgttctttgcacgttccaagtttgcgttgggttgggcatagaggggagtattgaggcggggctctatgactctaatgatgagtcgatgggttttggcgttgagagaagaagcttgttaagcagagtggttttcctcttggggttgcatgagacgatgcatgtttgggcaagggtggtggtgaggcccgtggtggacgacacggtgttcggcgtggtcgggagagaagagaaatgggtggagagggtggtggaggcggcgagcttaggtgcattgtggtggtggaggttgagggaggatgtggagagtttggtggttatggttgaggccaagaaagagcaattgatagatgtgagagtgagtgattttgttgggtggtggctctattatcttactgtcacaattgggatggtaagggttgtaaggggtcttgtgtggatggttacgatttgtctctatagaagaccaagggcaacaggggttacctctttgctggaacattcagagattgatgataaggtctaa

SEQ ID NO: 14912 - DNA, 2205 bp, Glycine max
  Peptide Sequence Number=SeqID_131690
atggaagatttgggaggtacccagttcgacggcctcagcaatgctgtgaggaggaagaggagtcagacttcgcgcaggcctcggcctgattcacagcatgcttctgaaggtcaggaactgtctcccttgtcgtcgacgccttcggaggatgctggcaaggcctctagtgatgagaatgttggttacgatgcgaattccaagagaaaggaattcaatcttaaccattgtgtctctcaaacctcctctggtactggagctgaagacgaaaaatcccataaaaagagtaaaaaagatggagggttccatacattttatagtaatgagcctgtacggagcggttcaaataataaacgctgtagtgaaggggttcttgctccagcaaattggaaaggttctagcaaaacaaaggatagcttggattcagagttgagaaatgcagatttgtatggtggaaggaatcctgagagcatgagtctggcacagtttggtggctctcaggatggattggggaatgagaaccgagttaaaaaggttaaactcaaggttggcggagtgacacgtactattcaagccaattcggcaaccaatggtgcttcgggaagtggaacaacaatgaagtctcgttcatcagatgcctccagaccacgccaaaagcaacagagtaattcagacgataataactctccttcggataagaggagtcgtctacaaggtgttccgtggaaggatttctcgaggggtggttttggtcttgggaaggaggaatcattgatggggaagatttctggaaagaacacaactagtaagctgggagacaagtctgaaccagttcgtaagagcaagcgagtaccaaagagacgtgtacttgatggggaatttggtgatgacgatgacgaggatgatgagattcggtacttggaaaagctgaaaacgtcaaaagtttctgcagtctatagagatgaagaagaattaaacaagaaacatcgaaagctatctagtgtctctaatttggaaaatgctgccccaaggtcaggcaaagacggtaagaaaaggtctagatctgatagagtgtatgaggacacagattatgaggatgaagacgagtcagggtctgatggtgagcttgaggataagaaaaagaaaaaacagaggaaggaatctgttgatgtattgatggacagtaagagggaaatgactcttacgactcgtcaacgggcccttcaatcaagtaaagatgcctctgcatctagtgctagtgtaattgagtttcccaacggattaccacctgccccgcctagaaaacaaaaggagaagctttcagaggtcgaccagcaactgaagaaagctgaggctgcgcagaggcgtagaatgcaagttgagaaggctgccagggaatctgaggctgaagctatcaggaaaatacttggtcaagactccagtaggaaaaagcgagaagagaaaataaagaagcgccaggaagaactggcacaggaaagggcagccaatgcactaatgcttgcatcaaataccatcagatacacaatgggtccgactggaacgtttgtgactttttctgaggaaatggggcttcctagcatattgaactccaaacctgtcagctgttccctgatttttacaaccacaaatgctggtcagaagtttgaaactattgttgtttgtttggcaacacatcaaaactttacttatctgctaatgatatcacttggtattgtttcagttatcccccacctcgtgagaagtgtgctggtccatcttgtacaaatccttataagtatcgggattcaaaatcaaagcttcctctttgcagtctccaatgctacaaggctgtccaggagaaggtggtggctgaaactacctgttgatgttgtcaatgatcctctatcactggcttcttccagttatatggaaccatcaatgtttttatctttcacagaggctttagttaagcaactgtgcgttgagcgtgatcctgtcggtatgacagtatcactggcttattccatttatgttatatactactatcttgagcatttctcattgtggattgttaatttgcttaatcttaaatgccggtgcaagagtttatatgatccagcttttcttaattcaaaggataacttaacagcattactgagactgagttcggctcaaaggaaagcttgccattatctttggaggggatga

SEQ ID NO: 14913 - DNA, 672 bp, Glycine max
  Peptide Sequence Number=SeqID_131691
atgggtttcaacaaaagttaccttcttttcaccgtgtccctctcatttctcctcctatccacccatgccatcagcagcattattgctccttctccctccccattcccaacccacaccaacaccaaaaccaaaaccatagactccatcttcaagaaagccctctcaaaaacccaaaacatgttaaaatcacccaaccccaaggtcctagacttctgcaaatccacagagaacccaaccctctgcggcgataccattgccccattcttccaaggctccttcttcgaccccatcaaggccctcctgaacgaagttgaagccacgcataaccaaaccttgaaggtcgccgacgtcattgcaaacacactcaacgaccccaacaccaacagaaacgcacgtgagccactcgacatatgcaggtcacgatacaaaagcattgttagtaccatcaaagaggccgtggagttgctgaaccaacagaacgtagttgatgcttattacaagttcagctccgttatttcggaccagacaacttgcgaagacgcgtttgtggaatcacccggagctcaatttcctttccctgatgactctctcactgtgtatcagcttgctggcaattgcttggccatcatggatgagatagttaatagtcataaccagtttttcttcgcttga

SEQ ID NO: 14914 - DNA, 1473 bp, Glycine max
  Peptide Sequence Number=SeqID_131692
atggagcccccttctttatatgattctagatcacctttggcctttgttgttgttcatgatctacctctaacagcaaatcaccatgtgttgaagcatgtgctttctcatggtgcaccaattgcagcactgtcaacagtcaatcctcctttatatggtcctttcacaagcaatggccactcccctgcaagttcacatttatccataccgttcaagaagaagagtgaagtgaaacctccaatttctgtctttaaaaatattgctcctgtgcattctactgcagctgcaggcccttccgctttggcccagccaccattgtctccttatgcttctaaaaagccaaggacagagagtgcaatttcaactgtgggttctcttccccacccaactagtacacgatttattgcttatgaagagcttaaagaagcaacaaacaattttgaaccagcgagtgttcttggagaaggagggtttggtagagtttttaaaggtgtcttaaatgatggtactcatgtagcaattaagaggcttacaaatggagggcaacagggtgacaaagagtttttggttgaggttgagatgcttagccggttgcatcatcgtaaccttgtaaaactagtgggatactttagtaatcgtgactcatcacaaaatgtactttgctatgagcttgtccctaatggaagtttggaggcttggcttcatggtcccttgggaatcaattgtcctttggattgggacaccagaatgaagattgcgcttgatgctgcaaggggactttcatacctgcatgaagactcacagccctgtgtaatacatagagacttcaaggcatccaacatattgcttgagaacaattttcatgctaaggttgcagattttggtcttgctaagcaagcacctgaaggcagatctaattatttgtctactcgtgtcatggggacatttgggtacgttgctcctgaatatgccatgactggacacctacttgttaaaagtgacgtttatagctatggtgttgtcttgctggaactgcttactggcaggaagcctgtggatatgtcacagccaactggacaagagaatcttgttacttgggctaggccaatccttagagataaggaccggttggaagagattgctgatccaagacttggtggaaagtatccaaaggaagattttgtacgtgtttgcactattgctgcagcctgtgttgctctagaagcaaaccaacgacccacaatgggtgaagtggtacagtcacttaaaatggtgcagcgcgtcacagaataccaagattctgtgttagcctcatccaatgcacgacccaacctacgacagtcctctagcacttttgaatttgatggaacatcttcaatgttctcttcaggtccttactctggtctaagtgcctttgacaatgacaacatttctaggactgtggttttctctgaagatctttgtgaaggacgatga

SEQ ID NO: 14915 - DNA, 174 bp, Glycine max
  Peptide Sequence Number=SeqID_131693
atggctgaagcaacactaggagcaaggaccgcaagtaatagcagaaaagaaagtgatctccgagtcaagctcgccatagcagagtggaatcggagaaccgtgatttcgagcggcgatgtcgttattccagcgggtagtccagagagtgggtttttctctttcaaatataaataa

SEQ ID NO: 14916 - DNA, 378 bp, Glycine max
  Peptide Sequence Number=SeqID_131694
atggcttatgcgactgacaaccaggtggtctttgaggatgaaaaaaccatttatggccgaattactcttctcttcagagatttggaatcacagtatgaggcaaatttaaagtgtaaggagcaaagtgagaaggagttagagtgcttaaccaaattaaaggccgaaaaggcaaatctcttgacccaattcaagacagtggaagaaattagggagaccaatatgaagtatcaaatcaatattttcacttgtaggactctcttgcagaaaagtttggcaaaaattcaaaatgagattgctcaacttctaccacaattaacggctaccgttcacaaagtgaacgattgtgatgacccaattcaagatagtggaagaaaatag

SEQ ID NO: 14917 - DNA, 234 bp, Glycine max
  Peptide Sequence Number=SeqID_131695
atggctcatggctatccatttcatacgttgtggtccttgctgtgctgtgttgtgttggcagtggtcatgtcttctctcctctcaaagaaaagaaatagcactagtctaatgatgagtaatgacgtcggtatgaagttcattaagattggactgcctgttgccattgttgacttttcggcttccatcttccagtcttcttcctcctcatctcattcttgggagtctagtcaatag

SEQ ID NO: 14918 - DNA, 804 bp, Glycine max
  Peptide Sequence Number=SeqID_131696
atgtcacaaggccagagtcccccaactagtcctgcaagatctaggtttgcctttgaaagaagaaggtctcgttcagctgagaatattaacttggagttccaagagagtaggaggtcctcttcagcatctcacagttcaaaattgaaagtggcaaagcttgtggataggtatcttcaagaagttgctagggatgtgaattttcagttgtcaaaattcattgctcttgctgagattataccagatttcgcaagacacgatcatgatgatctctacagggctattgacatttatctcaaggctcatccagaactcaacaagagtgaaaggaaaagattgtgtcgaattcttgactgcaaaaaactttctatggaagcatgcatgcatgcagcacagaatgaactacttcccctaagggttgttgttcaagttctcttctttgagcaagctagagcagcacaagctggtggcaaagtgactgatttgccaaccaatatcaaggcattactcacagcacacggtattgacccttcaaaacctacagcaccattaagcactactacaagtatacatgctgaggacaattggagtgtttcaaacttcaagtcaccaaagtcgaggtcttcaacactgaggatgaagctagctgaagatgatgacttcaatcaaaatggtttgacccatgatggaattggaaggaattctagatttaaggctatttgcgctattccaacccaacccaaaaaaatgcttagtaagttctggtctactaccaatagaactgctgctgccactgaaaagaattga

SEQ ID NO: 14919 - DNA, 330 bp, Glycine max
  Peptide Sequence Number=SeqID_131697
atgtctgttgaatcttgttggtccggacacgaagcattgaaggagccaacacggactccggtccgggtatctagcagacatggatggagccaagaccttcccaacgtgtcgttttgcagtacttgcgcacactttaaacaaacaattggtgggcaactactggagtttgagcacaaactcttttcccataatatgtccataagtgcccaccattctcaacgatccatgtcttcctctgctcatgccattcctaacgcagggatcatagtagctgtctttactattgcctacacttgtcacataggcacgccatcactaggctgcgtctaa

SEQ ID NO: 14920 - DNA, 171 bp, Glycine max
  Peptide Sequence Number=SeqID_131698
atggatgaagattgcccttacgcttttccaaaaataacccaacagccattctttatcccttgtaaagtcaagctttctggtggacatttaaatttttggtactctaatggaaatggtttaaacggtttaatttggcagttgagggtctttttcaaaccttgggttgggtaa

SEQ ID NO: 14921 - DNA, 703 bp, Glycine max
  Peptide Sequence Number=SeqID_131699
atgaagttcatgaaactaggatctcgtcctgatacattctacactgcagaagcagtaaggtcagtctcttctgaagtttctagtgacctcataattcaagttaagggaagtagatatcttcttcacaagtttcccttgctgtcaaaatgtttgaggctacaaaagctatgttcagaatctcctgaatcatcttctcagcaccaaatagtccaactccctgatttccctggtggggtggaggcatttgagttgtgtgctaagttctgctatggaataagcatcactctcagcccttacaacattgtggcggcacgatgtggcgccgagtatcttcagatgactgaggaggttgagaaggggaacttaattcagaagcttgaggttttcttcaactcatgcattctacgtggctggaaggattctattgtgagtcttcagaccacaaaggcgtcgcctatgtggtcagaggacttgggaattaccagcagatgcattgaagctgttgctgcaaaagttctaagtcacccctctaaggtgagtttatcacatagccattcacgaagggtgagggatgatgtttcttgcaatggcaatgaaagtgtgaggcataataagtcaggaaacaagggatggtgggctgaagatttggcagaacttagcatagacttgtattggagaaccatgatagcaatcaaatctggtg

SEQ ID NO: 14922 - DNA, 411 bp, Glycine max
  Peptide Sequence Number=SeqID_131700
atgccaatctccccctgcaaaagtatcagttggtctgtgtcgtcccgacatggggatcgcacccacaagacacccagtggacccggaaaagtccaacagggccctggggtttccagctctggttacgggcctctatcagtcctacagggtgcccgtacccccccggcaaggtcacgtcatcatagggatcgcgcctgcaagacacccagtggacccgaagaagtccaacagggtcttggagttgccagctctaaatatgggtctctgtcagttctagggagtgtctgtcgcccccagcaaagtcatcagacccccctaccaatcgagctttcatcaagaagtactgcgcccccaggcaggcgcagggcgaagcaccacagcagcattgggatggccggtagcgggcaatag

SEQ ID NO: 14923 - DNA, 1509 bp, Glycine max
  Peptide Sequence Number=SeqID_131701
atggagagacagagaagtttctccttcaaacccactaggcttttggtcttctctttcactattttttcctccatcctcttcctctctaccttcaccacctggctcaccaattacacaccttcaattcaccaacagattcatctttacttcaacacttctacttcttcttcttctgtcggtgacggtgaaagtgacagtgtggctcttccacctttaactgttcattccttgaccaaaaacttaactgtaaatgtcgtgaaagttccaactttgatcgataaccgtcttgctaggacccagaaaagcctctctggatccaaatctgaacctgtacgacaccatgtcggtgcctcaaatgttaatttcacgtcaatggaagagtatggaacttcacctgagagggtacccagcaaggaagagaagaaggtagtagcaggtgatttagttgggaaaactcaagttcctattttgaagaagattgagcagaagaagagagttgaagggtgtgatttaacaaaagggtattgggtttttgatgaaagctatcccctttattccaaagtttcttgtcctttcatcgatgaaggttttgattgtgagggaaatggaagattgaatagaagctacactaagtggagatggcagcccaaagggtgtgaccttccaaggttcaatgcaacaaaaatgctggagttgataagggggaaaagacttgtttttgtgggtgattcgattaatagaaaccaatgggaatcaatgttgtgcatgttattgggtgctattaaagatccaacgagagtgtatgagtcccgtggaaggaaaatcacgaaagagaagggaaattatagtttcaggtttctggattatcaatgtactgttgaatactatgttagtcatttcttagttcatgaaagcaaggcaagaatagggcagaaacgaagatcgacattgcgaattgatgccattgatcacggttcatcgagatggaggggagctgatattgtggttttcaacactgcacattggtggtcacattccaaaacacaagccgggatttattactaccaagaaagaggtctagttcatccccagctaaatgtttctacagctttcagaaaagctttgaagacttgggcttcatgggtggacaaacacattaatcatagaaaaacccacgttttctttcgaagttcagcaccatcacatttcaggggtggcgattggaattccggagggcattgtacagaagccacccttcctcttaataaaaccttaagcactacttatccagagaagaatataatcgcagaggaggtaataaagcaaatgagaactcctgtgacattgttgaatataactagtttgtcagcatataggatcgatggtcacccgtcaatttatgggagaaaaacacggtcgtctaggattcaagattgtagccattggtgccttccgggggttccagatacatggaatgaattgttatattttcatttacagagtagatga

SEQ ID NO: 14924 - DNA, 1296 bp, Glycine max
  Peptide Sequence Number=SeqID_131702
atgaaacaacatggagaggcgacaaaagatgctgctagaagaaccttgaagaccaagattaaacagttgacaaatcaagtccatgcgaagcgagagaaatcaattaaagagaaagttcaaaggcattcggaaaatcttaagcctttgttttcaaaggtcaactcgataatttcaaggagggggactttgcaaaataaggaaaaggtcaatatgctttcctcaagaattaacaagccaatttgcaagcataatggtttccctaaaggtttggtagggaaagattgcatcaacaaattggatattgcacttgcaaatgaaattaggattccataccttgaaaaattaccaccatatacaacttgggtgtatctgaccagaaatataagaatggctaaagatcaatctgtcataggaaaaagacagatttactacgacaaaattggtggtgaaataatgatatgcagtgatagtgaggaagagatggtaaatcttaaaaatgacaaacatgactttactgaggctgaagacctaattttgcggatgacacttgaggaatatgagtctactgaagaggtattgattatcgttaaagagtttgttaaaactactgattcacaaattcaggaaaggtatgaaaaactcaaggaaaagcatatggggagtctagacaatcattctgaagattgtcattgtaaaggatgcaagtgtcaccttgaaatatgtttggagaaaagcttgagtgctactttagaatcttttgataaccttttttgtcgtcagtgtctgatctttgattgtcctatgcatgccacttctcaacctgtaatgtatcatgataaaagaatcaatccaatagaaggatgtcatgaatctctaaaaagtcttgttgaacatacttcaaagaaattaatagtttctggtagcttcggccacggtgagcgggacaagggagttgtggaaggacaaaaagatatccaactgtccaattcaacgaaagtgcaagccaatgagatgacaaataactcagattggaaacatctagagaaagatttatatttgaagggagtagaattgtttggaaaaaatagttgccttatagcccacaacttgcttcctggatttaagacttgcttagaagtagctaggtacatgcttgctagtggagaatcaatgcctcatgaatccataccaagttcaatcactaacagaaatgataagattaatgaagattgcataatggggtgggaggagtggtttgatgatgatggaaaattaagtattgtacacataacataa

SEQ ID NO: 14925 - DNA, 336 bp, Glycine max
  Peptide Sequence Number=SeqID_131703
atggggaatgataaacttcttccttttatgatttcagaggaaaactgccaaacaataattcaagtatctttccttttccccgtctgtcctgaccttccctttactcaccaatcaccatgtcttttaaagacagtgaagcaaatggctggtcctaggattgctcatgctactttgaaaggaccaagtgttgtgaaggagatatgtatcggaatggtgcttggtttagctgccggcagtgtctggaagatgcatcactggaacgaacagagaaaaacccgggcattttatgatttgctggaaaaggatgagattagtgttgttgcggatgaagaataa

SEQ ID NO: 14926 - DNA, 726 bp, Glycine max
  Peptide Sequence Number=SeqID_131704
atgacactcctttggcctccctcggggatgaatttatgccacaacgcatttttatccttaaaccccccattgcagaccagaactcaacttcctgttcctgcaaatattccaatttcacaccctctcacttcaatctcaccccacttcaactcacactcccttcaaaaacccagattcccacccgcgagtgcaaaagctactaccaacgaaaccttgtccgaaattctagactcatcaagagcgcagaaactcgaccttgagctcaaaacattggaaccctttttcagaatcacagcaagaagcgtggtaacggacaaagagctcggaaaggccgaagggttcataagattctgggtaggaggcaaaattcttcacttggactcaatcaaactacaaagagagacactgggcatggagaaatcaatctttggccttggcttgttcatcggagccgttgcaattcgacatggttatgatagcggatgcaaaacagcgcagctattgtccatcaatgattcggatctttaccattccaaggttctcttctcaccaaccttatccaaaacttcacacctttttatttatctttgggcagccacggttacggggtcatcggttgaggatgttgggcacatgcttgtgtggggtggtgttggtacccgcatggatgctagcgttgaagaacttatgaaaaaatggtgtacacgatttaaagcgccacattaa

SEQ ID NO: 14927 - DNA, 2621 bp, Glycine max
  Peptide Sequence Number=SeqID_131705
atgctagatgagtcaactgtaggagtaaggtatcgcgttcctccatctgtgatcagtgatattgttgatgctccacctgtacctgcgttgtcattttcaccacttagggacagaattatttttctcaagcgaagagctttacctccactggcagaaatagcaaggccggaggaaaagttggctggtatacgtattgatggaaagtgcaatactaggagtcgcatgtcattctacactggtatagggatccatcaaattcttcctgacggtacattagggtcagagactgaggtgtccggtttccctgttggtgctaaaataaattttgtttcttggtctcctgatggttgtcatttgtcctttagcattcgtgtgaatgaggaggacaatgatagcagtaaactcacagtatggattgcagatgtgaaaacagggatagctagaaagttgtttcagtcacctaatgtacatttgaatgcagtttttgacaattatgtttgggtaaataattcttcattgttagtttgcaccattccatcatcccgtggagctcctccaaagaaacctttggttccaagttgcccaaaaattcaatccaacgaggagagaagcattattcaagtaagaacattccaggatttgctgaaggatgagtacgatgaagatttgtttgactactatgccacctcacagcttgttttggcttctttggatggtactacaaaagaaattggcccaccagctgtatatacctccatggatccttccccagatcacaagtacattttgattaattcacttcacaggccatactccttcattgtaccttgtggaagatttccaaagaaggtagagttatggagtgctgatggaaaattaatcagggagctctgtgacttgccccttgctgaggacattccaattgcattcaatagtgtgcgaaaagggatgcgttccattaattggagagctgataagccgtctactctttactgggtagaaactcaagatggaggtgatgcaaaggtggaaatttctcctcgtgatataatttatacacagcctgctgaaccactagaaggtgaacacccaacaatattacacaagcttgatttccgctatggaggggtttcttggtgtgatgattcactggctttggtatatgaatcttggtacaaaacacggaaaataagaacatgggtagtctctcctggatctgaagatgtagctccgcgcatcctatttgatagatcttcagaagatgtgtactctgatcccggttctcctatgatgcggagaactcaagctgggacatacattattgccaggataaagaaggaaagtgatgaaggaagatatattatactgaatggaaatggtgctacaccagaaggaaacattccattccttgatctgtttgacataaatacaggtaaaaaaatggaacgaatctgggagagcgataaggagaagtattatgagactgttgttgctctaatgtctgatcaagaagaaggggatttgtatttagataaactgaagatactgacttctaaagagtcaaaaactgaaaacacccaatactactttgttagctggccagataaaaacatagttcaggttacaaatttccctcatccataccctcagcttgcatcattgcagaaagagatgatcagatatgaaagaaaagacggggttcaacttactgctacattatacctaccaccaggttacaatccatcaacagatggccctttgccatgcctggtttggtcttacccaggagaatttaagagcaaagatgctgctggacaagttcgtggttctccaaatgaatttgctggaataggctccacatcagcccttctttggctggctagaaggtttgcaattctatctgggcctaccattcctattattggcgagggtgatgaagaggcaaatgataggtatgtagaacaattagttgcaagtgcagaggctgctgtggaggaagttatccagcgtggggtggctgatccgaagaaaatagctgttggtggacattcctatggtgcgttcatgactgctaacctgctggcacacgcacctcatcttttttgttgtggaattgctcgttctggtgcttacaacagaacacttactccctttggttttcagaatgaagacagaactctttgggaggccactaatacttatgtagagatgagtccttttatgtcggctaataaaattaagaagcccatcttgcttattcacggggaagaggacaataatccaggaacattaaccatgcagtcagacaggtttttcaacgctctaaagggtcatggtgctctttgtcggctggtgattttgcctcacgagagtcatggttacactgctaaagaaagcatcatgcatgtcctttgggaaacagatagatggctccataaatattgtgtgtcaaacagctctgaggcaggagaagaccatgctactgatacagtcaaagaacatgttagcaaaggcaccacaaatgctgaaagcaaagtggttgcacccagcggaggcggcagcagagaggtgtctgatcttgagtacgaagaatttcattctctgccgaggtcatccttgtg

SEQ ID NO: 14928 - DNA, 201 bp, Glycine max
  Peptide Sequence Number=SeqID_131706
atgggggaagagaagaaagggctctatgggaaaatttcaatcaaagccaatttggaaggactgaaacgaccgcgtcactgctggctggcgtatgcaatgacgacagctttgttccaccacaacatgtgcgctttttacttctttgttagtaaaagattcaaagcaagtactatgatttacatacggaatgatgaaaaatag

SEQ ID NO: 14929 - DNA, 786 bp, Glycine max
  Peptide Sequence Number=SeqID_131707
atgtcctattttatagggatgcagtcatcaccagagtttgccaacgaattactcagagcactgagacgcggcaagggttggaaatccaatatcaccaaaactgatttgtaccatctttggtttcggatgaaggataattcttttaactcaagaatgcgaatattctttgacatgtgtaacagaaacaaggatggaagagttaccgagacagatataaagcagacaattttattaaccgcttctacaaataagctatccgtgacacatgatgaagcagaggactatgcttctttgatcatggaatctctcgacaagaaaaacaaaggctacattgagatatctcaaatggggtctctattcaaggcaacaacaagtctatcaaattcaaaggcacactttccaatgaaaaaagtaccagcagcaggtagcagcacacagaatgttcagaacactagcggtgacttttgtgaagaacgagaagaaccaatgtcaaggaccgaagtgttgttcagaacttattggagacgtgcttggattgttctggtttggttgcttgcatgtttggggttgtttgtgtggaaatttgttcagtaccgccacagatcagggtttgaagtcatggggtattgtctttccacggctaaaggtgcagctgagaccttaaaactcaacatggctcttgttcttcttcctgtttgtagaaacacaatcacgtggctccgcaagcaccgtccgatcaactctgttattccattcaatgacaacattaatttccacaagtcataa

SEQ ID NO: 14930 - DNA, 509 bp, Glycine max
  Peptide Sequence Number=SeqID_131708
atggcatcaccgatccaacaacaacaacgctcgactactacaagttctggatctgaaggaggagatccgcatatcatcgatgagaggaagcggaagaggatgctgtcgaaccgcgagtcggcgcggcgatcgcggatgaggaagcagaaacagctggaggatctgaccgatgaagttagcagattgcaaagcgcgaacaagaagcttgcggagaacatagaggccaaggaagaagcgtgcgtcgagaccgaagcggcgaacagcattctgagagcacagacaatggaactggccgatcgattgcgcttcttgaactccatccttgagatcgctgaagaggtcgaagggttatccgttgagattcccgagattccagatcctctcctcaagccctggcagattcctcatccgatacaaccgattatggccaccgcaaacattatcgtgtggtcatcaatgcattgggttcctgagagagatgaatgtgaggtacagggtgttgatggctg

SEQ ID NO: 14931 - DNA, 147 bp, Glycine max
  Peptide Sequence Number=SeqID_131709
atgttgccttatattcagggccaactacagggttacagattaagagaatatactaggaagcggaagcaccaggaggctttgaccagtgaaggcaagatgttgcaaagagcaaacaagaagttggaagagggcatcaaggctaattaa

SEQ ID NO: 14932 - DNA, 1224 bp, Glycine max
  Peptide Sequence Number=SeqID_131710
cctaatgctctttcttcagctctggcgaaggatttcctttccaactttgcagatgccaatggcgaagccaaatacatgaacatcctgcaagatgttgcaaaccacaaaactcgagcagtccagatcgaccttgaggatttatttaattacaaagatctggacgaggaatttctgagccgtgttactgataacactcggaggtatattgggattttttccaatgcaattgatgaactcatgccggagcccacggaggacttcacagatgatgatcatgacatattgatgactcagagatctgatgaaggagtagaaggcaccgacggttccgatccacgtcagaagatgcctcctgaaatcaagcgttactatgaactttatattaaagcatcttcaaaaggacgaccctctacaattagggaggttaaagcttcgaacattggtcagcttgtaagaatttctggtattgtgatacgttgttcagatgttaaaccattgatgaaagtggctgtatacacatgcgaggattgtggatttgaaatttaccaggccaaaattcaagaattagctgaacatgtccccaaaggccatattccaagaacaatgactgtgcatctaagaggagaactcacaagaaaggtggctcccggggatgtggttgaattttctgggatttttcttcctataccttacactggttttcgagcaatgcgtgcgggcttagttgctgacacttacttagaggccatgtctgtaatgcatttcaagaaaaaatatgaagaatatgagtttagaggagatgaggaagagcagattgcacgattagcagaggatggtgacatctacaataaattggcacgatcacttgctcctgaaatatttggacatgacgacattaaaaaagcactgcttcttctccttgttggtgctccccatcgtacgttgaaagatggaatgaagattagaggagatttacatatatgtttgatgggtgatcctggtgttgccaagagtcagctccttaaacacataatcaatgtagcacccagaggggtgtacactactggcagaggaagtagtggagttggtctaactgctgctgttcagaaagatccagtgacaaatgagatggttcttgaaggtggagcattggtaatggaatcctcctttcttaagtacaacaacaacaattccttccatccttattgtgcttatatatgttag

SEQ ID NO: 14933 - DNA, 432 bp, Glycine max
  Peptide Sequence Number=SeqID_131711
atggcctctggtaatcgattacaaaggggtaacaggtcactggtaatcgattaccagttatgtgtaatcgattacacagtgcatattgcaggtttccatgttttgaagatgtgtaactcgagtttggtctctgaggaaccagcatgcacgcttcagcgcactgtggagtggatattacatacacctactccatatcgactagtggagccagtccaagtgatagaggtgacgtcatctgaagaagaccctgaggaggacccagaggagctacctcctgagcctgctgtggatgctcttgactttccagagggtgatgaggacccactccctgaggtggattctcccgaggacgtcatgtcggcatctgaggcagactctacggaggagagcggtcctggagggatagcgactagtggaggttcttcatcatag

SEQ ID NO: 14934 - DNA, 1545 bp, Glycine max
  Peptide Sequence Number=SeqID_131712
atgccgccctgcacgaaccctcgtcactcgcacccctcttgcaaatcacacaaactctacgaggtagctacctatttcttcattgttgctttgctcgatttggtcaatgaaacctctgattctgttgagctgcaacaagataaactgcttggtggccttctagctgatggatttgatgaaaaatcttgtctcagcaggtatcactttcacaaagggctatcagaaaagccttcttcttacctcatttctaggttaagaaaatatgaagctcagcacaaacaatgtggaccttacactgattcctataacaaaacagttgaacaacttaggtctggtggtcaatttactgagtcctcagagtgtaaatatgttgtatggatttcgtttagtggcttagggaataggattttgaccctagcttctgcttttctctatgctctcctcactaaccgtgttctactggttgaccctggagcggatatggttgatctcttttgtgagccatttccagattcttcctggcttcttcctagtgactttcctcttaatgctcagtttaataatttcagtcagaattctgatcattgttatgggaaaatgctgaaaagtaaagcagttacagattccactgttgcatcttttgtctaccttcatatagcccatgattatgatgatcatgataagcttttcttctgcgatgaagaacaacgttttctccagatcgtgccatggttaataatgaaaacagataactactttgtcccttctgtattcttaatgccatcttttgagcaggaactgaatgatctcttcccaaataaggaaacagtgttccatttcttgagtaggtatctgttccaccctacaaacagtgtgtggggacttgtggtcagatactatcaagcttatttatctaaagctgatgaaagagtgggcatacaaattagagtgtttgacactgaacctggtccgtttcaacatgtattggatcagatcttagcttgtactttgaagaagaatattttgcctgatgttaaccaccagcaggatgctaccaattcatcaggaattcccaagtcaaaagcggtactgatgacatccttaaactctggttattttgaaaaggtgagagacatgtattgggaatatcctacggtgacgggagaagtggttggcgtttaccagccgagccacgaaggatatcaacaaacacagaagcagatgcacaaccaaaaagcttgggcagaaatgtatctcttaagcttaactgatgtgttggttactagctcatggtctacttttgggtatgtggctcaggggcttggaggtttaaaaccgtggattctgtacaaacctgagaatcgaacagccccagatcctccctgtcgacgtgccatgtcaatggagccgtgtttccatgctcctcccttctatgactgcaaggccaagagaggaactgacacaggtgaacttgttccatatgtaaggcactgtgaagatatgagctggggccttaagcttgtggacagtgatagttatcgctag

SEQ ID NO: 14935 - DNA, 1263 bp, Glycine max
  Peptide Sequence Number=SeqID_131713
atggacaagttaatagagttgttgaagcagactgaaagcttggttcaagatctacaacaggaacttgaaatgaaagattcaatgagagtgaaggagttacataatgaaaattatgattcacagggtacttgtgatcattccttctgtgataaggagctaaatggattttcacctgaaaagcacacagataactctccaataactgactacaaaaaatcatatgatcaaaaggaagaagaaagatcagaatctatgagcaaaattgaagctgagcttgaagctgaacttgagagattgggattaaacatgaacgaatctagcccagaaagaccgctgtctgagcttgttgagctaattcttgaggtggggattgcccaaccttttataagctctactttggctatatctgtagttaatgtgaaatctcaaccgcaagaaatgcagtgcttaacatgggactatggtgtgctaatgtcgcgaaaattcttgcagcttgaccctgactttgtagcagattttgctcaaggtgagttgcaaactgatgtgatccctgggaaagattttgtccattcagaactaaatgaggatgacagtgacactgtggttcctgtaaattatgctgtttcgcctcatgaactaacactgtgcttgcatgaagttatccaatcaagacttgagggacgtgtacaggagcttgagattgcccttgaaaatagccaaaggaaattacggtttatggaatctgagcatgagagtcatccccaaaagtatttctcaagttgtggacaagcatcctccttgactaaagatgactgtgagcctattaccgaacccttagttatgagtttatttggtgactctcccggggcttacattgacacctcttatgaagaaataataaagatagatgacttcgaagaaaattcaccatctagcatccatatttctgattacaaagtagattcacattcacatgatttgcatgcattaggggttcaacattgtggagcaaatgatctcctaactcattccactgataaagaagagagactgtcaagggaactctcttctggtgaggtcacaatgttggaagggctaagctctagcaattatgaattaaatgatgttactggagatgaaaactgtgagtgtgattatgaggtggaaaggcaattaataagacaaattgttgaaaggaccaagaaaggttctcctgttttccaaaatgctagaaggatattgtatgctatggatgaagattaa

SEQ ID NO: 14936 - DNA, 171 bp, Glycine max
  Peptide Sequence Number=SeqID_131714
atgccttttagaggcttgaaaagtgcgagaaaacaaactgcattttctggaaaacgtgatgaactcgctaagcgagcattatgcgctaagggagttcatccatactcattgtatccgcgcgctaagccgagcttccctgagctaagcgcaattggttgcggcatccgttga

SEQ ID NO: 14937 - DNA, 414 bp, Glycine max
  Peptide Sequence Number=SeqID_131715
atgaagcacaaggtgtcaatcccaaattacagtacagagcagccaatcccaaaaattgctatagcaggtggcaggatggtcactattctaaccaattacaataaagaaattaaaggaacacagggacaaaatagagcaaggaagcaagggttacatttgactggaaacagtggcaggttttctagaaaattgtcacaaaggtcagggaagaccaagaaaaatggagaggcacagaatcagcagaggtcagggatggccaaaaagacaagaactgtaacagttggccagaaaaatgctggaaatgttgccagtaaagggtgggtgtttgtcagaaaggagaacaatgggtgccacttcataaaagagtgcctgcaactgacggagaaagaaggattttcggttctgattcaataa

SEQ ID NO: 14938 - DNA, 393 bp, Glycine max
  Peptide Sequence Number=SeqID_131716
atggctttctttggtagaattgggaatttattaagacagacagcaagcaggcaggttagttcagaattgcgatcatccccttcgttttttcaggctatacgcagtatgtcatctgctccaagcacaaagctgtttatcggaggtgtttcatattctactgacgagcaaagtttgagggaagctttttcaaaatatggtgaagttgttgatgctaggataattatggatcgtgaaactggtagatccagaggatttggctttattacatacacttcggttgaggaggcatcaagtgccattcaggccttggatggtcagttctcagttggggatgatgaagttgtgatggccatatcaggttatgcggacccatatttaaatcctttgttttaa

SEQ ID NO: 14939 - DNA, 1371 bp, Glycine max
  Peptide Sequence Number=SeqID_131717
atggcagaaacacaaacccagagaccctgttcaagcgtcctcgattctctgggggaagaaatcgtgagaatcatcgcacccgtttcaatatgcatgttcctggtcgtaatcctggtctcaactctcaacaccgattcttctctcttcgacgcatcgatgagcatggtcaccatcgcgtacaacgaaacaacctcggactccacctgggacaagttcctaggagcccttctgaactccttagccttcgtcatcctcgtcaccttcgcaaccttcgtcttggtcctcctcttctacttccgatgcaccaggttcttaaaactctacatggctttctccactttcatcgtgctgctattcctcggcggcgaagtctcgatcttcttgatccaaaagtttagtactcccattgattgcatcacgttcttccttgttctgtgtaatttcgctgttgtgggtgttttgactgtgtttatttcgaaaatggcgattcttgtgacgcaggggtatttggttgttgttgggatattggttgcttattcgtttactatgttgcctgagtggaccacgtgggccctgcttgttgctatggcgttgtatgatcttgctgcggttttgttgccaattggaccgttaaggcttttggtagagcttgcaatttcaagggatgaggaaattccggcattggtttatgaggctaggccagtgaaccatggtagtttggatcctatggaagtcacgcagaggcggttgtggagagaaaggagggttcagaatttgaatgctaattcagtgttggctcatggccccgacaatgttgaatcgcacgctgattcgggtgcaagcgctggctataaccgggatggcgcagacttggttagggaaaacgcttctttgaattcaattttgaatgctgatagttctggtggctccaatggttatggaaatttggtgagtgtggaagagggacgggtgcgagttcaagagactggttcggacctttctgcacccttgattgatcgtggaatgaatgtccagcttggtaggggagaagatgctgcgtcaattgaaaacttgatgctagagggaattggattgggttcttccggttcaatcaagttagggctgggagattttatcttctatagtgttttggttggcagggcggcaatgtatgattatatgacggtgtatgcatgttatcttgctatcattgcgggtcttggcataactttgatgcttttggctttttatcagaaagctttgcctgctcttcctgtgtcagtggcaatgggcgtgctgttttatttcttgaccaggcttttacttgaagtatttgtagtacaatgttccttaaatctcctgttgttctaa

SEQ ID NO: 14940 - DNA, 1719 bp, Glycine max
  Peptide Sequence Number=SeqID_131718
atggatgaggtgggaaggaaggagagtgagtatcaaattaagggaggaggagataatgaagacagcatgagcatgagcgtggcatgtggtgtgatcaacactgtagactggagaggcagaccctccaatcccaacgtgcatggtggaaccagagcttctgcttttgttcttgggcttcaagcatgtgaaataatggcaatagctgcagtgggaaacaatctcataacttatgtaatcaatgagatgcatttctctttgtccaaatctgccaacgtagtcactaactttgttggaactatctttctcctcgccctccttggtggatatctatcagactcttatcttgggagcttctggaccatcctcatctttggctttgtggaactctctggttttatattgctctcagtccaagctcatcttcctcaattgaagccaccaccttgcaatatgttctttgatggagaacactgcacagaagcaaagggcttcaaggcattgatattctttttagcaatatacttggtggcattagggagtggctgtgtcaagcctaacatgattgctcatggagctgaccaattcaatcaagagaaccccaagcaattaaagaagctctcaacttacttcaatgcagcatattttgcattctccgtgggagaacttgttgctctaacaattcttgtttgggttcaaactcattccggaatggatgcgggctttggggtttctgcagctgttatgacaatgggattgataagcttgatatgtggcactctatattataggaacaagcccccacaaggaagcatctttatccccgttgctcaagcttgtatcagagtacaacagggtacggggagtagcagtaacgacactaaggaaagcccgtggatattgtgcagtgtcgcgcaagttgagcaagcaaagatattgctatcagttattcccatatttgctagcaccattgttttcaacacaatattagcacaactgcaaacattctcggtccaacaagggagttccatggacactcacctcaccaaatcgtttcatgtccctcctgcgtcgcttcaatccattccttacattttgctcattgttgtggtccctctctatgatagtttctttgtcccttttgctagaaaaatcaccggccatgagtccggaatttcacctttgcagcgaataggctttgggctctttctagctacattttctatgatttcagctgcccttgtggagaaaaagagaagggatgcagctgtgaacctcaacgaaactatatccattttttggattaccccacaattcttaatttttggcttgtctgagatgtttacagctgttgggctcattgagttcttctacaaacagtccttgaaagggatgcagacattcttcactgccatcacatattgctcttactcattcggcttttatctgagctcactattggtttctatggtgaataacatcagttcctcttcttcaactggtggttggctccatgacaacgatctcaacaaagacaagcttgactttttctattggttactagctgccctaagcttcctcaacttcctcaactatctcttttggtccagatggtattcttacaagccatcccaatcccaaggcgatactaatgccaatgaaagcattaatctgtttggccacagctctaaaaactactctggagatgacaatattccgtag

SEQ ID NO: 14941 - DNA, 984 bp, Glycine max
  Peptide Sequence Number=SeqID_131719
atggaaaccggagttgataacaaaaaaacaggtgaacatgattttcaacaggcatctcaattaaaggaagaagaacaagaaagaacaaacaatagcaatttggatgaagctcatccttcatcaccatcacaatcccgaaaaccatctagtgcactggaatcatcacaaagcaaaccatctgcatctgagactatccccacaaatgttgaatcacaaacaccagcagaatctggtgaagatgatgttcccaatagttctatgccaaaacatgaacatggtgatgtggtagttagggcaaacaaccaaggagcagaaatacaaaaccctccagtgcaagtgatggagcgttcaggtgaatcaggagcctctcctcggtatgtttttccatcccatgtcttctcaaatagcaacgcaaactccacggtggaatggagcactgcctccactgaatcactgttcagcatctacatgggaaacatgagcttctcaaatgaattgatttgttttaaatccggagagttggataagcctggtgatgtatgcatgcatgatcagactaatgcttcaccaactcaccagccagatgcccaagcagaaaacaaattcaatgatatcagcaaaagaacttatgaactgcagttactacacgaaaaaagttcgaaggctgctgaagcaaaagctgctgagacaatgagagaggttataatggaaagtagtcaaaccacagagaatgttggtaaaggggatgataaggcttccaatttccatcgccagtcaaatggcagcgccagttcctacgcgtttcaatcgtcgaaaggtcgagatagaagtgtttcatccaagggtgctggagagaagcaaaatcaacagaagcagccagatgaagatgaagcaccaagtgcagctgatcaggccccgaaatcatccacaaatgcacctaataaatggctgaattgcttttcgtgctgtatttgctgtaattag

SEQ ID NO: 14942 - DNA, 210 bp, Glycine max
  Peptide Sequence Number=SeqID_131720
atgtccatgtacaatgctacatgcattcatctcactgacagtatgcaccattcgcaggataatagacctactacatccaatcccttacccccggaatctgaatcacacacttggaatgtagctcaacaaatacccaatttcggaactgaacgtgtagcttttgtcaggcgttatccaagtcttggcttatggagctatgttgcagactaa

SEQ ID NO: 14943 - DNA, 1300 bp, Glycine max
  Peptide Sequence Number=SeqID_131721
aactagccggtctgagtttattgtgagtgtcaacaaataccttgaagctcgaagtcataaactttctgttgggatgagattcaaaatgagatttgagggtgatgaagttcctgaaagaaggttcagtggaacgattgtgggtgttggagataacaaatcgtcagtctgggctgattctgagtggcgatcattaaaggttcaatgggatgaaccatcgtctattttgcgtcctgatagagtttctccatgggaattggagccacttgtgtctacccctcctacaaacccccagccatcccaaagaaacaagagatcgcggcctcccattctaccttcaacaatgcctgattcttctctgcaaggtggctcggacatacataatttctccataaaattctgttattcatgctgcttttactcaaattttctttttctctgtgcatcaggtgtatggaaatcaccagttgaatctgcaccattctcttattgtgaccatcaacatgggcgagatgtctatccatcaaccaatttcaattccactgcaactggttttcttggttttggtgggaactgctatgcttccaacaagtcaatatattggtccagtaggatggaaaactccacagaatctttttctcctgtagcacttaaagaatttggagagaagagacaagggactgcaaatggctgtagactctttaggattcagttacatgacaattctaattctaatgaagaaagtctaccaatggtcactttgtcaggaaggatgggtgatgatggcccccttccatctttggatgctgagtctgaccagcattctgaaccatcaaatgttaatcgatctgatatcccttcggtaagctgtgatgctgaaaaatcatgcctgcggtctccccaggagtcacagagcaggcaaataagaagttgcacaaaggtccacatgcaaggtatggctgttggaagggctgtggatttaacacggtttgatggatatgaggatctgctaaggaaattggaagagatgtttgacatcactggtgagctctgcggatcgacaaaaaaatggcaggttgtgtacactgataatgaagatgatatgatgatggttggggatgatccatggcttgaattttgtagcattgtgaggaaaattttcatctacactgcagaggaggtgaggaagctttcacccaaaataggacttccaatcagtgaagaagttaaacccagcaaaatggactctgaagcagtagccaatcctgaggatcagtcatctattgtggggcctggttgctaa

SEQ ID NO: 14944 - DNA, 423 bp, Glycine max
  Peptide Sequence Number=SeqID_131722
atggaacagcatgcaattttatccactgtttttgtaatcctggtggagactattgctctatttggttattctgatgattatgagacttcaagggagcaaggaaatttgagattgtcagaaacggattctaacagcatgatggaggatagggcagtgtttgtgattggtgttgtaaataaaggtaacactctagaaggtcaagatctagggagatggatcgaaaaacaggaaaatagggaaacgcactgtgaatacactatgaatagctcatttgacagaaacagggatgacaatagcagaagccatgaagaaggttctgatgtggattgggataggatgacagagaatgaagaaactcaagaaagtggaacagagataatagggatagaggagacaaagatatcagagtggcgatgcttctga

SEQ ID NO: 14945 - DNA, 1752 bp, Glycine max
  Peptide Sequence Number=SeqID_131723
atggccgccaaaacggtaacccccgacgccgtttcgacgctcctcgcaaacccttcccccgattccacatcggatctccccgacatcgtcgttcaagtcctcgatcttaaggcgacaggcaataaatacatgtttactgctaatgatggaaaaacgaaactgaaagctatgattccttcggatatgcgctctcaggtgctctccggggctattcaaaacctaggtcttattcgcgtccttgattacactgtcaacgatatccccaataaatcggacaaataccttcttgccattaaatgtgaagctgtatctcccgcgcttgaaatggagataaagagtgaggaatctggatctgggattcttttgaagcccaaagtagagggtggagtcaagactgaaggtgctgctgctgggattcttctcaagcccaagcaagaagtggtgacaaaatctgctaaccagattctacgcgaacagcatggaaattcggctcctgctgcacgcatggcaatgacgcgtagagtgcgtcctcttgtttcgttgaacccttatcagggtaattggacaataaaggttagcgttacgagcaaagggaacatgcgtacctataagaatgctaggggtgatggttgcgtcttcaatgttgaattgacggatgaagatgggaactttgaagttgctaacaagcagttcaaaactgtgcaaaatgattatgaaatgacgctaaatgagaattccgaggtggaagaggtggtcggtgaagcaagttttgttccggaaacaaaattcaactttgtgcagattgatcaactgggtcctcatgtcaataagtctgagcttgtggatgttattggagttgttaagaatgtgtcttcaacaatgagcattcgtaggaagagtgacaatgagagtattccaaagcgtgacattactattgctgatgacacgaagaagacagtagttgtgtccttgtggaatgaacttgcaactaccacaggagaagagctactggacattgttgataaatctccagttgttgcaattaaatctctcaaggttggggacttccaaggcagaagtgtggttctggtaaatccagacatacccgaagcaaaaaatctcagaagctggtatgattttgaaggcaaggatgctgcaatggactctgtaggctctggttcaagtccaatatctaacaatgggattagatcagtgtacactgatcgtattcatctttctgacataatctcaaacccatcattgggagatggaaagcctgcttttttcagtcttagaggacatataaccttcataaagcctgatcaggcaatgtggtatcgtgcctgtaagacatgcaataagaaagttactgaaagctttggttctggatattggtgtgatggatgtcagaaaagtgatgaacagtgtagtttaaggtatattatggttggcaaggtttctgatggaagcgctgagacttttatctctgtcttcaatcaggaagctgagaagatcgttggatgctctgctgatgatctagataatcttaaattacaagaaggagaagataatccttatcagatgacattgaaggaagctacttgggctcaacatcttttccgggttagtgttactccgaacgagtataatggcgagaagcggcaaaggataacagttcgagcagttgttcctgttgacttcgctgctgagtcaaggtttatactggaagaattatcgaagatgagagcataa

SEQ ID NO: 14946 - DNA, 1434 bp, Glycine max
  Peptide Sequence Number=SeqID_131724
atggtacgccaattttcacctactggtatttctaaggcaagggatctgtttgagagtgcccttactgcagctggtctgcatgttgctgaaggcagtaaaatatgggaagcatacaagaaatatgagcaggacatacttttaaccttcgatgatactgatgaacaggccaaagaaaagcaagttcaacgcattcgtagtttattccaccgccagttgtctgttccccttgctggtatgagttcaacaattactgcctataagacttgggagatggaacaaggaagtcttcaagatgttgaatccattgatttggttgatatttatcctcatgttgcggcttcataccagaaggccttggagatgtataatgctcgttttcatcttgaagaacagattttgagcccgaatatttcagattcagaaagattacaacactacatgaactatttgaaatttgagcagtcttctggaatgccagccagaattcaagttctatatgaacgagccattactgactttcctataacacctgatctctggctggattgtactcgcaatttggacaacactttgaaggttggtaatattgtcagcaatgtttattctagggcaactaagaactgcccttgggttggagaactttgggttcgatatatgctttcgttggagcgtggtcatgcttcggagaaagacttgtctgaaagggagaaagatggttttgcagactatgttcctaaagtctactgcttcagaatagatacagtaaaaaacagctttacagttgacgctaaatcaagctacaacacagtttcctttctttggaatagcttgtttggtcatttggtgttttggatgaacattgagtttgtccccacaatctttaattgtccctgtgtgttcatgttagaggtggtactactagagatgatctttgagaagtccctgctgtgtaccttttcaactcttgacgagtatcttgatttgtttcttacccgggtagatggcttaaggcgaagaatggcatccagcagtgaagaggatttggaatataaaataatacgggagacctttcagcgtgcatcggattatctgtcgccttacttgaagaatacagagggtttgctacatttacatgcttattgggctcgtttagaaacaaaacttgggaaagatataactgcagctcgtggagtttgggagaattgtcttaagctatgtggttcaatgttggagtcatggactggttatatagcaatggaagtggaattaggtcacataaatgaagcaaggtccatatacaagagatgctacagtaaaagattttctggaactggttcagagtgtagtgcggtcacacaggaaagaagacatgaagccatgaatggaatgggagagacgaacaagaaagagagacaaaagagaaacagggtctga

SEQ ID NO: 14947 - DNA, 663 bp, Glycine max
  Peptide Sequence Number=SeqID_131725
atggcttccgctgcgccaggtgcaaccaatgatgctttatacaaggaattgtggcatgcctgtgctggaccccttgtcactcttccgcgtgaaggggagagagtttattacttccctcaaggtcatatggaacagatgttgccacggttcaccttacaattttatctggaaaatatttgttctttcttgacttgccttgctttttggtgggagatgtctttgtttatgcttgaggcatccatgaatcagggattggagcagcaaatgccttcctttaatctgccttctaaaattttatgtaaagtggtcaatgttcatcttcgagctgaacctgaaacagatgaagtatatgcacaaataactttgcttcctgaagcagatcaaagtgaggtgacaagccctgatgatcccctgcctgaatctccaaggtgtacagtccattcattttgcaagacactcactgcttctgacactagcactcatggaggtttctctgttcttcgaagacatgcagatgattgtttgccaccactggatatgactcagcagcccccatggcaagaattagttgcaactgatctgcatgggaatgaatggcattttagacatatttttcgagagtgtgatcattggatatttctacagattgaatatgccaagtaa

SEQ ID NO: 14948 - DNA, 465 bp, Glycine max
  Peptide Sequence Number=SeqID_131726
atgaccgtttcaagcttagaaagaaaacattacaaaggagctggttccaacttccagacaccacccaagaaggaaaatgattccatgctttcatcagtagcaattcaggaaatgacaccgtggccctctgatactatgatagagaggccagccaaaaagcctaagcatgttaattcctatcaggaaagtgaggcaacggacattgtgagacaaatgccttgtgtgattacaactggaggtggcacaactgggaagagaacagaagggcttttgtacaagtataagagaggccaagtttgtattgtatgtgtctgccatggcagcttcctctccccaacggaattcgtgatgcatgctggtggtaaggaagtggcagatcccatgaaacacatcactgtttgttctgatttagtttatatcaatggagatggggctggtttatcaccagggccgtggaaaccataa

SEQ ID NO: 14949 - DNA, 531 bp, Glycine max
  Peptide Sequence Number=SeqID_131727
atggcttccttacccagttttactccttttgtatttctattgcttgtcattggatgcaatgcaaggcctttgtatccacttcccagcaaaggtgatgatggaaataggaagcccctacaaacttttcgcccttataacattgctcatcgcggttcaaacggagagcttcctgaggaaactcatcctgcatacttgagagctattgaggagggtgcagacttcattgaaactgatatcttatcatccaaagatggtgttcttgtatgtttccatgatgttacccttgataatactactgacattgcaaatcgcacagagtttgctaatcgtaaaagaacatatgaagtccaaggggaaaacatgactggcttttttactgttgatttcacattaaaggaattaaagtcattgagggtgaaacagaggtgtagcttcagggaccaacagtttaatgattttgataagaatgacataaatactgaaaataagatggaactgaaggaggaaatctcctctacaaggaaaaattag

SEQ ID NO: 14950 - DNA, 895 bp, Glycine max
  Peptide Sequence Number=SeqID_131728
atggaagagcgattggggaacgtggaagcgacggtggcagagatccgtcaactgctgctggaacagaacgagagacctcgccggagacagggaagacctctaggtcggggagatccacgtaacaatgacgacgacgggagtgatagtagcacgttatcacatggatcacgtttccgaccacgacggcacggtggtggtaacgaacggaggtattttggcgggagaaggaagttggagatccctgtttttaagggtgatgatgcttacgggtggttagttcgtgttgaacggtacttcaggctgaatgaagtacgtgaacatgataaggtggatgcagtgatgattgcgatggaggacagagcgttgaattggttccaatggtgggaggatcaaacaccattgaggagttgggaagagtttaaggaggcagtgattcgaaggtttcaaccgggaatactccacaatcccttaggacctttattgagtctgaaacaagatagcaccgtcatggagtatagagaaaaatttgagatgttggtagccccattgagaagggaggagaggggaatgcttgatagcattttcctcaatggattgaaggaggagttgcaggcagaaatgaagttgtatgactatcatgatcttgctgacatgatggatcgtgcattgttactagaagaaaaaaatgaagctctgaggaggaggggaattactgggagagatagaacagaatggaaggataaaggtggagggtccaagtttcgaaatcctggtgattttggtaaggacagaagggaaatacttaaagtaagtggagtaagtgagaaggtggaaggaaaaggggtggaaggtgtgagaggtaggagactgaatcctgcagagttagaggagagaa

SEQ ID NO: 14951 - DNA, 1444 bp, Glycine max
  Peptide Sequence Number=SeqID_131729
atggcaatgccggaaacaatccctcccactactcccagtgctcaagttgtcggcaacgcctttgtggagcaatattatcacattctgcaccaatccccagaattggtgcacagattttatcaggattcaagtttcttaaccagatcagacagcaatggtgtgatgacaactgtgacaactgtacaagaaatccatgaaaagattatttccctgaaatatgaagattatacagcagaaataaaaactgcagatgctcaggagtcacataagggaggtgtgatagttttagtaactggatgcttaactgggaaggataatgtgagaaggaagttctcacagacattctttctggctccacaagaaaaaggatattatgtcttaaatgacgtctttaggttcattgaggagaatgacacacctcagttaaattcttccacagtaagtgtcatcaatgaaaatgctgaggcagtgcacgagccagaatcagaggatctgcatgctctcaaacatcttgtggaagacactgcaactttggcagagggtgagaaccttaataatggtgctgaagtttatcatcctcaggatgaggaagaaggatcagttattgatgaagaggttgctgaaccccctactgatttaagtcagaatgatattgttactgttgatgattcaacttctgctgtcccggatgatgcaccaaggagatcatatgcagccattgtaatgaaaagtcatgtagcatctggtcatgtctatgttcccagccgagctgcaagaatagcatatgctaaatccagtgaacaattgcctactactgccaatgccaaatcaactcctgcgcctgaggcattagctcctagtagtgataatgcatctgggagcagtgatgttcatgaagaagctgaaggtcactccatatacatacggaacttgccatttaatgcaacagttgaacaacttgaagaagtctttaagaaattcggtcctattaagcatggtggtatccaagttagaagtagcaagcacggattctgttttggctttgttgaatttgaagaattgagttccatgcacagtgcacttgagtggtacagattagcattagcttgtagcaatgttgcctgtaattcccaaggttcagcttctgattggagcagttctggggctggaatgttcaggaatagagcttcacctatcactgttggtgagcgacaagctgttgttgaggaaaagagaactactacacgagtcagcggtagtgggagagggaggtactcaggaagaggtggtttccgaagcgacagtttcagagcgcgtgggaaatttggcagtggacgtggttatagcagaaatgaattcagaaaccaaggagaattctcagggcaacctaggagttctcaacggccaaatcaaaatggaggtgggcgtggtggtggacgtcaag

SEQ ID NO: 14952 - DNA, 450 bp, Glycine max
  Peptide Sequence Number=SeqID_131730
atgttcacagaagcaataactgtaaatggaccagaacagttgggaaatattcaagtacctaaaagagccagttatatccgagtaataatgttggagttaagtcgtatagcttctcacctactatggctaggaccttttatggcagatattggtgcacaaacccccttcttctatattttcagagaaagagaattaatatatgatctatttgaagctgcgacgggacccatgcttcgggcttccggaatacaatgggatctccgtaaagtggataattatgaatgttacgaagaatttgattgggaagttcaatggcgaaaagaaggagattccttagctcgttatttagttcgaattggtgaaatgatggaatccataaaaattattccacaggctttggaaggaattcccggcggaccatatgaaaaatttagaaattcgctgctttga

SEQ ID NO: 14953 - DNA, 237 bp, Glycine max
  Peptide Sequence Number=SeqID_131731
atggcaccagtgttttctaagaagtcttggcaatgtgtatggcatttgatccagaatgacttaatccatgcatggggcctggataggcagcttggctattgtgcacaggttcaggcgccatcagactccccaggagataatagagctaaagtttttggtaaaaggtggaaagatgcagcagagaaagacaaatgttggattgatccgtatgaacaggcaaacaagacaagccattag

SEQ ID NO: 14954 - DNA, 648 bp, Glycine max
  Peptide Sequence Number=SeqID_131732
atgatggtaagtgtaagctgccggatggtatttgtacatttgagcattggaagtgaggcagtgcctgaaggaattattgctagaatatctaacttggaaatgcagcccttatgggactctggtaaagataatggaataaggggagttcgtttgagtcagttgagggttgcgagaaggaagttggccttggaagggagagctcttgaatacctgggagttagaacatcatgtcatttgggatctctgagtattttaaagcgcccattgaacttgttggctatgacagtaggacttaagcagaaagaaattgtcgacaaaattgttgaaaagagttcagcttggagtagttgtgtcgtacttgtatctgctatcaatcaaacaaaatggtggtttgtgaaacggtttttgcatccagacatagttgctgaatacatttacgtatttctttgggatgaggacctccttgttcttgttgataatattgacaccaaaaggacaggcagcttggctattgtgcacaggtccaggtgcaatcagactccccaggagataatagagctaaagttttcggtaaaaggtggaaagatgcagcagggagacaaatgttggattgattcacatgaacaggcaaacaagacgagtcattag

SEQ ID NO: 14955 - DNA, 2370 bp, Glycine max
  Peptide Sequence Number=SeqID_131733
atgatgctgaaatgtgacgatgaaagtgttggaaatggaaacacaacgcaatcttcactcttgggtttagcggagcaagatgtcagtttaccggctgcttctccggcgcgtggccgtagcccgccccatgttctctctgacccaaacccgttcctacgccttctcatccgccgaagaagccgcggccgagcggcggcgacggaagcggcgtctgcgcatcgagcctcccctgaacgcgattcgacctccgccgcagcagggccctccgcgcgacccgaacgcccctcgactcccggactcgacctcggcgttggtggggcctcggctgagcctccacaaccgcgtgcagtccctgatccgcgccggcgacctggaggcggcgtccgccatcgcccggcactcggtgttctcagtgacacggccgaccgttcgaacatcgtcccgaacatcgtgtcctacaacaacgtgatcaacacccactgcgaccagggccgagtggacgtggcccttgaggtgtatcggcacgtggtcgccaacgcccccttcagcccctcccccgtcacctatcgccatctcaccaaaggtttgatccattctgagcgcatttcggaagccctggacctcttgcgcgagatgctctctaagggccacggtgctgattccctcgtttacaacaatctcatttctggctttctccatttggacaatttcgacaaggccatcgaactcttcgacgagctcaaggagcgttgcctcgtctatgatggcgttgtcaatgccacttttatggaatggttcttcagcaagggcagggacaaggatgccatggactcctacaggtccttgttggaccgccagtttcggatgacccctgccacctgcaatgtcctgttggaggccttgcttaaccattccaagacctctgaggcttggtctctttttgataacatgttggacaatcacacccctcccaatttccaggctgttaactctgactcctttaatattatggtcaatcactgcttcaagcttggaaactttgagcttgccctttctacttttaagaaggttggatccaagcctaactctaagccctttgccatggatgttgccggctacaacaatatcattgctaggttttgtgagaatgcgatgctgtcccaagccgagaccttgttcgaagaactctgctctaaatctttgagccccgatgtgcccactcataggaccttgattgaagtctacttgagaatggacaggatcgatgatgctctcaggattttccacagaatggttgattctggtctcagggtggttgctacctttggtaacaccgtgtttcatgaattgattaagaatggtaaagccattgactgtgctcaaattttgagtaaaatgggagaaaaggatcccaaacctgaccccacttgctatgaggttgtaatcaagggactctgtgctgatggcttgttggacaaaagccgagagctgctggatgaggttatgaggtatggtgttggggtcacttcttccttgcgggaatttgtgactgaggttttcaagaaagccgggaggggtgacgagattgagaggctgctagatatgaacagatttgcatacactcctcgtccatccccaccaagacctgcttactgtccaccgctggtcaggtccccctcgcaaatggcagcaggggcagcacatagcccaccttctgggtttccaacacgaatggcagcacagcagcatccaacacctcctcctcaaatgacaggagcacgttatccaccttctcaaatggctggagcagcacataatccaccttctggtgctccacatcaagtgtttgagcatcaacgcccgccactgccttctcaaatgacaggaatgcatcaaccttcatggggattatctcctccaatgactggacctcatcctggatcgtcacctaatacaggacagccttaccaccctaatgcatctgaacatcatcctcacgtgagcagggtagccccgcaaatgacagcgcagcattatacaccatctggaccttcacctcaaatggcaggacatcagccttatggaacaccacgtgggccccaacaatgggcagaacgacagtatccgccatcagggttgtctcctccaatggcaggacaacatcatccactagctggaccaactcctccaatgtcaggatggtctattccttcgaatggagcatcagctaaaatgtcaccgccatatcatatatctgcaggaccatcttctcaggtgactggaccatatcacccatcatcatcaacccctcctcactttgaggaatctcatcaacagcaatcagaagtccctgaacaggtagcagcttaa

SEQ ID NO: 14956 - DNA, 237 bp, Glycine max
  Peptide Sequence Number=SeqID_131734
atggccaccgtcaagaagggaaagcctgatctccgtaaggtgttgcctgttgtcatcgtccttcagcacaggccatggcacagaaaggatggcgttttacatgcatttcgaagattatgttgggtcacagtgaatcccaagggtgaaatgaaaggatctactatcactggtccaattgggaaggagtgtgctaatctctggccgaggattgcaagagttgccaatgctattgtttag

SEQ ID NO: 14957 - DNA, 408 bp, Glycine max
  Peptide Sequence Number=SeqID_131735
atggattcaaattttgagatgtcacaggatgctggttggccaagagtgaagataaaagaaaggggaagagagatcgtgaattcaaatcctcccattgatatttttaacaaaattaacaaattaacaggtagcttcaaactacattctcagttcagaattctgatagatatttatgtcctagttcttcaagctgatggaggaactggatctgcttgtataaatgctgcaactttggcccttgcggattctctaatagcacccctctgcttgatggattctaaactaccaattgacattttggaaaatgttatgcaactggcaattgaaggctgcaaagcaataacaaattatattcgagaaattttactggagaacacaaagcaacttgagcatcgacgaggtgtatag

SEQ ID NO: 14958 - DNA, 609 bp, Glycine max
  Peptide Sequence Number=SeqID_131736
atggttggtgtgctagttgttggtgtaggtgctattgtttacaaggctggggccctcacaggagctatagctggtgctctagcagctaaggctactaagagtggtcttctccggggagtttcattgggtgccattgccggctctatactctccgtggaggtgttggaagcttcccgcgcctattggtgtatggagcaaaccggctcacggggtgcatcatctatggcagatttcatagaggaacttgttcgtgggaggcttgttgaggaatcccttacacctgctattttaactgcttacaatttgcaggttggcattgctaatacaggctatgatgagattcatgatgttcatggcttagtggcacccagaggattgtcaggagattcattgaagaggttaccgcaccatatgatctcaaaggatatgaaggcagataatacttgctgtgcaatatgtttgcaggatattgaagtaggcgaaattgcacgaagcttacctcgctgtcaccatacatttcacttgatatgtgtggacaaatggcttgtcaagaatgattcgtgtcctgtttgcagacagaatgtgcaacttgttccttgggcaatttga

SEQ ID NO: 14959 - DNA, 1644 bp, Glycine max
  Peptide Sequence Number=SeqID_131737
atgggtgaagagcgatccgagatagtgttcttcgatgtggagaccagcgttccgacccgggcggggcagggttttgcgcttctggaattcggcgccattttggtttgccccaggacgctcacggagctccgcgattactccactctcgtccgcccagccaacctctccgtcatcacccccttgtccgagcgctgcaacggcatcaacgccgccgctgtctccgccgcccctaccttcgccgacattgctcacctcgtttacgacctcctccacgggaggatttgggcggggcataacatcataagattcgactgtgttcggattagagatgcgtttgctgagattaatcagccaccgcctgaacctaaggggaccattgactcgctggttttgttgactcaaaagtttggtagaagagctggtgacatgaagatggctactcttgctacttattttgggcttggacgccagacacataggagcttggatgatgttcggatgaatcttgaagtcctcaaatactgtgcaacagttctattcttggagtcaagtctcccagatatattcactgcaaatagttgggtttcaccaaatgctactacaagaagccgcagtaatgggaaatctccatcacagtggggcttattaaatattaataaagattctgtattatcatctcctgcaactgaatccaaagacaaaaatcgtccaataatttcttttgcattgagcagcccaaaagggaatgtctcgaatattgcagatcctaacatggatcaatcagatccttttaacttgagcactcttgaggctgaaataaaaagagaatccattaagtcagatgtcgccttggaggaaaaacccatgcaagagtcaactgatttggcttcctcatcttctgtatctcagccttgcagcagctctattgctgttttggaacctgatggaatatgtataccttctattgatgcatctcttgttccatcttttcgtggcagtcaaagaatagagttactgcatgaaggtttcctgtttcagcttcattgtactgatttgaaagtgcggtttggaataaactcaaagttttttgatagtgctggccggccacgattgagttttgtggttgatccatcaccaagtctatgtaatgttcttgatgcatgtgaccgtgtagcacagaagttaaccgtggattctggtagcagctctgattggaggcctgttgttattaggaaagaaggcttcttcaactatcctactgtcagattacaggtgaaccttggtgcagtggtaaggtcactgccttttgacctagtgtcatgggttcaaatcttggaaacaacttctttgcttgcaggggaaagactgtgtacatcaacttcccctagatcccacttggtagtagtgggcatacctactgcagtagtggcagacattgctatttatgccacggaaatatatcaaagagaatcatctggaacagtgcaaagacttctcttcagtaagtttgatgctgcagaacttggttccttgttcatgcctgggacatttgttgatgccgtcttctccttagatccgtatgattatcagcagaatgcagggattaaattagttgccaaaaaattgatcattcatagcaaatag

SEQ ID NO: 14960 - DNA, 1728 bp, Glycine max
  Peptide Sequence Number=SeqID_131738
atggatgctgaaactgagactgaggaacttataaatttgaacgataaatcaagtaactttggtgggaataatagtaagagtggcgatggattcattgacagaagcaaagtgaggattttgttgtgtgataacgattccaagagttctgaagaggtttttgctcttcttttgggatgctcttaccaggttacttcagtaaggtcagctaggcaagtaattgatgcactgaatgcggaggggcaatatatagatatcatactagctgaagttgaccttccaataaagaaaggcatgaagttgttgaagtacatagcaagggataaagaattgtgtcgaatccctgttataatgatgtctgcacaagatgaggtttccattgttgtaaagtgcttgaggcttggagcagcagattacctagtaaagcctttacgcacaaatgaactactaaatttgtggacacacatgtggagaaggaggcgcatgcttggacttgtagagaacaacatcttgacttatgactttgatctggtagcatcagatccaagtgatgccaatacaaacagtaccaccttgttctctgatgacacagatgacaagtccaaaagaagcactaatccagagacaggagtatcaatccaacaggaacaagaggctagtattgccaccattgctgctgtggtggtggagcttcccaatgctcttctatcagaatatcagcctgatgtgcctggaataagtgatcgtcgaacagttgcagctactccaaggcagcatccatcaagcagcagaactaatgatggacattttttatctggtccaaagaagagtgaactgaagattggagagtcatcagcctttttcacctatgtcaaagcaacaacacttaagagaaacgttgaagagagtgctcatgttgacaatactactactacagaagtcagggtggaagatatgaatcaagcatgtactgaacaggggggtaatgaccttaaaacacatgaaaatgaagaaatgtttgaaaaccattcacaagatgacttacccagcagcaatagtatccccgattctttctctattgagagatcttgtactccacctgcatcgacggaagtttcacagcaaaagcattacaaggaagaacattctcagggagtggtgcatccaagaaatggtagtcatggttctgggcctgctcaacatgcttatccatattatatttcaggagttgttaatcacgttatgatgccatcatcagcacaactgtatcaaaagaatatccaggacctgcagagtcatgctggttcttccatgattgcacagtacaatcatcttccccaatgtcctcctcatgcaaatgggatgacatccttcccatattatccgatgagcatttgcttacaacctggtcagatttctactaattcttggccatcattaggaagttcaagttcatgtgaagtaaaaataagtaaagttgataggagagaagcagcattggtgaagtttagacagaaaaggaaagagcgctgctttgataagaaaattaggtatgtcaacagaaaacggctcgcagaaaggcggcctcgtgtgaggggacagtttgtcagaaagttgaatggtattaatgtggatcttaatgggcaacctgcttccactgattatgatgaagatgatgaagaagaggaagacaatcatggagcaagagattcctctcctgaggatgcttga

SEQ ID NO: 14961 - DNA, 357 bp, Glycine max
  Peptide Sequence Number=SeqID_131739
atggtgcacaaaacgactttggataaagagcgaaatccccaaggtccctggattcttccagtttccatggtgcccaacccaaattgggagaatctggtggaagttgcgggtaagatccacggagctaaagttgtcggtgatgcgactggtgatttgaaggagcgtggtgatgagtttgctggggggaggggggataggcgttgggatgacaagaatggagagggaggagcggttcgagagattcatggcgaggagcgtggtggagatgatgatggaggtgaattgggagagctcagacatggtggagaggaagccgatgaggttgttaatgtttggagaggggggtttagagaatga

SEQ ID NO: 14962 - DNA, 741 bp, Glycine max
  Peptide Sequence Number=SeqID_131740
atggataaggttgccttgagagggctacacgtcctctccttcaaagggcttcacgccctcgccttcaaaggactacacgtcctcaccatcagaggactacacgttcccactttcagaggactacacatcctcaacttcaaaggactacacatccacgacttcacagggctacacgtcgtcaccttcagagggctgcaggccctcaccttcaaaggactgcacgtcctcacctttagaggactacacgtcgtcaccttcagaggactacacgttcccactttcagaggactacacatcctaaacttcaaaggagggatacacgccctcgcctttagaggactacacatcctcggcataaaagggtcgcgtaccctaaccttcagagggatgcacgcagtcgccgtcagacgactacacgtcctcgtctttagagggctgctcgccctccccttcaaaggactacacatcctcgccatcagagggctacacgccctcaccttaagaggactacacgtcgtcgccatcagagggtcgcgtaccctcaccttcagaggcctacacgttctcgccttcagaggactacatgtcctcgccttcagaggactacacgtcctcgccttcaaagggccacatgtcgttgccttcagaggactacatgcctcaccattagaggactacacgacttcacctttagagggctacacgtcctcgccatcagagggctacacgccctcaccttga

SEQ ID NO: 14963 - DNA, 747 bp, Glycine max
  Peptide Sequence Number=SeqID_131741
atggcatgtagggggtgctgggagtgccttttgaagctgtttaacttcatactgaccctcactggtctggccattgtgggctacggaatctatctttttgttgaattctctaaagcttcggatgatgacaacacgcctgcaatttctcccgtcagtgatgattctgctctgattcaacttggccggcctgtgcttatggccgtgtctctatccaacgacttttttgataacttgccccgtgcctgtgagattaacaacatgaaacttttggaatggttggtcaatagaatgtggacttgtggttatgaaataattggagcttcagaagagcttggatgtgcagcctttatattctttgacaaaaactggaaagaagaaattccaacagacaaaactggagattttgatgcgatatatggatttctgattgagaattggaatatcgtgaaatgggttgctcttggaattgttatctttgaggcccttcttttcctgttagcccttattgttagggctgcaaataggccagcagattatgatagcgatgaggagttcattaatccaaggcagcaagtacgacagccattgctcaacagaccagcagcaagcccagcaacagggttaccggttgctggaacaatggaccagcgtccaagcagaaatgatgcatggagcacacggatgagggagaagccttgtcgttaccaaacattttccccttacaaacaccgctttttggctatctag

SEQ ID NO: 14964 - DNA, 501 bp, Glycine max
  Peptide Sequence Number=SeqID_131742
atggagctcatcatacttgcattcatcttcacttttttgttcatcttcataatggttgctctcctgcgttttgctattgttcattttcacatttctacttttcgactcccttttgtccatactgatattgagtggcctcaaccaacacctattgcagactctattgactatgttgccaactccaccaactccattgttgattccaccaacactgtagttgacgccttctccacaacatcttcaccgccaatgtttgaaccacgaattatagcggttggagaaagaatttcagcatgggagcaatgctcgaacaacccatatgaggactttcgacagtccatccaagagttgattgaggtctatcccgagctggcgaattctaacaacatgaacatgctttttttccaataccttgagtacaacccagagagcatgcacccttacattgttcgtgcttttactgatttcttttttgaccttactttacaaggtgtggtttaa

SEQ ID NO: 14965 - DNA, 249 bp, Glycine max
  Peptide Sequence Number=SeqID_131743
atggtgattgttgtggtggttagtttggttgttaacggagatacatcggagtatatggaatccaacaaacacgaagcatccattaaagccattaacgaagaacaacaaagcttatctcgatggcggaaacggcatggcggtggtggagagttcctcaaatctagcaacggaagcaccaaacaatggcggtgcgacacaaaccaaacaccagtgaaggaagaagacaacgcttcaaggaaggaagaataa

SEQ ID NO: 14966 - DNA, 291 bp, Glycine max
  Peptide Sequence Number=SeqID_131744
atgaaattgaaggaccagatgaaaaacacagtgttctatgaattgacctccttaccaaagatcattcaaaggtttaccaagaaccctagagggataacccttctccacaggattggaattggtctcataatccacatagtgattatggtgattgcgtctctaactgaaagaataataaaaagagatatattgggtttttatacgcacgttgaagaggaagctatgcaccagaggcgttcagctaggacgaagcagctacccaagcattgggatatctaccaattaggatag

SEQ ID NO: 14967 - DNA, 1534 bp, Glycine max
  Peptide Sequence Number=SeqID_131745
ttgggaggttcacctggtcctgtgtctccaaaaaatcatcagctgaagtctcctttgagttcacataggaaagcttccatctctttgaataggttgaggtcttcaattgctgagttgttacattctgacaagcctgtctctgtagattctaatccagaaggattcactgcaatgactaagttgcagatatggaaaaatgtcatttcacaagtactggagcagacagaaactgaaatttgttcacttgagaatgaactggagccactacaatttgaatctggggatggaatgccatgttacaatacaaaatcctgtgataaagaaattggagactatcataaggttactcatcgtccagaactgtcacaaattggcccttccaatgacgacaacaacatagagaagatgatgcctctttcagctaacttgcatggtatgcatgatactaccaaggaaaatgatatcaatagtcctgggacaacaacaccgaaatttgtagaagcgcaacctttgataaaaatggtttcttctcttggtggtggtagttcattttcatcattaatgggaattgaagatgggatgaaagatcacactagcacaagcttttattccagtattcacgatgatactttgcctaacactattatttcttccaatagagaaattgcacagagtgcatgtgtagtatttaagaaattcttgcataacaaaactggcaagattatcagtaatgttggagttaatagtagctcactctctcatattgatgcattcattaaagacaagttagcagagaaaaataggtttgcaagatttaaggagaaagctttaacaattaagtataaagcccttgatcatctatggaagagagatatgtgcttaagatatccaaggaaatgcacccgaacctctcctagaagtctcaaattgcgtctcaaagttgtcactaattgttgtcagaagaaactatcctctattcattatcattgttttcctttccaccctgttggattctacaaatttgccatgatgtgcatccctatcatccatgtggttgctggctatgcactaattcccttactagtcttggcaggagatcagttaagcttagttccaacatctgagatgataaattatacaagccaactgctttcaaaaccccaagatgaagttaacagaaaaatcttgaagatgccagcattaattttggatcaaaaggataaaatgttttcaatgttcaattctagtaatgagctggtagaagatccattggctgttgagagagaaagggctatgatcaactgttggacatcagaggagagaaagattttctcggagaaattttcagcctttggaaaagactttcgaagaattgcttctttcattgaccacaagacaactgctgactgtgttgaattctactacaaagatcataagcccaattgtttagagaaagataagaagaaaaagaacaagaagaagggttgtaacagtcagaagtcgaaaacattgaaaactatcgtgaaaggattgg

SEQ ID NO: 14968 - DNA, 861 bp, Glycine max
  Peptide Sequence Number=SeqID_131746
atgttgtgggatcaaaagggagtcttcaaggataagaagcagaagaggtatggatctcttgcgagacaaaaacactcatcatctcattatggttttctcaagtttaagaatctggattctactcgatttcaacatgttggtcccaaaacaccgggttgtggtggtggtggtagtggtgctatgcaccagtttccaaaggaacctggccaaggctcttgctctggctatggcataacctttcgatccccaagagaccccagacacaagttctgggaaattactaatgatgcctctctgctcttgtcttcaaagaggtccattgataatgtgctaagtactccctcacatgcatgttcaatgaacaatggggagaagccttactccagagcacaatgccatgataataagaagaagaactatgagagggagagttcttcctcgaagaggctcattgatgatatgctaagtactccctctcatgcatgttctataaacactaggcagaagcttaactctagtgaacaatgccatgataataataagaagaactatgagagggaggattctttgggatggaaaccacttaataaagggaacaatacttttgaaaggttctattctcaaagcaatagaaagggtagggacaagaacaagaatatattggaaacgggtgtgaaaaatgtgattgaagagacaaggaagaggccaaggctgaattggggtgaaggactcgctaagtttgagaaaaaggaaattgagggtgatggtgtaagtgttgctactgctgctactctagcttctggtgcattcaattccttcacaggtatcttgttagattctatcaactactctttattatga

SEQ ID NO: 14969 - DNA, 325 bp, Glycine max
  Peptide Sequence Number=SeqID_131747
tgagaatgttgagcttcaggtcaagcttttccaactacacgaaagtgcccaaccaggggtgtctttaagacatcatcggagatcaaccagaagagttgaacggagtgcactcgcggcatggaacatggtacgaatgacgaaggagagcagcgtggctgctagggcgcgggagagtatgtttctgaaacaaggttacgaaagtggaagggctacaacgacaggtttttcattaaacgtcgctagtgtctttatcttaattatgattatgccaccgcctaacttacaaagacggtcctttagcaccgatgtagaatcagcgatgtaa

SEQ ID NO: 14970 - DNA, 132 bp, Glycine max
  Peptide Sequence Number=SeqID_131748
atgcagaaattgattaaggaaaggattgaaaataaggtggttaatttcgtgggtcttaataaggttaagtggtggctggacagaaatatagaaatggcaataactcaagctacagggctccaaatgaggtga

SEQ ID NO: 14971 - DNA, 669 bp, Glycine max
  Peptide Sequence Number=SeqID_131749
atgtgggcgatacgttgtgtgtaaaaacgcaaactacggacaatgatgtttgtgagttgggaggttcacctggtcctgtgtctccaaaaaatcatcagctgaagtctcctttgagttcacataggaaagcttccatctctttgaataggttgaggtcttcaattgctgagttgttacattctgacaagcctgtctctgtagattctaatccagaaggattcactgcaatgactaagttgcatatatggaaaaatgtcatttcacaagtactggagcagacagaaactaaaatttgttcacttgagaatgaactggagccactacaatttgaatttggggatggaatgccatgttacaatacaaaatcctgtgataaagaaattggagactatcataaggttactcatcgtccagaactgtcacaaattggcccttccaatgacgacaacaacatagagaagatgatgcctctttcagctaacttgcatggtatgcatgatactaccaaggaaaatgatatcaatagtcctgggacaacaacaccgaaatttgtagaagcgcaacctttgataaaaatggtttcttctcttggtggtggtagttcattttcgtcattaatgggaattgaagatgggatgaaagctcacactagcataagcttttattcca

SEQ ID NO: 14972 - DNA, 861 bp, Glycine max
  Peptide Sequence Number=SeqID_131750
atgttgtgggatcaaaagggagtcttcaaggataagaagcagaagaggtatggatctcctgcgagacaaaaacactcatcatctcattatggttttctcaagtttaagaatctggaatctactcgatttcaacatgttggtcccaaaacaccgggtggtggtggtggtggtagtggtgctatgcaccagtttccaaaggaacctggccaaggctcttgctctggctatggcataacctttcgatccccaagagaccccagacacaagttctgggaaattactaacgatgcctctctgctcttgtcttcaaagaggtccattgataatgtgctaagtactccctcacatgcatgttcaatgaacaatggggagaagccttactctagagcacaatgccatgataataagaaggagaactatgagagggagagttcttcctcgaagaggctcattgatgatatgctaagtactccctctcatgcatgttctataaacactaggcagaagcttaactctagtgaacaatgccatgataataataataagaactatgagagggaggattctttgggatggaaaccacttaataaagggaacaatacttttgaaaggttctattctcaaagcaacagaaagggtagggacaagaacaagaatatattggaaacgggtgtgaaaaatgtgattgaagagacaaggaagaggccaaggctgaattggggtgaaggactcgctaagtttgacaaaaagaaaattgagggtgatggtgtaagtgttgctactgctgctactccagcttctggtgcattcaattccttcacaggtatcttgttagattctatcaactactctttattatga

SEQ ID NO: 14973 - DNA, 540 bp, Glycine max
  Peptide Sequence Number=SeqID_131751
atggcttctaggaaatgtaaaagtattggttcaagacccacagcgcagtatgacacaaggagattctcttccttagatgcttggaccagatacacagataatgtccaggggagaaacattttaccagagaggaaagtagagatatatcactctgagctagatgagtttaaggctgaattggagaggcgtaatttccataaacgcctcaccaatttagtcgatgggagcatagacctagctttggtgaaagaattctatgcaaatttatacagttatgaggaccatccaccaaagcagtccagagttagaggtcatttggtgaagattgatgctgacagtctcaacacattctgggagacacctgtggttgcctacagactacaaagagatagaggctgcctgatgcatacctggccgagggttcatcttgaactcagagggccattctgggaagattctcaggaaggatatgactacactagctcaggtgtggagtgtcctctcatactccaagttggcccccacatcacatacttctga

SEQ ID NO: 14974 - DNA, 2766 bp, Glycine max
  Peptide Sequence Number=SeqID_131752
gccataggactatccaaagaaaggaattccccaagacattttcagctgtcctcccaattcatcaatggaaaacaaactcctgttgatctaagggagtccctgcgagtccttgctaaacttagagaagcacctcggcattatgttgaagctaaagaacttccaagattatcatatgaagtaaaagatggacattggcattccatctcaaaggatgctcctcggttttcttatgatggaagagaaacaagtggtacaacttttgaatcacatgataccttcaaatgcccatcaaagctaaaagagcttcctagacattcactggacagtggggaaggttcttggcacgcacgtggctctgattcaaaacccagtaacttctcaagaaatttcaatacaggtggtgcctccacctcagttgacaacgtttctagtcaacaacaacggtcagcatcccagaaccggccacctagtgttgtagcaaaattaatgggcttggaagctttgccagaatcctataaggccagtgatactaagtcaagtttgagtgaaactggctcaactcaaggtaatgatcagtttttgaaaaatggactcatcaagccacttagagtttataattctcctaaaatctcattgaaagacacaacttccccacgatggaagaatcctgatttggctgtgaaaccaaccttaagttcaaggtttcccattgaactagcaccatggaagcagcaggatggaaaccaaacctctgagaaactaacttcccgggccataaaagccacagaaagatcaccagattcatttctctcagtttatagtgagattgagaagagattgaaggaccttgaatttaaacaatctggaagggatctcagagctctcaaacggatactggaagcaatgcaagtaaaggggctgttagagaccagaaaagaagaacaagcttcaaatgttggaaataaaagagactatgaactaaatccgagccttattcagaattctatgtcagtgaagcaacaaacagccaggggaactgactctgtaaaggctatagaaccaccaattgtgatcatgaaaccaggaaaacttattgagaaaagtggaatttctgcttcttcagtctttccaattggtgaaatctctgattcccataaacttcagagtggtggtgtacatgcacatgataagaaggggacagcttccaatcaaatagcaacggatcagtctcgtaaaaacaatcactgggatggttctaccagttttaatgaaaagaaagcaaacagtatcaagactataaaatcagcacaatcccaaccaaggtctaaacaacttccaaaagaaaatagcccaagttcggtgaagaattcaggatctgttagcccgagaatgcaacagaagaatttagagtcggagaagcaatctcgcctgcctaccccaccatcagattcaaataatcccagaaggcagtcctgcaagcagacaacagaatcaggttctcccagtcgaaaactaagacctaaagttgctaattcatggtatagtgatgaccgacttagtgagactagcaatgaattgagaagtctaagtagtcagtgggatgaaatatctttgcaatcagacagtatcactgttgactcaaagatggatattgaagtcaccagcagtttacaatctgatgatactattgatagccaattccgttctatgaaggctaacgagcatttggtttcaggatcaacgcataagaaatcaactctgaggtgggatgaggatgagtcaattgcagaacctgcaacagatgcctcagatcatccaagtcttgattcagttgatgatgtctcagtgtacaaatatgatatgccatccccagtaaagagtaaatccaatgctcctaaagctgataatggtcaagagtataaagcaaatgacaatacagatcattggaaccctgcagatggcttcttcgttaacaacacgatcaaccgcaagaaattccaaagcgtagattgccttattcaaaagcttaggcagctaaactcgagtcatgatgaaactagaatcgactacatagcttccctttgtgaaaatacgaatccagaccacagatacattgctgaaatactattagcttcaggtctattactgagagctttgagttctgagttgctgacatttcaacatcactcatcaggtcatcccattaaccctgagttattccttgtgttggagcagaccaagttaagtagtttgctttcgaaagatgaaagcagctttggaaaagttgcttacatgaggctaaatacagagaagtggcacaggaaactcatctttgatgctgtgaatgagattcttggtgaaaaactaggctcgtttgttgagccatgcttgaagcctaatggactcgcaacaaaattcgtcagtgcacaaaaacttcttaaagaactttgctttgaggtacaaaaacttcagtatgtgaagccagattgcagtttagaagatgaaggggatggactgaaaagtatgctaagggaagatgtgatgtgtcactcagaaaactggacaggtttccctggtgaattacctggggttgtgttggatgttgagagactgatatttaaggatttaattgatgagtttgtgattgatgaaatggctagtttgcgagtgaagttcagtaagcacagtactctcaaaagttcgttttggacacgtgttccatctttgagtttggcttctgtaaggccaccaacttccttgccatga

SEQ ID NO: 14975 - DNA, 1176 bp, Glycine max
  Peptide Sequence Number=SeqID_131753
atgatgattgaaagttcaggtaaagttcatgaagccaaaaatcaacaagagggtgatgatgataacaacattaaaattgagaagctcttgaaggcacgaccctccacctcctcatcatcaagatcatggtcagcattcagaaatccaagaattgtgagagtctcacgttccttgggaagcaaagataggcacagcaaggtttgcaccattaggggactgagggacagaaggattagactttctgttcccacagcaattcagttatacaatcttcaagacaagcttggattcaaccaacctagcaaggtggtagattggttgcttgaagccaccaaatctgatattgacaaactcccaccacttcaatttcctcactgttttgctcatcagtttcaccagcaaaccctactgccaggtacctctcagttttctcttggaggcttctatgatgctgctaataacaactccacttttattaaggatgggggaaatcaaaaccgcctcacggcaacaaagtcaacaaggtattgggatatagattcactaaataatggtaaggagttagctgaaagtgtgtcaatctcccaaaaaggacagttctggatcaaaacaaatgaacaagaaaaccatcaaggtggaggaattggtggtagtagtactactactcataatagagaggataattcttcagttcattataagctcttcccaattgggacaactactaataactcttatttacctggtttgttaaacaatggcatgacacataactcctaccaccattctgagccttcaaggctatctttgtcccactttggaagccatggattgtttccttcacatgattcccatcaaagcagtggcattggtgtgccattttcgtcttctaatttctctggagcatcatctggtccccaattgcttttttgtccaacttctgctacaccatctgctttttactcggtggaaagtgatccaagacaatccaacaacaatgttcagatctttagctcaagttcccaagtcatgaagcgtcttcctctcatccaatctcttcattcaaccaattcacctattagtcggcgccttccgacatcatttagctccaagcttcttgattcagataacaatgatcgtagccaaccaaataagggtactagttctcgttcttga

SEQ ID NO: 14976 - DNA, 990 bp, Glycine max
  Peptide Sequence Number=SeqID_131754
atggtttgcactgccaatgatttacaagaatggaaagatttcccaaagggacttagagttcttctgcttgaaggagatagtagttctgctgctgagataagagaacaacttgaggccgtggactataatgatggtttgtcaagtaagcctcagaatttctgtacagtttccactttctacgatgagaatgaagccttgtcagcactctcgagtagtcctgaaggcttccatgttgctatagtggaggtgagtacaagctgtagccttggaggtttcaaatttcttgagaattcaaaggacttgcctaccattatgacttcaaaggaccagtgcctgaacaccatgatgaagtgcattgcgcttggtgcagttgagtttctcagtaaaccactctctgaggacaagctcaaaaatatttggcagcatgttgttcacaaggcatttaatgctggggcaaatgtcctgtctgaatcactaaaacctgtcaaagaatctgtagaatccatgctgcagcttcaaacagaaaatggacaagataaaagtaggatttcaattgatttagaaaatgtgtcgaggtttagtgatattgaccatgagcagtctgctgtatgtgataaatatccggctccgtcaacccctcaattaaagcaggggacaaggttactggatgatggagattgccatgatcagactaattgctcaacagaaaaagaaagtgtggaacatgatggggaatgtaaatctgtcgaaactttgtgtgagaatttgaatgctgaaagttctcctcaaccaagggaacctgataagactctgattaaggaggaagaggattttgccaatggttccaggggtgagagtgctgtttcactgagtccaaataataaaaagtttctcagcaatgccgatggtaatacatctccaaatagaacgggcgtacttaatgattcatgtgagattaaagctaatcggaagaagatgaaagtaagctga

SEQ ID NO: 14977 - DNA, 774 bp, Glycine max
  Peptide Sequence Number=SeqID_131755
atgaaggagtttaagtgtccagatcagctggcagagcattacaagtcatatgcctgctgcattcgtcagtggatctcacaacatattctagttgttttgcccatttgtgccatgcttgttggatgcacagctttgttctggagtgtacgacagaaattatgcatgtcaagacgaattgaggagctttacaataaggtctgtgaaatacttgaagagaatgcattgacatcaaagagtgcaaatggtgaatgtgaaccctgggttgtttcttctaggttacgcgatcacctgcttttgccaagagagcggaagaaccctttattatggaaaaaggttgcttcaaaggcattggttttgattttccttttgcttaaccttccagtggaaaatagccattccattgttgaggatgtcaataaggattttcttatggcatatccttgtaactcaacagagttggtagaaaaaatggttcaagaagattctcggatagatcgctatcctaagttggtgaagggtgaatcaaaagttgtatgggaatggcaagttgaaggctccctgagcttctcaaagatgaaaagaagagatgcaagcaaaacgagggtcaacgaaagcacagacctgaatcatcaacaccgccctgcaatgagaacagcagcagagggcaatatgtgcggcattggttgtaagtgtgacctgcattttttcaccaaaacaagtgttagattcatgggacctgcatgcttattacggaatgtgcttatagagttatag

SEQ ID NO: 14978 - DNA, 270 bp, Glycine max
  Peptide Sequence Number=SeqID_131756
atggcagcaaagctcttgcattctttagcagatgacaacacagatttgcaaaagcagataggatgcatgactggggtttcccaactctttgatcgtcaccatattattcctcctcgccacgttacccagaagaggcttcctccaggtaattcccacttcaatcatgacaacatggaaagaggttctaatagcataccccaacgacaatcagcagcttttaaaatttcttggataatggaagttctgttaccagaccaaaatttgggttga

SEQ ID NO: 14979 - DNA, 150 bp, Glycine max
  Peptide Sequence Number=SeqID_131757
atggatgttacaggcgacaatgacgactctgatgggcgacaacagaggctattgcttttggaaaccaaggaaggggagtgtatttttctggttgatgcttgcatttacacccctgttgcagtgagacttgcgccgattgagaaatggtag

SEQ ID NO: 14980 - DNA, 477 bp, Glycine max
  Peptide Sequence Number=SeqID_131758
atgtctcatcctgattacgagtctttagttacaagtacttggaacaattcagggggagatgcagtgttcaaattggacgtttgggagctagtggctaaggcttttcattctggagttattcatgattacctcaccgagactcttattgttcctattcctaaggtggatgatcccaaaactttgagagactttagacccattagtctttgtaatgtcttactaaagcacatcttgaagattcttgttaggagaatgaggtcgtttttggatgatttcattggccctctgcaaggtagtttcattcctaatagaggcaccactgataatgatatgattgctcaagagcttgtccactttatgcacaaaaaggaagggaaggccgagtttctgatgttcaaagtttggcactcttatcctcctgctgtttctaccttcctgttagctgatgcaatgggaataaaacatatcaggatttaa

SEQ ID NO: 14981 - DNA, 222 bp, Glycine max
  Peptide Sequence Number=SeqID_131759
atgcaagagacatgggtggaaaagggttcaaaagaccccaaggcggaaatggtaggaaaggtcacgattgatcaattgcgtacaattgctgctgaaaagctaccggacttgaattgctcgagtatcgaatcagctatgagaattatagcgggcactgcggcaaacatggggattgtggttgatcctcctgttcttgaacccaaacagaaggaatttgtgtag

SEQ ID NO: 14982 - DNA, 422 bp, Glycine max
  Peptide Sequence Number=SeqID_131760
atggtggtgagcaaggttgtggattcaggcatcaggaaggaaggggatcttgagcctgtaaacgatgcgtcctttggaggagtcgtagcgggtgacctcgaccttgactctatcgccggggaggatccgaacgtagttcttgcggattttgccggagatgacccacttctgctcgccggacttgtcgcccttcgcggcggatgcggcggggatggcgcgcgcagccggaagaagcggcggagggacgaggaaggagagggtgtgacggaagggtgggagggtgagaggggagaactgggtgcgggacgtgaggtgggagatgatgatgggaacatgtctctgtgttgtggtatgaagacgaagctgagtggtttgaacgatttggttggaaggaaaatgaatggggtttatggtgggataag

SEQ ID NO: 14983 - DNA, 1281 bp, Glycine max
  Peptide Sequence Number=SeqID_131761
atgaggtgggaaaaggttgaggtgaaggcgataggcacaacaacaaagggtggtggagggccagggaagaggtggggtcacacctgcaacgccgtcaaaagtggcagacttgtctatgtatttggtggttacggcaaagataactgtcagaccaaccaagttcatgtcttcgacactgtgaagcaggcatggagccaacccgctttaaaaggctccccacctacacctagggacagccatacatgcacagccgttggtgataatctgtttgtgtttgggggtacagatggaatgaaccctctcaaggatttgcacatattagacacttctttgcaaacatgggtttctccaaccataagaggagaaggaccaccagcacgtgagggtcatagtgcagcagttgttggcaaacgactatacatctttggaggttgtggaaaatctgcagataataataatgagctctactacaatgatctttacatattaaatacagagacatttgtttggaagtgtgctacaacgtcaggcactccaccatctcctcgtgatagccacagttgttcatcttggaaaaacaaaattattgtgatagggggtgaagatgggcatgattattatttgtctgacatccacattcttgatactgatactctaatttggagggagctgagtacatctggccaattgttgccacctcgagctggtcattccactgtttcttttggcaagaacttgtttgtttttggtggatttacagatgcccaaaatctttataatgacctttatatgctcgatattgatactggtgtttggacaaatgttacaactgcaacaaatggtccttctgctagattttctgtggctggtgactgtttagacccttttaggagtggtgttcttatattcatcggtggttgtaataaaagtcttgaggccctggatgatatgtattacctatatacagggattgcacgggaaagtgaacagagaccagaaaaattatctttaaagaagcaattgaaactgaaatgcctagaacaaaatcccaatcctagccaaaatcaagttctcgttagatatggagtgggttctgatgtgggacagatcatgacagtgttgaattatagccaatcaagtcttgctcttgcaactagtatgtgtcaaatcttagatatggaatgtagttatggcaagtcagtgatgactaaaataatgatccctctaaaagttttgattttaatcatttatgagcctggaggacaaaaacaattgaaatga

SEQ ID NO: 14984 - DNA, 375 bp, Glycine max
  Peptide Sequence Number=SeqID_131762
atgaaggctggaatgatactacattacattacaagtcagctaatgacaagttgtgcgcaaccatataaaggattgaaaatagctatgaaatcaaaaaccctaattaaacccagtggtcattcgaataagaaagcacggaactgctatagtactgattccacgcataatgctagggaaaaattaccaagaacgccgagaaaaatcgtgattatggctgaaattgaagttgtgtcgaataaaataatgaagactgggcctgcaaccgatttggaggcttctggcagagaccctgaggagaggattgaaggcgaagtgacgcgagatcattggttgggagagaaaggcgcgaaatttggtggaaaaggagcggcatga

SEQ ID NO: 14985 - DNA, 825 bp, Glycine max
  Peptide Sequence Number=SeqID_131763
atgaagggggtcacttcaattgttggagctgttgcgacggatatgggaatcttgacaactccacaattgcattggatggttcgtgctagaaataagggtatgaaagcttcagagcaggattactttgaacaactttcaagctcattcaggtgcttagtggatttgatccctgctgaaaaatgtaagtttgatggagaaggtgtctgtgatatgtgcaagtttggggaagtaggaggtcttattgaaagctggataaatgctgatcggcttgtttattttactgtgccacctgaaagcagtggtaggattgaccttgttgatggggacaagatactatccctgtttgccttatttattagggagcaactaagctttcttaatgagaaagaagacatgaaaaattgccaccaagtcaatcttggtgtcgtacagactgcttatgcaaatggggcatctactaattaccttaaactgttgagacttgaagtcaattttactccaactggagtgaaatatctgcatgaaaaagccaccgaatttgatattggtatctactttgaggcaaatggccatggaactgtcttattttcagaatctttcatagagtcgttggaggctagaactaatgagatttctttaggatccaaaggttcagaaggggaaaaagctgctctgagattattggctgtcagtaagttgatcaatcaagctgttggagatgctttgagtggattgctcttggtggaagtcatattacagcatatgggatggtcaataaataaatggaatgaactttatcatgatttacccagcaagcagctcaag

SEQ ID NO: 14986 - DNA, 1983 bp, Glycine max
  Peptide Sequence Number=SeqID_131764
atgaacggcttaagaagtcaaagagcccctctcttggaggctgagggtgctggaagaggaaagagggatggtgccgcggaaggtcaagtctcagaccttgaacatggtgatgcagtgccggcggaaaatgtgggattctgtcgagtgctttcacttgcaaaacctgaggctggaaaattaatgattggtacagtggctctgttgattgcagccacatcaagtatattagttcaaaaatttggtgggaagataattgacattgtctcaagggaaatgcaaactccagaggagaaagatgaagctttgaatgctgttaagaacaccatactagaaatttttctgatcgttgtctttggttcaatttgcactgcacttcgagcttggcttttttatactgctagtgaaagggttgttgcacggctgagaaagaatttgttcagtcaccttgtaaaccaggagatagctttctttgatgttactcgaaccggggaacttttaagtaggctatctgaagatactcagatcataaagaatgctgcaactaccaatctttctgaggccctgagaaacttttcaactgcattaattggtctaagcttcatgtttgcaacatcatggaagttaacattgttggctttggctgttgtacctgttctttctgttgctgttcgcaagtttggccgttacctgcgtgaactttctcataaaactcaagctgcagctgcagtagcttcatcaatagctgaggagtcctttggtgcaataagaacagtaagatcatttgcccaagaagattatgaaacaacacgctactcagagaaagttaatgaaacacttaatcttggtcttaaacaagctaaagttgttggactcttttctggaggccttaatgctgcatctacactttcagttattatagttgttatatatggagctaatttgacaataaagggttacatgtcctcgggtgatcttacatctttcattctttatagtctctcagtgggttcttctatatccggtctgtcaggattgtatacagtagttatgaaagctgcaggtgctagcagaagggtatttcaacttttggatcgtacctcatccatgcctaagtcaggagataaatgtccacttggtgatcaagatggggaagtagaactagatgatgtgtggtttgcctatccatcacgccctagtcatccggtgctcaagggcattacattgaagctgcatccaggatcaaaggttgctcttgtcggtccaagtggtggtggaaagttcatcattccacaatgtttcgtatttaatgtgcttgggttgaagaggaatagaaagagtacaattgcaaacttaattgaaagattttatgacccaaccaaggggaagattctactgaatggggttcctttggtagaaatatcacacaagcatttacacagaaagatcagtatagtgagtcaggagcctacactcttcaactgttccatagaggagaacatagcttatggatttgatggcaaagtgaacgatgttgatatagaaaacgctgctgtaatactttctgtcttcattctccaatgggacacctctctcccaagtcccaactcatttgctcataattggtatacctttgttggagaacgtggggtaaggctttcaggagggcagaaacagagaatagcaattgctagagccctgcttatggacccaaaaattctcctcttggatgaagccaccagtgccctagatgcagaaagtgaatacctagtgcaggatgccatggaatctctcatgaaaggaagaacagttctagtcattgctcacaggttatcaactgttaaaactgctgatactgttgcagttatatctgatggccaagtagttgagagaggcaaccatgaagagcttctcaacaagaatggtgtctatactgcattggtcaagagacaactgcaaacaacaaaaaccgaaatctcggtctag

SEQ ID NO: 14987 - DNA, 984 bp, Glycine max
  Peptide Sequence Number=SeqID_131765
atggatattttgatgggagatctcaagaaggagggtcgagtcatggatgcagaaacttttggtcctgtagctgagaatttggttaaactaggaaaagaagatgaggcattgggtattttcaagaacttagacaagtataagtgtcctatagatgaatttacagttactgctatagttaatgccctttgttccaaagggcatgctaagagggctggaggggtagttttgcatcacaaagacaagattacaggaacaaaaccttgcatatatagaagtattctttatgggtggtgcctttgtgaacggaatcttagacataatccttcaggacttgtgtctgaagctttaaatgtcataatggagatgaggtcttataatgttttcccaacctcaatcagttacaacatactgctttcttgtctagggaagaccagaagagttaaggaatctcgtcatatacttgaaacaatgaaaaattctggttgtgatcctgattggctcagctactatcttgtggcaaaggtgttgtttctgagtggaaggtttggtaaagggaaagagatggtggatcaaatgattggaaaaggtttggtgccaaaccctaagttctactacagtttgattggtattctttgtgggattgaaagggtaaattatgctcttgaactgtttgagaaaatgaagaaaagctcaatgggaggttatggaccagtttatgatgtgctcattccaaagctttgtagaggaggggattttgaaaagggaagagagctttgggatgaagccacagatatgggcatcactcttctgtgctcagaggatgttttagatccttcaaaaacagaagtttacaaacctacaaggccagaaaaaagcagccttgtggacagctcaagagtcaagtctccagaaaaagttacaaaattttcagggaaaatgaagatgagaaaaagaacagttgcaatgaagaagaaaaagaactaa

SEQ ID NO: 14988 - DNA, 1590 bp, Glycine max
  Peptide Sequence Number=SeqID_131766
atgtcatcatcggaactctcttctttctttctcctgcccctatcagccatactcagtttcgatgctttgctcggagttatgtttctagtggccgtgttcggctactggctggttcccggtggtcttgcttgggctttgtccaaattcaagcctgcgattcccgggccttgcggttacccggtggtgggcctggtttgggctttcatagggcctcttactcacagggtccttgcaaagttggctgaaaccttcgatgcaaagcccctgatggcattctcggtagggtttactcgctttatcatctcttctcaccccgacactgccaaagagatcttgaacagttctgcttttgcggatcgtcctgttaaggaatccgcttatgagcttctctttcaccgcgcaatggggttcgcaccctacggtgagtactggaggaatctgaggaggatttcagcgactcacatgttctctccgaagagaattgcggcccaaggagtgttccgggcccgggttggggcccaaatggtgagagaaatcgtgggcctgatggggaagaatgatgtcgtggaggtgagaaaggtgttgcattttggatcgttgaataacgtgatgaagagtgtgtttgggaggagctatgtgtttggtgaggggggtgatgggtgtgagcttgaggagttggtgagtgaggggtatgatttgcttgggctgtttaactggagtgaccactttcctctcttgggttggttggattttcaaggagtgaggaagaggtgcaggagtctggtggatagagtgaatgtttttgttgggaaaatcattatggagcatagagtgaagagggatgctgaaagtgaggataataaggccagagatattgataactcaggtggtgactttgttgatgtgctgttggatttggagaaagaggataggctaaaccactctgatatggttgctgttttgtgggaaatgatatttagggggactgatacagtggcaattcttctagagtggattctagcaaggatggtactgcatccagaaatacaagcaaaggctcagtgtgaaatagactctgtggttgggtctgggtgcagtgtgactgatgatgaccttcctaacctcccttacgtgcgagctatagtgaaggaaacccttaggatgcacccaccgggccctcttctttcatgggccaggctttccattcacgagacacaaattggcaaccactttgttccagctggcacaactgctatggtcaacttgtgggccatcactcatgaccaacaagtgtggtccgagccagaacaattcaagcccgagcggtttctgaaggacgaggacgtgccaatcatggggtctgatcttaggttggcaccttttggcgctggtaggagagtgtgccctggaaaagccatgggcttggccactgttgagctttggcttgctgtgttccttcaaaagttcaaatggatgccttgtgatgattctggtgtggacttgtctgagtgcttgaagctctccatggagatgaaacactccctcatcaccaaagctgttgcaaggcctacatcttctcttgcaatgtaa

SEQ ID NO: 14989 - DNA, 261 bp, Glycine max
  Peptide Sequence Number=SeqID_131767
atgaaaagttggatggttgagttagggttttctctccctagctcttatgagatggtgcaaccaccaaagccaccaaatgatggaggaagcatatctactactaaattattgtttaaagataaggttctaggggatggaaattttgtggttagtcttgatgttgaggctaatcgggagaaagttattaatgaggaaccttggatgttttcagcttccgaatcaaaagttggaaaggactttggtatggatatgatttcctag

SEQ ID NO: 14990 - DNA, 234 bp, Glycine max
  Peptide Sequence Number=SeqID_131768
atgttgtctctgtggtttccaaccgctggatctgttgtcccccgtggtgacttctttgccatcttactgctgccactgctcttgtgcactacattcacttctacagaagcccatgatgcacttgatccaactggcaatattacaatcaaatgggatgtcataagctggactccagacggctatattctagaactccatgttccagcaagctatgtaagcagattatcgagatga

SEQ ID NO: 14991 - DNA, 367 bp, Glycine max
  Peptide Sequence Number=SeqID_131769
tgagaatattgagcttcaagtcaagcttttccaactacacgaaagtgcccaaccagggtcaagagtggtcacagaattgaagttgcttctgctgcgaagggtgtctttaagacatcatcggagatcaaccagaagagttgaacggagtgcactcgcggcatggaacatggtacgaatgacgaaggagagcagcgtggctgctagggcgcgggagagtatgtttctgaaacaaggttacgaaagtggaagggctacaacgacaggtttttcattaaacgtcgctagtgtctttatcttaattatgattatgccaccgcctaacttacaaagacggtcctttagcaccgatgtagaatcagcgatgtaa

SEQ ID NO: 14992 - DNA, 1144 bp, Glycine max
  Peptide Sequence Number=SeqID_131770
cgaagtggagaattctagggatgaagaacaaaagagtaaaaaggcaatggagagcttagcttcggcattacatgaagtatctgcagaagctacagaaaccaaagaaaatctactacacatccaacctgaaagtgaaagctatgatgcccagattgaagacttaaagttagtcttaaaagctactaatgaaaaatacaactccatgcttgatgaggctgagtgggagcagagagaggttcaactagtcagttgcataaagaaaaatgaagaagagaaggaatccttggaaaaagaaataaaaatattgctttatttgcttaaagaaactgaggaagaacaaaatgccaaaagggaggaaaaagctcagttgaaggaaaaaatgaaggaagttgaggctaaggcaatccaactgcaggaagctcttaaggaaacaacaactgacaacatgaagttgattcagtgctcttaccaggggatggtagttgttgcatcaagagcaacaaggttgcctatatattcttcatttgccaaagaaggaaattacagtgacatatttgctaaaggagaggcattttcaactctctttaatgttattggaattggagttggtagtcaattagcatctaccatctgtgtatcaacgcaagaaaagaacctgagccctacacttttcctcgcgctttgttcttctcttctgcttcttcttcgcttcttctttgcgatcgtgagtacaggttcttcagcttgtttgtacggcttagccacgttacctagtcgtggtagctcgaaggagttggtttgtcgtcattaccgtgggctgtttggggtgctgactttgcattccgtttggggtgctcactcgtgctcgcaaggtatcattttcagtgaggagtcactgtctcacttgatttgttggtcattgtgttttgtttttgttggatttttcacttctgaaagacctagaagggtttatagggttcatgtatggggttgtgggtgtgtttgtcctattgagccaggaactgcatccaacttggtatcaaattcatatgagatttgttgtttctcttctctgaatgttgtggctttacttaggcctgcaaaagaaaccaaggatctttcaactcttcaccaggacaaatga

SEQ ID NO: 14993 - DNA, 204 bp, Glycine max
  Peptide Sequence Number=SeqID_131771
atgaaagatagcatgacatcacaattgcaattctcaccaacaaaatcatcagcacagcaaagcatacaaaaatatcaaggaaatgtatcttcatcagctcgtacctcgatcaagtcgtacctcagtatctgcaagattacgtatagcaagtctagcaaagagactgatgacgtagcaaacaaacctcgtacctcgatcagctga

SEQ ID NO: 14994 - DNA, 237 bp, Glycine max
  Peptide Sequence Number=SeqID_131772
atgcggggtaacctaatggttacccgtacctttcgtcaaccaggggcaaacgagcccgttggcgcacgaaccttgatattgtcttctgcaccttttgtcgtcgttacctgtgacatgcggggttaccttgtggttacccgcacctttcatcaaccagggcaaaacgagcccgttgacgagcgaagactaacatcgtcttttgcaccttttgttgtcctgaactgtgaagtcaagtga

SEQ ID NO: 14995 - DNA, 795 bp, Glycine max
  Peptide Sequence Number=SeqID_131773
atggagcttcaagaccatgatttcttggaggaattaatgtctctaagaagagaaacatgggataccaatccatgttcacaagaaaaccagcttttctctaatggctggagttttgattgttttgaggatcaaaactatcatcaagcttttcctccaaactctttctcttgccaacaagttcctcaaagttacaataacaaaggctacaactacaatgaaatttatagttccttactacatgaattctctgcaccccaagttatagattcatcatcctataacacccttgatacctctccttttctggctcaagaagattatccattgtccatgatggaagaagaagatccgggctttcttggggaagagcttcattgtttggaccttcaaaccacatgcaaaatggagccaagccattccactgaaatgcctattttcaacacaacttcatcatttgtggagagaaagaatagagcaaagaagcttcaggggcagccttcaaagaacctaatggcagagaggagaagaagaaagaggttaaatgacaggctctccatgctaagatcaattgtgcctaagataagtaagtccattgggttgaagtacttgaatgtaaaaccacatagaactactatgatggacagaacagctatacttggagacactatcggttatatgaaggagctcttggaaaagattaataatttgaagcaagaaatagaagtggattcaaacatggctggcattttcaaggatgtgaagccaaacgaaatcatagtgagaaattctccaaag

SEQ ID NO: 14996 - DNA, 867 bp, Glycine max
  Peptide Sequence Number=SeqID_131774
atgtcagatagcagattccagggatccatgctaacttcatcttttatctgcccagagatgcttccaagtggggtcacgtgttctgagaaatatggtatgagtgacttttggagacctatcaaagcagaacacgggactggttttaggaatctttcctctatggctgcaaccaatggacatcctccatcaagatctttatttccatcatataacggaaatcaatttccttttcttcatgaaaacagtgctacatccaccacaggaagcatcttctgtgagagcaatagcccctatccatctgcccttggggcccaaaattctgggttgagaccactattccaggacactgtaggaaatgagaacttcaatgtttttgatacctcatcaactgttcaaggattgtcggggatttcagactcttgttgtgctctctctcttctgtcatctcaatcccagaactcttcaagccaatcatcaggaattcccttggctcactccttggttattccaagcagtcatagccataactacaacatgagtcaggtctctgaaaagataggaataagctcacagacttcttcaagccgagtgtcagatagttttccatcagaactaaatcatgcagatggaagtcatctcagtcctgtattaatatcagacaataattgtattgtaaactttgatatggcagatggtatcttccaagcttcagattacttgaatgtaaaagatcatctttccggtgaagatggtgcaaccattgacttactacaattgtcatcacagcttcagcgagttgagcatgagaggcaatccttgcaggtgaagcaagagaatgattcttcttgcactctgcggattacataa

SEQ ID NO: 14997 - DNA, 129 bp, Glycine max
  Peptide Sequence Number=SeqID_131775
atggaaccttgtgatgatgctggtatgctgtggggagtcaagttatacaatgatttactcacttcagcaggaccccttgggaatgtgcagtctgaggtcatattccgaaaggacaaatcatttatttga

SEQ ID NO: 14998 - DNA, 750 bp, Glycine max
  Peptide Sequence Number=SeqID_131776
atggaatcttggagctatgtccctgaagaaaaggagtgtgtctccaatgaggcactctcacctcccaacactctcgggaggagtaaaaattctttcttgggctgggaactcaaaaccccatgtggtttttccaacgacatgttgggtttgggtcaccacagcattgagaatcaaggttttgaggaattgggttttcctgaaatgttgggaaaacacatgtccgatgatctaattgggagtgttccaaccagaaaggtgaatggtaatagacaacaacaacacagtgacagaatcactggcactgttgtggatgccccaagtgggttttctcaaagaggggactcaaattcaaagctttcaaactcaaattccctcattgatttgaagctgggtcgatttgctgaccatggagatttcactgatcgggcgttttccaaagttttgtcttcttctgagtcatcaacgcctcctaagagagtgagagcttcagggttgcactctcagactgcatattgccaagtctatggctgcaacaaggatctcagctcctgcaaggactaccacaagaggcacaaggtctgtgaggttcactccaagactgccattgttatagtcaatggcattgagcaaaggttttgccagcaatgtagtaggttggtcaacctttcttcatctttcaattccaagctgctaaatatgtattactatggcttgtcatctgtgcctattgattggaatactagaacatga

SEQ ID NO: 14999 - DNA, 177 bp, Glycine max
  Peptide Sequence Number=SeqID_131777
atggctcttattggaactcccgttagctatactatatttggtgagaaggacatgaccaatgaagtggcctcaatactttgtagaaatctcgaatctcaagattcatgtgacataagccatgcaccaagactccaagaggggaaaaatatcaccggaactgaacataaacaaacgtaa

SEQ ID NO: 15000 - DNA, 222 bp, Glycine max
  Peptide Sequence Number=SeqID_131778
atgtcgagaaaaccaaaaaggataaggaatggttcacggtttgaaaaaaaggattcggaagtcgtttacgcatggggaagattttggttttatggtaaactttgtgaagtcaagcaagtcggagacgtagcatggagtgcacgaaatgcgaaaaaagatttcgagtttgtggtaaactttgcgaggtcaagcaagtcaaagacccaacatgacattcgctaa

SEQ ID NO: 15001 - DNA, 110 bp, Glycine max
  Peptide Sequence Number=SeqID_131779
atggcggtagaggatatggagaagacaacctttattactctgtggggaaccttttgctataagattatgtcgtttggactgaagaatgagcaacatatcaacgggccatg

SEQ ID NO: 15002 - DNA, 168 bp, Glycine max
  Peptide Sequence Number=SeqID_131780
atggctgacccagatggcgataatgacagtgaaaggtctattcctccaaatagggacatccatttgggggtactttttatacgcatactcagactgagactgaagatcattgtttcaagttatatgaaattaaggatggagatggagcatttagattttagactctag

SEQ ID NO: 15003 - DNA, 888 bp, Glycine max
  Peptide Sequence Number=SeqID_131781
atgagtgacatagaacaagtacaggagcagatgaaggccgatatgaaggccatgaaggagcatatgacaatgatgatggaagcaataatgagcacgaggaagatgatggaggtcaacattgccgcaacagttgctgttggtattgctactgagaaggacccaactcacccacccagtttcaatcaagagagttgtctagtctctgacgtaggaggaggaagacctcctactatagtggagaaggaaaattttgatcatataaagaagaggctaagggccattgaaggaggaggaaattatgactttgttgacatgttagaattgtgtttggtatcgaatgtggttgttcctatgaagttcaaggtgctagaatttgataaatacaaggtgatcactttcctgaagaaccacctggagatgcattccctctcgggtctttcctggaatgatctaatggatgccttcatcaagcagtatcaatataactctgacatgactccagatagaatgcaactacaaaacatgtgcaagcgagacaatgaatcttgcaaagaatacactcaaagattgagagatctgacggctcaagtagtacctcccatgatgaaaagaaaaatgatgaccatgataatggacacattgtcggtattctattacgagaagatggtaggctacatgcatttgagttttgcagatctagtgtttgttggcgagagaattgaaataggtctgaggaaagaaatgtttgattatgttgcttctacaaattcgggcaataggaaacctgtgacgagtggagggaagaagaaggagggagaaactcatgatatgactgcagttcccacatggacaaacttcccactagccccttataatcccctatattaa

SEQ ID NO: 15004 - DNA, 339 bp, Glycine max
  Peptide Sequence Number=SeqID_131782
atgggaagggggagagttgaactgaagaggatagagaacaaaattaacaggcaagtcacatttgctaagagaagaaatgggttgctcaagaaggcttatgagctctcagtactctgtgatgctgaggttgccctcatcatcttctccaaccgtggcaagctttatgagttcagcagcacctcaagagataaagcattaaccgtccagaccaggatttactgtagtgatttggtgtcagagatgggatgttttgatacgaaaacatgttttactttgcattacaatttaaggattgctcagacccagagagggagagagacagtgtcctttagcttctaa

SEQ ID NO: 15005 - DNA, 354 bp, Glycine max
  Peptide Sequence Number=SeqID_131783
atggagtctgataacatcgtgaagacatacgatattcttatgaaggacacatctaacatgactgaagatcaatgcaagaaacacaaaatcacttgggcggagagggtgggtgaggaacgaaagagaaaaaaaagaaaggaagaagagaaggggcaaagggggtgggtggggaaggaaagagagaaaacaagaaaaatgaaagaaagaaaaaaggaagaagaaaaacaaaaggggcagaagagtcatgagatgactcaaaactttgacttcgatagaacttggcaacaaattgttgatgaagcacttgaagacaacactaacgaagaaatcataaaagcaggacatgattgttga

SEQ ID NO: 15006 - DNA, 423 bp, Glycine max
  Peptide Sequence Number=SeqID_131784
atggtggattctgaccttccaccgagtccaaatgatttcctatttcccccaatcgaccacgaaaatctccaaattgcgtcacaaacccctccctcacctccttcaccccaacccttcgattctcgtcttcgcggctggattagtatctccttccacatattgcgttccaagctttcatctttgatgcagagagggccaatttggtcaattgggctgccttctgcagcgcttctaatgtcatgctggatcttcatctccatcaggaagaagataaccctcacgcccaatgaagcgcgtctcgttaacatcatcaaggacaaagatcggaaaattgccaaactcttgcaccagattgcacaaatgaatgaaatactcatagatcgtcacaaagctttggttgcaaaagcagcggcagcggaatga

SEQ ID NO: 15007 - DNA, 100 bp, Glycine max
  Peptide Sequence Number=SeqID_131785
atgcatgctttgttagggtcattcaatagtgggaactggtctgattctaaagtccttgatagtatgggactaagttgttgtgctatcacgagggatcggg

SEQ ID NO: 15008 - DNA, 168 bp, Glycine max
  Peptide Sequence Number=SeqID_131786
atgaaaagctcaaggctagggtggaggtactacagagaaatcaaaggtttactgctttgtttcaggaattttatgggagaagatctggacagcttaaatcttagaggacttcagagtttggagcaacaacttgattccgctctcaaacacattagatcacgaaagtag

SEQ ID NO: 15009 - DNA, 498 bp, Glycine max
  Peptide Sequence Number=SeqID_131787
atgggtccagaactgaccggctcgcacgtgatttggtctcgagcgtggctcatccaccattttatcacggcgaagtcggccatgaacccagatttcaaccaaccacgaggcgggtgctcgcgggaggtcagcatacaccccgcgcagcaacattgttacatgtttgcgttggggaaacgatgtgtgacacccaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgttcagtggacttctcacaacgtcgcgggcagcgaaccgctcacgtcgccgcaatccgaacacttcaccggaccattcaatcggtaggagcgacgggcggtgtgtacaaagggcagggacgtagtcaacgcgagctgatgactcgcgcttactag

SEQ ID NO: 15010 - DNA, 216 bp, Glycine max
  Peptide Sequence Number=SeqID_131788
atgtctgcttttgtggaacgctggcataaggaaactagtagtttccatttgcctgtaggaggggtgactatcaccttggatgatgtggcattgttgttacatttgcctaacgtaggggcattctacttcaagatcaagcatcaagaatccaatccaagaatcaagattcaagagaagaaatcaagaagcaacaagtcaagacttcatataggataa

SEQ ID NO: 15011 - DNA, 255 bp, Glycine max
  Peptide Sequence Number=SeqID_131789
atgggggagacacatgaagtaccccaccataatctagccgacttcgatccttgcctcaaatattccactgaggggcaaacagttggtggcgtactcctagtccctcctgccgtggtggaaaggaagaaattggatcacctagaggaaaagcttagggctgttgaaggaggtagagattatgcctttgctaacctagaagagttgttcctagtacccaacgttgtcatccttcctaatttcaaggtgccaaactga

SEQ ID NO: 15012 - DNA, 345 bp, Glycine max
  Peptide Sequence Number=SeqID_131790
atgaatgaatctatttctgagcttcagaaaaaggataggacactccgtgaacacaacaacttgctctccaagaagtttgtgcaatttggatttcaaaaatcttaccgtacacaacaacatggtttgagtgaaaaacagataaaggaaaaagagaaggagctgaccccacaagagcaagaaggactgcaaaataacatggatgtgagctctgtccttgtaactcaaccactggagtccctgactattggaggctccccagaagtcaaatctaatgaagaaactccaacctcatgtcgacctaaaaccattcttccccctttgatgcctcttcctacaaatgaatag

SEQ ID NO: 15013 - DNA, 639 bp, Glycine max
  Peptide Sequence Number=SeqID_131791
atggcatttgataggaaaaacgaaaaaagctttgatagtatcagtaacaacaatttgtcacggccaagcaaaaaattccacagcaagaagagacattcaaacaatccaataataaaggataaagatggtggtggggttcccattggaaacaagtttgattattcaagttggtcactctccgcggatgaagattacatagtgttttgctttggaaaggatgtggcaaaaggtgacaaaggtgtcaatgaagtgcataaaaattcaaggccggtgaattgcaagctgaaatatggtgagaatgaagaacaagttagtgacctgaacattcatgagaaaatatcaaatgctaatcagcaccatgatgatgacataagaagagcagaatcaagtaactctgaccaatctgaaggcagtagaagttcttttgcgttccccgtgttaggttgggaatggattggaagccctgtacaaatgcccaagtcagaagagtttgtgatacgaacacaactacaccaacaaaggatgaaaaagacacaggtgaagaggcccacttaccttcacgatttcgtctggatttcgtctgaggaaactgtcaaaacagaagcttctgccaaatcttctccaaatcgccttgcttga

SEQ ID NO: 15014 - DNA, 351 bp, Glycine max
  Peptide Sequence Number=SeqID_131792
atggccacgcctcgtgttcaagcctgttgtgcatcttcctcctctgcttctaccacgaagttggcagagacaacgggaaataagataatggtggttgtggattctagctttgaagctaaaggggctcttgaatggggggcactctctctcacacttttcagagccaggacaatgttgttcttgttcatgtggccagacccacccgggaaggtcagaagaactgaatctggttcgaagtttaatgtgaaaagcatgtgcgagatgaagagagccggggtgctagtgaatgtggtgatgcttgaaggtgctatagtgcaagaggcaaagaacaaattcaatttttatgattga

SEQ ID NO: 15015 - DNA, 318 bp, Glycine max
  Peptide Sequence Number=SeqID_131793
atggacatgttgactccggcgtcgtttctcgtggaatcaggaagagcagtgacagagattgctagtttgtatccctttgcccacaaggaagcaccaatgcagtaccatgccaagtcaccaagtactgtgcaatttaccttctcatcttactggaagcatgcaaggactataattattatagcagagaggaatattgtcagaactcggtattttgataaaaatccaagtccacttaatgaaaaagcgcatgatattgcaatttctgctctaggaagtatttgtgaattccatcgtgaaagcattgatggctctaggtag

SEQ ID NO: 15016 - DNA, 171 bp, Glycine max
  Peptide Sequence Number=SeqID_131794
atgaatgatgaacacactgattgggaatctatatggatcgtgaaagtcttcttcagacaactaggtatacggtcagaaagaaatgctagaactttcactggtcgagcaatgcttttggagttcatttgggatagcattttttcacttagctttcttgcgatattctgctga

SEQ ID NO: 15017 - DNA, 108 bp, Glycine max
  Peptide Sequence Number=SeqID_131795
atggagggcgaaccctggtgcagcgccagtgctaccaacggtgctaaattggcaaaagatccgctaggccattccaccgtggcaccgccatttaacaacaatgcttag

SEQ ID NO: 15018 - DNA, 1062 bp, Glycine max
  Peptide Sequence Number=SeqID_131796
atgccaatgtcgcgtacaaaagtgttctttgaggaaacctgtttagcatcaaaagatgctatgccttttgatttactaaagaagaagatgttttcgagattaaatacaatggggattagaattaagaaaacttacgaagaggaatggtcttatatcccagttggtggatccctaccgaacacagagcaaaagaaccttgcatttggtgcaactgccagcatgtttttatccacagggtactccgttgtgagatctttgtcagaagctccaaaatatgtttcagtaattgcttctattttgaaagataatcatgccaaggacatcattactcaaaaaagaagaaaggagaatctatctatgcaagatttttcctttggactattttcaggaggattatctaatccaagacttgtggcagtttccaattccatatcatttgcaaatcctaaagcacctgtgtatccgcgccttgctctaggaaggtcttgggatgaagtaattgcaagtgattcaaaaccagcacgctacattagaaccctccactgctccttgtcctctatactctccctcaccggccccggcccaataactgtgacaattccagaggcacgagtggcgaatgcttacaagagcgcagcccactggatcccatggacgatgccgaagttgaggatgtggatgttggaggcgttttcggtgggagaacttggagtaagggcgagtgtcattcagggccttatttccacaaatggcttagggattccgcagcttgatccggttcagtttcgaagagggagggacactccgacagggcttttaagagaggctgctagagggagcgcagaagaggcggcgacagaggaggagaagggaaggaagatgaggcggttgagatcgaataaggggaaggggaaatcttttgtgcaggaggagggggtgatgatgagggagtccatccagtcgtcagagtcgcagtcggaaaagcggaagggtttcaaagtgattttggaaggaattttcgatactaggcttacaataggaatctcaaattcatggagctag

SEQ ID NO: 15019 - DNA, 534 bp, Glycine max
  Peptide Sequence Number=SeqID_131797
atgcagcatttcgtggatttgcaagagaattcggagttgggtgagtcgaattcatggctttcagcgaaagagcagtccggtgcggcacccaacaccaatttggatcgcgtcctcttcaacgacctcgtcgagattgtccctctcgttcagtcactcatcgtaatccctctaacccttttcactcttctttcttccattttcattgcaacgcaaaaaaaaggagatttattttatttatgtgcaagaggaaaaggaaacaaaacagcaacttgggatcgtaaagcaagccgttcattcacgcggcgtggttccatgatctacaccaagacacccacaagagaatcattgtccaaaagaactcattttgtgttgtttatatctttctgtttaaactcccacttgaaaaggtcagacttcagtttcagttatcagtgtaggcttgaagatgtaactaattttgagtctctgatattattgttaaatatgaaaaattgtggaactaagctatttccttctcaagcacagataccataa

SEQ ID NO: 15020 - DNA, 1053 bp, Glycine max
  Peptide Sequence Number=SeqID_131798
atggtcaagaatcgccagttgcagtttcacatgaaaatatttgttgaggcagatgtcattgtgtcaccaacaacaggtgtgactgcatactcgatacaagatgatgcattgaagactggtgaacttgactacgtaaatggagctacagttgttcggtattccatatcaggaaacttcctaggacttcctgttgtgactgtaccagtgaacctgcaagaactgttggctagcgtgaccctagttttatacacacaaggttatgttttgctcttctcagaccaactcataaaggatttggactattacgacattgttttccacatagaagatatgccttatgcaaatggatacacctcacagggagaccaattcacagctcaagtgcaagaaatttcgtcaacagtaccatacataatcgcaagtggaaatcatgaacgtgactggccaaacacaggatcactttttgatactccagattcaggtggagaatgtggagtttttgcagaaaccatgtattattttcctgctgagaatagagccaaattctggtataaggcagattatggcctgtttcgtttctgtgtagcagatagtgagcacgactggagagaaggatcagaacaatacaaattcattgagcattgtcttgcaactatagatagaaagcatcaaccatggctaatcttttcggctcatcgtccccttgactactcatctaatgattggtatggcaaggaaggctcatttgaagagccaatgggaagggaaagtttgcagaagctttggcaaaagtacaaagtagaaattccattttatggtcacgtccataactatgaaagaatgtgccccatttatcagaatcaatgtgtgaatcaagaaaagcatcaattactctggcactgtgaacggaacaattcatgtggttgttggtggtgggggaagtcacttgtcagacttcacaccaacaccccctatttggagtctttacagggatctctcgactatgggtttggcaaattgactggcattcaatcattcatatctcttgtttga

SEQ ID NO: 15021 - DNA, 483 bp, Glycine max
  Peptide Sequence Number=SeqID_131799
atgttggataatttgcttctggacattgaacattttgctaaagccagccatccaaacctcgctaaagctagccatccaaaccccgttgccattgttctcgttctcgtcctctctcaatcacggaatctgtccccttggaatctgccatggaagataaatagaatattatcgacatcggcgttgaagttccgccagttccgacgacttcggtgttccttgttacgagcctcctcaccctcttcattgaccctctctacttcttcctccccaacgttggtggccccgcctgcctccaggctgatcccaaactcagccaggagagggagcgacgacagcggtggaggaagggagcttagggaggagagggaggaagaaggagtggaggaagggtttggaggcgaggactggggtattacggcgtcatacgaagctatagctagggttagtaacttaaggaacgaatatgaaggcggtctttgttaa

SEQ ID NO: 15022 - DNA, 183 bp, Glycine max
  Peptide Sequence Number=SeqID_131800
atggtggtggagtggttgttcatcacgctgccacttgcttgcagcatggccccaccagcgtcaccttcaagtgatgaagagcgtctccatgcatatccccacaacacaactgtggttgagtcgatactccactatgaatctagtgttgctataatcttgctgttgagtaatggtacggagtga

SEQ ID NO: 15023 - DNA, 229 bp, Glycine max
  Peptide Sequence Number=SeqID_131801
atgcagaaaatgaaagtagtaagaaaatttgggattgggagggagaggggtagtgggagaggaatgcaaaaatgtggggacagtatcgactcaaccacagttgtgttgtggggatatgcatggagacgctcttcatcacttgaaggtgacgctggtggggccatgctgcaagcaagtggcagcgtgatgaacaaccactccaccaccattccccctatgcttctaactt

SEQ ID NO: 15024 - DNA, 786 bp, Glycine max
  Peptide Sequence Number=SeqID_131802
atggcaccgcacgatctccaccgtccgttcaagcgaccggcgatctccgatcaagagcggcgcagggaacagtctctgctccgccaggcacagaatcgccaagacgcccagcgccacgcgcgcttcttggcctcagccgcactctctctcccaccccaatcctccgaaccagaatccgaaccaaaacccgaacccgaattcgaactcgcggaattcgaagccgagcctcgactcatcggagcgtcgaagctgaaagccgtggaagctcgcaagtggttcgcgaagcagctcatgctccccgagtggatgatcgatattcccaacaacctcgctcaagactggttcgtcttcgctcgcccttccgggaaacggtgtttcgtcgtttcgtgcaacggagcgacgataagccgtctgcggaacggtgccgttctgcatcggtttccctccggcttgccgagcggggcaaggaagaaggacccctcctactctatattggactgcatctttcacgaggcggatcaaacttattacgttattgacatggtttgttggcggggttaccctctgtctgattgcaccgcggagtttaggttcttctggttgacctcgaagcttgcagaaactgatgcctttgaacctccctcgcattatcacaagtacaggcatgctcactatcaggcaggaattacgccgttagcattagtttggaaggatgagaactgtagtcaatatgttttggacacagacagtaaaggacaggttccaaaccaacagcaggatttctag

SEQ ID NO: 15025 - DNA, 804 bp, Glycine max
  Peptide Sequence Number=SeqID_131803
atggagctgtggaacagagcccgaagctttgcggaagaagcagcgaaacgatcccaggaactgtcgttgggagctagagctacccaattcaccaacatcatagcagaaaccaccaaagaaatcgcagcgcaagcttccaagcacttgccccgaccttatgccataaacgacgtcgatctccaccgttttggcatcaccgaagagttgagggactttgtcaaaggaatcaccatcactacctttgaggattttccccttcaagatgatacggaattgtctgatgttcctgcagtttcaaatgttaggcaggacctaaccgagtggcaggaaaaacatgccagtcttgttctttctacagtcaaggagatttcaggattgaggtatgaactgtgtccacgagtcatgaaagagaggaagttttggagaatatattttatacttgtgaataatcacactgcaccctatgagaataagtacatggaagacaataaactaaaatcatgtgaacaagtaaaagatcacaaagtgatgatggaatccttaaacactgaattgatctccaatcaagaggtgcaagaagtgaaaaaggaggccaaaccttcgaattcatcaacagagcaagacttggatgtatttcttctgggagaaggaaacagtgatgatgagcctgagtttatatttgccaacaatctctttggtctttcagatgatggcgatgggggatatgatgatgatttggaaaaactgatggataattcggagggatcaagttattccaagagtaactttaaggggggcacttga

SEQ ID NO: 15026 - DNA, 429 bp, Glycine max
  Peptide Sequence Number=SeqID_131804
atggcaaatctggataaagaatctgcagaccctgcagctgttatcaatctgaagctacagaatgatgctctatttcactcaggagagcaagatatgaagttccagttggctacagattctatagatatgatgctgaaagccatgcactgtattagagaccagttttctactgtggagaacatagatgaaagacccaggcagggggaatcaaaagttgatcaatctttggtggggagatgtgttatcattcgggctaaagcctcaactgaccagatcatttggcgagttgggttttcacttgttcttcctttgttttctcaactgaactggtgcaaacacaagcacgatgcctgcacatccattgtggattactttgcaagtgcaaaacataatgtgcattggattactggtttagaacttggagcataa

SEQ ID NO: 15027 - DNA, 1110 bp, Glycine max
  Peptide Sequence Number=SeqID_131805
atgatgaagtctgcaagggatagtgcacagaatgaagtgctagaaagcgaggaaacattttttctcaagaaagaaccctcctcgaacacccaaagagcagaactgcttgtgaaagtggatgggaagagtactgatcaaaagccaaacacaccaagatcaaaacactctgcaacagaacagcggagaaggagcaaaattaatgacaggcaagtatatatcgcctgccaaactgataaaagtttttctggatgctacagcaggcactcactagttgcaaagtgtaaacttgaaatgcagagtataaggaaattccaaatgctaagagagcttattccacacagtgaccaaaagagggacaaagcatcttttttattggaggtcattgaatatattcattttttgcaagagaaggtgcacaagtatgaaggttcatttcaagggtggagtaacgagccagaaagattgatgccatggagaaataatgacaagccagcagaaagttttcaacctcgtggcaccgataatgggtcaagtccatcaccaacaattcctgggagtacccagaatgtagaatctggcttgagcacagcaactacctccaagacaatggatcatcaggctggaaaaatgaacaaggcttttccaattcctattccttcacagctaaatttcttcactccaacccaaatcggtggtccaggtggagtagtgtctcagctcacacatagatcggcatctgatgctgagaacaccaaatatcaaccttcagtggaatgtcagactatgactgctaccaatgaaaagctgaaagagaaagagctcactattgaaggtggtgccattagcatatcaagcgtgtactcaaaagggttgttacatacgcttacacacgcattgcagagttcaggggtggacttgtcacaggctagcatctcagtgcaaattgaacttggtaaacaagcaaacatcagatcaaatgtaccagtgtcagtgtgtggtgctaaggatggtgcagttccttctaacaatcaaaagatgatgcgctctagagttgctagctctgggaagtctgaccaagcagttaagaagctaaagacttgcagaagttaa

SEQ ID NO: 15028 - DNA, 1548 bp, Glycine max
  Peptide Sequence Number=SeqID_131806
atgtgcagggcggagtgggaaggttttatgggtctgaagaagtgggaaagtaaggttccgaaggtgggaatgggaatgggtgtgttaggttcgggttcgggttcgggttcgtcgcggtcgagaatgaagatgtggatgatacgggcgaccacatcggtgttactgtggacctgcatcgttcagttaacggcgttgggtgacatgtgggggccgagagttttgaaaggttggccttcttgtttcactcacgagtctgccgttagagcaatggatgtcgagctaccgtcaccgcgtcctcctcttctccctccaaagagagtttataaaaacaatggttatcttatggtctcgtgcaatggaggactcaaccagatgagagctgcgatatgtgacatggtggctattgctcgatatttaaatgtcacgcttatagttcctgaactggataaaacatccttttgggctgatcccagtgacttccaagacatatttgatgtggatcattttatcacttccttgagagatgaagtgcggatactgaaagagttgcctcccagactcaagctgaaagtggagcgcgggtttctttacaccatgccgcctattagttggtctgatatatcttactataaggatcagattctacccttgatacaaaagtacaaagttgttcatttaaatagaactgatgctcggttggccaataatggtcaaccgctggagattcagaagctgcgttgccgagttaattttagtggtctgagatttacttctcagatagaggagttgggcagaaaggtgatcaggcttcttaggcaaaaggggccatttctggtgctccatttgaggtatgagatggacatgttggcattttctggctgtactcaaggttgtaacagtgatgaggtggacgaattgacaagaatgagatatgcttatccttggtggaaggaaaaaataattaattctgatttgaaaagaaaagatggtttatgccctctaacacctgaggagactgcccttacgcttaaggctcttgacattgatcagaacattcaaatctacattgcagctggggaaatatatggaggggaaaggagaatggcaagtctagcgaaggagtacccaaaattggtcaggaaggaaacgctgttggagccatccgaccttcagttcttccaaaatcattcatcccagatggcagcattggattatcttgtctcattagagagtgatatttttgttcccacatatgatggaaatatggccaaagtggttgagggccaccgcagatatcttgggttcaagaaaacgattttgttgaacagaaaactcctagtcgaattgatagatcaatacaataatggagtgctgaactgggatgaattctcttcagcagtgaaggaagcccatgccaatcgcatgggtagccaaaccaagaggtttgtaatccctgacaagccaaaagaagaggattatttctatgccaacccacaggagtgtttggaaccatcagcatatgaactgttggcgttgagtagaacgtga

SEQ ID NO: 15029 - DNA, 138 bp, Glycine max
  Peptide Sequence Number=SeqID_131807
atggcaatgattgttcgatctcgaggccttgtcgttgttgttgtcggtagcggcgacagagggagaggaatgagtgcaacaatgacgatagaggatgaaagcagcaacgataaagagaagaaacagagacgacaatag

SEQ ID NO: 15030 - DNA, 1534 bp, Glycine max
  Peptide Sequence Number=SeqID_131808
aagcagcaataggaatgaataatcaagccaagaatattgctgcatcatctttgtttggtcattctggaatggccccacaaaaacaccaccctaaccccattcagcagtggaaccatccaaaccctttactctctcagtcacagtcacaccctcaaacccaattccctggtccgtttcagttttcagatccccaaaaccaggtctttgcaaaagctcagtattcacaagcacatttgcattctccggctgcccttgctcatccgcaacctcagactcatccttttgcccacttgcatagtgtaaatactaatactgctaatggtacatcatctccggccaccggaagtgccaagcgagcaaccccaaagcccccgttgaggtcccacaattcgttgaatacgaaccaatccatgccgtttaaggccacggaattgaccccagctgctcggcaaaagaagcaaacaccagaaaaggtggctgcgcttttgcccgagtccgctctttacactcagttgcttgattttgaggctcaggtggatgctgctttggccaggagaaagattgatgtacaggaggctaagctgcctccccatgttcagaaaactcttcgtgtttatgtgtttaataccttctcaaatcatgcaaaaatggatgctgagaatagaaaggctgatgaatcttggtggtctctcaagataactggaaggatattggaagatggtatggattctgtgtctggaacttcacagggatcgagtccttcatacccgaagttctctgcatttttcaagaaaattaccatactcttagatcaaagcctttatcccaataatcatgtcattgtatgggatagtgctcgttcccctaccgaacaggatggttttgaggtgaagaggaaaggaaacaaagaatttactgcactgattgcaatagaaatgaattatacacctgacaagtttatggtttcatcaccactgtctaaacttttagggattgaggtagagactcgctcaagaataatagctactctttttaactacgtcaagtccaggaagctacagagcccaaatgacccttcattcttcatatgtgatccttctctacaaatggtgttcggggaagagaagatggatttcaccatggtttctcagaagttatcacagcatttgtcacaaccacgacctatacatctagagcataacatcaagctttctggacattctccagctgtatctgcatgttatgatatacaggttgatgtgccttttccactggaaaaggatatgtctacattcttggcaggttttgagagtcagaaagagattgaagcttatgatgaggcaatttgcggctccttaaagaaaatccaggagcatcgtagaagacgagctttctttcttagctttagtcagtatccagcagagtttattgatactttgatttcttctgagagcaaggatttaaaacttgttgctggagatgccagccataatgttgaaaaggagcttcgttctgaattcttcaatcaaccatg

SEQ ID NO: 15031 - DNA, 456 bp, Glycine max
  Peptide Sequence Number=SeqID_131809
atgcatagaaagagaaagcgcagggtccgacccgatacctcatctttcgccctagtgctcgttttcagagctgcaaaggaatcgacacagaaagtgattaaaaaagggagaagatatctttggtgtcaaacgctccctgattcttctgctgtggactccacttctctactgttccacctctccacactacgccgaactgtttcgtccaatgaaaatcaatcgcgaaagtttccgttgataagtcgtggagaatttactgctgcaagttctcgaatcccgtgttcgtttccgaattcaaacgggatcgaattctatgagatttcatctccggaaggagcgaaattcaaaattccgttgaattaccgggaaggaaaaggaaaacagaaaaacggaaaagcatcatattcaggttttgatggagcttcctcaagcacgcccccttggaaccgaaggtag

SEQ ID NO: 15032 - DNA, 111 bp, Glycine max
  Peptide Sequence Number=SeqID_131810
atggaagaattaatgtatgatggaaggggatgggggccacgtgagttgatcccaactcacgtgcataaaaacaaaaggagtatgcagaagataaccaaagcagaccagtaa

SEQ ID NO: 15033 - DNA, 1245 bp, Glycine max
  Peptide Sequence Number=SeqID_131811
atgactggttttatgttctctcttagtgcaccagagtttgatgtttcagagctagagaagcttttctctgcaaatgttccaaaacctactgattctggcaaatctggagggcggcgcaagtctgttggagctaaaactgataaaatcaccttggttgatctaaggagggctaataatactgaaattatgctcaccaaggttaagatgccacttcctgatatgatggctgcagtactagctttggatgagtcggtattggatgttgatcaagtggaaaatctcattaagttttgtcctaccaaagaggagatggatcttttgaagggatacactggtgacaaggagcttttggggaagtgtgaacaggtgccaagagtggagtcaaaattaagagtatttgcattcaagattcagtttaattctcaggttatggaatttaagaagagtttaaacactgtgaactctgcctgtgaagaggtccggaattctgttaaactgaaggacataatgaagaaaattctttatttgggtaatacattgaatcaaggaacagcaaggggatctgctgttggattcaagttggatagtcttttaaagctcactgacactcgtgcttctaacagtaaaatgacactgatgcattatctttgcaaggtcctggctgataagtcgcccgggctccttgatttccacctagaccttgtaagcctggaatcttccactaagctgaaagaaacagctgttgagatgggactgtttaaattccagcatcaggcaatcatcaagggattagaaaaggttaaacaagaatttgctgcatctgcaaatgatggacctgtctctgaagttttccataagacattgaaagaatttatagctgtatctgagtcagaggtagcatctctaacaaacctatattctgtagtgggtagaagtgctgatgcacttgcactatattttggtgaggatcctgctcgttgcccaatggagcaagttaccacaaccctgctaaattttatacgattgtttcggaaagcacatgaagagaatatcaaacaagcagagttagagaagaagaaagctgagaaagaggctgaaatggagaaggccaagggcattaacttgacaaagaaggcctccccttccatgatgatgatgacgatgacgacgatgatgtggcaattagcctttcaagctgatatattggcggggaatagcgaattcctgcgtcctgtggagttttga

SEQ ID NO: 15034 - DNA, 1131 bp, Glycine max
  Peptide Sequence Number=SeqID_131812
atggaagaagaaaacaaaggaatcatagtgaagcttccttttgtgtcatccctttcaatatttcttcaccttttttccttttcacccctgccaaatgtgactcttctttctcacctaataaccttcaaatctgatcgtgaaaccacttctctcctatctacaactgaagatttacaaatatcactcgactcatatctctccccttctgttccttcttcatcatcacttcctttgcatcaaaccgcaagagtttttcaagaggaatccacgtactccttttacatctacaaaagtgggagactttgggttcgtctttacttcttccctctccctgacccttcctataacctaacaagtgcggttttctctgtccaaaccaatcagcacgtgctcttgcatgagttctctgtgaggaacaatgacacatctgttttcaaggaataccttgttaatgtttctgatagtagattctctcttaaattcaagcctaagaaaaactcatttgcgttcatcaatgccattgaggttgtctcagcccctgacactctaatatcagattcagcaactgcactttccccacatggagaattcaaagggtgggaccagccaatctacaacaaggcatggaccgatgcaattgtgaatagaattgaggtgatgaagatgagcaacgatgcagacagcttggatgtcctaattgaggtactttgtgctaggccagttatttaccctacactgccaagagaggagattaatttggctgattgggcaatgaaacaacataaaagaggagtgctcagggaagtaattgatccacgtattgttaagattatcagtcctcaatcgttcaatgtttttgtgcaaactgctgagagatgtttagctgattgtggtgttgaaaggcctagtatggaggatgtgttgtggcatttggaatatgctttgcgcctacaaaaagatgccacaaggattaaagaacttgaagaaaaaagtgcaagtatattcacaaatgaatgtaatgataatgataatatagcaggtcactcgggtgatccagcaagtgatgtgtctgacagcacagatgctaattctgctttgttttctcagatagccaactttcaaggaaggtaa

SEQ ID NO: 15035 - DNA, 480 bp, Glycine max
  Peptide Sequence Number=SeqID_131813
atggtgtcggcaaggtccaccaccacctttctcctagttttcattttgcttcctctaagattctccagcgcacacacccaacaccaagaaggtaagaagacactggtggtagcaaaacttgaaacaccaagatgtccagtgaacgtagagatttatcatggtgttcctgcagttgctgagacaaatcaaggaataagatttcttccaggaaggaagatgatgtctagaggagtactctcgaagttgaatgtggtagagtccgagaatggaactaatatggcaaagggcttaaccaccaaatggaaagcgctttgtttgattggaaactgcaaccgtgaaaaagggaaaagaattttgggtctgaaacataaagacagtaaaaggagcaatgggcgttctacgagagtgaagatgtctggtttggtgcctctgaatgctgattattatgttccaagacctcacccacccaagaataactga

SEQ ID NO: 15036 - DNA, 882 bp, Glycine max
  Peptide Sequence Number=SeqID_131814
atgagtttaaagaatggaagagctaatatgatagcaacacgaacatacatgcccaagatagcagtgttagctggcccaagagacacaccagcaaaccagcacatttcaaagactatgtataatgggtttatcatcctcatggaaatatggcaactggtccggctgattcttatactgaaaccaaatgtggtgtttgtcatgctggaacagatgagcatcttctactactttgtgatctatgtgatactgcttcgcacacatactgtgttggcctgggctatactgtttctgatggtgattggttttgtcacgattgtgctatttcccgggagaccaatatcaatgaagaatcagaccaacaaaaattttgcgccaacagctgagccaagtgtaaccatcaatatctttgatattgtgagggaaacaggcagccgggtggttaatagaccaagggcatctcctttacaacagaacctgtcatctcctgttattcctttacctgataggttaagttacttaagtagattaaaaggaaaaggtcctgtcacaggtgtctgtaatatgcagcggaatgtaaaggtttttcgtgaaaattggaatgctttgagaagtggttcatttcagttccgttgcaattcatttcaacctggaagcacagttagtcaaaaacaagattctagttccttatcacatcacaaattggatggtttgcattctatggcttccacgagccttcaacaatccactgtccaaggtggtccttctaacaaaatgttgaatgagagagtctttaaagatgctgacaaggcatggaaaatgatggacagggcaaagaggatacaacgcctcatcatagaacaggcagcattctacagggagtag

SEQ ID NO: 15037 - DNA, 276 bp, Glycine max
  Peptide Sequence Number=SeqID_131815
atggagagagatgaaaagaacatggtcacgatgagggaccttaacgtccctggaggaagaaaagacgccatgcatagggagccagcgaacgtaggagaacctttggcggaaaattgggcctattccatgatgcaaacgaagcagaagtgccgcttcttcggggaacccaacgacgacatcctcgtcggaatccgaatcacacactgttcagaaccaggcgatagttcttatacggtgaagacgacagcgtcggctaagtccaacacttggctctga

SEQ ID NO: 15038 - DNA, 645 bp, Glycine max
  Peptide Sequence Number=SeqID_131816
atggaatgcaatgaagatgatgaactccatgtagcaccttatgcttccttaacacagcgccttcactatcattctccaacccagaaacctatctttacctcaacaaacctcttgaacgtggaagctggtgaaggccataatttgaaccacatggatccacctcattgtttgcatcatactccattttactgctcccaatttcagcttcctagcaacagcaacaacccaattcaaatcccactccataaaccctctcccaacatatcatcaaacaacaacaacaacaacaattctgacgaagcaaaggctctccttgatgacagaaagaagaagaggatgttctccaacagagaatccgctcgaaggtcgcggatgcgaaagaagcaacaaattgaagtcctgcagtaccatgtggacaatctgcagacattaaaccatcaactgtcccaaaagatcatttacttgttggaatgtaaccaacaaatccaccaacagaatgctcagctaaaagagaaagttttctctcttcaggtagcactctctgacttgttggctacttctggaagtgctgagcaacctcacctcatccctaatggcttcctagccgagtcttcgactcgaccaattgcgagttccagaacatag

SEQ ID NO: 15039 - DNA, 1281 bp, Glycine max
  Peptide Sequence Number=SeqID_131817
atggagatattcaaaattttgggggtgcaagaagcaattcttggaatgcaggaaaataaaaagatctcgaaaattatttatattttttctggggcacaagaaacggtgtgtgggttccccgtaatccagaggcgacaaggaacggacattgaattgcgacaggggcatttccgtcattccacagagcaacccgttatagccccaaaccccacactttccatcataccacactttctaaccaaccaaccatcaatggcagatgtaaccacctacctccgccaccaccgcgaccccgaccccgaccccgacgacgacgaccaaaccctaattccattcccttattgggatttggactttgatttcgaccccgaattccccacaaacactttctccttcaccgaccgcgaaaaccagatcaatttcgtcatggatctcttccaccagcgcgtggagcagtctcaactcaccgatcccctctccaacgacgccgttttcggcgtcatcgacggaatcgacttaggtttccccgccgccgacgacttcttcatcggacggagattctccgtcggatccgacgaatccgacggaggacactctcactcgcacgcggggattgacgacggtgtcctggggttctgcgcgcattccgacgaagactacaacgaaaacgacgacgttgcgagcatccctctctgctgggacgcgcttcaattggaagacaacaacaacaactacgatgacttcgagtgggaggaagtgatagacgagagagacgttctcagcatgctcgacgacaccgtttccgttaacctcggaatcgaagcagaagcagcagcagcagcagcagaagaagaagaagcagaatcagaagccagcattttggagtggcaagttttattgaactccaacaatttggaaggaccaaattcggagccttatttcggagacaacgaggatttcgtttacaccgcggactacgagatgatgctcgggcaattcaacgacgatgcgtttaatgggaagcctccggcctccgcctccgtcgtgaggaatcttccgtcggtggttgtgaccgaagctgacgtcgtttgcgcggtttgtaaagacgagtttggcgttggggaaggggtgaaggtgttgccgtgttcgcatcgttaccatgaggactgcattgtgccgtggttggggataagaaacacgtgtcccgtttgtcgctatgagttccccactgatgatgctgattatgagcggaggaaggcgcagagatctgttgttatgtga

SEQ ID NO: 15040 - DNA, 420 bp, Glycine max
  Peptide Sequence Number=SeqID_131818
atggagaaattgttacacaaaaagcgatatccttatcatcacccagtgtacggaagtctcactaggtcagaggtacaacattacaacttgtcattatccaccaaattcacactagtgactgctgaagaaatcttgtataaagctagcatgctctacactcgtctctttggaggatcttttgtatcagaacgtataatattgatatcaattgattggtgggttatccctgtagtctgtaaatatcttgcatcaaagttatcctgtgagatgcttaatgccttggatatgactcaacagcataatggatatacggagataatagatatttctaaaccatcaagggggcaattcaacccagtggtcctcatcaaattagaactctatatcatagctttaatatttctagtaaaatggatgtga

SEQ ID NO: 15041 - DNA, 3450 bp, Glycine max
  Peptide Sequence Number=SeqID_131819
ggttggtgttctgatcatgactagggctgtccgtagtagggtacttaaagatgccaatggtgatattagtgatcatctacgcaaccacattcatttgactaattgtattcacctgaagaaccatatgcacaagaacagccccatactggctgataggtcaatcatgagggacctagttgtgctgcagagatcgcggtctcttagagacccttctgcaagtcctccatcatggcactcgccttctgtagttgacttgcttttcaaaagagttgaaaatgatgccgtgtctcaagggggaaggatgtctgtaggtgccgagcgaaggaaggaagggagaagattgtctggaacttcaccacccttggtgagtataggttcatcaagagttgctccgggtgagattggtaggggtaatgatgggataacggcacctagtgaacgaagtagcaggagtggattgggagatggaaggagagttgggagagaagaatctggtaggaagaatgataggcctgactttttggatgttaatccagaggagcctctctatcaaggtggcaaaagcttggctgaagatgttatttcaaggcactcagagtctaaagctagaaagagcaaacaaagggggaagaatgttcgagatgcccaagttaagaccctttctgagcagctgaatgatgttccattggatagtgatgatttagcatcatcgaacattcattttcgtggaaggtttcctagacaggagaaagttattgaggaggtagaatcccggatgcgcagtcatggcagtggaatgaataagggaaaaaggcgtaagtttcgaagcgtgcgaagaactcgggttgctacaacatcaagagatattggagctgagaatgaaatctctgtggcttccaactcattagcccaccataaatatcacttggaggaggctgatgagtttgcagatgaaaatgttaccagggctccaaaaaatgggtgtggcattccttggaattggtccagaattcatcatagaggtaaaacattccttgacctggctggaagaagtttgtcttgtggtttatctgactcaaggttgaagaaagggacatttactgccaatggaagaaatatttctgagatgcctgtggcatctgagcgctcaagctcatgtacgaagtctgatgcagaggcactgcctttactagttgaggcttctggatctcatgcaagcactgaaaatgcttgttgggatcatgactactctggggaactaggtctttttggtgataatttattcaagcatgatgttgattctgacctcgcttcagaagctagatctggtgatcagcgtaagttgagagggaatcgtcacagtagacaccaaagtttaacacaaaagtatatgcctcaaaccttcagagatatgattgggcagaatttagtggcacaagctctttccaatgcagttatgaaaaggaaagttgggttgttgtatgtgttttatggcccccatggcactggaaaaacttcctgtgctcgcatatttgccagagctctgaactgtaattcttcagaacacccaaaaccttgtggtttttgcaattattgcgtagcacatgatatgggcaagagtagaaatataagggaagttggtccagttagtaattttgactttgagggcatcatggacctacttgacaatatgactctttcccagcttccgtctcattacagagtgtttatttttgatgactgtgatactctgtcaacagattgttggaatgctatatcgaaggtcattgatcgagtacctagacgtgtggtttttatccttgtcagttctagtcttgattggattgcaaccaaagaaggtctagaaattgataaggatgccctgaaactcattgcatcaaggtcagacggatctttgagagatgctgagatgacccttgaacaacttagtttgcttgggcagagaatatccgttcctcttattcaggaattggtagggctaatctctgatgagaaattggtggatctgcttgatttggcattatctgcagacacagttaacactgtgaagaatttgagagtgatcatggaaactggtgtcgagccattggctttaatgtcacaacttgctacagtaattactgatatacttgctgggacctatgatttcacaaaagaaaggcgaaggaggaagttcttccggagacaaccattgtccaaagaagacatggagaagctgcgccaagctctgaaaactttatctgaggctgagaagcagttgaggatgtccaatgacaagctaacatggttgacagctgccttacttcagcttgctccagaccagcaatatgtgttgccaacttcatctgataatagtttcaaccacagtccctttgctttaaaagatgcagatgcaagagaagcagctagactgactggtaatcctgttgacattcctaacaaagggagacggttatcaatggatgctagaattgaaaatttccatgctggaagctcagcagatggtatgacaaggggtcttggttctgagaaaaaacgacatagcgtgtctggttttactcctcaacatgctcattcacaaaccactgataagattaggatgagcgagaggcagattttgggtaaaaaccataaagaaattgaagagatatggttagaggtacttgagaggatacaagttactggtctgaaagagtttctgtttaaagaaggcaagctgatctctgttagttttggggcagctccaactgtgcagctaatgtttagttctcaattgaccaaatctactgccgagaagttcagaggtcatatcttacaagcatttgaatccgtccttggatcttctataacaatagaaattagatgtgagttaaataaagatgcagcctcggctgttcaacaacctcttacattgcccgctaccaatgatagttcgtcccagattagagactttaatggtgttggcactctagctcatccatcagtaactgattctgttgaaaagagaaggggtgaaattgtagaagaagcagcttctcaagtggagcacatgaatagcgagcagcaggttgatgctcatggaacatcttataaaagtttagaaggtacaagtataggacaatcatcagcttcccaaaaaatgccaattgttaagtcgcatttagacgaaagaaagcttatggagcaaggtcaaagtcggagtcttgtaagaagcaaagtatctcttgctcatgtgatccaacaggcagaaggtcagagaagtgggtggtcaaaacgtaaagcggtttctattgctgagaagcttgaacaagagaatctggcgagccctggtgcagcggtaaagttgtgccttggtgacttgttggtcatgggttcgaatccggaaacaatgggttcgaatccagaaacaacctctttgcatatgcaagg

SEQ ID NO: 15042 - DNA, 387 bp, Glycine max
  Peptide Sequence Number=SeqID_131820
atggggttgtcatatgaatatccttccaatttctcaagcacgatatcgtccatccgtgcttggactccatcaaggagctatgaaggcattcggaatcttcattgtgagtctgactccactactactccacttcaattcatcgcggatgctgtggttcgttctcacccctactacccaattgtcctgaaaattcaaagcttaatcacccttcaatggcagctccatttttctcacactcttcgtgaagctaatagctgtgctaactcccttgcaaagacaggtgcatctgaagattctcatttggtgattttggggaatgcgccgtccaacttatctacatctcttatggcagatgctcttggtgttttcttcaccatgaatagatag

SEQ ID NO: 15043 - DNA, 501 bp, Glycine max
  Peptide Sequence Number=SeqID_131821
atggcgaagagcactatcccactggagactggaaaaagttcactgccaacctcacaatcaagttgcacggccaggttctctccgggattatctctgcctcaaatctgtgataatttcttcaaggcagcttatgatcctcgaatatccggcatctatctccatattgatgttttaaattgtggttgggcaaaggtcgaagaaattcgaaggcatatcttgaatttcagaaattcagagaatcttggaattgaaccagaagtggaaaggattggcaaatacaaaagtgttggagatcagcttacccgtaaaaccatgtctgaagatcatcatgagatgtttactgcattgcttgataatatctatacaaattggctggacaaagtctcttctgctagaggaaagaaaagagaagatattgagaacttcataaataaaggtgtctatcaagtagagagacttaaagaagagggtttcatatcagacataatctatgatgacaag

SEQ ID NO: 15044 - DNA, 210 bp, Glycine max
  Peptide Sequence Number=SeqID_131822
atgaagcagaggcttaaagaacgtgatgtaacatttcttccaaaaggggggagcaaaaagaaagagagaaatgaagaaaaagtagaaggcaaacagctcaaacgcctgaatcagaaaaaaggaaggcgacccgtttggattattaaggctcagatctctcagcaagcttcacgagagcgagaaaacgatagtctcaactcgaacccatga

SEQ ID NO: 15045 - DNA, 489 bp, Glycine max
  Peptide Sequence Number=SeqID_131823
atggagccattcggtgcagaggaatgtcacagcagtgaatctggatggaccatgtatattgggtcctctatagatgatgctggtggacatagtactgatgatggtgatggtgatgatgacaatgacgacgacgacaaagaagaaggtactcaagctcatccacaagatgatgatgaaagtgatgattctatggcttctgatgcgtcttctgggccaagtcatcatcatggctttgcggatttccggcgagattctgaagagggaaatcatgacaagtattgctttgagaagaaagcaagtaaaacccaacacaagcaaatggaaggggaaaaggtggaaaagaaagggatgttaccggttgatagcaaagataagtctccagttcagggttgtggcaagctgcaattactgtgtagtcaattgcatttccatagttgttgtgatagtaatggccatttcactatattagctacagcatgcaaggattaa

SEQ ID NO: 15046 - DNA, 1104 bp, Glycine max
  Peptide Sequence Number=SeqID_131824
atgggagcaatgagtgataatggaataagccgcagcagaaagaagtcatcatcaagagggcaccacaggtttgtaggggttcgacaaaggccatcagggagatgggtggctgagatcaaagactctctacaaaaagttaggctttggcttggaacatatgacactgctgaggatgcagctcgagcatatgataatgctgcacgagccttgagaggttccaatgctagaaccaactttgagttgcctgagtcagcttcttctggtggtgctaataagcgtggtggttccaagtttgtgcctgaatgcactgaacccttttcttttgaggatgtgaatgagccaggttcagatgcagaaggccttcttggtgcacttaaggcaaaactgcttgatggaaagaaagggaagtttgatcagtttcaatttcttggaaattctgctgctcaagttgttcaatctggcatggtttcaagatcaagtcagaattgttctgggaagaaagagttattattaccaataccatcatcttcagctaatgatactgttctcacaaggatgaattatggaactggaaccagccctgtgcatggtgtgatgagtactttagcttcatcaaacacttgtgctaataagagtgtggttatcccaaatcatgattatcatgaaggagctgtagcaagcacaagcagtggtagagtcaactctcatcaactttgtcaaaccccacctgtggcaacatggcccagtgaagtggcatatgatttgccttggcctacacaatatatgagccaagttcttcctgataatggccttcttgcatcttccagcactgctgcagccaccttgactaatatatggccactttctggggtaattgagtctactgttgatatgacatgcatggatcagggaccatcaagtagcaacaaaagtggccaaatgatgaatatggtgagcatgcagttgcctctagttggtggtgcaaatgaaggtctttggacattggagcagcaacagtttgtgcaatgtgaccagaacaacagctggtttagttttaatggatcttgggatcctctcctctatgttccctctgagctagcctga

SEQ ID NO: 15047 - DNA, 459 bp, Glycine max
  Peptide Sequence Number=SeqID_131825
atggcttgtcggtggaaatcagccacaagaagactcttatgcattgatatcatacttccaggaagaactccaaatgatgtgaaaaactactggaacacctacattcgaaggaaggtatcatcatctcacaaggtggtgatcaatgaaaagcaagagaaaacaacagtgaagcctcatgtggtgataaagcctaaggctcgaactttctcaagaccttcaccctccgggttgagagggagtaatgttcttagagaagaaggtggtgagagtggggccaaacactgctcaactcatcatcaagcatgtgcagcttcatcagagtgcattaataattggagtactgatcagtggtggaaaactatgatgcacgacaagggggacaacttagacaacaaccaatgcttgttggcctaccaggatgaggttgggaagctaaaattcataatcctcttaagttaa

SEQ ID NO: 15048 - DNA, 693 bp, Glycine max
  Peptide Sequence Number=SeqID_131826
atggatgcagaagaagtcttgaagctctttgattcatgctggttcgggcatcaaaatttgaaggaacacacaagttcatcaacaataccaacaagtcttcatgagaattcttcagatcataatcaaataaaagaaccatcagaaccaacacttttacgcatccaaagcggtcatagcagatccatgagcgaccagttgagttccatgacatgtttcaaggacgattctctctcaccagactcagttttctcaccaaagcttcaaaccattctctcaggaaaagatgtcacagacgcagaagcagcacatgtgcagcttcaactactagtgttgcctaagaagagggaaaggaggaagaaaagaccgagcaagagtttatcagaccttgaatttgaggagctgaaagggttcatggatctggggtttgttttctcagaggaagataaggactcaagtttggcttcaatcattcctggcttgcaaaggctagggaaaagtgatgaggaagaagaggattctgaattagggtcctcagtccaaagaccttacctctctgaagcatggaaggctcaagaaaggagaaagaaagagaaccctctcgtgaattggaagattcctgctctgaacaatgaaattgacataaaagatagtctcaggtggtgggctcaaactgttgcttccactgttagatga

SEQ ID NO: 15049 - DNA, 1692 bp, Glycine max
  Peptide Sequence Number=SeqID_131827
atggcccctgctgcgtcttctccaccaccaagcttcgctctctccatcagagacgaccaccgcaaagacgaggagagcaagtgcgcttaccttgtggtagctctctgcccttgtctctttccgtttttgaatagtcctaggacatttgctagtaatgctgattctggggttgagaatgatgatgatgatgatgatggtggtgatggtgataagggttatgatggtagaggtgttagtggtgaatcatgtgcagatcctgttgaggttgagagggtatgcaaggtgattgatgaattgtttgcgttggataggaacatggaggttgttcttgatgaatgtggggttcggttgtcccatgatttggttgtggatgtgctgcaaaggttcaagcatgctaggaagccggcctttcggttcttttgttgggctgggaagaggcctgggtttgctcatgattctaggacttataacttcatgatgtgtgttcttgggaggactagacagtttgagaccatggtggcaatgcttgaggaaatgggtgagaagggccttttgacaatggagactttctccattgctatcaaagcctttgctgaagcaaagcaaaggaaaaaggcagttgggatctttgatctgatgaagaaatatgggtttaaggtgggtgttgatgtgattaatttcttgcttgatagtctcagcaccgcaaagcttggtaaagaagcacaagctgttttcgagaagctgaaagatagatttacacctagtttgcaaacttacaccatacttcttagtggttggtgcaggttaaaaaacttgctggaagcagggagggtgtggaatgagatgattgataggggatttaaccctgatgttgttgcacataatgttatgcttgaaggattgttgaagtgtaagaagaagtctgatgccatcaagttgtttgaaatcatgaaggccaaaggtccttcacccaatgttcggagttatacaattatgatacaggacttctgcaaacaaaagttgatgggagaagctatagaatattttgatgtaatggtagatcgtgggtgtcaacctgatgctgcactttacacgtgtttgatcactgggtttgggaggcagaagaaaatggatatggtatacagtctactgaaggaaatgagggaaagaggttgtccacctgatggaaggacctacaacgctttgataaaactgatgactagccaacatatgccagatgatgcagtgagaatatacaagaagatgattcaaagtggcatcaaaccaacaattcacacttacaacatgataatgaaatcctattttgtgacaaaaaattatgaaatgggtcatgagatttgggatgagatgcatcagaaggggtgctgtcctgatgataattcctacattgtatacattggtgggcttataagacaggacaggtctggtgaggcatgcaaatatttagaggaaatgttagagaagggaatgaaagctccgaagcttgattataacaagtttgcttctgatatttctaagactgggaatgctgtcattcttgaggagttagctcgaaagatgaattttgttggtaagtttgaagtgtctaatgtcttggctagttgggctgacatgatgaagaaaagtgccaagagaagagagcctacaacatctgctaggcaatttacatga

SEQ ID NO: 15050 - DNA, 300 bp, Glycine max
  Peptide Sequence Number=SeqID_131828
ggggtctgttattttactacaaagcgcctacctgaggagcgcgtttcaccagaacgcgacacgtggcttgtctggacaggacgatgtgacaggggtggtcgtgcctgcctgccaggcgctaccagtcgtgcctacctgccaggcgcgaccactagtggtagcctggcaggcacttccactagtggtgggccccctgacacgtccctgttccctataaaaccatctgccctccgtttcattttcacacaaaaatcaagctcatttggaaaccttgaagctgagttgaaacgtaccgattag

SEQ ID NO: 15051 - DNA, 1068 bp, Glycine max
  Peptide Sequence Number=SeqID_131829
atgtatccatcggattctgaacatctctttctccgtcgtggttgcacttgtactcactcaatccgagaccaaaacggcgccatgcctaccgtcagtgtggggcgggatcgcctgtttgcggctctaggaaagacttacacgcaagaggaattcgaagacttgtgcttcagtttcgggatcgagcttgacgacgtcacgacggagaaggcaattgtgagaaaagagaagcatttggaggaagaagaagctgatgaggacgaagaagttatctacaaaatcgaagttcctgccaacagatatgacctcctgtgccttgaagggcttgctcaagccctccgagttttctgtgagttccaggagattcccacttacaaactgtccaagatcagtaaggatgcaatgctgaaaatgcacgtgaagccggagacttctctgattcgtccatatgttgtatgtgctgtattaagaggtataacttttgataaagcaagatacaacagctttatcgatctccaagacaagcttcaccaaaacatatgtcgccgaagaacccttgttgccattggaacccatgacctggatacattggaggggcctttcacctatgaggctttgccaccttcaagtataacttttacgccactaaagcaggaaagaaacttcagggctgatgatctaatggagttctacaaatcagatttgaaactcaagaaattcttgcatataattgaggattcccctgttttccctgttatatatgacagtaagagaactgtgttatccttacccccaattattaatggtgcacattcagccatcactctggagacaaagaatgtaacagccttctcagaatattgtgaaaacaaatttgtcattgaaccagttgaagttatttcttctgatggcaagtcaaacatataccctgatttatctgtctacaatatggaagtttctctatcttacattactggattgattggggtatcattggaagcagaagaggtaattattttgctgcttcatatgagtggcgtgatcctgtacttgcaaattgactattcataa

SEQ ID NO: 15052 - DNA, 1965 bp, Glycine max
  Peptide Sequence Number=SeqID_131830
atggcacaagatactgtttctggagttgactcgcctcggggacgtctattacgagatcaggttcaagtggttaaaaaaaaggattctgatcgctatgaaattgttcctatccaagattctttgtcatttgagaaaggattcttcatatttatccgtgcatgccagttgttggctcaaaagaatgatggaatcatattagtaggagttgcaggtccatctggagcagggaaaactgttttcaccgagaaggtcctcaattttatgccaagcatagctgtcataacaatggacaattataatgattctagtagaattattgatggaaacttcgatgaccctcggttgacagattatgataccctgctcgaaaatatacagggtcttaaagcagggaagcctgttcaagttccaatatacgatttcaagtctagttctcgcataggttacagggcaaaccctgtcgcaacggtaaagttgcaccttgaccagttggtcatgggttcgaatccagaaaaatctctttgtatatgcaagggtaagactgtgactgttgaagtccctggctctcgtattgtaatcatagaaggcatctatgccttaagtgaaaaattacgacctttgcttgatcttcgtgtttctgtcactggtggagttcattttgatcttgtcaagcgtgttttgcgggacattcatcgtgccggtcaagagcctgaagaaataattcatcaaatctctgaaacgtcagcaagaactgtgacagttgatcaaataaaggcagttattgctgcagagcatactgaaactaaagaggaaacatatgacatatttcttctaccccctggggaagaccccgaagcttgtcaatcatatttgagaatgagaaaccgtgatggaaagtacaatctcatgtttgaggaatgggtgacagatagtccattcataatatcacctagaattacttttgaagtcagcgtgcgccttcttggagggctgatggccttgggatacacaattgcagctattctgaaaagaagcagccatgtctttcatgatgataaagtgaccataaaaactgattggctagaacaacttaatcgcacatatgttcaggtgcaagggaaagacagaaactattgcaaattttttgcagagaaactggggttggatggttcctatgttcctcgcacttacattgaacaaattcagctagaaaagcttgtaaacgatgtgatggcattgccagatgatcttaagacaaaactcagcatagatgatgacttggtttcaagccccaaagaagccctttccagagcttctgcagataggagaatgaagtatcttaatcgcggtatttcacaatcctattcaactcaaagggacaagattctacctaagctgactaaacttgctataaataacagaagatttgatggaagagcactagaatcccctgcaccaattgctaaccaaggagtcatcactcaactttctgatcaaatttcaacattaaatgaaagaatggatgaattcacctcccgtattgaagagctgaattcaaagttcgctatcagaaaagattcagcaggcagtcaacaaaacttggctttacaggctgaggcctgcaatggctcaggccccacttccttctttgtaactggacgaggcaatggttcattgactggatcattgctacctaattcatcatcatcttctcagttggctaaagagtctcccctgatggaagaggtattagtgattgcacgaggacaacgtcaaatcatgcatcaactagacactctgagcaatcttttgcatgaatactttggagaaaggtcacgcctgggaagaccagaccatacaggaagaatgcgtgaagctgaatccgtcgccgtccccctgcttctgactctggccattggtgctgttggtgtgcttttgttcagaggtttgacatcccaaaaataa

SEQ ID NO: 15053 - DNA, 1335 bp, Glycine max
  Peptide Sequence Number=SeqID_131831
atggggagtgacagcgaggcagagaaggagaagaagaagatgcttgcgctcgctcccattgctaaaccccttgccggaaagaagctttgcaagcgaaccctaaaacttgttcgtagagctgccgaacacaaatgcctgaaaagaggagtgaaggaggttgttaaaagcataaggagaggtcataaaggattgtgtgtgatagctgggaacatatcgccgattgatgtcatcactcatcttcctattctctgtgaagactctgacattccttatatttatgtcccatctaaagaagatcttgcaggcgcaggagcaacaaagaggcctacatgctgtgttctggtacagacaaagcctgtaaagggtgaaattgagcgaggggaacaagagaaactaaagttaccactaccgtcaccggtgacaggccctgagtccgtagcattcgaccggaacggtggagggccatatgttggtgtttctgatggaagaattctcaaatatgctggtccaggcgagggtttcaaggaatatgctttcacttcaccaaacaggaacaagacaatctgtgatgggcttgctgatttctcagaactccaagcaacatgtgggaggccattaggattacgtttcaaccatcaaacaaacgaactatacgtagcggatgcttattctgggcttatcaagattggacccaatggaggggctccaacccaatgctttaaagatatacaaccacaacaagagaatgtgaacactactcttcagtttctcgatggcttggatgtagacgtcaacactggaatcgtttatttcacccaagctagtgctaactacggtttcaaggatgctcaggcactacaaagcagtagagaccaatctgggagcctattctcactggatcccaaaacgaaccaaacaagagtgttgatgaggggtcttgcattggcatctggggtggcagtaagcagagacgggtcatttgtgcttgttagtgaatacttggcaaacagaattcagagattttggctaagagggccaagagcaaattcttctgaactattcttgcaactcactggtagaccagacaacattaggagcaaccagagaggtcaattttgggtggcagtgaatggtgttttaggaccaaatccacctcctaggcccactattttacctgctggagtcagaattagtgagaacggtatcattttacggattgtttctcttgtccaggagtttggtagtgaggcagtgagtgagattcatgagcataacgggacactctactctggctccttgcaagcttcctatgttcccatttctgctatgatctag

SEQ ID NO: 15054 - DNA, 801 bp, Glycine max
  Peptide Sequence Number=SeqID_131832
atggtgcctgtggtcacattcatgatggcattaccatttgggttagagaccgtgaaaatcaaatgcaaaagtgggagagctaagattcttggttcattggtgtgcataggcggcgcattgatgttgacactttacaaaggcaagccactgtttaatttttctcactatgaatctgtatctcctgtggccaacagttctgcagtgaatctagcttctacaaggacaaagggaaaatggactattggtgtaatagcgttggttttgggaaccatcttttggtcttcttggtttattttacagtcaaaaataagcaagagatatccatgccagtattctagcacagccatcatgtccttctttggggccattcaatcagctgttatttgcttcttcactgaccacaacttgtccatttgggttctcaagggaaagatacaaatcattgctattctatatgctgggatgattggttcgggtttgtgttttgtgggcatgtcatggtgtgtgaagaagagaggtcctgtctttactgcagcattcagtcctcttgttcagataatggcagcaatgattgatatccctgtcttgcatgagcagctccatcttggaagtgtgatggggtctatcttggtgattattggattgtacattcttctatggggtaagagcatggaaatgcagaatcgtgtggtcaagttagtccaagaagctgaagaaaccaaggagcaagaaccgcaaccgcaaatacaacagttgacagtgtatgttcacgcagaatcgtgtgattcgcagtgccactaa

SEQ ID NO: 15055 - DNA, 4563 bp, Glycine max
  Peptide Sequence Number=SeqID_131833
atgacgcacccttcgtcctctgataaaattgaagaactcctcgttcgcctcaccacacagcaacttactctctccagcaaaatcgatgacttcatctctcacattacccctcttttttcccctgcttcccacatgccttcatcccttccacgcccttttcctgttcctgcacaacaccatcgcctcaaattagatgttccacgttttgatggaacggacgcccttggttggatctttaagatcaaccagtacttcgagtatcatgggaccccggagtacgaccgattaacgattgcgtcattttatatggaaggaagggccttagcatggtttcagtggatgaccagtaatggtcaattcacttcgtggcctgttttccttcaagcattacaaaatcgatttgcaccatcacaatatgaggaccccacgggtactctttgcaaactcatgcaaaagggatcagtagcttcttacctctctgagtttgaggatttagcaaatcgtgtcgtcgggattccgccggccttcctcctcagctgcttcatttccgggctgactccggagatccgccgtgaggttcaggcccaccaacccctcactctgtcacaggcggccggcctcgcgcgcctccaggaggaaaagctgggtgacctccgaccaccaccgtccaccatgcgttctcgccctccctcactttcttcttcatccttctcaccacggccgcaacccctttcaccccttttcccttccccgtcagccatacgaccgccacctcctccaccttcccccacccaacctttcaaacgcctgacctctgaagagattgccagccgccgtgagcgcggcctctgctttagctgcgatgagaagtaccacagaggtcaccgctgtgcctctagggtatttctcttcatcgcggaaggggacgctgctcctgacccaccacatatagccccacttgacccgaccctcgaacccgacccggacccaactgaagcccatgacccgcatccggcccaacttagtttaaactccatggccggtcacttagcgcccgaaacgctgcgtttcgtggcttccattgctgacgttgaagtagtgctcctggtggacggagggagcacccacaacttcattcagcaacagctggtcgagaagttgggccttccctccatttccaccaccccgttgcgcgttatggtcggaaatgggcaacaattgagttgcagttgcatgtgccaagctgttgccatcaacattcagaacaatacatttatagtggatttgtatatccttcccatatccggagctaacgtagtacttggggtccaatggttaaaagccttgggacccgtgcttaccgattacaacacactttcgatgcaatttttttcagacggccgcctcattcggctccagggtgacttagatgctaaacttcacctcctcactccggtccagcttcgccggctcagtcgaacacaaggtgatgctctgttttatcacattaccttgctatctaattcgaccccttccctgtcacaggagttccctgccccaattcaggacttgctgcgccgattcgaggctctcttcaccactccttctaccctaccgccggctcgagctacagaccaccacatccacttgatccctcaggcaactccggtcaacgttcgaccgtatcgctacccccactatcagaaacaagaaatcgagcaacaggttgatgctatgctccagaaaggtctcattcagcccagcaccagtccgttttcttcttcggtcctcctggttaagaaacacgacggctcttggcggttctgcgtcgactacagagccttgaatgcgcttaccatacgggatcgttttccaattccaacgattgatgagctccttgacgaattaggcggcgcctgctatttttccaagctggatttgctccaaggttatcatcagattcgtatgaatcctgaggacattccgaaaactgcatttcgtactcaccatggccattacgaattcaaggtaatgccatttggtttgtgtaatgctccatcatcgttccaggcaaccatgaattcgatttttcagccttacttgcggcgtttcattatcgtcttcttcgatgatattctcatttatagcacttccatggatgctcatctgcaacacttggaaatcaccttcaaggtactactgacacatcaatttgccttaaaactttctaagtgtacctttgcacagagacaggtcgagtacttaggccacttggtctccttcaatggcgtggaacctcttaccgacaagattgaagctgtccgtcaatggccttccccgcgcaccgccaaagctcttcgtagcttcctcggattagctgggttttacagaagattcatcaagggctatgctacgattgctgcccccttggtcaaagctaccacattggatccctttcaatggactgatgttactcaggctgcatttgaccaattgaagctcgctctatcctccgcaccggtgttagctctcccggattttcaccttcccttcactattgagactgacgcctctggggtgggcttgggtgctgtgctctctcagaaggggcaccccattgcctatttcagtaaaccctttagtgccaaattgctccgatcatcaacgtatgtccgtgaattgtacgctattacggccgccgtcaaaaaatggaggcaatatttgctcggacaccgttttgtcattctgaccgaccaccggagcttgaaggagcttctcacccaggtggtccagacacccgagcagcacatgtatctcgccaggctcatgggctacgattacgaaatccattatcggtccggtgctagcaatcaggctgctgatgctctctcccgtgttccagaccctgattcctcccttgctctcatgctttcggttccatgcttgaccttcatggacgaactctgttctcagctcgaccaacattctgactatgtgcatcgtcgacaggacattgctaatcatcccgccaaacaccctgggttctctgtggttaacaatcttattttgcaccgtcaccgcatatggttaccacgtgatattcctattattcctaccctcctcgttgaatttcatgcgacccccactgggggccactctggcattgccaagacgattgctcgcgtttctgagaacttctattggcctggtttgcgtgaggatgtcgcgacctttgtggccaactgccgtgactgtcagtccactaaatacgaaacaaagaagcttgctggccttctttgccctctcccggttcctcatcgtccatgggaggacctgtccttagattttattgttgggctgccgccgtacaaaggtcacacagtcatattggtggtcgtggatcgtttttctaaaggggttcatctggggatgcttcctactgcgcacactgctttcatggtggccactttattccaggacatggtggtcaaaattcatggtgttccccggagcttggtctccgatcgagaccctctgtttcttagcaagttttggcaggagcttttccggcgcagtggcactcacttgcgtatgagttctgcgtatcacccccagagtgatggacagactgaggctattaatcgtattatcgagcaatacttacgctcgttcgttcatcggcgccctcgtatttggggccgtctccttccatgggcggagtggtcgcacaacacttcctggaactccgcgaccggggccactccatatgaggtcacctttggccggaagccatttaacttcccggagtaccttgccggtgactctaacattgatgctatagataccctgctttgtgaccgggaggaaaccttccttatgattcgtaagaaattactaaaggcccagattctaatgaaggagaaagctgacaaacaccgacgtgatatagtcttctcgccgggacaatgggtcttacttcgcctgcgccctcaccgtcaaacgtctgcccgggaaaaccccaccatctcgggaaagctggcaaaacgttactatgggccatttcaggttctcgaggccattggcaaggttgcctaccgattacagttaccacctgatgctaagatacatcccatcttccatgtctccatgttaaaaccattcaagggtgatcctaacgaccctgttgctaatccactgccgatttcttttcatgacgatcaccccctcgtccaacctgctgcgatccttgcttctcgaccatcatctgtttctgggtgggacgtcctcgttcaatggcatgggctctcccctgatgagacttcctgggaggattggtcaaccttatgccgggattatcaccttgaggacaaggtgctttcccaagggcccaggggtgatacagggggaaacatagcagagggagacaatcaacagaatgaggtgcaacaagcaatgcagattaacaaccagcaggataaggtgcaacaagcaatttcagaaaacaaagagcaaaggcccaagagaagggtagagagaccaacgtacctcaaagattacatctga

SEQ ID NO: 15056 - DNA, 4128 bp, Glycine max
  Peptide Sequence Number=SeqID_131834
atggccgaacacggaactcgccgtaccaccactgacaggctcgaggacgccatttccatcctctctgagaagcactccgacctagccagcaaggtcaacgccttgtacgagcaactctcccagatacactccacgtcacacccttcaccccagcactccagtcatcctcgacctccagtcaagctcgaagttccacgcttcgatggccacgacctgttgggatggatttttaaaatctctcaattttttgaataccaaggaacgccggaggaggatcgcatcacggttgcttccttctacctcgatggaacagctctcagctggttccagtggatgtacaggaacggtttcatcacttcctggtttgaccttcttcaagctattgagaatcgttttgccccatcattttatgatgatcctcgtggaacattattcaagttaatgcagcgcggatcagtcacggaatacctcacggagttcgaaagattagccaaccgcatcgtcggcctttctccctccattttgctgagttgtttcatttcgggtcttagccccgaaatccgccgcgaagttcaagctttgcaacccgcttcactccctcacgctactgctttggcacgtctccaagaggataagataactgaccgccggagatcctctcgaccttcgttctcttccccacacacaccaactccaaccctatcctctcagccatccacctctagacctcgccctaaaacaccttttatccagcgaactcaagaagaaatgacgtatcggcgtgaaaaggggctttgttacaactgtgatgagaaatggaactcatcacaccgttgtaagggccgcgttctcttcttcattacggcctccgacgaccctcccttttccgataccacctcaccagaagtcacaacacattcacctaacgagccttccccttcctttgaccccacatctcttcatcctcacatcagtttacatgccatggccggcgtcccagcaacggagaccttccgcctttatggtctggtcaaccatgcgcgtgttacaatcctggtggatagtgggggtacccacaactttatccaacctagggttgccaagtttttaaacttaccattggaagccacaactccccttcgcgtgatggtgggcaacggttccgttttggactgccggcaactttgcccagccactaagctgctaatccaagatcactccttcaccataacactacgcgtcctaccattaagtggagctgacattgtgttaggtgttgagtggttgcgtaccctgggcccgatagttacggattattccgcattcaccatgcacttcagccatcaaggacagcctatcaccctccgcgccgacgttcagtccgatactgacccggtctcggctaaccaggtgagatgtatgttacatactcagtcaacctctgcacttttccacttatccttactacccgttaactccattgaagcacctccagacccacctcaccccatttctgcaattaatgccctcttactccgtttcagttccttattccaacaaccttctacccttccccctcctcgtaaccacgaccaccatattaaccttctcccatcagctagccccattaatgtccgcccgtatagatatccgcattttcagaaaaccgaaattgaaaaacaagtcacagccctgcttgaatcaggattcatccaaccaagccgcagtccatactcttcccccgtcctactggttaagaagaaggacggcacatggcggatgtgtgtcgattacagggcgcttaactcaattacagtgcgagatcgcttcccacttccaactatagacgagctccttgacgaacttggccgcgcttcctggttctccaaaatagatttacgtcaagggtttcaccaaatattaatggccccagaagacgtttctaaaactgcttttcgaactcaccatggacactttgagtatagggtcatgcccttcggcctctgcaacgcgccgtcgacattccaggccgcaatgaacgccgtgcttggtcctcacttgcggaagtttgcaacggtgttctttgatgacattctcatctacagcgagactctcccagatcatgttcatcacctagagcgagttttcacttcattaactcaggcccaatactatcttaagcgttccaagtgtctcttcggccagcgcaagctagactatttgggccacgtcgtctccgagaagggcgtccaacctgacccttctaagatacaagctatcctcgattggcctgcacctcgatcagccaaagaactccgagccttcctcgggctcacaaggttctaccgaaaattcgttaaaggttacgccgcgattgcaacacccttaactcgcctactttgtagagacgctttccagtgggtaccagaatcacaggaagcctttctcgcgttgaaacgtgctatgacggcagccccagtcctcgccctcccggatttttccttacctttcgccctggaaacagatgcttccggcacggccatgggtgccgtccttcaacaacaacgccatcctatcgcgttttttagcaaacccttctgccctcgcatgcaacacgcttccacgtataagaaagctattcaggctcacccagaggatcacccccacttcaccatcgccaacgagctcattttcttcaagaatgccatctggattgactctcgcaatccattcattcctgcattattacatgagtaccacgcaacccctctcggaggtcactttggtgtcaagaagaccctccaccgtcttcgttctaatttccagtggaccaccatgattgctgatgttaagtccttcatccgcgaatgccgtgtctgccaacaagtcaagcacgtgactcgcaagtcagctgggctccttcaaccaatctcaccccccactggtatctgggaagacctctcgatggactttatcacccatctcccaagctctcacagcttcacagtcattttggtggtcctcgataggttctcgaaaggcctccatcttggtgctttgccaactcagttcacggcttttaaagtagctacacttttcctggatatcgtgtgtaagctccacggtttcccttccagcatcatttatgatcgcgatcccgtgtttatcagttccttttggcgcgagttgtttaagcttagtggcaccaccctccgcatgaccaccgcctaccaccctcaatcagatggccaaacggaggtgatgaatcgcagcgtcgagcagtacctgaggtccttcgtccacaaacgcccagaggaatggcataagtttcttcccctcgcggaatgggcgtacaatacctcgcaacactccggaactggggtcactccctacaaagttatttacgggaaacccccaccttccattccgggatacgtcttggggtcctctcgaaatgaggccgttgacacccttctccattcacgagctgagcttcacgaatcccttcgccgcaacctcctcaaagcacaagccgagatgaagcattttgcggacaagaaacgccgcgatgttcagtacgagatcggccagttagtctatgttaagcttagacctcaccgtcaacagtccctccgttctcagcgtcaccataaactcatgaagcgatacttcggcccatttcccattatggaacgcattggcagcgttgcttaccgtttgcaactacctgaagggtctcgtatccaccccgtcttccattgttctttactacgccctcatcacggacctcttgacctccccacctcttcccttccggcggatacttcctccccacaccctatacttgagccactagccatccttgactctcgaatggacttctctgtagaccccccaactcgtttcgttcttgttcaatgggttggtcttcctccggaagactccacgtgggaaaagtgggacgaggtttgccatgctcatcaccttgaggacaaggtgagtttcacagggtcggatgatgttagcagcagcaacccagctaaggaagatagcagccacgatgaaccagtaccacgaagacaaaggagttccacacgtccgaagcatctagaagattacgtgttatag

SEQ ID NO: 15057 - DNA, 802 bp, Glycine max
  Peptide Sequence Number=SeqID_131835
atgcaaaaggctttaaggaggaccgtttgggtgccattgcaccagctcctgcagggcgtgcaacccaagtcccctccctcttggatcagctccaacatttgcacctttgcacctaagggcggaggtggtggaggtccacccccaggaggtctaggagccccaggaacaccagggggaggtggaggaggaggacctcgaccaccgggagtaggtggaggaggtggtcctcgaccaccaggaggtggcggtggaggtggtgctccatacattggaggaggcggaggaggtggtcctcgcccaccaggaggtggtggtggaggaggtggtcctcgcccaccaggaggtggtggtggaggaggcggtcctcgcccactaggaggtggtggtggaggtggtgctccatacattggaggtggtgctccatgcattggaggaggcggtggtggtggtggtgctccacgaattggaggaggtggggcaagtagggttccatacattggaggaggtggaggtggggctccactcgaaggaggaaggggtggtgggggtggggctccactagatggacgaagaggtggcggtggggggagggggactctagacaatggaggaggtggaggtgggggtggggctccacttgacgaaggaagaggtggtgggggtggaggtgtgggtggagatggaagtagtgaagctttaccaaaaggagggggaggtggcggtggaggtacaggtggtggagctgaatatatatgtgaattagctaagggtggtagagggggaggcggagggggaggtggag

SEQ ID NO: 15058 - DNA, 672 bp, Glycine max
  Peptide Sequence Number=SeqID_131836
gtcattacggattcacaattcgtaagaccatggacctttgcgacaaggttggtggcgacaaagtacgcaagtggtgttagagggagacactccacggcaaggttggagcgtagggagacactctacggcgaggaggtggcggtgatctcacacgacgatgaaggagctggcagtgacctcagtagcctcgagcgactcccgtgtggtgatgttattgagcgagaccagagggagggcgatggccatgaaggaggtggcggtgatgcggcgcatcggaggttggagcaacgggtggtggtggtgggcgatgacagtggtaaggaggtggcggtgctggggtgtgacagaggtggcatagcggagttggagggttacatggtgttgaatttggaccttcaaaaggcgtatgataaggtggaatgggattttactcttgataccctcagcaaggttggtattccgccttggatggctaatgccattcatgttcatatgtcttccacatttatggcgattaattggaatgagattggcacatctcatccaagattcagttcagaatgtgtagcagctggggaagtcaaccagatattaaacccttttgctaatgcatctagccagaagatcaacatgagcaaatcaaaggttctcttctcaactaatgtctcataa

SEQ ID NO: 15059 - DNA, 297 bp, Glycine max
  Peptide Sequence Number=SeqID_131837
atgaataaatttgagaggcttgaggcagggtggagcaataagaagaagaagaggaataacgataacagaatacttgtaatccacttcctgctaggcaaaaccagtagcacatggtgcgtcgggaacaacaaaacgagaaagaaaggagtatggacttgcggtggtgcgaagagtaagaggttgcggttcagggttcgcgacggtggacagaaagcggtgctaggaggtcctgcggcggattgcgtagcggcaacgggatgtttcggggtttcaaatcgggctctgattgtaggttga

SEQ ID NO: 15060 - DNA, 618 bp, Glycine max
  Peptide Sequence Number=SeqID_131838
atggaaaacatagacccctcaaaattttcacaccaatctcaaaaccaaaacaagaataatcttcccttgatgcctattgaaatagacaagtcctataagaagagagccataaaggttccaaaagtagcaaacaagagtgagaaaaagtttcttggggtgagacaaagaccttcaggaagatggattgctgagatcaaggactcctcacagaaactaaggctttggttaggaacttttgacaaagcagaagaggctgccctggcttatgactgtgctgcaaggcttcttagagggagaaatgccaaaacaaactttccaaaccatggaaccatgaacactcatgaagaagattgcagccttttgggtaagaatccaagggcctaccaacttcttaagcatgcagtcatgaagaaccatgcactttcatcatcgctttattccacagtcgtgccttggaaaaaccagatcatgatgagagacgagtttgactcccttgttgaggaaactatactccttctttcagtgcttcctaaactactaatactggcagatggggatgatggttacattgggccaaatcagtgtgctcattcccaaaagacaaaaatgagggaatga

SEQ ID NO: 15061 - DNA, 471 bp, Glycine max
  Peptide Sequence Number=SeqID_131839
atgaagaatggagatagtggcactcactcagattcatttcattacattgagaaagatggaggcgtttcacactcacagtcaggagaagaaggtagctctggcacggttacagtgtacaagcaatcttcttcataccctataacagctccttcacctctatctggccttccagaattctctcacttgggttggggtcactggtttaccttgagggatcttgaacttgctacgaaccgtttttccaaagaaaatgtcctcggtgaaggcggctatggagtggtttataggggacagttgatcaatggaactccagtggcagttaaaaagatacttaataacacaggtcaagcagagaaagaatttagagtagaagttgaagctattggccatgtccgacacaaaaacttggttcgacttttggggtactgcattgagggaactctcaggtatcacagttctcaattacagtag

SEQ ID NO: 15062 - DNA, 462 bp, Glycine max
  Peptide Sequence Number=SeqID_131840
atgaattgcatgcttattaatctgctactcggtggttggatgttagtttatgagtatgtcaataatggaaacttagagcaatggcttcatggagctatgcgtcaccatggataccttacgtgggaagcacgtatcaagattctccttggcacagccaaagcgctagcgtatttgcatgaagcaattgaaccaaaggtggtgcaccgtgatgtaaagtcaagcaacatattaattgatgatgatttcaatgccaaggtttctgattttggcctggccaaattattgggtgctgggaagagttatgtcacaacaagagttatgggaacttttggatatgtggctcctgaatatgcaaatactggccttctaaatgagaagagtgatgtttatagctttggtgttttgctattggaaggaattactggtagagatccagttgactatggtcgaccagcaaatgaa

SEQ ID NO: 15063 - DNA, 231 bp, Glycine max
  Peptide Sequence Number=SeqID_131841
atggcaacagcagcattgtcttcaattgtacagcagcaacaagcagagccagaagctgttgctgttccaagccctagtgcgtggaaatcctcaggatcttttggtccattctttgccgtcataactgtgtttataattctctctgttctttcgtgctatttgggtcgcaagtggaaccgaaggccgatcgaaaacaccattggagagtatcagaggaagtggcttttttga

SEQ ID NO: 15064 - DNA, 2214 bp, Glycine max
  Peptide Sequence Number=SeqID_131842
atggggactgaaaatcctggtcgtccaaccttccctccttcaagacctgcttcatcgccttttgccgctgcacagacagtgtcacctttttcgtcaaccggtcccgtggctggatcagagcctccttcttttcgccctagtccttctgctcctccaccgcaaggcgccatgcggttttcgtcggctggacctgctgcagttagacccggagcacccagttttagacctgcaccaccagggaggttcaatgatccatcagtacctcctccagtgggaccttccaatgccccaccggctgctggacctttccagcagtttccgccaccgccttttcccccaacaatgcagccacgtggtcctccgcagccaatgttaccgccatcaattcaatctccacctagtcaagcactgccttttcccacgtctcttccggctcaaccacagatgccttctgttccaatgggctctcccccgccgccgccacaaagtgctgctcctgcacatttaggttcaaattttcctcctccgccacctacaattcagccatcttttcctgggtacccgagtaagcatgccagtcctgaaatgcaagctccacctatgcactcctcgttccctgctaatcaaggaaattttgggcctgtcccgcctgcggcttcttctccttttttgtctcacccaggaggttatgttccatcacccccaatggctcccccactaggtatccagccaatgcagcagccaggatctgtgcccccaatgggtgccattcagggcttggcagaagacttcaacgcactcacattgcaaactcgtcctggaacaatggatccattatttgatgccaaggaacttccaaggccattggaaggtgatgttgaaccaaagaatttggttgacatgtatcccatgaactgcagtccccggtatctacgactcacaaccagtgcagttcctagctcccagtccttggcttcaaggtggcatcttcctcttggagcagttgtatgtccgcttgctgaacctcctgatggggaagaggtgcctatagttaattttgctccagctagtgttgtccgctgcagaagatgtcgcacatatgtgaatccttatatgacatttacggaagctggaagaaagttccgttgcaacatctgtaccttgcttaacgatgatgcaactggaaaaagagttgatataaatcaacgacctgagcttacaaaggggaccgtagaatttgttgcccctgctgagtacatggtgcggcctcctatgccaccagtgtatttcttcctcattgatgtttccatatctgctgttagaagtggcatgattgaggttgtagccaatacaataaagtcatgcttagatgagctgcccggctttccacgtacgcaaatagggtttgcaacttttgacagcacaatacatttttataacatgaagtcttccttgactcaaccacagatgttggtagtgtcagatctcgatgatatatttattccactgccagatgatcttctcgttaacttgtctgaatcaagaaatgtggtagaaaccttcctagatagtttgccaaccatgttccaggacaatgtaaacttggaatcagcttttggtcctgctcttaaggctgcatttatggttatgagtcaacttggagggaaattgttaatatttcaaaacacacttccatctcttggtgttggccgcttgaagttacgtggagatgattctcgtgtttacgggacagacaaagaatatggattgagactgcctgatgatccattctataaacaaatggctgctgagttttccaagtaccaaatctcaacaaatgtgtatgcattcagtgataagtacactgacatagcctccttaggaactctggcaaagtatactgctggtcaagtgtattactacccagctttccaatcagccattcatggggagaaattgagacatgaattgaggagagaccttaccagagaaactgcatgggaagctgtaatgcgcattagatgtgcaaaaggtgttcgcttcacaacttatcatggaaacttcatgctgaggtccactgatttgttagcacttcctgctgtagattgtgataaagcctttgccatgcagttatcacttgaagagacattgttgacaactcagacaatgtatttgcaagtagcattgttgtatcctttctttgataacttttga

SEQ ID NO: 15065 - DNA, 486 bp, Glycine max
  Peptide Sequence Number=SeqID_131843
atgtcatcaaagcttcaagttcagcagcttaatcagttaagggagattttcggtcgatttgacatggactcagatggaagcctaacaatgctagagctagcagcacttcttaggtctctggggctgaagccctcgggtgaccaagtccaagcactgttagccaacatggactcaaacgccaatggcaaagtggagtttgatgaattgataagagccatattacctgacataaatgcacaggttttgctgaaccaagaacagctcctaggggtgttcaagtgcttcgatcgcgacggcaacggttacatatcggccgcagagttggccggggcaatggccaaaatgggccagccactcacgtaccgagagctcacggagatgatcaaagaggctgacacggatggggatggtgttattagcttcactgagtttgccactatcatggctcgctctgcttctgattttctaggcctctcgttctgctga

SEQ ID NO: 15066 - DNA, 342 bp, Glycine max
  Peptide Sequence Number=SeqID_131844
atggcatggccattgcatggagaaaagaacagaggtggttcaggaagtgcttcagagtttaaaacagagaaaataatggtggttgggtgttgccaaaaatactggaggatgaaaatctctaatttgcccccaacaaacccccaaaatgtcacagcattgaggcaaaatgggatttcaaaaatgcttccctgtagcgccataatagctggttattttcactgtgattgcaactgcagtcaccattcaaaaatgcaccatcatgcaaactttgtagcagcccaaggctgcactacaccactataccacactatcaatgaacgtcacacaaaagctggccattga

SEQ ID NO: 15067 - DNA, 3684 bp, Glycine max
  Peptide Sequence Number=SeqID_131845
atggctggggggagaaggaggaggcaccacttcagcagaatccatgcattcacgtgtgggagagcttctatgaaagaggagcattcactaataggaggccctggcttctcaaggaaagtctattgcaatgaccctgaacatgccacagcgagtcttctcaattatggtgacaattatgtcagaacaactaagtatacattggccacgttcctccccaagtccttgtttgagcagttcaggagggttgccaatttctacttcctcgtttgtgcagttttgtctttctttccggtgtctccttactcaggcatcagtaacgttgtccctctactggttgtggttgccgccacaatggtcaaagagttcattgaggattttagtaggaaaaaacaggatatagagatgaataacagaaaagttaaactgcatcgtggaggtggtgtttttgactattctaaatggagggatttgaaagtaggagatgtagtgagggtggaaaaagatgaattttttcctgctgatctcatcttacttgcatcaaactacgatgatgcaatttgctatgttgagaccatgaatcttgatggcgagacaaatctgaaactgaaacaagcactggaagcaacttcaaagttgcatgaagactcaaactttcagaatttcagggctgtcatcaaatgtgaagatccaaatgcaaatttgtacacatttgttggtagtatggagctcgaggatcaacagtaccctcttgcacctcaacagctactgcttagggactctaagctgaggaacacagattttgtttatggcgtggtaatatttactggacatgatacaaaggttatgcagaatgcaacagatcctccatccaagagaagcaaaattgagaaaaggatggataagattatctactgcctcttctttgtacttattttaatttctttcattgggtccatattctttgggattgcaacaaatgatgaccttgaaaatggaagaatgaagagatggtaccttagaccagatgataccgaaatttactatgatccaaatgaaccagtagctgcagcaattctgcatttcttcacagcacttatgttgtatggttacttgattccaatttccttatatgtatccattgaaattgtaaaggttcttcaaagcgttttcatcaaccaggatgtgcacatgtattatgaggaaactgacaagccagcacatgctcgtacatcaaatttgaatgaagaacttggccaagttgataccatactttcagataagacaggaactttgacttgcaattctatggaattcattaagtgttctatagctggggttgcttatggacaaagagttacagaagttgagagagctctatctgggagacatgaatcacatccaggccaagtgttggaaaagatcagtgaatcaaagtcatccattaaagggtttaactttatggatgaaagggtcatgaatggaaattggatcaaagaacccaatgccaatgtaatccagaatttcctacagttgctggctgtatgccatactgcaatacctgaagttgatgaagaaacaggtaaggtttcatatgaagctgaatcaccagatgaggcagcttttgtgatagcagccagggaacttggatttgaattttatgaaaggacacatacaactatttcactgcatgaattggaccccatatcaggccagaaaatcaacaggtcctacaaacttttgaatatattagagtttaccagtgcaagaaagcggatgtctgtaattgtgagagatgcggagggaaaactattgctacttagcaaaggggctgacagtgtaatgtttgaacgaattgcaaagaatggaagggattttgaagagaaaacaaagcagcacattagtgaatatgctgattctggtttgaggaccttgatacttgcatatcgtgaacttaatgaggaagagtacaataaatttagtaaagagtttacagaggccaagaacttagtaagtgaagaccaggagcagattgttgaggggatagtacaaaatattgagaaggatttaattcttcttggtgctactgcagttgaagacaaactacaagatgggagggaagcaaggcttgctctctttttatgccggagtgttcaacctaatacaattttgtgtaggggtgttcctgaatgcattgacaagctagcacaggctgggattaagctatgggttttaactggtgataaaatggagacagcaattaatattggatttgcttgtagtttacttagacaaggaatgaaacaaattataattagctcagatactccagaaactaagtcattggagaaaatggaggacaagtctgctgctgaagcggcgattaaatcaagtgttcttcgtcaactaagggaggcaaaagcattactttcgacatcagatgaaaactatgaggccttagccctgatcattgatgggaagtctcttacttatgcactagaagatgatgtaaaggacttgtttcttgaacttgccattggctgtgcatctgttatctgctgtcgttcatctcccaaacagaaagcacttgttacaagactggtgaagatgagaactggtagtacaacactagctatcggagatggggcaaatgatgttggaatgctccaagaagcagacattggaattggtatcagtggcgtggaaggaatgcaggcagttatgtcaagtgatattgcaatagcccaatttcggtttctagagcgcttacttcttgtgcatggacattggtgttacagaaggatttcatcaatgatctgctatttcttttacaagaatattgcctttggcttcactctgttcttctttgagatttatgcctcattctcagggcaagctgcatacaatgattggttcatgtcgctgtacaatgtattcttcacttcacttcctgtaattgcattgggagtgtttgatcaggatgtctcttctaaattatgtctcaagtttccattattatatcaagaaggcgtccaaaacatcctatttagctggaaacggatcatcggttgggcattgaatggagttgtgacttctgccatcgtattcttcttttgcatccgtagtatggaataccaggcattccgtaaaggcggtgaagtcatggggctggaagttcttggtgccaccatgtacacctgtgttgtgtgggtggtgaattgccaaatggcattatctatcagttacttcacttacatacaacatatattcatctggggaagcattctattctggtatatattcctcctggcatatggagccatagacccttccttctcaaccacagcctataaggtcttcattgaagctcttgcaccagccccatttttctggatcataactttgctcattctgattgcttccctccttccctatttcatctatgcttccatccaaatgcgtttcttccctatgtatcaccaaatgattcagtggatgagaaacgacaggcaaacaagtgatccagaatactgtaatgtggtaaggcagcgatcgattagacacacaacagttggattcacagctcgtttggaagcatccaaacgttttgaagcatccagaagagttgaagcattcaatccttttgaagcttccaaacgttcccaagggaagtctgaggacagatag

SEQ ID NO: 15068 - DNA, 2319 bp, Glycine max
  Peptide Sequence Number=SeqID_131846
gtttacgtacttaacccaaagcaagacctgcatggattaggttttgatccttataagcatgctcctgagtttagagagaaaaaaagatcacgcttagccagcaaggggggacctggcttctccactagagatggtctttttggaaaggctgcccccggttttggtattggagctcttgaggagcttgatgcagaggatgaggatgtctatgccactggttacgaatttgaagatgcttatgttcaagaagttgaagaacctttgacattgagattagaaaaccagagaaaagaagttgaagaaccttcgacgctgagattagaaagccatagaaaaaaagagcagaaggaccagggtgatctgcctggttttagagttgcatccaattctgactataaaatggaaagatttgaggctcctctgatccctaaggattttgtgccccaccatgaattttctggacctctcgacattaaccgcaagagctatgaagtcaatccaccagatgttcctcctccagaggatggaaatttaaaactattaattgagggggttgcaaatctggtagctaaatgtggtaaattatatgaggatttatcaagagaaaagaatcaatcaaatccgttgtttaattttctttctggaggaactggccatgaatattatgcaaggaaattgtgggaggcacaacagaaacacaataatcagactagtcggcaattggatagaaaaatgcctcccagtgtgcagaggctaacagctgagagtcgaggccagatcttaggggaaaaacctctagaaaaaagctcccaagatctatcctcgtctgttgcttctacagatattcatctccaatttaatcttactgatacatttatcgagtctgcatcacttagtgagttaatgaatgtggaaaagcctttcaaagatgatcctgcaaagcaagaaagatttgagcagtttcttaaggagaaatataaagggggattacgctctgctagttctagtttagctggtgatatgtcagaagttgctcgtgctcaagagagactaagttttgaggctgcagctgaggcaatagaaaagggacgacaggtcaggggaagcaagcctttaattccatcttccgtggattttatcccaggtggtgttatgcagtttacttctggtgaagtaaagcccaagaaagatctgcaagctgaagatattttgaagaagaaaatgtaccctaagagggaagagtttcaatggcgcccttcacctcttctgtgcaaacgctttgatcttattgatccttatatggggaagccaccacctgctccacggattaggagtaagatggataccttgatttttacatcagattcggtcaaaggtgccaaagtggacgagcctgttacttcaaagaaagacatctcacctttgcagctatctactaataaagacataaccataagtattactgaaaatgaaatggaaggggacgtggaagtggaaaatattgaaaggccagttgacctatacaaggctattttctccgatgattcagatgatgaaggccctagtaataggagagtggagaatcaagaaaagaaagctgaagtagctaatacagcactgagccgtttgattgctggtgattttctggaatcattgggcaaggaactaggaattgaggttcctcctgatatgccttacgctatgcaaaagtccaggaatgttgcacctcagaaagacatctttaatgaagatgcaagaaccgatatcctgaagagtgaaaacaacggtgtgatgtccttaaatcatgatttgccaaatgatcagcagcacattgctcatgagggtgggccatcaaaaggtgatgacaccattgatggaaatatgcttgagagcagtattaacaaaaccaagggaaccagcagccaagacaatgacagctgttcagaagaaaggagcaaaaagcaatctaatagggaaaaatacaatgagtacaggaaagataaaacccctgtaacacacggctgggattatagcagcagttctaagttagaagaggaaaggagcagaaaatgttccagacatcatcggcataagaagcgccatgcaggaagtcattcatctagtgacgatgacagaagagatagacacagttcaaggtcaaaagggagaaggaaaggttcttcccaagaaaaaagcaggagtgaaaaacactcaaaacatcacaagcacagaaagcatgaatctccaaatagatcctctcgttatagcaaagagaaagacaattcacattccagaaaagagaaaaggcggggagaatga

SEQ ID NO: 15069 - DNA, 289 bp, Glycine max
  Peptide Sequence Number=SeqID_131847
atggatttgattctcctcatttctgttcttgcaaaaggcgaggatgagagcgcgtgggagaaggtaactggtaaacgcgctttgggcagtgtgggttgccctaatcggatgcgagcgagaactggttctcttatcctccatgtcttcttcgctcttgcacctcctcttccttccacaactacgatcttcgatagtgctttctcagattcttccttcgtggtaaccggtcgaatcatggagcccatggacattgttggcaagtcaaaggaagacgcttcgcttcctaaag

SEQ ID NO: 15070 - DNA, 585 bp, Glycine max
  Peptide Sequence Number=SeqID_131848
atggagtcagatgaagacgattttgttttctacggaacgccgatagagcgtgaggatgattcaatcagtcgcaagaagaaggccattgccgagtcctccggtcagctccgaactctccccgcttggaagcaagaggttagagatgaggaagggcggagaagattccatggagcgtttacaggaggctattctgcgggttactataatacagtgggctcaaaggaagggtgggcacctcagtcatttaaatcatcaaggaagaacagggctgaattcaaagagcagaacatactgaattttctagatgaagatgagaaaactgaattggaaggtcgttttttggggacaacctcacagtttgacacatttggtttcacagctgctgaaattgctcgcaaacaagctgagaaggaacagaaacagaggccatccataattcctggacctgctcctgatgaaatagttgttccagccactgaatctgttggggtaaaactgctcttgaagatgggatggagtcatggtcgctcaatcaaggattcacattctgaggcactgtatggtatggcttcctattaccattag

SEQ ID NO: 15071 - DNA, 318 bp, Glycine max
  Peptide Sequence Number=SeqID_131849
atggagaagttagccattttgatccaggagcatgttcaacttggtttgtggcaccccgtggttcctactagaaaagtctcgggtatctcatctctttttggcactaccctcctcaaggatttgtcaaacttaatactattgcgtggacaagggggtattagaaacttagttgttgaatcagattcgactatggctttgaaaatgatttctgagggtgtttctattactcatgcttttgcagctctggttaatagcataaggtcttactgtgataagggtaactttgttgctgatagtttggcctccggatttgcttag

SEQ ID NO: 15072 - DNA, 233 bp, Glycine max
  Peptide Sequence Number=SeqID_131850
gcggtggtggtggatcaaagcaagtacggatgaaggagacatcttcttcaacttgtgtgaggcgaatatccatgctggcaaagcgagtgctgaatcttcacgctaaggaggaggtgaaggagtacgctcatcttgaggagggagtgcgtctttcttcagccattgaccattccgatccttacggtaaccaaaagaagtcacaacaccagcaccaattgcaaaggaacgcttga

SEQ ID NO: 15073 - DNA, 360 bp, Glycine max
  Peptide Sequence Number=SeqID_131851
atgtttgcagagacgcgtgctaggatgaacggtggagccattgcttccaagcagccagatgctgaccaaaaagcaatagtgctctgtttatttgttaccttgatgaatacgggaaatcttgaaactgaggcatatcagttcaacctcaccaacatgtgccacgagaattcagtaatggttaacctgatgtcaccatggtgcgcctttacactagaagacatggatgcagcagaagagtgtgcgaagagcatgtcgagtttcaacagtgatggctttgtgttttgtttgttcttagttcttactttagtttattttaatcctttttttaccgttttggggcaccaagtcaaaagagtttag

SEQ ID NO: 15074 - DNA, 1764 bp, Glycine max
  Peptide Sequence Number=SeqID_131852
atggcagaaacagaagacacccttcaagcctcgcctatgaacgaaacagagaagaagatgaagaagaataataagaagagcgacaaaaaaagatctcgggatattgctacagaggagcgtccagaggaagaggagaatgagaataatacagatagcgatggagaatcctcgaagaagaagaagaagaaggtggaaggagaaagtgaagtggaagagaaaaaggtgaagaacaacggtggctctggaattatgagcaccgagtcatttgaatctctgggattgtctgaacctacttataaagccattatggatatgggattccaccacatgactcagattcaagcgagggcaattccgccacttttgattggaaaagatgttcttggtgctgcaaggactggttctgggaaaactcttgccttcttaattcctgctctggagctgttgtacaatgttaagtttacgcctcgtaatggagctggtgttattgttatatgcccaactagagagcttgcaatacagacgcatgctgtggccaaggagctgctcaagtatcattctcaaactcttggattagttattggaggttcagctagaaaaattgaagctgaacgccttgctaaagggataaatttattggtaggaactcctggtcgtcttctagatcatcttcaaaacacaaaaggattcatgtataaaaacttgaagtgtctcatgattgatgaagctgacaggattttggaagcaaactttgaggaggaaatgaagcagatcatcaagatccttccaaagaataggcaaacagctttattttcggctacacaaacaaagaaggttgaggatcttgcccggttgtcatttcagacaactcctatctatattgacgtagatgatgggagaaccaaggtcacaaatgaaggattgcttcagggttatgtcgtggttccctgtgccaagcgctttattgttctctattcctttttgaagagacaccagtcaaaaaaagtgatggtctttttctcttcatgcaactctgtcaaattccatgcagacattcttaatcttattcaattgaattgctcgagtattcatggaaaacaaaagcagcagacccgaacaactaccttctttgacttctgcaaagcagaaaaggggatcttgctctgtactgatgttgctgctcgtggacttgacatacctgctgtggactggattgtgcagtatgatccacctgatgaaccaaaggaatatatccacagggttggtagaacagctcgtggtgaaggtgggaaaggaaatgctttgcttttcctcattcctgaagaattgcaatttctttgctatctgaaggcagctaaggtccctgttaaagagtatgcatatgatgaaaagaaggtggcaaacgtacaatctcacctgtaccaactgcaaattatcttacaaaggattatctggataattcaggagaatttggtggtcaacaatttctatttgaacaagatggcaaaagaagcttatagatcatacatattagcttacaattctcattctatgaaggatatattcaatgttcaccgtcttgatttgcaggctgttgcgtcttcgttcagtttttcaaacccaccaaatgtgagtctgaacataaacagtagcaagcaaaggaataaaatgcgtaaagttgatggaagtagacatggattcaatgacaacaatccttatggaaagaaaaatgctgatgataagcggcagtttgtgaggcactag

SEQ ID NO: 15075 - DNA, 353 bp, Glycine max
  Peptide Sequence Number=SeqID_131853
tgttcaagtacgagagagactcggttatggtggtgacggaagaagagtatgaaaaatgcaaagcctctcgtcccctctttttctctaacaatggtgacacagtcttcaagtttgaccggccaggcttgttctacttcattagtggggtgagtggtcactgtgacagagggcagcggatgatcatcaaggttttggatgtggagccagcagcacccccacctcaatctgcaaatgaggatgcacaaaaaccaccacataaaaaaaatggagttgctgaaatgattcctatgagtataataacaacatccacactttttgttttgtcaaccttcgtccttcagctttatgcttga

SEQ ID NO: 15076 - DNA, 258 bp, Glycine max
  Peptide Sequence Number=SeqID_131854
atggcttcagttggtgtggcaccaacatcatcaggcttgagagaatccagtggtgttgatagattgcctgaggagatgaatgatatgagaattagggacgataaagaaatggaagccaccgttgtcgatggtaacggaacggagaccggacatatcattgttactaccattgggggtagaaatggtcaaccgaagcaggtgttccttctcccttctttttcccctaacatgtactgtgctgtggaaactgggatgtag

SEQ ID NO: 15077 - DNA, 648 bp, Glycine max
  Peptide Sequence Number=SeqID_131855
atgcccttcatctccagaagaggtttaagggagaccttggccaagcaatcgacaacttctaaatctggggtcatggtgaattcaaacaatcgtgaacagttggtggttgacaatggtattgttgccgtcaccttttcaagacctgagggctacatccttggaatttcatataacggaattgacaatatacttgaagaagaaaacgaagatcaagatagagggtacttggacgtggtctggaatacaccgggaaagcctagtaactttcagagaatacacgggacaattttttcggttatagcagctgacgagaatatggtggagctttcattttcaaaatcatggacatcatccctgaatggctcaagtgtccccatgaacattgacataagatacattttgcgaagtggtgactcagggttttattcatatgcaatatttgatcgccctgaaggattgcccgccgtggagattgaccaaattaggattgttttcaaactcaacaaagacaggttcaactacatggctatatcagatgaaaggcagagaagcatgccaacgatgagagacagagaaactggccaaatcctagcttaccctgaagcagttctattaaccagaccaattaacccagaattcagaggagag

SEQ ID NO: 15078 - DNA, 1332 bp, Glycine max
  Peptide Sequence Number=SeqID_131856
gttgatgataaataccagtactcctgtgagaacaaggtcaacactgttcatggatggatcagtgttgatgctgctgatgcaccacccgtgggtttctggatgataacgcccagcagcgagtttcgtaatgctgggcccatcaagcaggaccttacttcccatgttggccccatcaccctctcgatgtttgtgagtactcactatgctggcaaggaggtaaccatggcatttcaagaaggggagatttataaaaaggtttttggccctgtatttgcctacgttaacaatgcttcaaacgaggatgacacactatccctctggtcagatgctgttcagcagcaatccaaagaagtcagaagttggccttacgattttcctaaatcagtggatttcattccaccgaatcaaaggggaatagttttgggaagattattagtccaagataggtacttcagaggaggtagacttctatatgctaacaattcttatgtcggtctagctttgcctggtgatgaaggatcatggcagatagaaagcaagggctatcaattctggactcaagccgacacaaagggtttcttcctaataaataatgttgttcctggtgactataatttgtatgcatgggttcctggcttcattggtgattacagatataatgctacaatcaccatcacaccaggaggagtcatccgattggactcacttgtgtacgttcctccaagaaatggaccaaccatatgggaaattgggtttccagatcgcaaggctgcagaattctatgtaccagaaccttaccctacactcatgaacaaattatacaacgaacagcgcagagacaagtttaggcaatacgggttgtgggaacgttacactgatttatatccaaatgatgatcttgtttacactgttggtattagcaagtatagaaaagattggttttttgctcatgttactagaagcacaggaaataagacataccagccaacgacatggcagataatatttgaacatccaaatcaaataataagaggaaactacacattgcaactggcattggcatgtactgctgatgctgacttgcaggttcgtgtcaatgaccctagcgctaatccaccggactttgcaacgggtaaaataggaggagacagtgccatagcaaggcatggggtgcatggtttgtataggttattcagcattaatgtaccaagtgatcgatttgtgaaaggaaccaacaccatctatctaaggcagtcaagagccatgaacccttttcaaggagttatgtatgattatatccgtttagaacgacctccattaacacagatttga

SEQ ID NO: 15079 - DNA, 456 bp, Glycine max
  Peptide Sequence Number=SeqID_131857
atggaacaaagagttgctggaagcaaggaaaaacccttcccaacccctatttatgttattaggacgctgtgggggagggtgttgggttcaaaatatgagggttggaaaggttgggaggtaaatgaggtgagagcattggattctatttggtggagggacttaaaaattgtatgtggatggggaagtgagggatggtttgatagaaggatagagtggaaaattgaagatgggaggaacactagattttgggcaaatacttggatgggggaagacaatcttaggaactcttttcctaggttattccttaattcggaacaaaatatgggtttggtgagtgatatgggaaattggaacaatggttcatggttatgggaagttaggtggcttagaccatggttggagtgggagaaacatgaggagaggagttccataatatattggaaagggctgaggtga

SEQ ID NO: 15080 - DNA, 177 bp, Glycine max
  Peptide Sequence Number=SeqID_131858
atgccgctaagcgagaaagtcgaaactggcttaagtgggtgtaacgtcagttacacccacacttgcacaattttcgccttccctgctctctctcccccaaaactgctcccttttgcatctttgccttctgtgtgctgcattcactccgaatcacccagcattttcagtacaagatag

SEQ ID NO: 15081 - DNA, 378 bp, Glycine max
  Peptide Sequence Number=SeqID_131859
atgactttacaattagctgaccgctccattaccaggccatatggagtaattgaagatgtgttggtcagagtgaaacattttatcttcccgacagactttgtggtaatggatatctctgaagatactaacatccttgtaatattgggaaggccattcatgttgaccgcaagctgcatagttgatatggggaagagaaagctggagctaggttttgaagatcagaaaattgattttgatttgtttgttgaagacaagcctgctccacaacacaatgtctgcttacaggtaatggaaggaggtcaagaggttctgaagatcattgggaacttgctgtataatctgtacataggagtatatcagcctatctttgaatgttaa

SEQ ID NO: 15082 - DNA, 222 bp, Glycine max
  Peptide Sequence Number=SeqID_131860
atgggtgccaaatacctcgaagtggtcaaacgagggtcgcatcccaacaatggatggtccctggacgaaattaggcatgagaagcgtgctaagcgcaattccaaccctagagggaattgcgctaagcaagagttgttgtgcttagcacaagaggaattgcgcttagcgagaattgtcgtgctttgtgcaaataacaatccgagagggaattgcactgagtga

SEQ ID NO: 15083 - DNA, 246 bp, Glycine max
  Peptide Sequence Number=SeqID_131861
atggagcgttatctacaacacttggtttgccagcaggcggccaaccatcggggcctcagtcagcaggggcagggtttcgctcctttcgcgtgccttactccagagcagtttagggctgaggtcacatggcccgaggcccaggtaggggaggcgcctgcaggatcccccgacgatgcagaggaggcccgcatggatgaggagatgtcggatttgctcggtttcttgggaggaagcgaagccacatga

SEQ ID NO: 15084 - DNA, 357 bp, Glycine max
  Peptide Sequence Number=SeqID_131862
atggagagtgtacttgttgttgtgtattacaatggtgacattatttcatcatctgaaggagtatcttttgaatatcctattggttctaaagttgttagaataagtgaggatatgatgcttgatgctttaagaaaaacaattatgaacaccatcggagagtttgtggagcttaaacgcgacaatgatgtgagaaaaatgtttttttttatcttttcaaaatttagtagtaaaggtctcattgagttgaatgcaacttttggccaatctccagatgaagtctttgtcctgctgtgcaaacctaggaaacctagatctactgatgagatcattgttttggtgcatgataaatatgtgtaa

SEQ ID NO: 15085 - DNA, 450 bp, Glycine max
  Peptide Sequence Number=SeqID_131863
atggtggtggcggtgttacggtgtggcgaaggtggggaaggtaatggccttacagattcgtcgttatggattgtgaatccatatgaaagactcaccattacggattcgcaatccctttatggaaaatattcaagcgatgggggaaggtgggtgatgtgtttattgcggcaaagagagacaaatggggggggggggaagggggaatttggctttgtgacaattgatggtattattgatgttggtacaatggagaaacttttgaatactatatggataggtatgtttaaattgagggtcaatgcacgacaagttgataggtttgtgaagggaatggtacataagatcacatcagcgaatcgtaagggagaaagaggagtgaagaggcatggaaaaaggaatgggagaatatatgtggatgttgtaaggagggataagaaaagattgatatag

SEQ ID NO: 15086 - DNA, 231 bp, Glycine max
  Peptide Sequence Number=SeqID_131864
atggcgctaagtgagccttcgaggacagaaagccctcaaaagcttaaggtggcgaaaaaaggaggggtggaggagacatccctaccaccgtgtaatatgtattttgcttccaaaaacccctattgtagcttaaaggtgaggaaaatgcaaggatcatgcatgagtgaacataacatgcaaacaatgaaaatagaatgcatgcagtgggcggaacaaaagcatgctaaatga

SEQ ID NO: 15087 - DNA, 357 bp, Glycine max
  Peptide Sequence Number=SeqID_131865
atgatgaacattggacgcgtgaaatcagcacttgcacgaattataggatttgatgtaagctcttttggacattccgttgagcctcactgcaaaggatcgatcgacgagaacgtcgagtctcatggtgccaatttccaagcatatgagagattttgcaacctcaccttgataacgcaaaacaaagagcttcaaaatcgaataaaatggaacggaatggaaaggaaaggggcttatgactccgatgatggaggaattgaattgaacatcatagaggcgggggagcctgacaactttttggatgacgagtttggaatggaagaagaagaagagccccaaacgataagaagaagaacctaa

SEQ ID NO: 15088 - DNA, 375 bp, Glycine max
  Peptide Sequence Number=SeqID_131866
atggtcatccagaagaaccatcttccggaaagtttccagaacaacgtcttccggaataaggttcttctagaagaaccaaatggtcatccggaagaaccatcttccgaaaagtttccagaacaacatcttccgaaaactttccgaaataaggttcttccagatgaccatttgattcttctgaaagaaccttattccggaaactttccggaagaagtttttctggaactttcggaagaagtggttcttccggaaagttcccggaagacggttcttctggaagaaccaaatgttccaggatgtctcaactctcaaggcatttttggcttaaatgtaccaggtgggcattggaaattcatataccactggctaaactga

SEQ ID NO: 15089 - DNA, 696 bp, Glycine max
  Peptide Sequence Number=SeqID_131867
atggctgctggtgtcactgtcaagtccgaggttctagaatcttctccccctgaaggagtatgttccaacacggaggaaaaccacctggttcagaccaatttgtctgatgggtcacccaacaaggggttttgtttaattggagatatgtatagagaaggttgtttaattgggaaaaaaagaagaagtaaagatagtgggtttcaattgtgcttgtctgtgccagcatctggacttaatgcagtgattcctagtgcaaatcagcttaccatcttctataatgggagtgtttgtgtctatgatggaatccctgcagagaaggtgcatgaaataatgcttattgctgctgctgctgccaagtctactgaaatgaagaagattgtgacccaaactaccctcatttcacccgttccctctaggccttcttctccacatggaatcactaacaatattgcttcctcgcagaagagttccatctgcaggctccaagctgaatttccaatagcacgcaggcattcacttcaaaggtttcttgagaagcgtcgtgacaggcttgggagcaaggcaccttatccttcctcatcaaccacaaaagtggctgacaacatagagaacaacttctgtgctgacaatgcaccagaactggtttccttgaaccgatctgaggaggaatttcagccaacggtctctgcctcttga

SEQ ID NO: 15090 - DNA, 258 bp, Glycine max
  Peptide Sequence Number=SeqID_131868
atggagaaagagatgatcacattgatagtagacacattactagtgttttactatgagaaagtggtgggttacacaccttcaaactttgcagatttgatcttcgctggcaaaacgatcgaagtgggtctgaaaagaggcaaatttgatcatcatgctttgacgaatgagaaaattgggacaaatagaggggatgaggtggaggaaggaaaccatgttgtggctgtcattcctacttggccaagttttccaccggcttaa

SEQ ID NO: 15091 - DNA, 141 bp, Glycine max
  Peptide Sequence Number=SeqID_131869
atggtgaatgactcttttttcttgggagaccccattgttccttcttccgaggatagggatggaaattctcatcctgggtcaaggctttcagaacggccggacatgatgtatgccagggtgttggtttgtccaacggtttag

SEQ ID NO: 15092 - DNA, 150 bp, Glycine max
  Peptide Sequence Number=SeqID_131870
atgggttttcctttgccggcagtcatttaccctgccgaaaatttatctgattttagcattcgttattcgctctcccttgaggagattatgctgtccttttcttcgggggaaaggatgaggattcttttcatgggccaaggttcaaagtag

SEQ ID NO: 15093 - DNA, 273 bp, Glycine max
  Peptide Sequence Number=SeqID_131871
cctgtggagtggatactacctacgcctactccatatcgactagttgagcctgttcaattgatagaggtgtcatcctctgaagaggatcttgaagaggacctagatgagttacctcctgaacctgctatggatgcccctgacttaccagaggatggtgaggacccgctccctgatgtagattctccagaggatattatgtcagcatctgaggcagactctacagaggagagtggccctggagggacaacgaatagtgatgactctccatcatag

SEQ ID NO: 15094 - DNA, 336 bp, Glycine max
  Peptide Sequence Number=SeqID_131872
atggagtccatgaaggaccaaatgacctccatgatggaggccatgttaagtatgagatggatgatggaagacaatgcggccgcagttgtcgccaccagcgccgccactgaggcagacccgactcacccatccagcataaaccaaacaagtcgtccaatcccaaacatggtaggtcggggaggagaggtgttaggcagaattggcagtccccatatggtgcaaaataagaattctttcccaccgtacggtttacctccccactatacactacccaatgcagtgcacgtgcccaatgagaacgccaaccactccgttcccattccccttgaaggctag

SEQ ID NO: 15095 - DNA, 444 bp, Glycine max
  Peptide Sequence Number=SeqID_131873
atgtcgttcaccaaaggaaagatgtttgtaaatgaaatggctccaaagaaactctccacgaagaggtctagaagggacgccattggagaaggctccagtaccgccttggagtttgatagtcaccgtttccggagtgccgagcaccagcagcgcttcgaggccatcaggggatggtcattccacaaggagaggcgtgtccagctcagggaaaatgagtacacagacttccaggaggagatagctcgcaggcattggacacctctagtgactcccatggccaagtttgaccctaagatagtcctagagttctacgctaatgcttggcccacagaggagggagttcgggacatgcgctcatgggtgaggggtcagtggattcccttcgacgcagatgccctcagccagttcttgggcgacccgttggttttagaggaagaccaatag

SEQ ID NO: 15096 - DNA, 606 bp, Glycine max
  Peptide Sequence Number=SeqID_131874
gaggttgtctttggccaagtttcaggaaaaggtagaagggtagtctttaaactaaaggacttgagccagcaattactatcttgcactttgtgggatgattattgcttgcagtttttaaagttcttagatgattatgaaggtgatggtccaattacagttctattgacccatggtagaataaaggaagctcagggatcttatcccccatcggtcagcaattttttcaaggtttcaaagttaattattaaccaaccggtgatggagattcaagaattcaatgaatggcttgcggagttgggcattgaggcccggtcaggttttaaatcccatggtgaagggagtacacaactttcaggttctatccaattatcatcaaaggaaccattctttggaaagactgaggcaaagactattgatgacattaacaccatctctgaacttgcatttagtgccataaaaaaaagtgatgcagagatggtgcccttcacatgtgcatgcggcaaatacaataaggaagttgtgcttaggtataggcttgaggtgatgatcaaccaggagatgaaagcacaaaattcctgctttgggaccgtgaatgcagtgaattaa

SEQ ID NO: 15097 - DNA, 231 bp, Glycine max
  Peptide Sequence Number=SeqID_131875
atggcagtggaatggagaaggaagagagagaggagacgacatttcaaggagaatatgaatctagaagaagttcaacagcataggaggccatggataagagcttggaggaagaaggagatgaatgaagggagagagagagaagagcacgaaattttgtgctcaaaaggagctctgaaatctgaacccactaatccaagatcaattacaagattctccactaagtgtgcttag

SEQ ID NO: 15098 - DNA, 174 bp, Glycine max
  Peptide Sequence Number=SeqID_131876
atggcctccatcattgcggccatttgctctttcatgggctccatgtcggcctccatctactcttgtacctcctccgctttacccattactctagctctagcacagaaatgggtttatgatcccaacatggttggctcatggtacctaacacatgtaactaagaatgcagcgtga

SEQ ID NO: 15099 - DNA, 285 bp, Glycine max
  Peptide Sequence Number=SeqID_131877
atgaaatctctgaggccagggtcagacgcaaccaagtactgcaggtttcaccgcgatattgaacacaacaccaaagattgttgggccttgaacggcaagatcgaagaatttatacaggctggatacttagcccagtttgttaagagaccagaccactaccaggaaggagcaaggcctaaaggacatcaagaggagcaacacaagaaccaagaagtagacaagagaagactggaagaccgaggtagacagagacaacaaccacaacggcatgagcgaccaccttaa

SEQ ID NO: 15100 - DNA, 243 bp, Glycine max
  Peptide Sequence Number=SeqID_131878
atggttgaaactagccaaataaacactaaaagaggtgtgaaagataaggctcccaacacacttccaatgaaaggcctttttgttacaaaacttgaaagcaatgaagtgcttcttagtccaatagctcttaaggtggttggccccttgcttcttgactcaaattcttcaagggatggcaccaatcctccttccaattccctatatgacaacccacaaacaaggaaacaaagagacaagaaataa

SEQ ID NO: 15101 - DNA, 417 bp, Glycine max
  Peptide Sequence Number=SeqID_131879
atgtcaccacaaacagagactaaagcaagtgttgggttcaaagctggtgttaaagattataaattgacttattatactcctgactatgaaaccaaagatactgatatcttggcagcattccgagtaactcctcaaccaggagttccgcctgaagaagcaggtgccgcggtagccgccgaatcttctactggtacatggacaactgtgtggaccgatgggcttaccagtcttgatcgttacaaagggcgatgctacggccttgaacctgttgctggggaagaaaatcaatatattgcttatgatttgcgaatccctactgcttatattaaaactttccaaggtccgcctcatggcatccaagttgagagagataaattgaacaagtatggtcgtcccctatataggatgtactattaa

SEQ ID NO: 15102 - DNA, 290 bp, Glycine max
  Peptide Sequence Number=SeqID_131880
atggggacaaatcaaaccagcaagaggttttaccaagtcaaggttaaaggcctagataccaccagcatcaaggaattagggcgtgtccatagaggccattgcgtcactccccaatactacgaccagcctttgagatgcttcacgttcggagacttccaattggtaccaaccattgaagaatttgaggagattctaggatgtcctctcggggggaagaaaaccatatcttttctccgggtgtctcccctctttgagcagaattgcgactgtggtcaaagattcagcaagag

SEQ ID NO: 15103 - DNA, 464 bp, Glycine max
  Peptide Sequence Number=SeqID_131881
atgacaagcagagaccaagtttggtcattctgcacccaagatacgcggagataccttacggttatccgcacccttttgtcatccagaggcggcgggcccgatgacaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatctgcaccccttttgctaggcagacacagttgtgtccgatggcaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacg

SEQ ID NO: 15104 - DNA, 288 bp, Glycine max
  Peptide Sequence Number=SeqID_131882
atgtatgaatatcctaggagaacccgcgcattaacgcgtaagcattcctttcaaaattcatatggatattcatgctttgttggtaaaacggaaatggctccgaagaaactgtccacgaagaggtctagaagaggtgccacaggggaagggtccaatgccgcccccgagtttgatagtcatcgtttccggagtgccgagcaccagcagcgcttcaaggccatcagaggatggtcgttcgacagggagaggcgtgtccagctcagggaggatgagtatgcggacttttag

SEQ ID NO: 15105 - DNA, 152 bp, Glycine max
  Peptide Sequence Number=SeqID_131883
atggtttcaaacgtggtgcttaaatttcacgacgatccaacggtgaacgagtccaagatcgtcgtttttctgagacaggttaggtggcatgcgggagagggttttgggagaagagagaagaaacaacattgtgaggcagaggaggctgagga

SEQ ID NO: 15106 - DNA, 465 bp, Glycine max
  Peptide Sequence Number=SeqID_131884
atgcctcgttcttctaatctcgctcaagactctgaggaggacttgattctgatgtgggctttcttgaccgatcatccaatcgactgggcccatttgattcgttaccgcttgcataaggcattgcggtctgttaaatgctcctttgctattggtgccgatgcggtaacctcctttggttaccgtaaggacatggatgggcaattgttaaagaaggacgcacaacctccacgagacgaacgtactccctcttctccgcctcaacaagatgattcctcagccctcatgaatgaagttctttcggaattacgaggccttcgcacctatgttggtgaacactttgattccttggatggtcgcatagatgccattgatgctcgctttgaaggaatggatacccgcatcactcagcttgaaaaggatgtgagttatcttcgtcggtgcttcgaccttccaccacgttcctag

SEQ ID NO: 15107 - DNA, 252 bp, Glycine max
  Peptide Sequence Number=SeqID_131885
atgacggtaatagagtgcagcacgtatgcatggggacctgctgtgcttgcttatttatatagagagatgtgcagcgccacctacaaaactaaatcaatcggagtttttgtggaagtcttacacaacaaatgttatgtcagcgttacctccaatttgtttgattggaagtgtagcgtagcgtggtgcacggtggtgtcactcatttgtttccatgttgttgagtggcaccaacccgataaagttttgagataa

SEQ ID NO: 15108 - DNA, 429 bp, Glycine max
  Peptide Sequence Number=SeqID_131886
atgcaatcacacgaacttgcactgcctctggagcctaaggttggtccctcagctgcttgtgtcagcacaaaaggaagttgtgttgatccctcaccaaccgatccagagacgggtgactcagacaaatgcgggttgtacatcgaagaaaatctatcccacctggttgcccaaggaagagtttatgagggatccacaatagttcacaacatccctttgttgcatggccaagtgatggttggtgttgaggaggttaaagatgcagaggctcctgttcttgtacccactgacgaggttattttagtggggcaagtacttaacaccttccttgcttggccgacacatctcgtgaagcgtttatcacaacagttgtgtctccagcaaaacctacagatgggccggatgctcaggtacatgatcccctatatttga

SEQ ID NO: 15109 - DNA, 222 bp, Glycine max
  Peptide Sequence Number=SeqID_131887
atgatcgttgatcaatctctattcttttcattaactaaattacccagtcaaggtgcaccttttgagggcaccattgttgatgactggaagttcgactattctagtcatgatgctcgccgtatggtctgcaatgaccagactgatatgtgtaacgacccgcctcgtcgctacgaagtgattttgtcacaacataaattcatccaacaacacgccattacttaa

SEQ ID NO: 15110 - DNA, 231 bp, Glycine max
  Peptide Sequence Number=SeqID_131888
atgaagctttgcttctacactttaatggttaaggaagagtgtaaggaggtaagtgtctcctccaagaggttagctaggaaggaaagtcattttgaaataaagaaaaatattaaagaagcttcccctcttaaacaacctccacatcttctcctttgtaaaaagacacttgttagcactgccacacctcttgggcttgaggttattcctcaagtaaaggagttattggattag

SEQ ID NO: 15111 - DNA, 387 bp, Glycine max
  Peptide Sequence Number=SeqID_131889
atggcgagaaggcgtgctcgttttgaatttgcacatcatgggggctgccggccagatgggggcatcaggttcaccttagcaacagtgctggtagcggcaattgtaaccgcattggcttccattatcttcttcatgctcatcatggcctccatcattgtggccattttctctttcatggcctccatgtcggccttcaccttctcttgcacctcctctgctttacagattttcaacttggtccatgacatcttcgtcaaggtgaaactggaagtaacagggacatcgacagccctaaatgtgtttggcagtagacgaagtagcgatgtaacacgatccatcttttgccccaattttttgcaagatggttacttccatacttcaacttga

SEQ ID NO: 15112 - DNA, 792 bp, Glycine max
  Peptide Sequence Number=SeqID_131890
atgaaaaaaatattgatcatccttctggtagcttttattatcattcagttttttcctattgacaagaccaatccaccgctgaatccgggtatggattttttaaaaataaaaaaaacacaacctgaggtcgccaaactcatccgtacatcgtgctacgactgtcactccaacgaaacgaagtatccatggtactcaagcattgctccttcatcgtggtttctcaaaaatcatattgatgaaggcagaaagaatttaaatttctctacctttgcaatgtatgaacctgaaagacaggcacacaaattgcaggaatgtattgaaatgattgagaaagaggaaatgcctctggaatcctatattgtcggtcatcaggacgcaaaattaacccctgaacagagaaagcagcttatacaatattttaaaaaagtaaaagcagaaactgaacggtcgatgtggatcctggaacgcgacaaaaaaaacaaattcctttttgcttctttacaatcggatttcggccagaagttcttatccgaaagagggttggagactactgttttcaatacgatgtatctctggaaacctaatcagtactatctggtaaaatctagggctgttcttcagattgctcaactcctgggtggtgtataccaacttattgcagctggaaaaatcataccgactttcttaagtgaccaggtttatgatttgatttcaagaaacagaatgaaacttgctgctcaaaaatgctatctgcctgatcaaaatcagaaaagaaagtttatagaagtttaa

SEQ ID NO: 15113 - DNA, 780 bp, Glycine max
  Peptide Sequence Number=SeqID_131891
atggtggcatcgaccggcgatcttagcgtttccggttcgtcgatcgcggcaatcggcggcaccttcacggcgggtggcaatgcctcgctgaaggcgaacgagagcattctgctcgccaatgcgaaggtgacggccggcggcaatctcggcctgacgtcgaatggagacatcaatatctccgtcaccgaacggtcaacgaccagcactttgcgcgacaagcggagttttacgacggttgtgagaaccaccagccagggttccgagatcaccgcgggcgggtcggtctcagccaatgcaggtggcaacctcaacgtcatcggcagcaacattgctgccgatggaacggtcggtctgaaagcgaccggcgatgtgacaatcgctgaggccatagacaccaccacgatagattacacctacaggaaaaagggcggtctgttcggcggaagcaaacagacgacgagccacacggaaacgcagaccgtcgtcggatcatcggttagcagtgggaagggcgtgtccatcatctcaggtggagataccgtcgtctccgcctcgaaggtgactgccggcgacgagaccgacaaagccgatatcaatgtcagcgcgggcggcgatctgctgatcgcgtcgggcaagaatacggcggagttcgagcagagctcctcatccaagggctttctctcgaaaaagagctcgacgcagtacaactacgacgaagccacagtcagctccgagctttccgcatccggcaacatcaagctggatgctggcggcaacgct

SEQ ID NO: 15114 - DNA, 147 bp, Glycine max
  Peptide Sequence Number=SeqID_131892
atgctgatagaagatgctgcagctagagcatggagacagggggagcagaaagctgatgtcacaagagatgtcttaacatcctggaaaaggctagtagctgatagaagagcatggagacagggggagcagaaagctgatgtcacgtga

SEQ ID NO: 15115 - DNA, 258 bp, Glycine max
  Peptide Sequence Number=SeqID_131893
atgacgaacaacgaaggacgaagaacggttgaaactcttcgcaaaatcacccatggaaacgttacggaagcgcctcgccttggattttcttcacggaaacaatttttctcactaattttaagaaaagggaggagatgcttgccacccagctcgcacaggcgagctaggttgcttcctccagaaggaaccgccttctggaggaacatcctggaaggcccaagtgggcctggttgctatttgcacccccatttttactaa

SEQ ID NO: 15116 - DNA, 624 bp, Glycine max
  Peptide Sequence Number=SeqID_131894
catagcatgcgtccgtcatctgcaccgggcttgttccggtcatgcgggtgggcaacgttcgctcattgccatgctgaatcatccgctggaacaccgattttaccggcgtttgccgggaataatagtttcgaacgcggcgttcttcttgttgatgaccacgaactggtgcgcgcagggatacgacgcattcttgaagatatcaaaggtataaaagttgtcggtgaggctcagtgcggtgaagacgccgtaaaatggtgccgaggcaacgcggtcgatatcgtgctgatggacatgaatatgccgggcattggcgggctggaagccacgcgcaagattgtgcgttatgcacccgacgtcaaagtcatcatgttgaccatccatactgaaaatcctttgcccgcgaaggtgatgcaggcgggtgccgccggttacctgagcaagggcgccgcgccgcaggaagtgattaacgccttgcgttccgtgcatgcggggcagcgctatatcgcgttcgatatcgcccagcagatggccctgagtcagctggagccgcaggctgaaacgccgttcagctgcctgtctgaacgcgagttacagatcatgttgatgatcactaaaggcaaaaag

SEQ ID NO: 15117 - DNA, 258 bp, Glycine max
  Peptide Sequence Number=SeqID_131895
atgactaaagcaagtcaaaagggggtacggaaagaaaatgagggaggagcttgccacccagctcgcctaggcgagctaggttgcttcctccagaaggcaccgccttctggggaacttcctggaaggcccaagtgggcctggttgctattttcacccccctatttactaaatacacccttgcctttttttgctgattctttttctgtaacgttacggaaccttatgaattacgtaatgatacttgttttctttccataa

SEQ ID NO: 15118 - DNA, 153 bp, Glycine max
  Peptide Sequence Number=SeqID_131896
atggctgggacgccacaagggtcgtctcttaggcaatcatggaacacaagctccagactcgaaaatggaggacacgtgaatgacagcgcaattcactcacgtggctccggaaaaggacgagaatggaggattgccttgagggtcctctcttag

SEQ ID NO: 15119 - DNA, 357 bp, Glycine max
  Peptide Sequence Number=SeqID_131897
cgcaacggcaaccgcatgcttgagcgccagctcgccgccgaggacacactcgacgcgctccacaacctcgcgagccagcacttcgtgcggagcttgccgctctcgatgttccagcagcagatgggctacggcatgtaccagaacgggcagccggcgccggggcccgcgccggcgccggcgccggccgcggcggcgccggggcccgcgccggcgagccgcgtcgcccagaagaaggccgcgtgcgagcgcgcggaagccaaggccggcgaggactgcacgctccggaagctgcagacctttctctgcgacgactacgacgaccgccagctctccctagccggcggcctcaccgcagtc

SEQ ID NO: 15120 - DNA, 529 bp, Glycine max
  Peptide Sequence Number=SeqID_131898
gaagaactattggaatcctgatgatctgacagtttctatccgaggggctaggagggtgagggcgaggccagctgagctcccttccacatctgcagctcctactccagcatccacttcagcagctccttcagtcccagctcagagatccattcctactattgagcagtttctggcgagtgtagcctggcctgaggcccaaccttctcttcacagggaagatgaaggtcccatagcccaggtagcacaacatatggaggatgagtcatccgaggccaccattccagagccattcattgcaaaggaggaggcaggtcacttcagagcctcctgcaccagtggtggacctatcctcgcctcagtagaggagcatgcagtagacccctccgctcctatactagagatactagaggactcgaccacactagtccagactttgaacacctctcctctagctactccagtacttcatctaacagatgatgaggatgttcagacacaggacactcaggaccagtcccaggaattctaa

SEQ ID NO: 15121 - DNA, 261 bp, Glycine max
  Peptide Sequence Number=SeqID_131899
atggtggctcggattacattaagggatggatatgagctcaggattgcgttgggtcgaaatggtgatggcatggtgactttgctggaaattgccaaaaatcgtgggaggtttgggttgggttacaagcccaccaatactgataagagaagaactactctagagagaaaagaaaagtgcttggcttgtcttcaagggcatgaaccacggatagagaggtccctatctgccgcattagcaaaagcttcaggagtgcgggattga

SEQ ID NO: 15122 - DNA, 666 bp, Glycine max
  Peptide Sequence Number=SeqID_131900
atgggcccctataaagctcttggtctgaatagttttcaaagtatcttctatctcactttttggagcactgtgagtcatgatgtgtgggagttggtagctaattctattactacagggcatattcatgaaggcttggctagaactttgatagttctaatcctaaagaatgacaaccccacatctttgaaggagtttcgtcccatcagcttatgtaatgttctccttaaagttgtctccaaggtcattgtgaatagagttagacctcactcagacaacattattgggtctctccaaagcagcttcattccagggatggggacatatgatagagtgaattggagatttctggagcttacttggaatgactttggtttccctccttcgatcattaaagtgatcatgtctctaacaacttctacttccctctccctaaagtggaataatgaggtcctagagagttttaagtctaatagaggtcttcgtcaaggggaccccctttccctttatttgttccttctttgcatggagaaactggcccttatgatccatgagaaagtgacccaaaaggcttggcaacctatcaaacttactaaggattggttagaaatttctcatctggtttttgaagatgattgcctcctctgcactacagcaaaatcctcctaa

SEQ ID NO: 15123 - DNA, 1266 bp, Glycine max
  Peptide Sequence Number=SeqID_131901
aaaccatcaaggaaagaactcacctcaacacaagaagacgtggaggcctcacaccaaaccctagaggaaacaaaatctccgacatcatcatcatgcaatctcgagaaccccaagaccccctcaacagaaagagaaacttccattctgaaatccttcaaaaacggacaccaaagcgacacaacaacaacatgcccatcacaggacaaaactccaaagaaaccagacaaggtgcttccatgccctcgatgcaacagcatggacaccaagttctgctactacaacaactacaacgtcaaccaaccgcgccacttctgcaagcattgccagagatattggaccgccggaggaaccatgaggaacgtgccagtcggtgccggccgccgcaagaacaagaacactccctctgtgtcgcattttcgccaaatcatggtgcctgagggccttcagaacggatcattgcacggcgctgtgttgacctttggatcagattctcctctatgtgattccatggcttctgtattgagccttgctgagaaaacaacacaaaatggtgtcctaaatggtttccattcacctaatactaatactattactagtaataaaggggatgaatattatgatactgttatgggttcaactttgagtgaaaagagacacaatgcaactactagtactaactcacatgaaaaatcattggataatcataagagttatcatcatcaaggtttcactcctcaattgtgcttcccaggttcttcttcttcttctccttggccttatccatggaaccctacaaagactccttcagctttttgcaaccctgtgccattctacactacacaagcattctggggttgcatgccaccaccctcttggagtgtaaattaccaatctgcccctagttctggcccaaattcccctaccttagggaaacactcaagagatggggatatcttgtttcaaaaacctagcacagacatggcagaaaataacaacaacaacaacaccgtgttgataccaaagacactgagaattgatgaccctactgaagctgcaaagagctccatatggtcaacactggggatcaagaatgagaagggaaactccctcaatggaggagggcttttcaaggcatttgcatcaaagggtagtagtgatgagaagaagaataaccatgtgatgatggttgaagcatccctatccccggtgttgcaagccaacccagcagctttgtcaaggtcccttgtcttccatgagaggacataa

SEQ ID NO: 15124 - DNA, 351 bp, Glycine max
  Peptide Sequence Number=SeqID_131902
atggggagagttattaggtggttcccaccacccaataactatatcaagatcaacactgacggtagctctttcggaaattcgggtttatcaggttatggtggaatcctccgcaatgagcatggccattggattcgggatttctcaagtttgtatggttttatgaataacatcaatgcaaagctggttgctatccagaaagtctttagtccttggccaccagaaagaaaatgctgtttgactcctctctgcgaaggtcacatcagtgctttatcgctttggcacatcatggatttctacattgcatacccattattgcttggtgcagatacaagatattttaaatttgtctga

SEQ ID NO: 15125 - DNA, 510 bp, Glycine max
  Peptide Sequence Number=SeqID_131903
atggacaatggaaagacaaaggatacacataatgctcaattggatttagctgtaataagtgatcggaaagagattgagttggttaacattggtcatgccaaactttttaaaccaaaggtagcctatgcattgaccaaatcccagagagtcataatttgtaaatgggtcaaaaaactaaagttgctagatgggtttttacactccctaaaaagcaaagttaagaataaggctagggtaaagggttcaatttgtgaggcttacttggtggacgagacatctacctttgtctcattttactatcctgatagaattcaaacgagaaggactagcatgactcataatgttgatgtaggtgaaggttcttctgctactcctcctatatcaattttcaattaccttggaagagtgagtgagaaatccataacatattatttggactcatgtgactttgatgctgctcacttgtacgttcttcaaaactgtgaagaggttgagtcgtatttagggtaa

SEQ ID NO: 15126 - DNA, 125 bp, Glycine max
  Peptide Sequence Number=SeqID_131904
atgttgagtcctatgaaaaataaaggcgaggacattgagtcctatggaaacataaaggcgaggacattgagtcctatgaaagataaaggcgaggacgttgagtcctatggaaacataaagacgag

SEQ ID NO: 15127 - DNA, 249 bp, Glycine max
  Peptide Sequence Number=SeqID_131905
atgggggagaagcttgcaacccagctcgccaaggcgagcaaggtggcttcctccagaagcaaccgccttctggaggaatcttctggagggcccaaaaccttacggattgtgcatcaatactttcttttgatttccggcacgtcacggaacttcacaaattgcctaatgatgggtgccaagcacctcaaaatgaccaaacacaagttgcatgccaccaagcaaaggtccctggacgaaattagggcatga

SEQ ID NO: 15128 - DNA, 219 bp, Glycine max
  Peptide Sequence Number=SeqID_131906
atggaggtgcaaatagcaatattcaaattttcgaatctgggctcttccagaatatttgggaagctaggttgcttaaggaggaagcaacgtagctctcctggccgaggtgcttccttaacacttccgagatgttttcgtgagcaaatgcgtgaaggttttccgccgctcttcaccgttcttcatccgttcttcgttcgttcttcgttcttcaacctgtaa

SEQ ID NO: 15129 - DNA, 177 bp, Glycine max
  Peptide Sequence Number=SeqID_131907
atggatttcgaaatctgccattttatgcagaacaatgctgtcaaaattgtgcagcagttttttttacatagtgcagaaaaatgcttatgcattgctagtcacaggaagagtagtacatctcggaaaaatggtggtgcagtgcaggtcacgggaaaggcagtatatatcgtgttctag

SEQ ID NO: 15130 - DNA, 336 bp, Glycine max
  Peptide Sequence Number=SeqID_131908
atgcgtagtgattgcttagtgcaattctccattctcaaccctttttctgagcccatgaattgggttttcgttcatgtgtcctccacccacgagtttggagccatgtgtagtgattgcttagtgcaattcaaggaatcctccattctcacccttttttcggagcccatgaattgcgttttcgttcatgagtcctccaccctcgagtttggagccaccctcaaggcaatcctccattctccccctttttcggagcccatgaattgcgttttcgttcatgtgtcctccaccctcgagtttggagccgtgtttcatgattgcctaagtgcggacccttaa

SEQ ID NO: 15131 - DNA, 1218 bp, Glycine max
  Peptide Sequence Number=SeqID_131909
cttttaaaggaaggcacttcccctcttgctcaaattgctgctgctactactttgtgtcatttggctaatgatttggatagggttagagtcattgtgagtgagcatggtgtgcctgctgttgtgcaggttcttagtgactcccccatgagggttcagaccctggctgccaatttggttgccaggatggccaagcatgaccctgtcgcgcaggaggatttcgcgagggagaacgccattaggccgcttgtcacgctcttgtcgtttgatacctttgtggatgatccattggggcatttggggaagcagagtattcactctattgttcagattaataaggaattggggaagggtggccggggagggcaccagttctccagttcctactcgagttcgtatttgtttacggagtggagtagccggggagtgaaccataggaaggagagggagaatgaggatcctgtggtgaagcttcagctgaaggttagttgcgctgaggcgttgtggatgcttgtgcaagggagcgtgaccaacagtaggaagataactgagaccaaagggatgctttgcttggctaagattgttgagatggagcaaggggagctgcagcttaattgcttgatgacgatgatggagataaccgctgctgctgaatacaatgctgatcttcgccgtgcagcatttaagaccaactccccggctgctaaatctgttgtggaacagctgttgaggataattaaagaggtggacagcccggcattgcaaattccagcgatgaaggccattggctcgttggctaggacatttcccgctagagagacccgggtaattgaaccgttggtgacacagatgggtaatagaaacgcagaagtagcagatgaggcagtggctgctctcgccaagtttgcttctccagataatttcctacatgtggagcattccaagacgatagttgaattcagtggaatcccggcactgatgagactgctaaggagtaatgaagttgcccagatgcatcatgggctaactcttctttgctaccttgcactgcatgctggcaacagtgagtccttggaacaagcaagggtgttgatagttctagagggtgcagacagaacagtccttcctcagcatataaaggaattggtctccatggcaataatccacctcaatttgtatcatgcaggaatgaattctcaaaggatatcatattttccttga

SEQ ID NO: 15132 - DNA, 1117 bp, Glycine max
  Peptide Sequence Number=SeqID_131910
agtcgccgacttactctgcactctgcaacagatgaagcacccaacatggcctcgcacctcctcttctcccttctcctctcttcctttctccaaccgttccgaattcttcaccacgcgcctctgcgcgcgtcctccgctgccgtcccctcccggcgccggcgacttctcggcgctcccctacgacgtgctggcgaagatcgccgcctccttcgacgaccccaacctccgcgcggcgtcactggtgtgccgcgcctggtgcgaggcgctgcggccgctgcgggaggccatggcgctgctcctctgggggaagcgcttcaagcacggccaccgtggcgtcggccccaaccccgatagggccctcgactccttcatcaaagccgccgcgcgcggctccgccctcgccatggtcgacgccggcctcatctactgggagcgaggcgagaagcccaaggccatggagttttatcataaggctgcggaactcggaaacccttctgcgcagtgcaatttgggactttcctatctccaagctgaacctccgaacactgagctagctgtcaaatggttacataaagcttctgtttgtgggaatgttcgtgcccagtaccagcttgcgctttgtctgcatcgcggtggtgggagggtccgtagcaatctgaaagaagctgttggtgctctatccatttcctctcctcttctaattatgagtgaagcagtgaaccttttctttcagaggggtgtgtgtgtcaatggattggaactctgcttggctaaatggtatatgaaagctgcagagggtgggtatgtccgtgccatgtacaatatctccttgtgcttctcctttggggaaggactgacacgtaatcatcaactagcaagaaaatggatgaagcgggctgcggatcgtgggcatagtaaagctcaatttgagcatggacttgctctcttttctgagggagacatgatgaaggctgtggtttacttggaacttgctactcgtgctggtgaaaaaggtgctgctcatgtcaagaatgcagttcttcatcggctttcatcagcttcacgtgatcacgccatgcatctagctaacagttggcgtgcattgccatcaagttga

SEQ ID NO: 15133 - DNA, 2448 bp, Glycine max
  Peptide Sequence Number=SeqID_131911
atgaccagagctcaaacctgccaccctttggatccactatcagctgctgaaatatcagtagctgtagctacagttcgagctgctggggcaacccctgagtgtgtgtttggttcaatttattttgaagaacgagtcacttatgtttgcccgcttaatgataacctttcaaaaataaaggtgagggatagtatgcgctttgttgaagtagtcttggtagaaccagataagcaagttgttgcattagcagatgcatatttcttccctcctttccagccatcattgctccccaggactaaaggaggacctctgattcctactaaacttcccccaaggaaagcacgattggttgtttacaacaaaaggtcaaatgagacaagcatatggattgttgaacttagagaagtacatgcagcaactcgaggtggtcatcatagaggcaaagtaatttcttctgaagtcgttccaaatgttcagccaccaatgaatttaaatggcttaggtaatacttgtgtggagagcttaaagaatttgaatctgtaccaacaggccaatactgatgtatacatacaggatgctgtggagtatgctgaatgtgaagctgctgtgaaagatttccctccatttcgtgaagcaatgaagagaagagggatagaggacatggatcttgtgatggtggatgcatggtgtgttggatatcatagtgaagcggatgctcctagccgccggcttgctaaaccgctaatcttttgtagaactgagagtgactgcccaatggaaaatggctatgcacgtccagttgaaggaatccatatacttgtagacatgcaaaatatggaaattcttgagtttgaagaccgtaaactaattccccttccacctgctgatccattgagaaattatacttctggtgaaactaggggaggagttgatagaagtgatgtgaaaccattacagattattcagcctgaaggtccaagttttcgtgtcaacgggcacttcattcaatggcagaaggtgattgtttgtaccttactttttctagaagcaagttcattcgagacatgtaaactttggaactttcgcatcggttttactcctagggaaggtttggttatttattctgtagcctatattgatggaagtcgagggcgaaggcctgtggcccacagattgagttttgttgagatggtggtcccttatggagatccaaatgatcctcactataggaagaatgcttttgatgcaggagaagatggtctgggtaaaaatgctcattctctaaagaagggttgtgattgtttaggctatatcaagtactttgatgctcacttcacaaactttaatggaggtgttgaaacaatagagaattgtgtttgcttgcatgaagaggatcatggtattttatggaagcatcaagattggagaacaggtttggctgaagttcgacggtctagaaggctgacagtgtcttttatatgcactgtggctaactatgagtatggatttttctggcacttctatcaggcaagttattgtctggattcatccatcagagtttgtctaataagattgatagaatggaaaccatggttgagtcctagtgatatatactttaaaattaaaaattcatacaagtgggtgtctcaggatggaaaaatagaagctgaggtcaagctcacgggaattctcagtttaggagcattgcaaccaggtgaaagtcgaaaatatggcacgactattgcacctggattatatgcacctgtccaccaacacttttttgttgctcgtatggacatggctgttgattgcaagcctggtgaagcatttaatcaggttgttgaggtggatgtcaaaattgaagagccaggaaagaataatgttcacaacaatgcattttatgctgaggaaaaactgcttaaatcagaatcggaagcaatgcgtgattgtaaccctttatctgctcgacattggattgttaggaacacaaggacggtaaaccgaactgggcagctaacaggatacaagctagtacctggttcaaattgtttacccttggctggttcagaggccaagtttctgaggagagcagctttcttgaagcacaatctttgggtcactccttatgttcccggcgaaatgcatcccggaggggagtttcctaatcagaatccacgcgttggagagggtttggctacttgggttcagaagaatagatcattggaagaagccgatatagttctttggtacgtgtttggtataacacacattccccgattggaagactggccagttatgccagtggaacgcattggctttatgcttatgccacatgggtttttcaattgctccccagctgtagatgttcccccaagtgcaagtgatttggatgataaggagaatgggatgtctgcaaagcctattcagaatgggatgattgccaagctctaa

SEQ ID NO: 15134 - DNA, 373 bp, Glycine max
  Peptide Sequence Number=SeqID_131912
cgtcgaggatgctgaggagccacatcatgtcgccggtggaggcgtcgatgtgggtgaggactttgcggaaatcggcggcgctgacgatggagacgacgcggcggaggatgctgcggcgcttgcacttgcggacgagggcgagggcgcggtcgaggttcttggaggcctcagcggcgacgcggcggatggggcgctcgtagaggggcggcgcgacggaggaggtggaggtggcggtggcgaagcggacgagggttcggagcatttggaggaggcgatcgacgtgcttcccaacctcggagcactcgagtttgaacgagtcagactcgtccacggccgagcgaactcgctccgccaccataataggatatactag

SEQ ID NO: 15135 - DNA, 982 bp, Glycine max
  Peptide Sequence Number=SeqID_131913
atgcattcattgaggtatgaattggttgaagagtgtgttgatgattacgatgcgaaacctggaatctgtgagttgaggaaggcagttctagaaggtatgagttggttgaagagtgtgttgatgattacgatgcgaaacctggaatctgaaggcagttctagaggagctgaagatgcacaactggctggtacaggaaaatcaactcttttagcagcaattctcagagaaccccatcaaatccaaccacaactgggatccaccgcagttttcatcgccggcacccctgacatagctccgatcaccagcactggcgacttctatagggaattcatggtggagtccaagaagctcgggtacctcgccggccccgccatcttctccttcgtctcaaagtactccctcggcgccttcactcaaatctttgccggccacgtcggcaccattgacctcgccgccgtctccgtcgaaaactccctcatcgccggcttctcctacggcataatgctagggatgggaagcgcgttggaaacgctgtgtggacaagcggtgggagcagggaagcttgacatgctgggagtgtacatgcagcggtcatgggtgttacttctcagcatggcttttgttctgtggcctatgtacatcttcgcgggacaagttctgaagttcatagggcaagacacccaaatttcggaggctgcgggaaccttcgccatttggatgattccgcagctgtttgcgtacgcgctgaattttccggtggcgaagttcctgcaggcgcaggtgctgagttggctgctcatggtgaagctcgagttggggctggtgggcgccgccgtcgtgctcaatggctcgtggtggtggctcagttggtttatgtgtttggtgggtggtgttggcctgcgtggaacggcttctcgggggaagcgtttcggaatctctgtggattctttcgcctctctcttgcttctgctgttatgctttg

SEQ ID NO: 15136 - DNA, 195 bp, Glycine max
  Peptide Sequence Number=SeqID_131914
atgtctccgcaacaccacctaatgaatgttcgcttgcagaaatctatgccggatactgagaatgacgacatgcactacatgtgtttcgccactgagaatgacgacatgcactggtattttgccagtgtggatgacaacatgcactcattgtttcgtgcacatgaaccctacgctgctgtaggctggcacacctaa

SEQ ID NO: 15137 - DNA, 579 bp, Glycine max
  Peptide Sequence Number=SeqID_131915
atggaatttgcggcaacctctctccagctcgtatcgccaattggacttgcggcaagcactccacgtggctcgtatcgccaatgggaccaacggtttagtgtccacgtaagctcgtatcgccagtgccaatgtcgggatcagcctgtatcgccattgccactggcgggtcatgctttaccgccaaagccaacagcggcttccatgcaaataagagaccctctgtgcaaattgtttgaaaacatacccatttacgtaaaaaattttgataatgatttctcctatattggtaaagatgatccttattcccaaataaagataaaatggttattttctccacatgcggcactagatcatccactgtccatgtatttatcccttgtggagacaccatgtactgtaatgtctctgcaacttcagcccgcaattattaggggtgcaaaggacaccgtgaaattggttgttgcattccaaattgtctcactctatcaagttggtgccactcaagaacttggaaacaaattagtggcaccaccgcgcaccacgctacatttccaactaaacaaaacatttgttgtgtaa

SEQ ID NO: 15138 - DNA, 228 bp, Glycine max
  Peptide Sequence Number=SeqID_131916
atggtgaataatttcgtgactgagggggcgttcgtagtgactgagggggtcaaagaccaagaagtgagttatttatcagccaagcattctattcttcttatggctagatccaatctcctggtccctgtggaaaggaaaaagaatttttcacgttcttcctttcgggaaggaaggattagtaaaatcctattgattgcaattttctccagacccccgggaaaagcatga

SEQ ID NO: 15139 - DNA, 1377 bp, Glycine max
  Peptide Sequence Number=SeqID_131917
atgcctcttcttctcgcacgcaccccaccatcctcactctctccattccctcttcaaaacgcacgcgcgcctctaatcactgcctctcagaagcgcttccctcttgccgcaactcgaatagttcttttcacttcccggcgcagcattctagcatcccctcctcccaagtgcgcctccatcaacggagtctctgttccgaacaatccagaagcttccggagaagaacaacaacaagtctataatgcttccgagcttctcgagcggattcggaaatgggtcgggattttaccgtcgattctccccggcggacggtggtgggagttctccggcgacgtcgacgttcaggtggtggcgcagccggtgaccgtgtggcgcgcgctcgggaaaatgtgggaccttgtcgcgggtgacagatgggtcatcttcgctgcattctctgctctcattgttgctgcaatttcggagatttcgataccgcatctcttgacagcatcaatcttctcagcacagagtgcggaccttactgtttatcaccggaatgtgcggttgttggttctgttgtgcgtggcttcgggaatatgcagtggaatacgaggttgcttttttggcattgcaaacatgattctggttaagagaatgagagaaacactatactcttctcttcttctgcaggatatatcgttttttgacaatgaaacagtaggtgatttgacaagtaggcttggggcagattgccaacaagtgtcaagggttattggaaatgatcttaatttgataatgcgcaatgttcttcaggggggaggttcattaatctacttgttgattttatcttggccacttggcttatcaacattggtggtatgctccatattagcagcagttatgttacgttatggaaggtaccagaaaaaggcagcaaggttgatccaagaagtcactgcttctgcaaatgatgtagcccaagagacattctctctggttagaactgtacgagtttatggaacagaagaagaagaacatggaaggtataagtggtggctggagaaattagctgacataagcttgcgacaaagtgctgcatatggagtttggaattttagctttaacattctttatcattcaactcaggttattgctgtgctatttggaggaatgtctattctagcaggaataaggctgctcacactgataccatctataattgttttaaaacttttggtacttgctatgatggttgacattggtggtcacaaggtgcaacatgtgaactttgttgtctatcctggtgaggtggttgcaatagttggacttagtggtagtggaaaaagcacattggtgaatcttttgctccgtctctatgagcctacaaatggtcag

SEQ ID NO: 15140 - DNA, 588 bp, Glycine max
  Peptide Sequence Number=SeqID_131918
atgtttgtacaggaacccaaactcttccgaatggatattagttcaaacataagatatggatgtacgcgagatgtaaagcaggaggatattgaatgggctgcaaagcaggcctatgcccacaactttatctcagcacttcccaatggttatgaaacacttgttgatgatgatctgttaagtggaggacaaaagcagcgaattgctattgctagggcccttcttagggacccaaaaatattgatccttgatgaagccactagtgcactagatgctgaaagtgagcataatgtcaagggtgttcttcgatctgttagaagtgactctgcaacaagaagtgtcatagtcattgcacacaggctttctaccatacaagcagctgacaggattgtggtgatggatggtggtcacattattgaggataggaccatgaaaacagtaattgtatgtagccatatttttatttggtttaggctgagccttggtgcatcagcaaggttgttgccttgtgagctagaggtcactgattcaaatcctggaaacagcttttcttcttactggaaaaagactgcatatatctacccttcctag

SEQ ID NO: 15141 - DNA, 750 bp, Glycine max
  Peptide Sequence Number=SeqID_131919
atgctgaagcatgttgttcactcgttaggcctagtggataaaaatccaagaagaaagagcaaagtgagaggaaccaagacaatccctgactttggtttgagatcaaaggatttatatgtaagggtgattcatcagggtggactacaagatgcatttccggcatccaagttgacagcgaagtatcccgggatgtgtgttgcaagagcacaagtcttcatggctcctcatcactcagtgctagggcctgaagagcatttgctgcttggtcacaagtatgtcataatctcatgcaaagatgtggagaagctgaagcgtaaacatcctcagcaatgcaaaaccaaagagcataatggtgtggtaacattggaggcaaacatcattaggtctcctagtggacacaaaccaaaagagaatgacaaactcagtgtgccaaatgagatgattaacacaaggacaactctatctcctagtgaatgcaaaattcatgagaattgtgaagttaaagagccaaacattctagggaaagagaaagtgaatgaagagatggatgtgtgtcaaggtggagaagatatagaagttcattgctctgcaaaggatttttatgttggcaaggataagtcagtaagatattcaagaagaaaaggaattaaagtgaagaaacctttttcaccacctcttccagagggaagatcatataggggtttgggatggcaacctagccttgtcaccgtgcaagagctctctccatga

SEQ ID NO: 15142 - DNA, 488 bp, Glycine max
  Peptide Sequence Number=SeqID_131920
gcgaggacattgagtcctatggaaacataaaggcgaggacattgagtcctatgaaagataaaggcgaggacgttgagtcctatggaaacataaagacgaggatgacgttgagtcctatgaaaaataaaggcgaggacattgagtcctatggaaacataaaggcgaggatgttgagtcctatgaaagataaagatgaggacgttgagtcctatggaaacataaaggcgaggacgttgagtctgatgaaagataaaggcgaggatgttgaacaaaggatgttgagtcctataaaaaataaaggtgaggacattgagtcctatggaaacataaaggcaaggatgttgagtcctatgaaagataaaggcgaggatgttaagtcctatggaaacataaaggtgatggcgttaagtcttatgaaagataaaagagaggacgttgagtcctatggaaatataaaggcgaggatgttgagtcctatgaaagcataa

SEQ ID NO: 15143 - DNA, 153 bp, Glycine max
  Peptide Sequence Number=SeqID_131921
atggttcaagagttgtttacgcatagggaagaaaaagccatttggtgcaagggaagctcgcccaggcgagctgctcgcttagggttgaagctttttcttggcccaggcaagctagatgctagcctaggcgagtttagggtcagaaaactctag

SEQ ID NO: 15144 - DNA, 652 bp, Glycine max
  Peptide Sequence Number=SeqID_131922
gtgtcacattgatggaggtggagaagaagtagatgaatatttattggatcaatcagacttagatgaaccataccatgatgaatacatcacaagcgaagatgagatagagactcgagtcaccatcaactctttcattcacatatcaacctcaaagccaacaattcctgttattggacactgtcaagctccaatttttataattcatcaagaggaagtgaatcccaccaatgtaggggaatcggtccccccttctagggaggccacacctttgacatcagaagtttcacttacacttaagttaccacctcgtgcagagtgtggacaaccaattgatgaaagcctttgcttcaaatttttgctagacttaggggttttccatatcatctcagacatctttaaggcaaaatttaatgaagcatgtccaagttggaagaaggcatcaactgaacttcataataggtggtttggagagtttaaggagaacgcgatcaaatctatttttgagaagagaggttcaagacttttgaaaaattcatcaacaagatcagtaatgagcaagagctctattgccaaggagaatcagactgttgataaaagatcctcgacatactatagtggctctatatctactatagctcaatttgagaagctg

SEQ ID NO: 15145 - DNA, 372 bp, Glycine max
  Peptide Sequence Number=SeqID_131923
atgggtttagactacattgagagaggtgcaaaagtgtccaaagaagacgtagttttggtgatggaaaagctgggaatgaatgttgaatgtgatggtgatgatggggtagaggggtttgatgtaaaaaatattggggaattgtttgatgatgaggatgttaccttgtcggaggtagagcaagcatttgatgtgtttgaccaaaacaaagatgggtttatagaggcaagagaattgcaaagggtcttatcctgtttggggttagggaaagatttgatggaatgccaagaaatgattaatgcagttgatcgaaatggtgatgaactaattgatcgcaatgagtttgttaggattgtggaacagagttttgggtga

SEQ ID NO: 15146 - DNA, 1398 bp, Glycine max
  Peptide Sequence Number=SeqID_131924
atggccagcagcaagtgttgcatgatctctccacaacaaaaccagaatgcccccacatgttacccttctccaataggagtagtctttgcagatatgatggggtctctctctcttgccacagtttcaaataatgcttcttcatctcaagaaagtaatgtttatggttatggttatggttatgcctctggggtgggaaatgggagcacaaggtggagttttcctttcatgagggagtttctttcttcaaactttgaagactgcagtgatttagtaggggctggggagagtaacaacagtaatgagaaaacaaaccataataatggcaagttcagtgaagaagaaagtaaccctaatgagaaccatgccaatggcaaagaggtggatagtggacactccaaactttgtgcaagagggcactggaggcctgctgaagattccaagctcaaggagcttgtggctctttatggccctcagaattggaacctcatagctgaaaaactagaaggaagatcaggtaagagttgtaggctgaggtggttcaaccagttggatccaaggatcaacagaagagcattcagtgaagaagaagaagagaggctaatgcaggcacatagaatttacggcaacaaatgggccatgatcgcaaggcttttccctgggagaacagataatgcagtgaagaatcactggcatgttataatggccaggaagtacagggaacaatccagtgcttacaggaggaggagaatgagccaatctgtgcacagaagagtggagcaaaatccaacctttgtttgcagcagcagcagagataatgcctcaaccacagaacaagaaccagaaccatcaccttcctattatcccaatctcattcaccatggagtagcactcaccaataacatggctagtttcccacccttccatggagtagctgcgtgtaatggcgtggttgttgagtttggctcaaatggttctccacaaaacatgactagtgggagagaagcaatgccaaacaccacacatgttggcttgtctgctcaagctcaacaacaagcaccatttgatttcttctctggtggtggaagcaatgacatagtgttagagtccataagccatatgagaagcagggaaagaaccaatggatctcacaatcatcattgccaattatctggttgctaccctcattatccccaacaatatttgatggcaatgcaacaacagctagacaacaacaacaatttttacagtttcttgaattcctcaccagcagcatcaacagctagggaaccatcatcatcaccatgtgttgcagaaatcagagataaagtggagaatagtgaccccccagatggtgttccacccccattttttgacttccttggagtaggagccacatga

SEQ ID NO: 15147 - DNA, 132 bp, Glycine max
  Peptide Sequence Number=SeqID_131925
atgaacgaagtggagattgagaggcagcgagaaaagattggaggagctaagacggagaggaagaagcacgagagtggaagaggtgagacgaagaggaagaggcgcaaaatgattgttaacattgatttttga

SEQ ID NO: 15148 - DNA, 354 bp, Glycine max
  Peptide Sequence Number=SeqID_131926
atggcacctccagactctattcccacggtagagcagttaaatgagatggaagacgaaggtcccacagcccaggtacctcggcatgtggaggatgagtcatctgaggccaccatcccagagccatttgatataggagaagaggcagaggagacacaggtgagacaagtagctgctaccactcctgagcgatcccttgaggctacttccgagccttctacaccagtgattccagaggatccaactacaccagtcctagttgttgacacttctcctcccactactccagttcttcagttgacaaatttggaggatggtcagacacaggacacacaggaccagtcacaggaattttga

SEQ ID NO: 15149 - DNA, 152 bp, Glycine max
  Peptide Sequence Number=SeqID_131927
atggcagaaccatcaaagaagagaaagggattatcctccacaaccaccgctgcaggacaacgcaaccacgacacatctagtgacccacctaatccttctttttcttctccacggtcattgactctattttcttcagatgaacaacatcaaag

SEQ ID NO: 15150 - DNA, 351 bp, Glycine max
  Peptide Sequence Number=SeqID_131928
atgaagaggggtgagaatgaaggagaaacccatgctgcgattgtcattctacatggcccaacttcccaccagcccaacaatgtcaataacaaccattctctttacccaccacccagttatccacaaaggtcatccctgaatcaaccacaaagcctatctaccacacttccaatcacgaacaccacctttagcatgaaccaaaacaccaacgaaggaaggaattttgcagcaaaaaagcctatagaattcaccctaattccggtgtcttacgatgacttgctcccatatccattcgataattcaatggtagccataccccctgctaggtttcctcaacctctatttttctga

SEQ ID NO: 15151 - DNA, 216 bp, Glycine max
  Peptide Sequence Number=SeqID_131929
atggactatgaacaagggacaatatctcggattcgtatgaacaccaataggaatggcaacgcaatgttggaaacacataacatgggtgaccagaccggactccatccaagcatgaaagggagttcatcggtgttaaggatattctacgcctccatgtgctatcctttattcccatctcttttagataatattttgtgcttaaccatacaggagtaa

SEQ ID NO: 15152 - DNA, 204 bp, Glycine max
  Peptide Sequence Number=SeqID_131930
atgaaacacagctccaaactcgaaagtggaggacacatgaacgaaaatgcaattcacggagctccgaaaaaaggggttggcgggaccgaacggtccaccggtggggtgggatatcgccagtcgagaatgaccttgaatggaaatctgaagggaagagacaccaaaaatgggttttcctttgtcggcagtcccttaccttgctga

SEQ ID NO: 15153 - DNA, 708 bp, Glycine max
  Peptide Sequence Number=SeqID_131931
atgaactcctttcagttagcaaatgagtcttcttctctcctttccttatctccaaaatttatcctcccagaagataaaaggccacaactttcagatgttacttcactggactcaattcccataattgatttgagtgatcacggttataatgatgacaacccttcatcctcattgatggttcagaagatatcacaagcttgtgaggaatatgaattctttcagatagtgaaccatggcattcctgaacaattttgcaccaaaatgatgacagcaattactgacctcttcaatcttcctccagagcaaataggacagctctacacaacagatcctcccaagaacacaaaactttacaacaattaccttcatgtggagggtggagaaaaggttaaaaatgtggaggaggcttttagtgaatatccaagggagattggacttggaatagaagaggattgcttgcttaaaacattgaggcatcaacctagactaagagcacaatcaaatttctatccaccaagcccagatccagagccagagctgaccttaggtcttcctgtgcatactgatttcaatgctctaacaattgttttgcaatcagacgtttctgatctcctagtgatcaaagatgggaaatgggttgcagtgcctgttaatcccaatgcatttgttatcaacttgggagatcaaattcaggctagatgcacataa

SEQ ID NO: 15154 - DNA, 604 bp, Glycine max
  Peptide Sequence Number=SeqID_131932
gcttgtcgaggcctctgctgaatcggtgaagaggattctcccccaggcgttcgggaagattcgtgccctcgttgtgcttgatttgtctcagaatcagttaggggtgattcctgattcaatagcaggactaaagaagcttgtagagctggatgtttcatctaatgttttagagtccctacctgactccattggattgctagttaatctgaagatccttaatgtgtcagcgagcaagctaattgctcttcctgagtccattgctctttgcaggtcactagttgaactggatgcaagcttcaacaacctagtgtgtctgccaacgaacatgggttttggacctgttaaccttgagaagctcttgatccatttgaacaaaccaggggctgaggctgtgaaggatttcatggccaagtggtggcttgatctcatcgacgaagctcaacagaaaagcatggctgaaacacaaaatcatcaagcacagacgggatggcttgcgtggggagcctcattgttgaataatgttgctgaagtttcagaaagtgttgcagaatattttggcgctaaaaaagctcccagagacccatcgctggatcaacagctgtga

SEQ ID NO: 15155 - DNA, 135 bp, Glycine max
  Peptide Sequence Number=SeqID_131933
atgtctgataaaacgtgtcctccatgtctggactattctactggccccagcctcagaagggaaaatgcaaaagcagatttcacagcaacgttggtggaactttcattgaaaatcaaacctgaatttgaatgttga

SEQ ID NO: 15156 - DNA, 879 bp, Glycine max
  Peptide Sequence Number=SeqID_131934
tttgtgtcacaagggcagagtccaccaactagtcctgcaagatctaggttggcctttgaaagaagaaggtctcgttcagctgagaatattaacttggagtttcaagagagtaggaggtcctcttcagcatctcacagttcaaaactgaaagtggcaaagcttgtggataggtatcttcaagaagttgccagggatgtgaattttcagttgtcgaaattcattgctcttgctgagattataccagattttgcaagacatgatcatgatgatctctacagggctgttgacatttatctcaagggagagaaaattgcctgtcaaagctgtgtgatagagttatatcatattgctgcattccagtactatgtccaagctcatccagaactcagcaagagtgaaaggaaaagattgtgccggattcttgactgcaaaaaactgtctatggaagcatgcatgcatgcagcacaaaatgagcttcttcccctcagggttgttgttcaagttctcttctttgagcaagctagagcagcacaggctggtggcaaagtgactgatttaccaaccaatatcaaggcattactcacagcacatggtattgacccatcaaaaccaacagcaccattaagcactactacaagtataaatgctgaggacaattggagtgtttcaaacttcaaatcaccaaagtcaaagtcttcaacactgaggatgaagctagctgaagatgaggacttcaatcaaaatggtttggcccatgatggaattggaaggaattctagatttaaggccatatgtgctattccaacccaaccaaaaaaaatgcttactaagttctggtctactaccaatagaactgctgctacaactgaaaagaattga

SEQ ID NO: 15157 - DNA, 111 bp, Glycine max
  Peptide Sequence Number=SeqID_131935
atgacaaccaatgatttgaaagttcagatttcatctagaaatgatgtgatgtcaggagatggaatgaaggcacaagtgaggctttctagcagccaaggcctgtgtagatga

SEQ ID NO: 15158 - DNA, 225 bp, Glycine max
  Peptide Sequence Number=SeqID_131936
atgaagatgaaagccaaaaaaacaagaaatgaattgaaagtctcagatttgaacacttactggttgaagaacgaagaacgcatgaagaacggacgaagaacgacgataaatcttcacgaaattgctcacggaaacgtctcggaagtgttacggaagtacctcgacttggattttcttcacgaaaacacgttttttcacccaaaacagctgaaatgcatagcatag

SEQ ID NO: 15159 - DNA, 210 bp, Glycine max
  Peptide Sequence Number=SeqID_131937
atgtctgaggttgttattaaagactctgccataaagctgtttggtagaacaatttctctgccccgcaacaccaaaaacgaggtttctcctgatgaacctgctcctcctgaagattcatcttcatcttttccacgtgaagtgagctccacaacggaatatgatgctggggataagtggtggccacaagtcattgtggggcactgtcagtga

SEQ ID NO: 15160 - DNA, 891 bp, Glycine max
  Peptide Sequence Number=SeqID_131938
atggaaaaacttgagaagaaatctctcaaagaaaagaaagcatacataacatgggaggagaatgacatgggctcatcaagtgactctaaaaatgaagttgcaaatctaagtctcatggctagagattataaaagtgatgaagagatagcatcctccaatcttgattcaactatttcagttgatgaacttcaatatgcatttaatgatttgcataaagaatgcattaaacttgcaaaacttttttcatccaataagaaagacatttcaaacatagaaaaagaaatttcaaaattgaacaaagaattaaaggaatttaaacttgaaaatgaaaccttaggattaattgatgcaaactcatcatgtactaaatgcttaatgtatgagaatgctattaaatcctactcatgctcatcttgcaacaagtttgagaaagaaataaatggtttgaaaaacactcttgcaaagtttacctttggggcatattgctcaaatctaacattcaaggacccaagaaaatttggatacctaaatcaaaattgtgatattgaattgaaggatcttttgaagcaaagttggcacattgatagtgaatgttttaagcacatgatgggagatgcatcaaaatttattcacattactcctaaaaatagtggacatgtaacatatggagacaacaataaaggaaaaattcttagagtcattaatgtccaggccttggaaaacacttatattcatgaaaaggagttagaatccaaggaaaaggaaaacaaaaaggaaacttcatttcaagaggaatcaagaaccattgatcttccaaaagaatggaaagcttcaaagaatcatccacttgataacatcataggtgatatatcaaaaggggtaacaacttga

SEQ ID NO: 15161 - DNA, 150 bp, Glycine max
  Peptide Sequence Number=SeqID_131939
atggacaatgcaaaggaaattgctactcccatgagcactgcttgttacttggataaggatgaaggaggcaagttagttgacatcaagaaatgtagaggtatcagaccaatcctaaagaaacacatcttagtgcaatcaaaagaattatga

SEQ ID NO: 15162 - DNA, 378 bp, Glycine max
  Peptide Sequence Number=SeqID_131940
atggttaaggaggagtgtaaggaagtaagtgtctcctctaagagtgatcaaggggttcctatgaaccctaagagaataaaggtcattcctaagtggcccactccaccaacaccactcaatgagttagtgaggaaccatgttccttcatggaaagatgcccaggaaatgggttttcagatcttaccttacttcaacataccaaacatcactaatacatatgtttttgttctttttacaagtgttgaggaaaaaagcccagagtttcaagaatctcgggatttgaggtcaaatccttttcgaggggagggaatgatgcaatcctaccccgcaagggcattggatagaagactccaagaagattgggccagagatgcgtga

SEQ ID NO: 15163 - DNA, 699 bp, Glycine max
  Peptide Sequence Number=SeqID_131941
atggattcctttcgatggagatgccctcagtcagttcctgagacacccactgatcttgggagaaggccaacaatgcgatttgtagggattgcacctacaagacaccccgtggacccggagaagtccaacaaggccttagggtttcccgctctgattacgggcctctgtcagttctacaaagtgtctgttgcccccaacaaggcgctgcaacagctagaggaggacctacagccagctgcagatgcaccaccaccgcctcaagatgaggtaccgtctctgaggtccatctttgatcgcttgcaaaggatagaactccatatgcacagtcctttcccttggcccacccccgagcagttcgaggccatggtggcctggcttggcctggggatgagaccgattttgagacataagcggggcccgcggggacctccggaggtggagatgaagcccaagaggatgaggacatggccgacatggtggacttcctcctgtgaggagtcagagctgttgttcgcactccgggatactacttgtttgtgtggatgcaaaatctaccaacaagtgcaccaggtcgtcaaatatctaaaggtgttgggtcctcttactgagcaaattgatgcaattaaggatgtttctctaattaaagatgtttttgtgttctatgctgaaggctcaagtactaaacacgatgtctcgtga

SEQ ID NO: 15164 - DNA, 462 bp, Glycine max
  Peptide Sequence Number=SeqID_131942
atgaccgaccctctcaatgagtcaatctcttgctttctcaaaagggtggacccttgggtactagtaccctcaccttccgaggactacacgtcctcgcgttcagaggactacacgtcctcgccatcagaggactacacgtcctcgccatcagaggactacacgtcctcgccatcagagggctacacgccttcgcctttagagggctatgcatcctcacctttagagggctacatgcacaccctcagaggactacgtgtcctcacctttagagggctacatgccctcgccttcagagggctgcacgccctcaccttcagaaaactacatgtcgtcgccatcagagggctgcgcaccctcaccttcagagggttgcatgttctcgcatttagagggctacacatcctcactttcagaggactccaaatctgcgccttaagagaatttaaggtcttgtgcccttaa

SEQ ID NO: 15165 - DNA, 762 bp, Glycine max
  Peptide Sequence Number=SeqID_131943
atgacatcggcagaaatgcagttgagaagagaaaggggcctatgctttacttgtgatgacaagttttcccctagccatcgttgtcctaataagcaatattttgttctacagtgggaagaagaggatgaacctgcattacaaccagatccaccagacgaggttgagacagctggtgaccctagtttgcaagatcatcatttgtcttataatgctttaaaaggctcatcaggtcttggaacaatgaagtttcaaggatcaataaatggattgggagttttggtgggaaatggaaatgccttgactgctgaaggattaattctagacttggaggtgaaaatccaaggtcatacactgaagctaccagtgtacctacttccaatttctggtgctgatctagtgctcggggctgcatggatcaattatttagatataccggttgatatggaactagaactggccatgatactttacacttatagaacagtatttgatgtgccatcaggattaccccctagcaaaattagcaatcattcaatcccattggttgaaggtgttggaccagtaaaagtcaagccatataggtatcctcacagccggaaggatcagattgaagtaatgatagctgacatgctcaaggaagggattattgcccctagcacaagcccattttcatctccaatcattcttgtcaagaagacccccccccacttggagattttgcacagattacagggccttgaatgccatcacaatcaaagatag

SEQ ID NO: 15166 - DNA, 333 bp, Glycine max
  Peptide Sequence Number=SeqID_131944
atggattcaaatgcttgtctaccacacttgctagtgttagcaataacattggtattggttagtcatgcaatgggagattcagctcaagacaaacagagatgtgcagaatccctgacaggtgttgcaacgtgtctgccatatttgggtgctgacgcgaaagcacccacagcagattgttgcagtggtctcacacaagccatgaagaccaacaagaagaagttcccagaaggaacagatgaaacggcctcagctaagaatagtgaatcttatatcgggaagagattcttagaaagtttggttgcagttgcagggcttctaatttggctttcatga

SEQ ID NO: 15167 - DNA, 997 bp, Glycine max
  Peptide Sequence Number=SeqID_131945
agggctatatgccttcaccttcagagggctacacgtcctcaccttcagagaactacatgtcctcgccttcagagggctgcactccctcgccttcagaggactacaggtcctcaccttcaaaggtctacacgtcctccccttcagaagactacacgtcctcgccatcagagggctacaggtcctcaccatcggagggctacacgccctcgccttcagaggactacatgccctcgccttcagaggactacacgttctccccttcagaggactacacgtcctcgccatcagagggctacatgcccttaactttagaggactgcacgtccttggcttcagaggactacatgtgctaacctttagagggctgcacatcttcgctttcagagggctccacatctgcgcctttagaggacttaagagggaggctatcgcgcagctactatgcataccggggcaagatgctcccggggaggttatcgcacagcaactatgcatactggggcaagatttcatccaaccgctgcaaggagacgagtgtggatcatgcgcaccaccacaactccgatctccccctaccgaagtgtcagttggtctgtgccatcatgacatagaagtccaacagggccctgcggtttctagctttggttatgggcctctgtcagtcctaccagggatcgcgcctataagacacttagtgggcctggagatgtccaacagggtcctggggtttctagctttgattacgagcctttgtcagttctacgaagtgccattcgcccctaacaaggtcatcaggcctcctactaatcaagctttcattaggaagtactgcgcccccaggcaagtagggcgagacaccacaacagccaggggatggctggcagcaggcaacagacacaccgccgccacctccagagcccctcagctcatctacaaaagctggagcgttgcctacgacccgtggtcgacaaccaggcgaccaagtccaaagccaaag

SEQ ID NO: 15168 - DNA, 246 bp, Glycine max
  Peptide Sequence Number=SeqID_131946
atggggactgccatgcaaacaagcagtgcaaaggtggaaatccagatggccatactggagaagatccttcagggtctgacaggtcaagccattagaaagattcagatggatttcatcagaatgaagggtagcacactgcacgtttaccattcttatggaagaaaaacaccagaattgacattggaagggcttatctcagagctcatccagcattataatgggattgagtgtattgggaatgcataa

SEQ ID NO: 15169 - DNA, 1732 bp, Glycine max
  Peptide Sequence Number=SeqID_131947
atggttgttgcactttatcttaggttggattcaatacttttcgagcttcaaaattggaacatagtgactcccatggctcagtttgttgacaaggttgaacgttatttcaataagaccaacatacagataaaagcagaattagatggtatggagcgaaccaaagatgaagaatccaagaaattcaaaggccacaacattgaatttgacttccacatccttataaaaattaaagaagcaatggtggatgtttcctccaattgcatggagctagcactaaaggccttggctagcaccctaatgtctaagttgtcatctatgaggcttattggagtcacagaggaaggaagacttgctcaagaaattggtgaatgtgctcttactatgactcaagataaagggaagaaggaaaggaaggaaaataaccatatacctcctattgccaaaattaataaggagtctagatgttttttctgtaaaaagaaagggcacatgaagaaggactgctataaacataaggcttggcttggaaagaagggtgaacagttcgtctactctgggaattggatgcgtacacgtgtagtggctattggcacatgcgaattttatggcgaatacactaaaaatggacaagcacctggtctttttgcaaaatttcttgaagagcatggtattgtggcccaatacaccatgcctggctcgtcgaatcaaaatggtgtggttgaaagaagaaatcgaacattaatggacatggtaaaaagtatgcttagcaattccaaacttcctcgttcattatggaatgaggctcttaagatagctgtgtacatactaaattgggtaccaacaaaggcggtccctaaaaccccatttgaattattgaaaggttggaagccaagtttaaaacatgtgcttgtttggggttgcctagctgaagtttggatttataatccaaatgaaaagaagctggacccaaggaccattagtgcatatttcattggttatgctgaaaggtctaaggggtatagattttattgtccaactcatagcactagaattgttgagtcaagaaatgcaaagtttctagaaaatgatgtggctagtgggagtgatttaactcaaggcattggtcttgagaaaaatcaatgtgagggagcagttcctacatcaagttataagctagtggtttttggcaatactcaccaaaatcgtgtaacacaagctccacatcaagttaatcctatcctagcagatccaattgaacaacataaaacacaaaatgttgagaaacctgttgaacaacatcaaacacaagatgttgaacaacctgttgaacaacaaccagaagagtctcaatatgactttggagttgaaaatgatcccgagtcatttttgcaagtgattaacagttgtaattctaagttatggtatgatgctatgaaagatgaattggaatctatggtaaataataaagtatgggatcttgttgagttgcctaatgggataaagcctattggatgtaaatgggttttcaaaaccaagaaggattcattaggattcgctcaaagggaaggagttgactacagagaaaccttttctcctgtatccatgaaagattccttatgcatcataatgacattagttgctcattttgacttggaattacatcaaatggatgtgaaaatgacttttctaaatggtgacttagaggaagaagtttataagacacaacccggag

SEQ ID NO: 15170 - DNA, 885 bp, Glycine max
  Peptide Sequence Number=SeqID_131948
atgggctacgtgggagtacgtgagctcagttggaggagggcaacaggggatggtgggtttatacgtgatttgtggatgtggaaaacttgttgtgcaccatcgcccgaccgccacctagtaccacagagtggtacctggagatatgtcacgggggtcaggagatcttggggacgtcaggaacaaagaccacaaagcaaggaggcttgtgtggtggctggccagctgtggactttgattgatatatgggatatggcctctggtaatcgattaccaagggcctctggtaatcgattaccaggctgtgtaatcgattacacagaggaacatgtcactgcctctggtaatcgattaccaaggctgtgtaatcgattaccagagatgaaaagccttgagataccccttttacttacatgtagtggttatgggacgcattgtgttgctaccgcaatcgtgatggcgatgcagctaatccatgatcgagtggagatggagtgcctagagggagcttgggagaccctcgaaggcaatacgaggtgccgattccggggcacgattcgatttacggctacttcgttggtgcatctagatgaacccgcgcgcacgcttcagcgtactgtggagtggatactacccacgcctacaccatatcgtctagtggagccagtccaagtgatcgaggtaacgtcatccgaggaagaccctgaggaggatcttgaagagctacctcctgagcctgctgtggatgctcttgactttctagagggtgatgaggatccccttcctgaggtggattctcccgaggacgtcatgtcggcatctgaggtagactctatggaggatagtggccctagagagatggcgactagtggaggctcttcatcatag

SEQ ID NO: 15171 - DNA, 678 bp, Glycine max
  Peptide Sequence Number=SeqID_131949
atgcttcactttttgggactttcagttggcaccgagcttaaaggagttcaaggggatctaaggatgcccgatagaaggaaggaagccatacctcttttctgggaatggagtagtgggtataccgaggaagtgcttggaggagaaggcaaaaaccatggcaagccaatgagagtggcgattgatgcctttcttgcttatcaccacaacaaggaaagcccagttgttgctgtgttggtagatatgtatgatgcattcgacctgagatgtcattgcatgtgtttgggaaaagacaaagtatattgggaagagttcctagcaagtgtgatggggttgtccattagttggttctcacggtggaaagaaggggtagtaggagtattgtgctcagggtatcctatgagaggtgcgccattggaggaaaccatcatgcctttcattgcacgaggattcagtgaagctaatacggagatacttcaaaagatccgtcaggcatggaataaggtggaaagggaagataaagagcttagaggaagaagcaacagtgtcataggcggttatcacaaatggctgaaatctagagtgcaagggattgtttggctcaaaaaagatagagggttggaatggggaagagacagaggagtccgaggaaagcgaagaggtgcgagtcttgaaggctga

SEQ ID NO: 15172 - DNA, 303 bp, Glycine max
  Peptide Sequence Number=SeqID_131950
atgttgtcaaattcatctgttgaattatggagaaagctatggttggaggatggcataacaaggcttctgaaccaaccagagcaagaactgcctttgattttagagataatgggtttgacatgtggattgcaaacaccagatcgaggaaccaaatatagctgccgtcacatctcattggacccttctagcctggcttattggaattggtcttgggatgaaattgtctcctatgatttacttgtcatgtttaattatgtgtttagccaaacggagcagaagatcaattacgttggccattccttg

SEQ ID NO: 15173 - DNA, 615 bp, Glycine max
  Peptide Sequence Number=SeqID_131951
atgggcccgaaatctaccctaaggctcataagaaccctagggccttctcttgcatctctggcccaatctacttggagtttttctatccaatgcccttgcggagtaggattgcatcactacctcacgcaaccccccacgcacttccatctcttccccaaccaccaagaacccgtcatcttcccttcccctgaaacacttatctctagaggatgcgataaaaaatatcaccacggccacaagtgcacctcaaaggttttccatcttattgctgaagaagacaaagatgcacagatggacccttcacttctggactcgcaacccgaaccgcctgatgaaatggttttttcccaggcccagatcagcctccacacctgtttgacggtcggcaagtgcaccggatcccgcaagcagtataaaatggatgttctctacctaacaatgttcatgtgttctatgttgtctcctggactactaaaccccgatgtctcgtgcatgtgtagtctaatcctaatcaagcgtcgtcctcagatgtctcttattgtactaaacttaatcagaaccgcattaagacataacataacaaaaacttggttacagtacttcgatgtctcgtga

SEQ ID NO: 15174 - DNA, 720 bp, Glycine max
  Peptide Sequence Number=SeqID_131952
atggacaacagaggaacaggggcttctccttacgagatcacgtatggtaagaaaccttttactatcccacagtatgttataggaacatcgaaagtggcagcggtggatgactttctgactaaccaagaggccgtttttgccttatttcggaagaagctgttgaaagcccaggaggttatgaagagatcagttgataccaaacgcagagacatgaattttcaatgtggcgactgggtaatggtcaaattaaggcctcataggcaatcatatgtttcaaataccactcactccaagctcgcaaagaggttttatggtccttatcagattatggagcagattggtaaggtctcgcattcaccctgtcttccattgttccatctcaaaccatttaagcaatctttcacctgtatacctttaccttttcctgctaagactgttgacatcaagcctctgatttcacctctcacgatcgtcagtacgaagtgggaccagaagtcctcatctcccaaacttttaatgcttgtccaattggaaggactatctccagatgatgccacatgggaggactgggaggagcttaagtctgacttcaaccttgaggacaaggtcattttcgatgttgcaggggatgatatacagagcaagatatcacaagtggaaatgacaagcagacccaagagggaaatatcaacaccaaaatatttagcagattataattga

SEQ ID NO: 15175 - DNA, 213 bp, Glycine max
  Peptide Sequence Number=SeqID_131953
atggtggctggagaatcgaaggctcgagagctagcagctgagtgtgaaaggtacataggcatttgccctaagcacgtgagctacctgcacctgacatatctgattttccatgactataaagaggtgattatggtcgtggtgccaagagtactcaatgctgatgctaccagcctaggttgcagtcagatgaccacgaccatactcgattcttga

SEQ ID NO: 15176 - DNA, 186 bp, Glycine max
  Peptide Sequence Number=SeqID_131954
atggtctcagtaaaattacgatcccgggagaaaaaggaatcgcatgaagacagtacaagtggaggtttcaatctcttctccgtctctctgacgtttgggaactctattagaggcagtcggaggaaaaactggaggaatctcagggaaccactagagatgccgctgtcgttgttggaagacacgtga

SEQ ID NO: 15177 - DNA, 240 bp, Glycine max
  Peptide Sequence Number=SeqID_131955
atgacatgcgggaaccatttggtcccccactttttaattttgtcatccagaggcggcgggctcgatgacatgcggagaccaattacggtcatccgcacgcttttgctatctagacaagttatgatcattctgcgccctttgtcattcaggagcagcaagttgagtgataaacacgcagagacaagttatggtcattctgcgccttgccacccaggctcgatcgtgtccgaagacacgtag

SEQ ID NO: 15178 - DNA, 750 bp, Glycine max
  Peptide Sequence Number=SeqID_131956
atggagtttgatccaagtttccaagggccacaatacctttcaagtcttttccctagaaactcctacttgaagccactaactcaaaccatatttccatcacaaagctccattttcactccacctccaccatcatccgtcatgtttcaccctaacaacaattcccaccattttcaagaccacatcatgaatgtgcctaccaacaacactccctttgtgatggaaggtccttctaaccccatcaccacccctatgtatgggataacgaccccttctttaggcgatgggtcttccctgggaggctttgtcaatgttcaatgtcacccccctatgatgttggcaccaaaaaacaataacaaaatggaggccttgtatggccaggacaaaggcaaagccatatcagatttttcacaaaaaaccatgctttgtttatctgaagattcttcttccaagtcgccatcacccgtttctctccctaatgattggtggatgagtcaatatcattgggacactgatcaaaaggtaaaggtggaaaaggattccaacattggtaatgataatgtaatcaaagggaagtggagtatgaaagaagacagggatctcatagaattagtgaatcaatatgggttgaagaaatggtcaaaaattgcaaagttattacattgtaggaccgggaagcagtgtcaggaaagatggaacaaccatctccaaccaaatattagggtttctctcctttccattcttattttatag

SEQ ID NO: 15179 - DNA, 975 bp, Glycine max
  Peptide Sequence Number=SeqID_131957
gtgacagtgaacggccccggtacaaggaaggaagtaggccaatccaatgggactagcaagaattctgatcatgacgagattctgaaactgatccagaagagtgagtataaagtagtagaccagctgctgcaaactccctctaagatatccattttgtctctgctattgaactcagaagcacaccgtgaggctctaatgaaggtgttagaccaagcttttgtggaaagggacgtgactgttaatcaattggacagtatagtaggaaacattactgcctgcaataatttaagttttagtgatgaagagcttcctgaggaggggaggaaccacaatctggcgttacatatatcggtgaactgcaagtctgatgctctgtcgaatgtacttgtggacaccggttcctcattgaacgtaatggccaaatccacattaggtcaactctcctaccaggggcctcccatgagaagaagcggggtggttgtcaaagcatttgatggatcaagaaagtctgttatcggggaggttgatttgcccattacaattgggccgtttgttttccaaattacattccaggtgatggatattcaagccgcatacagttgccttttgggtaggccatggatccatgaagctggggccgtgacatccaccttgcatcaaaagctgaagtttgtcagaaatgggaaattgatcactgtgagtggagaggaagccttattgaggcgtcaaaagccggagaaaaatgaagtatcttttgctacttggaagagcgcacagaaagtggtgcaggaaggaacaggtgtaggatggggaaaaattgtgcagttgatagagagtaaaaaccgtgaaggactgggatttgcttcctctgcaggatccgcaacgaacagtgttggatcaagctccatcactagcaccttttgtagcgccgggttcatcaacaactcgccagaagccaatgctgtcttggaagac

SEQ ID NO: 15180 - DNA, 213 bp, Glycine max
  Peptide Sequence Number=SeqID_131958
atggtgctcattaatcactctgcagacttcagaaattctaaaccaattaaccaagctgtggaaaaacttctgtggaagatcaattactcaagattaaagtccaggaggggacaattttgtggacataaggaaagtgccaatttctccatctttttgttccgtgtgatttcttcaccattattcgttggccaccacagatggttaatcaattaa

SEQ ID NO: 15181 - DNA, 675 bp, Glycine max
  Peptide Sequence Number=SeqID_131959
atgtcaggaaatattttggtgaaattttcaggtaaggagaaactggtgctgtacgaatacatgggaaacggagacctgggaaggtggctacacgagcttccaactggagacaccaacgtggaggactggacaggcgacacgtgggagattcaaaacggcgtcgtcgacgatggatccccagaaaagatggggtggctcacacgacaccgtatcgcagtgggcatagcgcgtggcctcgcgtatcttcaccacgcgcgttccaagcccgtggtgcacggccacctcgtcacctctaacattctcctcgccgacgacttcgagcctcggatcgccgatttcgggttgcgatccgacccgaacccgagttctggcactgaggacgacgtgtactgtttcggggcggtgctggtggagctcctgacggggagggagagcacggcggaggcggtggcggcggcgcggaaggcggtgagggaggggcacggcgttagggttttggacgagaggctccgactcgggggtgactcggtggtactgagtcagatggtggagactctccgagtcgcgtttttgtgtacggcggagagcccttcgaagaggcccacaatgcaacaggttttgggtatgctcaaagacattggacctcatcaccaccaccaaatcaactcgtcctga

SEQ ID NO: 15182 - DNA, 264 bp, Glycine max
  Peptide Sequence Number=SeqID_131960
atggctatatttataaagccacacctttatatctccaccttaataatttcctccagtaatggtattttatttagcattacgaggcaactttgttggactcgagtcgttggactcaaggtggtcatagaaggcaacgatggtttggtcgaaggagacaccagccttgacaaggatggtggtaaatatggggcgttggagggaaaggttcgaaaggaagaaataaaaatattaagtttaaatcgattcgagagtcattcaaactaa

SEQ ID NO: 15183 - DNA, 516 bp, Glycine max
  Peptide Sequence Number=SeqID_131961
atggccccttctggaaggacaacaacagcatcaacaaggacaacttcaaagacaacaagaagaacaagacagcagagaagaacaacaaacttcaagaagaagcagcaacagcagcacaacacaaagagcaacaacaacaaaaaacaacaagaagaggttcctgttccaactgttttgccctccagctactgcagctcctcctccataagctcacaagactcttctaattcaaaggaagtggacaacatgcatggttctgctgaggtgattgatgtttgcaacagtccatgttccacaccaaagggtaaaaaattcaggattcctgagatttcaacatgccctccagcacctaagaagcctagggttctctccaattgctctttgcgtaggtctccactctcattctttgcaccccctgacttggagcacttcttctttgtggcacttagagatgtctcgggtttgccattcactaaatttagctggggtggctctccaactaaatttggattttaa

SEQ ID NO: 15184 - DNA, 1044 bp, Glycine max
  Peptide Sequence Number=SeqID_131962
atggagagcaaactatttagtagttcttcccatcaagaccctattcaacatcagaggaagttcatcaagttgaccaacatgttgaaacaaagccagaatgacatcactacaaggaatcaatgcacaagtgccttcctaaggaggtatttctctcccgtgaagatggatcaatacatcaggggcatgggaaactttgtgcaaagagagcaagagagtccacctgaagctttgtcctcacattataggatgagtttggatgctgcttatgggggggaatgcactgttgatgacgagctagttgcaaccatggatgagatcaactttgttgggggaagaaaaacttcttataaccaataccctagcaatttcaatcaaggggatgagaaagtagtgtttaacttgtctgatactttcaaacaactttcctcatttgctttctatagtttcattgagtctattgacatatctaatgcattgatggaaggggtgttctcaattgaggaaatactgtcgtttttccactctcaacatggtcctagaccgttcagttttgataggttggaatggggcaatggtccaatgccaaaaccttttgttgaggaacctcctaaattggagttgaagccccttccttccaacctcaagtatgacaacaagaaaacatttgggtggagcattcatgacataaaaggtttagacccgataatttgcacccacagaatcaacattgaagaagggtttccacccaaacagttaccccaaaaaaggcataattccaacatgatggaggtggtcaaaggagaggagaagtgccaattcatggtgaaagagtgtgttgtcttggggaccaactcgccccatgttggcatggaggtcgatcttgtcaaagtggaggtgattgcaaaattgccactgccaaattatgagagctgtggggggctttttagggcatgttggattctagacgaggagtgcctacgggcattcaatattcttaagcagagtctggtgagtgctcctgtggtgactacccttcgagctcat

SEQ ID NO: 15185 - DNA, 204 bp, Glycine max
  Peptide Sequence Number=SeqID_131963
gtgtatgctgctaaaggcaatagaggaaggaaggagttggtgcttaataaaggggattgggtcttggagatgatcaacaacaatgcttatatgctaaacctcctagaggagctagacctcccagaggagtatggagttagcaacacatcatataatcacactttgtgcatgtccttcatgctttacatgcctcatgacatctaa

SEQ ID NO: 15186 - DNA, 697 bp, Glycine max
  Peptide Sequence Number=SeqID_131964
atgtgtgccttcggggttttatgtgaaaaattctttattactcctaccgcttttaaattccttcatcactataacgtgaatgtaaacaaaaaagagggttgggtttctcttgccggcattcccgaacggacttcttctgccaacaaggataccatgaaacctgtggtatacatgtcttcctccgaccaagaagacagtgttgtacttcataagttcccgagggctcttcattgtaagaccctagtgggcatgcctttctccaaaactttgactgtggattgggagcatgagtatctttttgactacgtcgaagatgattgggttccttctccccctcccatcagatcgggggactgcttctcgttgggggaaggattcaatcctagtgccttcatccagtcttccatgctcaaccaattggatcgtgacatgctaagggaggaggttgagacccaggaaaaggcattaaagaccaagttagcctttgccgagaattctgctaagactctcgaggaagagattaaacgcctcaataaagagtttgctttattcaaggaggaagctaaaaaggctaaggagaaattaaacagtgatctcaatgaggctaagtccaagatcttaaggactcatgaagatgtcaattgtcaagtggatttggtcaatgaagttgagatgtctgaggatgaagtgccaactg

SEQ ID NO: 15187 - DNA, 678 bp, Glycine max
  Peptide Sequence Number=SeqID_131965
atgaccaggtttagagagaaagtgtgtgggaaatcctcaacaaagccaacataccaagaggtgaagatcgaaagtagtcatagtcgaggaaaatccaaaaccagcagaacaccccgatccagttgctggctaagaatggacctccaccaagagctaacaagttcaacctttaaaaaactaggcataccagaaaggcagattgagccattcataggttttgtgggagaaacaacggacacaataggatatgtgcacttgctaactactttcaaagatgaaagggggtcaaagtccatcatgatcaaatatatcttaatcggtgtcttaacttcttacaatatattgataagacttccttcactcaacgagttaggggccatcattttaattccctatctggtgatgaagttcccaagtgaggatgagaaaattatcactgtcagagctgataagatgattgcaaaggaatgttatgtgttaagcctcatgatttctaacatgaagaatatggtagagcccaaagtacaactggtagtatgcacctctcttaacatcaacctgggagaattcaaacttgatctgagagaagtagagctgagagcagaacccactaaagaagtgattccaactttgaaaagagtcatctcagtgcaccaaactcaaatgccagataagtag

SEQ ID NO: 15188 - DNA, 210 bp, Glycine max
  Peptide Sequence Number=SeqID_131966
atggctacgaatgacaacacaccaacaccatccttcaaggaaatcaaccatgattatggaggcacaactcccacctggatggaagtcgctgaacatcgatcaatacggatggactcttggacccgaacaaacacgtggatgcatccgtcacatagaaaatctgttcatgaattgacgacacatcatatgtcgagtgtccctacacgttga

SEQ ID NO: 15189 - DNA, 2343 bp, Glycine max
  Peptide Sequence Number=SeqID_131967
atgggagaggattctggggagtttggagaaagcacaaaaatcaatcacaagatggaaaatgttgaaagagaagaagaaatagacccagaaagcaatccactgaatgagccactgctcaagcggaaccggacactgtcttccaaccctcttgctctggttggagaaaaagtttcctacatagaaagcttggactatgagataaatgagaatgatctattcaagcatgactggaggagcagatcaagagttcaagtgttgcagtatatattcttgaaatggttactagcattccttgttggacttctcactggtattatagccactctcatcaatcttgcagttgagaatattgctgggtataagcttctggctgttcttaaatacatccacaaagaaaggtacttgacgggtttcctatatttcacgggcattaatttcgttttgacgtttgttgctgctattctctgtgtgtgttttgcacccacagcagcaggacctggaattcctgaaatcaaagcttatcttaatggtgttgatactcccaacatgtttggtgctacaacattgattgtcaagataattggaagcattggggctgtctctgcaggcctagatttgggaaaagaaggaccgttggtgcatataggaagctgcattgcttccttactaggccagggaggccctgacaattacaggatcaaatggcgctggcttcgatattttaacaatgatcgtgaccgtcgggatcttatcacctgtggttcatcttcgggagtttgtgcagctttccgggctccagttggtggagttctctttgctcttgaagaggtggcaacctggtggagaagtgctctcctgtggagaacttttttcagcacagctgtggtggtggtggtgctcagggccttcattgaaatctgtcatactgggaaatgcggcctttttggtgaaggaggattgatcatgtttgacgtaagcaatgtcacagtgaggtaccatgttatggatattgtccttgttgtagtcattggaatcattggcggggtattgggaagcctttacaatcatgtactacacaaggtcctcagactctacaatctcatcaatcatcttgcagttgcactattcacatcaatgtgcgaatatggtctcccattcttagcaaaatgcaccccatgtgatccatcacttccagagtcaacctgccccaccaatggacggtctgggaatttcaaacaatttaactgcccacctggctactacaatgatcttgctactctgctgcttaccactaatgatgatgccgttcgaaatatattctcaactaacacccctcaagaatatcaacccttgtccctcgtaattttctttgtactctattgcatattaggactaatcacttttggaattgctgtgccatctgggctcttcctcccaatcattcttatgggctcaggttatggccgccttctcggcatctacatgggacctcatacaaacattgaccaagggctgtttgcagtactaggtgcagcctccctcatggctggttccatgaggatgactgtatccctttgtgtgatcttccttgaactcaccaacaatcttctcctactaccaataacaatgattgtcctcctaatagccaaaactgttggagacagtttcaacccaagcatctatgagattatactgcacttgaaaggccttcctttcatggatgcaaatcctgagccatggatgagaaatctcactgtgggtgagcttgttgatgtaaagccatcagtggttaccctccatggagtagaaaaggtagccaaaatagtagatgtcttgaaaaacactacacataatgctttccctgttatggacgatggggtagtaccaccagtagtaggacaggccaatgggggaacagaactgcatggactgattctaagagcacatctcatccaagcactaaagaagaagtggttccttaaagaaagaaggagaacagaggaatgggaagtgagagagaaatttacctgggtagagctggctgagagagaaggaagtattgaagaggtggctgtgaccagtgaggaaatggagatgtttgttgatctacatcctcttaccaatacaactccctttacagtgctagagagcatgtcagtagcaaaagcaatgatcctcttcaggcaagttggacttcgccatctgcttgtagtacccaagtatcaagcatctggggtatccccagtaattgggatcttgaccaggcaagatcttcttgcccataacattctgacagtctttcctcacctggcaatatctaagggtagagaaaagaggaattga

SEQ ID NO: 15190 - DNA, 573 bp, Glycine max
  Peptide Sequence Number=SeqID_131968
atgatacgaaatactcatccaaagcttggtgccactcaaatgaaaaatttctttcaaaaagcaactaatgaagataggatcactgttagagacaatactataaggaaaaccatgatgcttacagactatatccaaaaagagtgtggcaactttgaaggcattataatgagcaggaagtgtgcgaaaatgtacacccttggagaaacaatcaacaataaccagaataataaaatccattggagggagggaaatagtaatgaagtcaagggaaatgttaggccttttagtctcaaaaggaattggcaaagcaagacgacacccatagcaaaccctgaagcgtcgggcttaagagggaataagacagtaaaatccgacaaggccaaaatgggggcacaggctagtcgagcatggcttggattttggagcggtctagttccaccccttggactgagacaatatgccccaaaaattcaagctctctttgggcaaaaacacgcttggaaagcttcaagaagaattaagtttgcaaaagaagagaaagaatataatctaatcgatgaaggtgggcagtga

SEQ ID NO: 15191 - DNA, 342 bp, Glycine max
  Peptide Sequence Number=SeqID_131969
atgcaaacaacattttgcagaagaggaggtggaattacttccactaatgaaggcattggagttgagcaaagagcaataatcactatgttcgggggtggagtagtcactaactgttcccaacagatttctgcaaggtttgaccgttggatttgcaaaataacaatattttacctctctcttagtgtgaaaagtttgctaagcgcaattcgaacccgagaggcaattgctctaagcgtgaattgtcgtgcttaccacaagaggaattgtgctcaacgcaaattgtcatgcttagtgcaaatcctaacccagaggaattttgctaagcacgaaagtcgtgcttag

SEQ ID NO: 15192 - DNA, 504 bp, Glycine max
  Peptide Sequence Number=SeqID_131970
atggccactttatatggagcagaaaataaatgcgtttatgctgttggaggagcttggggtggcggtgcgggtggcgaaggaggagggaggagttgtatgacgagaacaggttttggtatgaggaaaaaggttaaggagctgaaagtgagtggagggaaagcgttgtctaagagttttgaggctaatgtttctgctgtttactacttaaggggtactactaccactgggttccatacattcccttggaggacaagtatgggtaaccaggaacttcttgattattttagcatatatgatgctatgagagcacgacactcttatggcccacaaggtcatcgtgggatgagtgttttgatatttgaagcctcagctattggctatctagaggtagaacgtctccacaagcattttgttgagcaaggaactgataaagattcttggttcacttgccctattttatatctccctgggggaattgccagctctatggatacatggctatag

SEQ ID NO: 15193 - DNA, 300 bp, Glycine max
  Peptide Sequence Number=SeqID_131971
atgtatatgcaagaacaattcttcaaggaccagatcaaaatcattcatgattcaagggatgcgaaggaagaagatatcaagaggatgcaaccggaggaatgtgagaaggtgaagcagtcatgtactactggtcatgtgaatgctaaggaatatagactcaaggtggaagagtatctgaaatttgttgaggtccaagataaagaaatggagaacttagttgctgaaaaggagaagttgttacatgcttgtggcatgggttatgctgcaatgaagtcgaggcattgggaggaagaagtttag

SEQ ID NO: 15194 - DNA, 345 bp, Glycine max
  Peptide Sequence Number=SeqID_131972
atggtggaggtctccacggagtccattgcctccttcgcccaatattatgaccagcctttgaggtgcttcacctttggggacttccaattaacacctacggtggaagagtttgaagagatcctgggatgccctctgggaggaaagaaaccatatcttttctcagggttccatccctccttggctagaatttccaaaatagtcaaaatcttgacacaggaattggaccggggaaagcaagtcgagaatggggtggttggagtaccaaggaaatgtttggaagcaaaggcgagaaccttggcaagtcaagacgaatggctccgttcgtggacgtcctggcgctcttga

SEQ ID NO: 15195 - DNA, 237 bp, Glycine max
  Peptide Sequence Number=SeqID_131973
atgcccaatgcccaaacaccacctatagcgcaaaccaaaaaggaattttgcagcaaaaaacctgtaggattcacctcgaattcagccataacccctgccagggttcctcaacctccatttttccaagaatacgactcgaacgcaacatgtgcacatcatggaggagtctctggacattccaatgagcactgtatgaccttgaagcgtaaggtgcaaagtgtaattgatgcaggctag

SEQ ID NO: 15196 - DNA, 483 bp, Glycine max
  Peptide Sequence Number=SeqID_131974
atggttttccgccagggaactgatgggcaaggcggggttgccttcaaccccgcaaggggtcaatttgatggcccggcgcgaaggctggctcagccgccgccgcagcggcgtgcagggcaaagcgctggaataccatatcgacagcctgccgtacggcgcgcgcagcctgtcggccttgcacgagacagaccctccgggctacgacgtcaaacgccaggatccgatacgggtctggatcgagtattactatcacctgacgccggccgagcgggaaaagctgctggcgttcctgatgcgcgagggcatgagccgcctgctgcagctgatcgagcccccccgctagcccgaatgctcaatcctccccttccggcgcccagccgtcgttgtgccacagatgcagcgtggcgtaagagcgccacgggcgccaacgttcggcatagcgttcgatctggcgcggcgtcatgccgggaaaacgctgtttga

SEQ ID NO: 15197 - DNA, 390 bp, Glycine max
  Peptide Sequence Number=SeqID_131975
atgaatgcaaaaccccaacgtcgttccctgatgctgcgcctgctggttgcggcgattgcgatcatcgtcgccgttctggcctggcgccatttcagcgccgcccaaccggccgccgggacgacgccgggcgcgcaccaggccgccggtaaaacgggagcgggccgcgcggcgggcggcagacgcggcgcgccgatgtcgccggtgcaggtggcgaccgccacccgccagacggtgccgcgctatctttccggcttgggcaccgccaccgccgccaataccgtgaccgtcaccagccgggtcgatggccaactgatggcgatccactttaccgaaggccagcaggtgaaagccggcgatctgctggcggagatcgatccccggccgttccag

SEQ ID NO: 15198 - DNA, 110 bp, Glycine max
  Peptide Sequence Number=SeqID_131976
atggcttcgagaaagcattccacaaagaaatctaggaaggacgccacagccgaagggactagtgctgctcctgagttcgatagccatcgtttcaggagcgctgagcacca

SEQ ID NO: 15199 - DNA, 291 bp, Glycine max
  Peptide Sequence Number=SeqID_131977
atgaacccagatttcaaccaaccacgaggcgggtgctcgcgggaggtcagcatacaccccgcgcagcaacattgcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccgcgggacaccgtctccgggcccccgggagtcgcacttaa

SEQ ID NO: 15200 - DNA, 325 bp, Glycine max
  Peptide Sequence Number=SeqID_131978
atggaagagggatatgctgcttctgtaaatcagaattaccagtggaagatcacctgcatagaaattagtgaggttgggcaggttcatttgcggatgaggaagatgttgctggttgaggttcttgaccctgctttcccgacctcaatgctctggtctcttgttgaaactgcagttttgcatagtcatttgcctcacaagttcttcaagggaaggattcgaccatataaggttgggatgattcctccacccgggattttacctgttgctggagagcataagcttcaggctgttcaattgcttcagattgttgcacagaagggcaaag

SEQ ID NO: 15201 - DNA, 489 bp, Glycine max
  Peptide Sequence Number=SeqID_131979
atggaaaggaatctgccagcaaattttaaaggaatctttcttggttattcattacaaagcaaggcatataaagtgtttaataggataactttgcgtgtggaagaatttgtatatgttgtttttattgaaaaaaactcttttattcaagaaattgttttggaggatgaagatgcaggttttccagatgaacacattacacttgaagaagaatccaattttaaggatcttgaacaaagcaaagaaatcactaccactcatcctaaagacctcccaaaggaatggagaactcaaagagatatctccttggacaacatcataggtgagatatctaagggagtatccactcgccatagacttagaattctatgcaataacatgacttttgtttctcagattgaacctagaagcatagatgaagcattccatgatgagcattggttgttggctatggatgatgaattaaatcagtttaaaaggaatgaagtgtga

SEQ ID NO: 15202 - DNA, 1074 bp, Glycine max
  Peptide Sequence Number=SeqID_131980
atgattggtaagggtattacgccttcactagtttcggacagccacatgatacttggtcactgcaaaaagggttgcatggatgatgcacatgaagtgatgaatggtattattgaaagtggtttaaaaccaaatgccattacatacacaattttgatggaaggatcttttaaaaagggtgattgtattgtgcccacagactacacatttaactccattattaatggcttgtgtaaagttggccgagtgtctgaagcaagggataagttgaatactttcatcaagcagagttttattcctacatctatgacttataattgcatcattgatggatatgtcaaggaaggtgcaattgattctgcagagtctgtctatagggagatgtgtcgaagcgaaatttcaccaaatgtcatcacttatactagtttgattaatggattttgcaaaagtaataagatggatcttgctttgaaaatgcatgatgatatgaaaagaaagggtttggaactggatattactgtatatgctactctcattgctggtttctgcaaaatgcaagacatggaaaatgcatgcaaattcttctctaaacttttggaggttggtttgactccaaacacaattgtgtataacatcatgattagtgcctacagaaatttgaataatatggaagcagcacttaacttgcacaaggaaatgataaataataagattccatgtgatttgaaaatatacacctcactgattgatggacttctaaaagagggtaagttaagttttgctttagatctttactcagagatgctttgcaggggtattgtgcctgatatcttcatgtacaatgttctgataaatgggctctgtaaccatggacaactagaaaatgcaggcaagattctaaaggaaatggatgggaataatataactcctactgttcttctttataacactttaattgctggacattttaaggaggggaatctacaagaggcttttagactgcatgacgagatgcttgacaaaggtcttgtgcctgatgacactacatatgatattcttgtaaatggaaagttgtaa

SEQ ID NO: 15203 - DNA, 1461 bp, Glycine max
  Peptide Sequence Number=SeqID_131981
atgcctcgtacaaccactctcgagtgctccggttgccctccacttcgcgctctaacgtttgacgcgcttggtcttatcaaagttgtggaggcccgcgataagcaacgaggagctcccctggtggtagagaggtggggcgaccctgaatcatccaaatgtgtgatggctgtatcaatgatcgaccgcaagtctcatcctttattagctgtagcaaggaaaaacaaccagattgaagttttgagccctgtaaacggagatattcaggccacaatctcagatgccaatgatttagatgttcaatctgaagagaataatattgttggattgcatttatttgcaaaacaaaattcggaattagctttcaggtacttgaattcctgggtacctaatggtacatcagtcttgctcttcttgaccctggatactaatggattcagagttggaggagggcatcaaaaacagatttccttgttggattgtactctacttacatgcacaaccaaaggaaatgcaagcataaggtccattgaacttgctgattcatctaaaggatcttcctgtataaaaacatggaatgtatgttctggtggtaacatcttgtgttgcaaggtggacggaaatgagaagtttgctttatttggagggaaatgtgttgaaatgaatatttgggatcttaacaacttcactaagatctggaattccaaacctccaactaaggataacctcggtatatttacacctacttgtttcacatctgctacatttcttatgaaagatgaccatcgaaaatttgttgctggcaccaacagccatcaggttcgcctttacgacgtgtctgctcagaggaggcctgttctctcatttgatttccgtgagacaccaattaaagcattggctgaggatatagatggctattcaatatatgtagggaatgggtcaggtgacatggcttctgttgatatacgcacaggaaaaatgctaggatgtttttctggaaaatgctctggaagcatcagatccatagtcaagcaccctgagctacctgtaatagcttcttgtggactggacagctatttacgcctttgggatacaaagacaagacagcttctttctgctgttttcctgaagcaacatattattcatgttctttttgactctaactttgatgttaaagcaaatatatccacagtagcggatttgctaccatgcaatgaacaaactccaactgagatcttggttagcaaagaagttgaaggatcacctttgaaaagaaaaaaatcttccagaaacaaaccagatggcggtgaaagaaagaaaagatctaaacagagtaaagaacgcaaggagtccaaagaaaatgatggatgggagaagattgcatcaagagatgagagaagcaagtcagcatccaagaaaggaaacaaggctcaattccagtgttgtgatttagatgtggactaa

SEQ ID NO: 15204 - DNA, 210 bp, Glycine max
  Peptide Sequence Number=SeqID_131982
atggtagaatacagtacgatattgacaacaacggaaagaggaggacgaggagctgagcggaggacgaggagcggagagtacaaagggaaagaggaaagaagagacgcgttttccggagggcctaggaaaggagaatataataatgagaagaggaaagatacattcgaaagagtagagtcacggagagaggaagagtcaagcattatttaa

SEQ ID NO: 15205 - DNA, 129 bp, Glycine max
  Peptide Sequence Number=SeqID_131983
agggagaaaaatgaatcgcatgaagacagtacaagtggaagtttcaatctcttctccgtctctctgacgtttggaaattctatcaaagcagtaggaggaataattgaaggaatctcagggaaccgctag

SEQ ID NO: 15206 - DNA, 468 bp, Glycine max
  Peptide Sequence Number=SeqID_131984
atgggtagagtgacaaaagtttcacttcactgcatcaggtgtggggtatcacggtacaaagtgaaggataatgatgagtgtagcagtgacgaaagcacaaagaaaggccccctagcgaaggtgttatggtatcttttgatcattctaaggtttaagtgtctgtttgctaatgaagatgatgcaaaagaccttacatggcatgcaaatgggagaaactacgatggaatgctccgccatccggttgattcctcccagtggatgaagattaatcgtttctatccagatttcgacaaagacataagaaatcttaggcttggacttgccactgatggaatgaattcatatggtagtttaagcactcaacacagttcgtggcctattttgctagtaatttacaacttgtctccttggttgtgcatgaagcaaaaatacataatgttgtctatgatgatattagggccaagatag

SEQ ID NO: 15207 - DNA, 234 bp, Glycine max
  Peptide Sequence Number=SeqID_131985
atgcacaactgccctaggggtggcgtgtcatggtacaaagtcaaggatgatgacgagtgtagcaatgaagaaagcaccaagaaaggccccccaacaaaggtgttatggtatctttcgatcattccaaggttcaagtatctatttactaatgcaaatggcacaaaagacctttcatggcatgcagatgggagaaattgcgatggaatgctccgtcattcggttgattcctcttaa

SEQ ID NO: 15208 - DNA, 456 bp, Glycine max
  Peptide Sequence Number=SeqID_131986
atgttacgggactcaatcagacatccgagaaaaaagttattgtcgtttgaatttgctcagagcatcaacattcaaatttcgagcgtctcgttatattacgggactcaatcagacatccgagtaaaaagttattgtcgtttgaattggctgagaggttcaacattcaatttcgagcgtctcgttatattacgggacacaatcagacatccgagtaaaaagttattgtcgtttgaattggctgagagctccaacattgaatttcgagcgtctcgatatatgacgggactcaatcagacatccgaaggttcaacattcaattctgagcgtctcgttatattacggaactcattcagacatccgagtaaaaagttattgtcgtttgaattatctcagagtttcaacattcaatttggagcgtctcgttatgttacgggactcaatcagacattcgagtaa

SEQ ID NO: 15209 - DNA, 405 bp, Glycine max
  Peptide Sequence Number=SeqID_131987
atgcctgcgtcagattttccgggcgtaccggaccggccttcagcaacgtttagtgacaccgccaatcgtatagatattaagatttcagctgcacctgacaggctgcagctggctgatttcgtgaattactggaaagcagaaagcgtggcgtactaccagagtcagtggggattgaaactggcacgctatattgaaaaggggcgcaaacacctttcctctaagcgctccagagaaagacgagactgcatgctggcgccggcagaaatgctcaccgtcctcgctgccatcaatgccggtcaggtccagggacatttcgtcaatggaatactgctcagcgcggggcgtagctcttccggggtggtcattatgcgctgcgacatactttggcgtaagtgcaatggataa

SEQ ID NO: 15210 - DNA, 252 bp, Glycine max
  Peptide Sequence Number=SeqID_131988
atggcatcacaaaggctacttgagaggatgactacggcggtacttgaggtagcaattgattgcaaaggaaaggctaatcaactcagaggaacaatgtctgtgggtgaatatgccaccaagtttgaggagttatcaaagtattgtccttattattgggacatggatgaaaggtccaagtggttgaagtttgagaatggattgaagcctcacatcaaacaagttgtggagtacttgaaagttgttcaatttccg

SEQ ID NO: 15211 - DNA, 717 bp, Glycine max
  Peptide Sequence Number=SeqID_131989
aaattatcgcaagtcaaaaaggaccaccgaggtaaatgggctccaaactatgaaggaccatttgtggtgaagaaggctttcttaggaggagcgttgttgcttatgaacatggatgatgaagagctgcctttgcctatgaattctgacatcgtcaagcgatattatggtagagagtacatctacttggattgttatactcagaacaagagagggtacatctcttgtggatcagttcaagtggagggtacatccacttggttgttcaaagagaacaagggagggtacatcccttgtggatctttggcttgtaaaggattttacaaggttgaaagaaatctcaagaaccgttggttgcttggggactggatgccacttgatccaacatatcttgcaatgggaaaagtgaatgaacaaccgttttgggtgatggtcagcaccacaccaacttgggtaagcctaggggcaagtggaaagttgccaacaggtgctaggtccatgattagattttctcacaatcaaggaaaggagttaggaatgatgagatggcgaagcctcgactacaaccccgcgatggctctaaagctttttgctataagggctaagaaggccaccacaggggagggatctaatgcagccccgcaagcagaaattgagtttgatggacaccatttccgaagcaacgagcatcagtgccgtttcaaagcgattaaggattag

SEQ ID NO: 15212 - DNA, 135 bp, Glycine max
  Peptide Sequence Number=SeqID_131990
atgaggggaaagttttgggtggagaaaaactccccctccctcgtttttatgcctccaggtgcaggggtgctcgctcagacgagctcagctcgcccagctgcgctttccgcttgtccagtgttgggcatgagatga

SEQ ID NO: 15213 - DNA, 279 bp, Glycine max
  Peptide Sequence Number=SeqID_131991
atggaaaccgtttcaggggatagaggactagtggattctagcttgccggtggaggacttcacccagctgcctgctggtagggatggtggtggtgcttctgttgcacttgctatgccatcctggcatggtaagtgtggtaagatgagtcattttgctcatgagtgcccagataatgatgtgacttgtttcaactatcgaggtaagggccacatcagtactagttgcccgcttcccaggaaggagaatagtagtgggagtctgaataaccagagtggatga

SEQ ID NO: 15214 - DNA, 2109 bp, Glycine max
  Peptide Sequence Number=SeqID_131992
gccgatcgcgctggccagcggcacgtcgccgatcagcggcaggtgcaggtcgaggtggccgctggtcaggaacggcacgccgaacagcatcgaagcgctgccgctgaggatggcgatcagcaggcccatgccgatgcagcggatgtagtcgaagccgaagcgcgattccaccgatgcagtgccctggatcacgtactggatcagcagcggcaccgccagcaccaggccggcgatgaagccaccgcccggcgcgttgtggccgcgcaggaacaggaagatcgacacggtcagggtcagcgggaacatgatctgcgccaggtcggccggcaccggcagcttgatcggcgggccgggcatgatctgctcaggtgccatccgcgtgcgccgcagcagagcatgcaccaccagcgcggcgatgccgaacacggtgatctcgccgaaggtatcgaagccgcggaagtcgaccaggatcacgttgactacgttctggccgtaggcctcgggcagcgcccggcccagcagttcgccggccatcgtgttcggcggaagggtcatcgcggagtaagccagcgcgccaaggccggcaccggcgatgatcgcgatcaccgcgtcacggcgcttgcgccagcgcggccgctccggcccggactgcgcaggcaggtagttcatgcccagcagcatcagcaccagggtcaccatctcgaccagcagctgggtcagggccagatcgggtgcggacaggaacacgaaggtcagcgccaccatcaggccgacgccaccgaccagcagcaccgccagcaggcgctgcttgtagacgcgcagggtggcgaccgcacaggccatcatcaccagccacaaggcccagcccagcagcggaatcggctgcggtttggtccagttcggcgaggccgggttggcgatgtagggcgcggcggccacggtgatggccaccagcaccaggcccagcagcatgcgctgcaggctgccattggcgatgccgttggtcaggcgcatggccagcgcggagatcgcatccagctgtgcatggaacacgttgcgcccggtggtgcgggtttccacgccgtgcaggttgatcagcttgcgcaggccgaagtacagcgccacgccaccgactacgccgatcgcgctcatcgccagcggcaggttgaaaccgtgccacaccgccaggctgtactcgggcatggcgttgccgaggatcgaggccgcagcggcatgcagcaccggcgccacggtcagtgccggggcgatgcctaccgccacgcagatcaccaccagcagttccaccggcaccttcatccagcgcggcggttcatgcggcacgcggtccaggtcgtgcgggccggggccgaagaaagtgtcgtgcacgaagcgcaggctgtaggccacgcccagcacgccggccagcagcgcggcgatcgacaccgccgtgcgcatcgcgcccgggccgccaccggcggtcagtgcctcggcgaacagcatttccttggacaggaagccgttgagcagcgggatgccggccatcgccagcgaggcgatgatcgccagcgcgctggtgaacggcatcagcttacgcaggcctccgagcttgcgcatgtcacgggtgccggtttcgtggtcgatgatgccggcggccatgaacagcgaggccttgaaggtggcgtggttgaggatgtggaacacgccggccaccaccgccattggcgtggacaggccgaacagcagggtgatcaggcccaggtgggaaatggtcgagtacgccagcaggcccttcaggtcatgctggaagatcgcattccaggcgccgatcagcagggtcagtgcgccgatgccgctgaccgtgtagaagaacaggtcgctgccggccagtgccggatgcaggcgcgccagcaggaacacgccggcctttaccatggtggccgagtgcaggtaggccgagaccggggtcggcgccgccatcgcgtgcggcagccagaagtggaacgggaactgcgcgctcttggtgaagatgccggccagcaccaggaacagcgcgtacgggtacagcgcgctggcgcggatctgctcgccggcggccagtaccacgtccag

SEQ ID NO: 15215 - DNA, 303 bp, Glycine max
  Peptide Sequence Number=SeqID_131993
atggaaccactgcctgtagtcactttgaaatgggcagtaacgcaaagcaatactttgagggaagataatgattgtatggctgctcatttcactgccaaaggattgaaagttgttctttttcatatgcactccaataaatcaccaggaccaaatggcctcaatccaacattcttcaaaagattttggcatctccttggacctaaagtgcataaagttgcctcttcttggttacaacaaagtactttccttctacagctaaattccacaaccatccgctctcatcccaaaatgtccaaaccgtga

SEQ ID NO: 15216 - DNA, 296 bp, Glycine max
  Peptide Sequence Number=SeqID_131994
atggaatcacatgaagacaatacaagtggagacttcaatttcttctccgtctctctaacgtttgggaactctatcagagcagttggaggaaaaactgaaggagaaggaatcattcattctgaaatcgtaattatttctgttcacctggagaaggagacttgcagatcactatttcatcccgacgatttttgcttttttgatacaaatattggagtttttagagactcgctgtgcgtttggcaagatagcaacacccatcttggcttgtggcagatgaggaagtttcgagatgacaa

SEQ ID NO: 15217 - DNA, 310 bp, Glycine max
  Peptide Sequence Number=SeqID_131995
tgtcacaaaggtttataccactttcaacactccaccacctacatataatccatcaccattgaggtcttgttatcgtccatcattatctattcaaatgcatgacatgggtcatgagaatgaggacgaagatgatgataacaacaatatcaacaataatgatcatgatgatgatgacaacggtggtgatcatcttcctcaacaacaacaaataattacatgtgatgatcctagaacaagagaaggaagaggtcgtagaacaagaaaacaacaaccatctacaaatcaaatgcaacaagatcagagaccttaa

SEQ ID NO: 15218 - DNA, 168 bp, Glycine max
  Peptide Sequence Number=SeqID_131996
atggaggccgatttcgttgttaacagagatacatcagagatggacgaagaccaatggatgtatgacagtataatgtctgaaaaagttgatatgaatgaacaaaataaagatgaagctggtgtgaatgaagaacatgttgattgttctgatgcttttaatacttcttag

SEQ ID NO: 15219 - DNA, 228 bp, Glycine max
  Peptide Sequence Number=SeqID_131997
atggcaagagataaggaatacaaagaatggaaagtgagtgttaatgtctcaagagatttagaagagtgtataaggagtgatggatggacaaaatgtgatgtaagctccattggagcttgtaggcctaggatcttcttcatcaatgaattcctttacttcttggaagatgaatggcaacagaatggagaaggaagagagagaggagatgccacttcaaggagaagatga

SEQ ID NO: 15220 - DNA, 483 bp, Glycine max
  Peptide Sequence Number=SeqID_131998
atggcttattccctagtggatggtgcctcccctcttctcttctcctttgccttccgatgcatctccatggtggaaaaatcaccattaaaggacctcattgaagctcaaagatccagccttcatagaagctccacaagcaagcttccatcaaaagggggaaaatctagtgaagaaatatacccccaagaagaaggacaacctttaatggttaaggaggagtgtaaggaggtaagtgtctcctcgaagaggttagctaagaaggaaagacattttgaaataaagaaaaatattaaagaaatttcccctcttagacaacctccacattttctcctttgtaaaaatacacttgttagcattgtcacacctcttgggcttaagtatattcctcaagtaaaggagttgttggatgagggtttggttcgcaagagcttaaatccttgtgctttgttggtggccaaaatagtgatcaaggggttcccatga

SEQ ID NO: 15221 - DNA, 222 bp, Glycine max
  Peptide Sequence Number=SeqID_131999
atgttcgcttggtcataccaagatatgcctgacttgagtcctgtttacttccggcaagtgcatcggatcgcgcaacctaatcctgatcaagcatcgtctgcagattcctcttgttggactaaaaagatatttacatcaagtacctacaaggaagatccaatagaggatttagctttccaaaactgggaagcttcctttacaacgaagagaagagaaagatga

SEQ ID NO: 15222 - DNA, 429 bp, Glycine max
  Peptide Sequence Number=SeqID_132000
atggttgccgcccagctcgcccaggcgagccaggttgcttcttccagaagcaacagccttctggaggaatcttctggagggcccaagtgggcctggttgctatttgcacccccatttttactaattacggaaacttacgaatttcgtaacgatacttgttttctttccgtaatgttacggaaccttatggattacataatcatcccctttttgacttacgcaatgttacggaacctcaatagttgtgcaacgatgctccatttgatttccggtgtgtcacggaaccttacggattgtgcatcaatattttcttttgtttttcggcatgtcccggaatttcacaaattgcctaatgatgggtgccaagcaccttacaaggaccaaacaaaggtcgcatgtcatcaagcaaaggtccccggacgaaattaa

SEQ ID NO: 15223 - DNA, 963 bp, Glycine max
  Peptide Sequence Number=SeqID_132001
atggttaggatcagaggattaggtcgtgccttaggtcacgttattggcaaaggagatcgtgatgatttcgattatgttgcgcagcgtcgacggcctaccgcatttgcacggaggcagcaagtacctatgactgtggcgcatgatgagtcagtactccctgcgccagatgtagaggctgacgtatttccggatgacccgatggcaccagctgatgtagaggacactggggcagacattcctgcagacacaggcgcccaggccgctgaggatgagcatgagggatttccgggtggtccaagcgacccatccatgctgacccagtatacggatcatgttgcttgcagcgtatggatgagagatgagcgtcctgagttgaagttatcctttcacgggaggaaggtacatagtttaggcaagcctgcccctgccattgagggactagttgttgggacaggactaagtcctctgagacttttgtcctcgtttgtcgagcggtggcaccgggagacgtctagtttccatctccctgtgggagaggtgacaatcacgctggaaaacgtcttgtcgcttttgcatctgcccgtggttggcaacttgcatgcctttcagcccttgcacgtggatgatgcggttcaaatgttggtggacttattgatggtctctacagaggctgtcagggctgagacagggcagtgtcgtggaccgtacgtacgcctgcaatgggtacgtgatatctatgagcgcggatgccagacaagttattgggcagctgcggctcgcacgtatcttcttcatcttctgggttgcactctgtttgctaacaagagtgcaactaatgttcatgttgtgtatttgaaggccctttgtgacctcagtcagactgggaggtacgcttggggagtagctgcgctggtgcatatgtacgaccacctgaacgatgcctctatcagcagcagccgatag

SEQ ID NO: 15224 - DNA, 2128 bp, Glycine max
  Peptide Sequence Number=SeqID_132002
atgaagcaagtgcagttcaccctactcctatcagtgtctcttgttattctttttggtccaatcctagttatctcagtagacctttctttcaacgatgatgtgttggggttgataatgttcaaggctggtctacaagacccaaaagggaaactctctacgtggaacgaagatgattatagtccttgccactgggttggtgtcaaatgtgaccctgcaaacaatagggtatcttctcttgttcttgatggattctctctttctggccacattgatagaggccttttgaggttgcagttccttcagattctgtctctctctaggaacaacttcacagggaccatagctcctgatcttctcacaattggtgatttgctagttgttgatttgagtgagaacaacctctctggaccaatcccagatgggattttccagcaatgttggtctctaagagtagtttcatttgccaacaacaacctcacaggtaaggttcctgattctttgagctcatgctattcattggcaattgtgaacttttcctctaaccagctacacggggaattgccatctggaatgtggttcttgagggggctacagtcaattgatctttcaaacaactttctggagggagagattccagaaggaattcagaacctgattgatttgagggagttgaggctaggtagtaaccacttcactggtagggttcctgagcatattggagactgcttgcttttgaagttggttgatttcagtggcaattctctctctggaagacttcctgagtcaatgcaaaagctcacctcatgcacattcctcagcttgcaagggaattcattcactggtggcattccacactggataggagaaatgaaaagtctagagacattggatttttcagcaaacagattttctggttggattccaaattctataggaaatcttgacttgctgagtaggttgaatctgtcaaggaatcagatcacaggaaacctgccagagttaatggtaaactgcattaaacttttgactcttgacatcagccacaatcacttggcaggccatcttccttcatggatatttaggatgggtttacaaagtgtctctctttcagggaatagcttcagtgagagcaattatccctcacttacttccattcctgtatcttttcatggcctccaggttttggatttgtcatcaaatgcattttttggtcaacttccatctggagttggaggtcttagtagcttgcaagtcttgaatttgtccaccaacaatatctcagggtctattcctgtgagtattggagaacttaaatctttgtgcattcttgacttaagtaacaacaagcttaatggaagcattccttccgaagtagaaggggcaatttcactcagtgaaatgaggctacaaaagaacttcttaggtgggagaattccaacccaaattgagaagtgttcagaactaacatttctgaatctttctcacaacaagcttataggttcaatcccttcagccattgcaaacctaaccaatcttcagcatgcagatttctcatggaatgagctctcaggaaacttaccaaaggagctgacaaatctttccaaccttttctcatttaatgtttcgtacaaccacctcctaggtgagctaccagtgggtggtttcttcaatatcatctctccttcatctgtctctggtaatccattgttatgtggttctgttgttaatcactcttgcccttctgttcatccaaagcctattgtcctaaaccccaattcttcttactccaactctggctcttccttacaaaaccatcaacataggatgatgctcagtatctctgtcattattgccatcggtgctgctatttttattgtcattggtgtggtggttgttactgtcctaaatatccatgcaaggtcttcgatgataccttctgctgctccatttgtgttctccggtggtgaagactatagtggttcacccaggaacgatccaaactatggcaagcttgtgatgttttctggtgatgctgaatttgctgatggtgctcataatcttcttaacaaagacagtgaaataggccgtggaggatttggagttgtttattgcactgtccttagagatg

SEQ ID NO: 15225 - DNA, 404 bp, Glycine max
  Peptide Sequence Number=SeqID_132003
attgttctgatgaaccaaagattggagactttggcttggtgaggctattgccaatgctagaccattgtgttttgagcagcaaaatccaaagtgcacttggatacacggctcctgagtttgcttgccgcacggtcaagataaccgagaagtgtgacatttatagttttggaattttgattttggaggtggtaacaggaaaaagacctgtggaatacacggaggatgatgttgttgttctttgtgacaaggtgagaagtgcattggatgatggcaaagtggagcaatgtgttgatgagaagcttaagggtaattttgctgcagatgaagcaattcctgtgataaaattggggttggtttgtgcatcacaagtgccctcaaaccgtcctgatatggctgagttgtaa

SEQ ID NO: 15226 - DNA, 231 bp, Glycine max
  Peptide Sequence Number=SeqID_132004
atgcaaagtgcaaacttatttggttcatgcttctgggcttcttgctgcgatgcagtcggtgccggagtgctacggtggggtgcgacggtgaaaggaggtttttggagtgcgactgtgcaaagtaaaggttttggttctgggaagaagctatacaaggcatttcctgaaaaagtagagtgcagaatgcatagagttcctcagaatttcgcatgtgttgatgaagctttttga

SEQ ID NO: 15227 - DNA, 881 bp, Glycine max
  Peptide Sequence Number=SeqID_132005
atttggatgcaggagtcggtgttgattttggacttttgatgcaattgctagatagattttctactgatgcttgccaagttttggacttgaatgccggtggtttcgggctttggatgcatgtgttgggaaagttttgggatttgaatgtgggtgctgggcaagttctgggcttagatgtgggtgtcaaacaagcttttgttgatgtttgccaagttctagacttcgatgtaggtgcctttgacgatatgctagtttacagggttgaaccagttcctgctaaagtccaagctattcaacaatggcccactccatcatcatccaaggccctgcgtagttttctgggtcttgctgggttctaccaaaaatttattcatgggtatgcgtcaattacagtgccgctaactaatctcctggccagagattcattcacttggtccacagaagctcaaacaacttttaatgatttaaaggcggctctcactaccgctctagttctcatgctgccagattttacgttgcctttcacagtggaaaccgatgcttccggtgtagctctttgctatcattgcagcagtgaagaaatgacgccagtatttttgggccaccccttcataattctcaccgatcaccatagcctgaaggagttgatggcgcaggtggtacagacgttggagcagcaaacctatttagtcaaactcctcgagtttgattataccatccaatttcattcaggaaaggctaatgtggttgcagacgctttgtcgcgcattctagagttacctccaaacaccctgttatctctttcggtgccctacttaacatttcttgaagaacttaagcaacatcttgccaacaaccttgctttcaatgaattacaatag

SEQ ID NO: 15228 - DNA, 367 bp, Glycine max
  Peptide Sequence Number=SeqID_132006
aacttgtaaaggacttttgcaagatagtggaacgctcaagtgggttgcttggggactggacataggcacaagggccacttgtctaacatgcttgagtgacatgaagtgttctatgcccgttctacccagcccagaaacttaccccacaatgaaggccaaactcatccgcaaacatgtaccactcaatttgaataaagcttgccagaactggctaaggaacaatggctcacgattagaagttaagcttcggggcataccatggatcttcccgaccataaccataaaaagaacggcgactgtgtgcgaagatggtgtgttggcaacatgcctagatgaatacccttcgagaactggtctaccaccataa

SEQ ID NO: 15229 - DNA, 204 bp, Glycine max
  Peptide Sequence Number=SeqID_132007
atggctcgcacaaaaaaatctagtcaaatgacgtccaagacaacaaaggaaattacagataagattgcaaggcattgtggattagaagtggttagaagtgacgctaaaagtctagggcattgtggattgactaagaccctcatagttgaccatgaccgtggtgaatttgccatgatcattgttagatcattgatgttgttctag

SEQ ID NO: 15230 - DNA, 201 bp, Glycine max
  Peptide Sequence Number=SeqID_132008
atgactaaccacggactaatctattacactttttgcacatttggtggtggtagttgtaacaacaacaacgatgatcactttggtggtggtgatcacgcttgtggtggtgggagcaatgatgacaatggtcatggtcgtggatatggtggtggtggtgctggtgacgggcgtgatggtgacagtaggtttgagatattttag

SEQ ID NO: 15231 - DNA, 330 bp, Glycine max
  Peptide Sequence Number=SeqID_132009
atggcagaacaagctaagcagcacatgactacacctgagtcattagtagcttcgtcgtctacgtcgaaaaagacaagaaaatctacacgactcagatcattggctaccagacctgttggggtggagagaccagaggttcatgtggatcctaacactaggaaagtcaatggtccccacaaaaagaaattaaggatgtatttagggatcttcgctagagacaagatggacattacatttgttaactggaaagaagttcctgcaaatcagaaggatttaatttgggaggacattcagatatttgaattaaatgttgaatgttattgtaattga

SEQ ID NO: 15232 - DNA, 264 bp, Glycine max
  Peptide Sequence Number=SeqID_132010
atgagggaggaggagttttcctccacccaaaactctcccccctcacttcaaaaacaccaagctcacgggaactacgaagacagcaacccccaagcttccattgttgagtttttgcttcccttttcacgctttgtttcactccctacaagggttgtaagggatggccttaggcctatgttgcattctggagtaatggggcatgccacattgcccccattctcttgttattcatgccaaaacatgcgcccaccaagtgctcggtga

SEQ ID NO: 15233 - DNA, 420 bp, Glycine max
  Peptide Sequence Number=SeqID_132011
atggctttgattcagagtctgcagctcccaaatgaaacgacagtcccatcctccgccacccccgcgtcctccactcccgattcaactctaaccctcaattcccttcccaatcaacccttcgtcataggagtttctggagatactgcctcgggcaaaaccaccgtctgcgatatgatcattcaacaactccatgatcaccgtgttgtcctcgtaaatcaggactcattttatcactggttgaatcctgaagaattggaacgtgttcacgagtactatttcgaccaccgtgatgcttttgacacggagcagttgttaaagtgcacgaggaagctcatcagtggccagggcgtgcatgttcccatttatgacttcaagaagcagcaacactcttctgatagttttcgccaggttttcgattga

SEQ ID NO: 15234 - DNA, 1002 bp, Glycine max
  Peptide Sequence Number=SeqID_132012
atgagtgattttgcttggagaccacttgtgaagcaagtcagacctgctggtggtgttgtgccaccatcatctacaactcttcttgaagggggtcaacctacagttgaggttagccctaccgctgaggttgcccccaatgccctttcctctattttggctaagaggaagagggatgattgtgctagggcattgggcctcaagaagttgaggggccccatgagcctttgtgccctgaggcaagctacaggattgacgcttggcgtgggttgccctttgagtttgcaagatttgcctccggcttcattggctgtcaaggcttctattgctattgttgctacttctgttactcctgcttcttcacctcctcttgctatgcctgttcaggaggccgctcctgatgttgttgaagttagtgtgccaactgctttgcctggttttgttatggcgtcgttgtccaccattgttgcacctttgttgagtgttggtgtggtgaccactagtgcttttgttgtgcctcctcatccttcttcttcagatccattagttctaccctttgttgtgttggcggtggtgtcgccttcctcatcttcttatccttctgaatgtttcacaaagaacgtagaacaagaaaacaacgtaaggaatgatcacagtcgcgattcagttgggcctcaactttgtttcctctgctttttccttcttctttctctcttctctcaattccctcaactgaccttggaaccccttaaaacacccctaagatgcctatttataggcaaatggtcacttttgggcagttggagctcgcccaagcgagctggtttcttcaccatgaagctatttgatggcccgagtgtcgcaacctacccttcggcgggagggcgacgcgagactcacgggtgcatcttccaaggaaggaaaatgcgcggagtcaccaccaacatttattcaaggaaaacgtcagaaaaaccggaaagggcgtggtctatgaactttaagtga

SEQ ID NO: 15235 - DNA, 483 bp, Glycine max
  Peptide Sequence Number=SeqID_132013
atggtttcctgtggtgaagcaaaggacaccattgatgaagaatattcaaggcctacaagctccatatggagctacatcacacatgaagcaccccgagaccacaatctagtcgacttcaagcctcacctcgaatatgccgctgaggggcaggcattttgcggtatacccctaccaaacactttggggggccctcaatattgcctacaaccacaacccttgcattttgcggtgggaagagtccctcctgctatggtagaaaggaagaaatttgatcatttaaaggaaaggctgagggctattgaaggaggtgtgaatgcatatgctaaaacccgtatgcaaattttcatagaggctatagatttaaacatatgggaagctattgaaatcagtccttacatccctactatggtagcaggaaatgcaaccatagaaaaacctagggaacaatgggatgaagaagaaaggaaaaagggtacactataa

SEQ ID NO: 15236 - DNA, 878 bp, Glycine max
  Peptide Sequence Number=SeqID_132014
atggctaagtcagaccctgaggtagtcctggagttttatgctaatgcttggcccacagaggagggagtgcgagacatgcgttcatgggtcaggggtcagtggattccttttgacgcagatgccctcagccaattcctgggtgacccgctagtgttagaggaaggccaggagtgtgagttcagtcagaggaggaacatggccgacgagttcgacgaggaggccattgcccaactattatgcacaccggggcaggatttcacccggaccgctgcagggaggcgggtgcggatcatgcgcaccaacatgaccaccttgacccagatgtggatgacattcctgctcagcaatgtcttgcctagtgatcataactccgatctccctctgccgaagtgtcagctggtgtatgccatcttgacacggatgagcgtccatgtggctcagttgattgcggatgccatctatttgtttgcaggtatgccacccaccaggcaccctctagacccggataagtctaacagagccttggggtttccagcattgatcacgggcttctacaagtcattcggggttcccgtcacccctagtaaggtgatccgaccgccgatcacctgggccttcattgagaagtattgcatgcctaggcaggcgcagggtgatgcacctcaggccgcagacgcaccgccaccacctcatcaggccaatcctactggtaggcggccaaccactgtgggcaggtacagatacatgagtgtctctaccggttcagcctcagtcagcaggggggaggcgcctgcaggatcccccggcgatgcaaaggaggcccgtatggatgaggagatgacgaatttgctcggtttcttgggaggaagcagagccac

SEQ ID NO: 15237 - DNA, 663 bp, Glycine max
  Peptide Sequence Number=SeqID_132015
atgtttggaccaccagagggtgctgggtcggatgggggtgcttgtggatacattgacagtgtggaaaaacctccactctctaaaatggtatcagctgggggtccttctctttaccttggtggcagaggatgcggggcatgctatcaggtaaaatgcacagaaaatgccttttgttcaagaaaccctgtgagcgtgatgataactgatgaatgtcccggttgtacctcaccatcagttcattttgatctcagtggcactgcctttggttccatggcaactccaggccaagcagataatcttcgcaatgctggagtgcttaatattctctacagaagggttgcatgctcctttgggaactctatggccttcactatcgataatggggccaacccatattattttgctaccgaaatagaatacgaaaatgggggtagtgaccttgtggccatagagttgaagcaagctaattctgacacgtggcttcccatgcagcgttcatggggtgcaaggtgggctttgaatttaggtttacaattacaagcaccattatctattaagctcacagaacaaggcaagggctattacaagacaattgtggctgatagtgtaattccacatggctggcaacctggccaagtttatcgatctgttgttaatttttaa

SEQ ID NO: 15238 - DNA, 159 bp, Glycine max
  Peptide Sequence Number=SeqID_132016
gctaagtcaaatggtgatggttatgttgcaaagcgcaaagcaattacacattctgcgattgatgacaatgagcatcattcatgcaatttccagaaaaatctaagcacgattggagttatgcattatgtcaggttgctgtcacaagtgagaaacaattga

SEQ ID NO: 15239 - DNA, 1900 bp, Glycine max
  Peptide Sequence Number=SeqID_132017
ggaaggcaccaaaggctaccttctttatgatcctatcacccatgagttctatgtttcaaggaatgtaatcttccatgaaactgtctttccttttgcctcacctccacctgccaataatcctgtcagtgtcaaccctgatattactaacttagacacatctgacattctcctagatcttccactatccttacctccaccaaatgaacctacctcctctcctgcaccaaccagaaaatcacatagactaacaaaacctcctgcttatctctctgaataccactgcaatttgctatcctcaatgctgccagcatctaatccagaacccaaaacttataaacaagcttgtaagtttgattactggaatcttgctatgaaatctgagttagatgctcttgcatccacaaacacttggtctgttgttgatctgcctaaaggtaagcaaccaattggttgcaaatgggtttacaagatcaagcatcatgctgatggatccattgaacgatacaaggcccgtttggtggcaaagggatacactcaactagagggtgtggattattttgacactttttcaccagctgctaagcttaccacaattcgcacccttctatctgtggctgctattaaggactggcacttagaacaacttgacgtcaacaatgctttccttcatggtgatctgcatgaggaagtatatatggatctgcctcctgggttcttgcggcctggttcttcttctaataaagtctgcaaattacataagtccttatatggactgaaacaagctagcagacagtggttctccaagttatccactgctcttatctcccttggatactcaccttcatctgctgaccattctttgttcacaaaactacataattctcatttcactgctcttttagtctatgttgacgatattgtcttgacaggtgatgatttgcaggaaatacaatctgtcaaacaattccttgactccacattcaaaatcaaggaccttggcaagcttaaatactttcttagattggaaattgcaagatctactcaaggcatctttctcaatcaaaggaagtatgcattggaattgcttgaggacaatggtttattggctactaagcctagtacaactccctttgattgctccttgaagcttcatgacagtgactcacccccttatgaagatgaaacagcctataggagacttgttggcagacttttatatttaactacaaccaggcctgacattgctttcattgttcaacaacttagtcaattcatctctcagccattacaagttcatcactcagcagcaattagagtcctcaaatatctcaaaagtgctcctgccaagggattgttctattcttcctcctccacactcaagctctctggttttgcagactcagattgggcaagttgccctgctactcgcagatcagtgactggttactgtgtctttcttggcacatctatgctgtcttggaaatccaaaaagcagtccacaatatccaggtcaagttcagaagcagaatatagagctttggctagcttaacttgtgaattagaatggctgcagtatttgttcaaggatcttcacatctctcttgatcaacctatctcagcctactgtgataataaaagtgctatctatcttgctcacaaccccatcttccatgagaggacaaaacatattgaaattgactgtcatgtcattcgtgagaaaatacaaactggcctcattcatctcctgccagtttcttctgttgcacaattggcagatgtacttaccaagccattgcctgctccctccttcaattcattgatttccaagcttggtctattagacattcatagtccagcttgtggggggctattacatgatgtaaatagtaattctagttag

SEQ ID NO: 15240 - DNA, 675 bp, Glycine max
  Peptide Sequence Number=SeqID_132018
atgacttcttgttcttctattacaatatccccaaggaaactgcgctatgatctctattcctattcatacaaagaagactccaacaccccattagtgataaatgttctggcttcactcattgagaggagcatggctagaacacaaaggattgtgaagaattgctccaattctttgtccaaagccataagcacaaacatctttgattgtagggagattcctgatttgaccattcagtcctatctagagagaattttcaggtacactagggcaggaccttcagtgtatgttgtggcctatgtctatattgaccggttctgccaaaacaatcctgggtttagaatcaatgccagaaatgtgcatagacttctcataacaactatcatggtggcttctaagtatgtggaagatatgaatttcaggaattcatactttgcaagagttggtgggttgacaacaaatgaattgaatgagttggagcttgaatttcttttcatgatgggtttcaaattgcatgttaatgtcagtgtgtttgagagctattgctgccatttggagagggaagtcagcattggaggagggtaccacattgagagaacactaaggtgtgctgaagagatcaaagcaaagaacatagaaggaaggggttatacacaaatcacacgtgtaatgttgtag

SEQ ID NO: 15241 - DNA, 186 bp, Glycine max
  Peptide Sequence Number=SeqID_132019
atgagttaccacacaatcggcaacccgacactatcactctcaccgagaagacaccactggtggcgtgttagggtgttccatccttgcaaggatactccaacacatgtgatcaacatgagcttaaaggacattccaaatcgttgcaaccccaagagatttctatcccgtagggataggttctcctaa

SEQ ID NO: 15242 - DNA, 608 bp, Glycine max
  Peptide Sequence Number=SeqID_132020
agccagagagttgttctcttgaaagccttacttttgagtgcctgagctcggtcattaacttggcctacattaggaagaactgttggaatcctgaggatctaacagtttctatccgaggggctaggagggcgaggttgaggccaactaagctcccttccacatctgcagctcctactccagcatccacttcagcagcccctttagtcccagctcagaggtctattccttctgttgagcagtttttggagagggtagcttgtcctgggacgcaaccttctcttcacagggaagatgaaggtcccacagctcaggtaccacaacatgtggaggatgagtcatccaaggccaccattccagagccattcatgatccacccacaccagtggtggacctatcttcgcgtcagcatgcaactagacccttccactcctatcctagagataccaaaggacccgactacaccagtcttgactctgaacacttctcttccagctactccaatacttcatctaacagatgaggaggatgttcagacacaggatacccaggaccagtttcccaactcgaactcgggagggcatggacgtgcccagcttgatttctcttaa

SEQ ID NO: 15243 - DNA, 645 bp, Glycine max
  Peptide Sequence Number=SeqID_132021
atgagtatacagacacatcaaatagccctagataatacaaatagggtcaccacacaacttgagagagcaatacttcccaaatcttcatctgcaagggcaccaccaaatttaattctcaacattggcaaccagaatgtcacaccaatggtttcttccattggtacatctaatgttatcattcccatggccatgccaaatccgagacaaaacttacaaattgaaagggagttgaggagagaagaacccaatgaagtagcaaggaattttagactcacagagggacaagcagaacgaccattgggcaatcaacgacttgaaattggagaaggttcatcctctaagcgtcgaaggacaaattcattgccaaggcaaggaccaaacacaggtcttgcactccagctaccaaacaatgcacctgcatggcaaggtcctaacacaggccttgcacttcagctaccaaacaatgcacctgaaattcaagggccgcagaatcagaacaacaaccctggaaatcaagtggaaattaggggcaattctctctatgatccaatatttgagactcttggattagctgttgaccctcacattagattgtttgaagcacagaacggtcaagcggaaaaagggtactacatgttcaaatga

SEQ ID NO: 15244 - DNA, 435 bp, Glycine max
  Peptide Sequence Number=SeqID_132022
atggatgcaaaggagtttggtttaggagaaggaattcttgtacaggtgggattaatattaggagaaactagttcacaaattcaacagcaaaatttagccaggaactatgatccgtttactaatcaacttctaaacgatccaccagtgtttcaaggcttggctatttcaaatgaaaatcatacaaggagtcaggtagatgaaatagcaagagttaacatgggaaaagcaaatacacaaatcatgactagcgaaagatctacattaccacctcttcaagatgatcatactaataactctcacgaggcatggaactctaggacgatccatcaagctaaatggttttctcattgtaggtatacccaatcccaatctcaagtcgcaatgcctaatgattatcgtgagcgtgttgatggtcctgttcaactctataggtaa

SEQ ID NO: 15245 - DNA, 825 bp, Glycine max
  Peptide Sequence Number=SeqID_132023
atggataaaaacttacctggttctgtgcagagagaggagcaactaacccagctgcatcttcctccgtggactgggaatcaagagtttcattggtggatggataggatctgtgtagtggaagttaggcaagttgaaggagggaataagagagattggtttaaccaagctttggtcaaaagggtgggggataggagggacacgtttttctggaaggataagtgggctggggacgatctattgctgcaaactttcctagattatttagtcttgctgttaataaggaggcaaagattggggaaacgggggagtgggtggatgaaagatggtgctggaaatgggattggagaagggagttttttgggtgggaagaggagctgtttttattactgcaggttgttttggaggataatacaccagttggagacataccagttgtggagcagtgaggcaaatgggatattcacggtatcttcagcatatgtctgcttaaaggaaaacactatgaccgagggtgctggaatatatcaattggaaaggcttatggaattctctgataccgctgaaggtgacactgttcgtgtggaaggaagtatgcagtttatgcgcttgggaagaggaatcagtgggtttggtactcttagttttaaatgggtgggaatatcttctgcaattcacaaaaattttgagacaaatatggtacattttaatggaatggcggggactgttggcgttgaatcagaaagctgggaaactatatatcatggctgcaatatcatgggcaatttggctaaacagaaacaaggtggtgttttaatagacagataa

SEQ ID NO: 15246 - DNA, 436 bp, Glycine max
  Peptide Sequence Number=SeqID_132024
gagatctgttgcaggtgatttaattcccatagatttggagattaacgctacttgcaggagacaaaatgcagagagaattagaatttttttgcaggacttagaagcagtagcaactccaggagaagaacctcgatcttttgaggcattttctagttttccaactcaagggcaatctcatacaagagttaaaggagacactatcatggctgagcagccaaggagaatgatccttgaagactattcaaatgtaattcgattgagcttgttttcgttctcattgtctggagaagctaagaggtggcttcactcgttcaaaggcgttaagacttgggatgaagtggttgagaaatttctgaagactatttccctgagtctaagactgcagaaggaaaaacgaccatctcttcttttcaccaatttcgagatgaatccctga

SEQ ID NO: 15247 - DNA, 138 bp, Glycine max
  Peptide Sequence Number=SeqID_132025
atggcaggagcaacagtgggcactgggcactgggcacttatggggaaagagtttcttcgtttagccaaaaccaaaagtgtgcctaagtactgcaaaacgacacgttccgaaggtcttggctccatcaatgtctgctag

SEQ ID NO: 15248 - DNA, 800 bp, Glycine max
  Peptide Sequence Number=SeqID_132026
atgaagttcatgaaactaggatctcgtcctgatacattctacactgcagaagcagtaaggtcagtctcttctgaagtttccagtgatctcataattcaagttaagggaagcagatatcttcttcacaagttagttgttagtacttattctgaagttcatggtgatgttgttcagtttcccttgctgtccaaatgtttgaggctacaaaagctatgttcagaacctcctgattcgtcttctcagcaccaaataatccaactccctgatttccctggtgggatggaggcatttgagttgtgtgctaagttctgctatggaataaccatcactctcagcccttacaacattgtggcggcacgatgtggcgccgagtatcttcagatgactgaggaggttgagaaggggaacttaattcagaagcttgaggttttcttcaactcatgcattctacgtggctggaaggactctattgtgagtcttcagtccacaaaggcgttgcctatgtggtctgaggacttaggaattacaagcagatgcattgaagctgttgctgcaaaagttctaagtcacccttctaaggtgagtttgtcacatagccattcacgaagagtgagggatgatgtgtcttgcaatggcaaccaaagtgtgaggcataacaagtcaggaaacaaaggatggtgggctgaagatttggcagaacttagcatagacttgtattggagaaccatgatagctatcaaatctggtggcaagattccctcaaatcttattggagatgcattgaaaatctatgcatctag

SEQ ID NO: 15249 - DNA, 207 bp, Glycine max
  Peptide Sequence Number=SeqID_132027
gataccctagaagccaccaaaacaggtcacattcagctttttgtccaatgtggctgccctttattgctttctcatttggctgagacatgtacttacaagaagttggaaaaggaaaacacatcaaccgcaccaagtgcaaaagcccaagtgttccattccatccaccttaactttcgatcctggcaattaaccgctgtctctggttag

SEQ ID NO: 15250 - DNA, 492 bp, Glycine max
  Peptide Sequence Number=SeqID_132028
atggacatcccactgagaagcaccaggaagtaccttttcaaaaaaacagacctgttgagattaagggagctagcatctttagtaagtgatccagttgattttcaagctcatcatgggaagttgctcagaattcttagagtagatgttgaggaaggatgcctagagaccctggttcagttctatgacccgctctaccattgcttcacatttcccgattaccaacttgtccccactcttgaagagtactcctacctagtaggtttacctgtgccagacaagatacctttccatggttttgagcctacccctaaaccctccgacatcgcagccgccctccatcttaaaacctccatcatccaagcaaaccttacctctaaaggaggcctccaaggtcttcccacccacttcctctaccaacaagcctccatatttgctgaagcagctaaaccccgtacccactctactcgccgatacctaccattcaatccatga

SEQ ID NO: 15251 - DNA, 396 bp, Glycine max
  Peptide Sequence Number=SeqID_132029
atgggcccaattttgttagacccgcagagaccccttctgggaggatgtgcagaaaaaggcacaggcctccagaagcaaaacaccgccccccacgtgttgtctcgtgggggttatgaacacttagaacagaacctgatggttgagaagataaagaaaaaactggaggaagatgctcaatccgaaagcactgaaggcgtgattgaccctccatctcccatcacacgtgaagtggaagactgggattctttggaggagcaggcgtcacagggttcgtttgtcccccatggacgtcaggatctcctgactgctgccattgggcgaccagaacaccctggccgtgtgcgtgcttctagagtcggtgtgaccataaagcaatactttggattggctccatga

SEQ ID NO: 15252 - DNA, 315 bp, Glycine max
  Peptide Sequence Number=SeqID_132030
agatctttcttgatcggtgctgttgtggttgtgtcctttggttaccccaaagagcgtgatggctcttgggtaaaaaagggtgctcaaccaaatgatgatgaaggacaattaccagttgaaggggactcttctctccttcagagtattttggacaagtttgatggactccaaacctatgttggtgaaaggtttgatgctttggaacaacaagtggacatgcgattcgacgcaatggactcaagaatcacaaaggttaaagaagatgtcaccatcattcgcgactgccttgatttacctccaccaccatcagtttag

SEQ ID NO: 15253 - DNA, 858 bp, Glycine max
  Peptide Sequence Number=SeqID_132031
atgtgggaagcactttctcaggttttgtatttaaacctctctcgtaatcatatccatggtgagattgggactacattaaagaatccaatatctatcccaactattgatctaagctcaaatcacttgtgtggtaaattaccctatctttcaagtaatgtgcttcagttggatctttcaagcaattcattctccgaatccatgaatgactttttatgtaacgatcaggacgagccaatgcaattagaatttctgaatcttgcatcaaataatttgtcaggagagatacctgattgctggatggattggacatctcttgtggatgtaaatttacaaagcaaccattttgttgggaacttaccccaatccatgggttccttggcagagctgcagtctttacaaattcataacaacacactctcaggaatatttccaaccagtttgaagaagaataaccaattgatatccttggaccttggggcaaataatctttcaggaactattccaacatgggttggagaaaacctcttaaatttgaaaatcctccgccttcgatcaaacagatttgccagccacattccaagtgaaatatgtcagatgagtcatcttcaggttttagaccttgcagaaaacaatctgtctggcaatataccgagctgtttcagtaacttgagtgccatggcactaaagaaccaaagtacagatcctcgtatctattctcaagcacaatatggtaggcgttactcttccacgcaaagtatagttagtgtgctactatggctgaaaggaagaagagatagagtacagaaacattctgggtttggtaacaagcatatgatctgtcaagtaacaagttattag

SEQ ID NO: 15254 - DNA, 186 bp, Glycine max
  Peptide Sequence Number=SeqID_132032
atgcatggctccaaacttgaaggtggaggacacgtgaaccaaaacgcaattcatggggctccgcaaaagggtggaggacacatgaacgaaaacgcaattcattgggctccgaaaagattgagaatggagaattgcactaagcaatcactacgcatgtctccaaactcgaaggtggaggacacgtga

SEQ ID NO: 15255 - DNA, 1058 bp, Glycine max
  Peptide Sequence Number=SeqID_132033
atgaagttgcaaaagccagaaaagtattttgaagcagcagcaaataaaagtttcaaaactttagttcaaaaccatctgaatgcttatcagaattatttcaaaagagtagatctggatttaggaacttccgaagcagcaaaaaatcctacagatgtccgtattaaaaattttgcaacgggttatgacccggagcttatttcattatattatcagttcgggcgttatctcctgatttcttcctctcagccgggcggtcagcctgccaatttgcaggggatctggaacaattccaacaaaccggcctgggacagcaagtatacgattaacattaatacggaaatgaattactggccggcagaaaagactaatcttcctgaaatgcatgaaccattgatccggatgataaaagatttgagcgaaacaggaagagaaactgcaaaaacaatgtacaacagccgtggctgggtagcacatcataacaccgatatctggagaataacaggagtagtggattttgccaatgccggaatgtggccgatgggcggagcctggctttcacagcatttgtgggaaaaatatttatacagcggagacaaaaactatctgcgaaccatttatcctgttctgaaatctgcagcacagttttacgaagattttctgattgaagagcctgcacatcactggctggtagcaagcccgtcaatgtcgcccgaaaatattccgcaaggacaccagggaagtgctctggcggcgggaaatacaatggataaccaattgatgttcagtctgttcaccaaaacaaaaaaggcagcacagattctcaatacagattcagataaaattcaggtctggaacactattatttcaaaattaccgccgatgaaaatcggaagctacggacaattgcaggaatggatggaagacttagacgatcctaaagataaccacagacatgtttcacatctgtacggattatttccttccaaccagatcagtccctttaccacaccagaattgctggacgcctccagaactgtgcttattcaccgtggcgatgt

SEQ ID NO: 15256 - DNA, 225 bp, Glycine max
  Peptide Sequence Number=SeqID_132034
atggtcaaactgcttcgtgctaatagaagaaaaagccctcaaaccctaacctcacaaaaccctactacaattcctcaagcgatgatgacgatgagaatgttccccgattttgagggctgcgactacctcaacaggttcttccttagggtttggcatcgcagaattacccaccccaacaaaattatggtcaagcatcacaaaatcaatataaggttatggaaataa

SEQ ID NO: 15257 - DNA, 189 bp, Glycine max
  Peptide Sequence Number=SeqID_132035
atggaatatattcacatgaggcggaacatatttactggttatatcatcggcaatcgcctgaatttcaagacgttcttcgaaccaatcatagactttattgagataggaattctcttgttaggaccctatgaatcaattaaaaaaacatcagattcatactataaccacgatgattcaaaaaaaccttaa

SEQ ID NO: 15258 - DNA, 363 bp, Glycine max
  Peptide Sequence Number=SeqID_132036
atgtatttgtcagcaaattacacattgagagacaaaagttgctatttaccccagaaaattataagaaaggaaaggaggtggggagaagggagttgctatgtgcacccagcattattgctggggcacccagcaaacagtgaagtggcaaaattgcccttcaataattcttctttcggaagaagtatttccgtaaacttttcggaaaaagcttttccggaaagtttccggaaaaaaatttcttccggaagaagaatttgtgaattccggaagtaccacaaactacgtccggaagaacgtcatccggaagtttccggaagaaccttcttccggaagtttccggaagaaccttcttccggaacttaa

SEQ ID NO: 15259 - DNA, 756 bp, Glycine max
  Peptide Sequence Number=SeqID_132037
atgctgcatattacaagcaaagggttgggagggagactaacctgttcgcggagaagacgaagaaaaccttgggcgcgcctcgcggagaagaagcaagttcacgaagaagataagaagaaccaggttcacagaagaggaagagaagacgaagctgttcgaacaaacagtgtcttccgggaggactatggagagcgtgtgggtcacgaccgggttgcaccggttctttcgggtcgggcgcgtgagatcatagctgatacattaacattagcttctgccccaagttgttggaaaagtctacctcttcagcagcataggagccgccacccctcattctctcaccttctcaacccttcttctattctctatgcttccacaacaccattgaacgatgcagagtttcctggccgtgacatgttgagtttttattcacagaatatgttaagagcaaaggcgataagtagtaccctctcaagcaatgctaggagtattttgcttagtggttcgcgatgtaatgcagcagatggaaattcatgcaattgccccgaggatgaaacatgtgtgtcgaagagacagcagaggaaaaacaatgaagatttacttgcgccaaagccaccctccttggtgtccaaagccacgtctcaagttgtaggaacactggtttcgggaaacttggctaatgggccagcttcccacaacgttgggagtgttggtcaatctggttgtgtacaaaagtccggcctacttcgtatgcaccga

SEQ ID NO: 15260 - DNA, 150 bp, Glycine max
  Peptide Sequence Number=SeqID_132038
atgcctaagtggatgagggcacatggagagagcttcgacacaacttcgagaaaggtctcaatgagtgacgcacatcggagtagagtgagtcactacatgagggagggcattgtggttgacggtggccggggaattttgagagaggtttaa

SEQ ID NO: 15261 - DNA, 1854 bp, Glycine max
  Peptide Sequence Number=SeqID_132039
atggggtgggtggcgaatcggtggacgggcgtcgccgccgccatatggatccagtggagctgcggcgcatcgtacaccttcagcatctactcctccgtgctcaagtccacgcagggctacgaccaatccacgctcgacaccgtctctgtcttcaaggacatcggcgccaatttcggcgtcctctccggcctcctctactccgccgtcgtcccctacacaacccaccgcgcctccgccgccgccaagtccaaatgggcatcgctcggcgggccctgggtcgtcatcgcggccggcaccgtccagtgcttcgcgggcttcatcttcatctgggcctccgtcgtgggccttataagcccgccgcccgtgccggtcatgtgcttctttgcgtggctcgcgtccaacggccagaccttcttgaataccaccaatgtcgtcaccggcttgcgcaatttccccgagtacagcggcaccatcattggtatcatgaagggatttcttggactgagtggagctatcttgatccaaatttaccatacgttttttgatggggacccagcaacataccttttgatgcttgcagcgttgccttcattcatctgcgtgttgcttatgttcttgctgaggatatatgaagtgcatggcagtgattacaagaagcatttggatggtttctctgtggttactgtgattattgtagcctatctcatgttcataataattttacagaacttagttagtttaccatactggggacggatgtttgcatttgtgattcttatggttctgctagcaacgccttttggaattgctatcaaggctcattgggaagaatcacggaaatttgcgcaatcctacacaattgggaggagttcttctacaaataagggtactacttcctccagttattctgcatcagtggatcaagtggagtaccatgagttgcctagtgatgaggggcaggaacaagtgacttcagatgacaaattgccccgtgaagaagaaaagaacctctggcaagctatgtgcacggttgatttttggatgttgtttgtgatcatgatatcaggattgggttctgggcttgcaactataaataatatgagccaaataggacaatcccttggctatagtaccatagagattaataatttggtgtcactatggagtatgtggaacttccttggtcgttttggaggtggccatgtatcagattatatcatgcacagaaaaggttggcccaggccactgttgatgacagcaactctagggataatgattcttggccatttaattatagcatctggtttccgtggaaatttgtatttgggtcctgtcctggtaggtatctgctatggtgcacattggtccttgatgcccacaatcacttctgagatatttggtgtaaagcatatgggtaccatcttcaatactattgctgcagcaagtcctcttggatcgtatatactttctgtcagagttgttggatatatttacgacaagcaagccgataaagaagataatttgtgctttggcatcgactgtttcatgccctcattttttatcctggcagggagactttggatggcattgacatgcctcgagggaagctcggaagctgttgaatggaggatggatagaattcctgacctgatcaagggcattgaattggttccggtggttagaactgtggacaagggtcatgatttggccagcgttaaaccatgggttgttggggatgtttcagatttacttttcagaaaatccatgaggaacattgaaaacgcggagaatgtcactgcaagactgcaactgttagttgaatcttcattgccagcatttgttatgtatgattga

SEQ ID NO: 15262 - DNA, 866 bp, Glycine max
  Peptide Sequence Number=SeqID_132040
actatgtgtttaaagtctcagaaatttatgagtctcagttctatcatcaagcaattagatttcctaaatggcgtcaagccatgaatgaggagattcaggcccttcaaatgaacaacacttgggttgttcaacctctaccacccgataaaagacccatcagttgcagatggatttataaggtcaagtatagagcagatggctcccttgatagatacaaggctcgtcttgttgcaaaaggaaattggaacatgtttcagcttgatttaaataatgtgtttctcaatagtgatttgattgagggagtatacatggacatgcctcttggttatcttgtcaagaatgacaacatggtttgtaaactcacaaaatcttcgtatgggagtggagcaactctagttacattgttggtgtacgttaacgacattatcattgttgggccagatcagaagttgattgcagaaacccaacaaatgcttgtcaaacacttcaaaatcaaagtgattggtgatctcaagtattttctaggcttggaaattgacaagtctcctcgtggcatccatctttgccaaaatgcctctcaatatcgtaggctaattgggaggttaatgtacctcacaatctcgcacccagacatctctcctcaccttgccaaggcattatatttccctcatcatcatccatgcgggtttctacatatgtggacaccgactagggtagttgccaagtcacccatcgtcaccatcggtttttgtgtatttctcgattcatcattcattgcatggaagtccaagaaacagcccatggtggctcgttcatcagcagagggaacatgtcctgactggcttcatcaaccttgtccaagttaa

SEQ ID NO: 15263 - DNA, 428 bp, Glycine max
  Peptide Sequence Number=SeqID_132041
ttgttagtaagcatgatgttaagggttttatttcacatacaatatggcctcaaggaagaggaaagccacaacatcccaaccccaggagccttatgacaccaccatattcatctctgaggctacctaggagagaatatgatgagttcaggcgggagttagagatgcgatgttggcataaagccttgaccaggcagatggatgggcacatagatgtagccctgctcaaggagttttatgcaaatttgtatgatccggaggacaaatctccgaggcagagacccccgtggttttggagtcaggggaaagatacacagcctataccaggttctacggcagacgcccagatccttaggagcttgtctccaagctctgtatttcagggggcaactttatccttaacgctgatggagcgccctggaagctcctga

SEQ ID NO: 15264 - DNA, 498 bp, Glycine max
  Peptide Sequence Number=SeqID_132042
atgcttgcagagtcgtctctggcgtggcctcacgagctacctctagctataactgaggcttctgggttgcagaggcctcacctccccccccaaaggagaaggctggactcttggccaggccacctgagcagtgaactcctcaatactgatgatgggctgatgctgagtcaagtgctggtaggtgctggagtagatggtgaaggaagaactgaagtagagggagctacaaaagtaaaggtagggtcagctggagtagaagaggaaggagcagctgaatcatgtcccctggccttagacttgcgggtccctggaaatgtgatcgaaggatcatccagggactcgaatgtcagcaaatctggaacaactccttgggcgatgcatagggcagtgataagcgtcggaaatccaagcttggaggagttggactgggccatctgcaagatctgtccagagatgaatgagcccacgtacatgtccatcttcataacgagcccataa

SEQ ID NO: 15265 - DNA, 402 bp, Glycine max
  Peptide Sequence Number=SeqID_132043
atggcatcagaagtgtcaattctgcaaccttcttcctctcttctcctctcttcatctttcatctctgaagttcttcaaccattcgagctttctgccatggatgatccatatgatccttacatcatcaataatgcttatacaatgctcatggctcttgttggaagaaacaaactcagatttgttgatggaacaattcatccacctgaccctaaagatcctttgcatcatgtgtggctccataacaacaacattgttgcatcatggctcatgaattccatttcaaaagaagttgttgcgagtgtcacctattccttaattgcaacaacaatatggaaggatcttaaggatcgcttccatcaaaacaatggagctcacatccttcaaccgaaacgtgatttgtaa

SEQ ID NO: 15266 - DNA, 186 bp, Glycine max
  Peptide Sequence Number=SeqID_132044
atgaataaacttggagctaaatcaggcatagccatagtttatcaatggaaaatgaagaagaagaaaaagttagaaaaggttgagaaatggatgctaacaattcacaggatagaatatggaacaggatcattaaatatcaatctaaagggtaatacaccacatgcttacttgtacaaggttgcgtga

SEQ ID NO: 15267 - DNA, 436 bp, Glycine max
  Peptide Sequence Number=SeqID_132045
acggagaggatttgagctagccgaggatgtgatcgaagggagcaacacaagcaggacgccgagaagtataaacacgtcatcaacttcgtcatttagatacaaagacggtcctgccgcaacacccgtcttcgtattgtttgtggtacacgtggattgcacctacacagagcatcttctccgacaaagaccatcgtctccgacaaccaccatctcgtgtccgttgcgtcttgttccgtttgaagccgccgccgacaaaggcccttggttgtcttcatcgtggtctacattgtactatttaaggaagataagtggggtttatgtggggctcgttgatgaagctgacttgcgggcagtgagtgaacgaccttcgggaacagcctgctgccatccttcatcagtggtgtgtcatcctgtgccacattatcagtttcgttga

SEQ ID NO: 15268 - DNA, 1035 bp, Glycine max
  Peptide Sequence Number=SeqID_132046
atggagaaaaggtttaagaataagaatgtgcaagcagattttggacttaaaggaaaagaacatgtgttgaaaatcatcttaaccaattttctgtcttctttcctcaatcggtactacaccaatttctcttcgtatgtaatcacttctaatcctgttttttcactcgagatagcaacaggtccaagagagttaccgggagatcagcccaatatcgggattatgtctgaagggcacaatgaacaagagaagggtgcattgctggattactactacgctacttatgccaatgactcatggctgcgtgtgaatgagccaaagagcaattgttgtgactggcaacgggtcttgatgagtgttcatggttggatatgttgggtaaacgattactcagaggttgcttgttgggtgtccaccggggagagacaagcagcaagaataagaggcttatacctcagagcaattttaaggcaagatatcagcttctttgacaaggaaaccaatactggtgaggttgttggaaggatgtcaggtgacacacttcttattcaagaagccctgggagagaaggtaggaaaattcatacagtgtgtggcatgttttttaggaggtttagtcatagcattcatcaagggttggcttctaacccttgtccttctatcttgcattccacctcttgtcatctctggttccatgatgagctttgcttttgaaaagttggcatcccgtggacaagcagcttattctgaagcagcaactgtagtagagcgcacaattggttcaattcgacaagaaccaatactcttcagttgcagcatcaaagaaaacattgcctatggtaaggatggggcaacaaatgaagaaatcagagctgccactgaacttgctaatgcagctaaattcattgatagatttccacatggagttgacacaattgttggcgagcatgctacccagctctctgggggtcaaaagcaaagaattgccatagcaatggcaattttgaaagatccaagaattctacaggtgaacctttag

SEQ ID NO: 15269 - DNA, 1275 bp, Glycine max
  Peptide Sequence Number=SeqID_132047
atggctatgcctcgaagtttattcattactctagctattttcttgggattcctttcaggttcatatgcagcgaaattcagaatcagcaacgaatgcatcagcacagtttggccagcaattgtcgcaaactccacttccaccaccggcttttccctccaaccagggaagtcctacatggttactatgcccaccggtgaagtaaaggtatgggccagaaccttttgttcttacagtattgctggaaatttctcttgtttcactggggattgcagctcctcaaacatagattgtcgcggtggcaacgcaaaccccaaaccccctgttactctggccgagttcactctgaacggttcctatgggctcgactactacaaagtgagtttgagggaaggtttcaacctccccatgagtatcgaacctggggggagctgcagatcgactggttgtgggagggacttgaaccaaaagtgtcccacaaagctgaaggtgataatagacggtggggacgtggtgggctgccaaagtttgtgccaagctcatgagacgtgtaagtccaccttgttttccgagttttcaaagaccaaatgccccgaggcttaccaacatggctcctttacctgtgcgtctgctcaatattatacagtcactttctgtcctacctcctcaagaagttcgaagaatgcagaaaaagaaaagaaatctccagtagaaaattcgggaggtcaagtgcaaggctcactctacgtcctcctccggctattaaaaaagtatgtggtgcctattgttgctgtcaccgtaacatggtacagctcaccaaacagacaatggggaatggaaatggtcatgggacaaactagtactacagctgaagccctcgcccgcaaccaacaacatgtctatgctgagatgttcactctgaacggctttaacaggcttggttacatcagagagagtctcacgcacggcttcaaactggccatgagggtcgaaccccttgtggaaccggagaccggaggtgcggagcttgtgaaaggggctcctttacttatcgtcgtcgtctgcgacgacgtaataaattcaatggatttcaacgacggcaccgtcgtagacctaatcgtgttctacgatggttgtctgcttcggaccgtcgtagaatggtcaacaattcaaagacggctacccgacagccccgtcgtagaactaaggaaggactacgacgaccttggggacagcaccgtcgtagacataatcgggttctacgacgattgtctctaa

SEQ ID NO: 15270 - DNA, 999 bp, Glycine max
  Peptide Sequence Number=SeqID_132048
atgtctgaccataacccttccgcacttgaacgcattgaagatgcaatttccaaacttgcttcgagccaactccaggtcaccgaaaaactcgaggatttactccttcgcgtggccaacctcgaacagacagcaaactcaaacacatctccctcttcctcttcacccgcacctgcatcaaacaccataaccattactcacccgaaaatgaaactagacgtacctagatttgacggctcagacccttcggggtgggtcttcaaaataactcaattcttctcctaccactctacccccgaacgcgagcgccttacaattgcctccttttacatggagggtccagcgttagcgtggttccagtggatgagccggaaccaccagctgaccacttgggctggttttttggaagcactcgaggcacggttctcaccttcaccttacgaggaccccaccgggatcctcttcaaactcacacaacaagggtctgtaacgacttaccttcaccaattcgaatccctagctaatcgcatcgtcggactgcaaccctccatgctccttagctgcttcatctccggcttggaccccgccatccgccgcgaggtgcaggcattgcaatccctcaccctggctcacgccgccggcttggcacgactccaggaagataaactcgccgcccaacggcgcccttactcccaacttccctcccaacgccctcctccacccccaaatccacttcctttaccaccactcaaccctaatgtttttcccttaccctctccttctacccctctccttcccactcccccgaaaccacccccactgccctttcgccgcctcaccccggccgaactagccagtcgcagggaacgcggcctatgcttccactgcgacgagaagttcacgagagggcatcgatgcgcctctcggttcttcctcttggtggctgatgaggacgacccaaatgcccaagatgtgttagacaagtggcctcagatatcttaa

SEQ ID NO: 15271 - DNA, 201 bp, Glycine max
  Peptide Sequence Number=SeqID_132049
atggtggcgagcgtgacaacgtggtggtgttgctggaggaggtctgatacagctgagaatgtaattaagaaacaaaaagctgaattagcagaagcagaaccaaaggaagcagaatcaccaaactcaggggcaaagatggaagaaccaagaccaaaaaggaccattaccaaacctccttacctgcaggatttcgtggaatga

SEQ ID NO: 15272 - DNA, 243 bp, Glycine max
  Peptide Sequence Number=SeqID_132050
atgcctgaagcgggtatcacggaacagtacgaacagtacgttgttggagtatttacagacaaaagtattcggttattggggaaaaatcaatatacttttaatgtcgaatcgggatcaactaggacagaaatcaagcattgggtcgaactcttctttgatgtcaaagtaatagctatgaatagtcatcgactcccgacgtatgattattacgcttcaaccgggttattctattccacctcttag

SEQ ID NO: 15273 - DNA, 297 bp, Glycine max
  Peptide Sequence Number=SeqID_132051
atgaagaaggaaagagttcagccttcttggcacttcgaagcgctgaggaaaattgctgaggaaaattgttttcgtgaagaaaatccaagccgaggcgcttccgtaacgttttcgtgggtaattacgcgaagattttcaaccgttcttcgacattcatcgttcgttcttcattttcttcagtcttcaactggtccaacgcctttaaatgatcacctttcaagtaaaaagaaattgtgtgattcacccttaagaaagaactacgtaggtctgatttcctcttcaatggagggtacgtag

SEQ ID NO: 15274 - DNA, 528 bp, Glycine max
  Peptide Sequence Number=SeqID_132052
atggcggaatggagtcgcagaattttggaaaaatgccaccaaataacggtggcattgcaggttgcttatggcggtgctatgacagccgccatagtcatggcgcggtgcgaccagcagcagtctccagcgcaacgaacggcggcgcgggcgccggcgacacacacaacaattgcagacgacgttctcgagcgcgacgacaagagaccagcagacgacgcacacaagaaaccgacgaccgacgcacgcgaccgccgcatgacgcacgacgcacgtcgacggcaatgctctggtgcacaacgacgacggcaaactggcctcttaaacaaagaaggaagaaagtctagacatttgagaattcataatccaacagtttataatcaagacaactgcaaaatgataaatgacccaactaccaagcatagacaagcaatctacataaggggaaaaagtgaataccgccaaaaacaacagaggaaaaaggaaagaaaaaaccacgaagtcatattacctagccagtcaaagatttag

SEQ ID NO: 15275 - DNA, 669 bp, Glycine max
  Peptide Sequence Number=SeqID_132053
atggccctccaaatcctaaccgtcaattccatttccaacgccgcaccggaagtcatgggcatggactactacaacatactcaaagtgaatcgcaacgccagcgacgacgatttgaagaaagcctacaagagactcgcgcgtatatggcaccctgacaagaaccccgtcaacaagaccgaagccgaggccaaattcaaacgaatctccgaagcctacgacgttctcagcgacccgcagaagcgtcagatctacgatctctacggcgaggaggcgttgaaatcggggcagtttcccccacccccgcagtcctcgtcctcgtcgtcctcgcgcgccttccaccaccaccaccaccaccaccgccagaacaacaaccctcccccggcctcggcctcgtcgttccgattcaacccgcgcgacgccgacgacatctacgccgagtttttcggcccggacgacatcggcgccggtgcctcgtcccgccgaggcggcggcccggacgccttcttccggacctccaacggcggaggcgccgcgttcagcgcctccgccgctgcaggacggaaggccgccgcggtggagaacgcgctcccgtgcagcttggaggacctctacaaaggagtcaagaagaagatgaagatttccaggaacgtctacgacgcttttgggtaa

SEQ ID NO: 15276 - DNA, 1002 bp, Glycine max
  Peptide Sequence Number=SeqID_132054
atgcctaggaaactactaccagagagaaatgtagtagtatattacaccgagtttgataagttcaaggatgaactcgagagaagacactgggatgaggagctgactagttttgctgacgacaacatcgatgttgccattgtgaaagaattttacgcaaatcactacgacctggaagacaagtcacctaagcaggtaagggtcagaggccatctaattaaaattgatgaagatactttgaatacctttccgaagaccccagtgattgaggaagaaggtgaaattttgtgtgcttattcgagatttgcactcctgaggcctaatcctcaagagttggctgctaagctttgtatcccatggaggggattcaagctaaacgctgatggtcagccttcgaagatattaaggaagaacatgaccactttagctcagacatggagcgttctttccttctctaacttaattcctacctcccacacatctgatgtcacattagacaaagccaagttaatctatggcatcattatgaagatggatatgaatgtggggtacctcatctcccaccaggtttctcttactgcacaacatgattcatccagacttggattccctgctttgatcacagctttgtgcaaagctagaggagtccaatcagattctagatccctggagagcctcagccctgccattaacttggcatacattaagaagaattgttggaatctagatgatccaacagtgacatttagagggccaaggaaggccaggggtggcctggctaggagcctaaaccagaggagccaacagcagcaacagagatgtacacatggctcaggaggaggagacttccacagaccagtaccagagccatctcctgcacctattcctgaggagacccagccatctgcaccagtcatggagctagagaagcctatccaggatgtaccagcagctccagcactggatcttaatgaagatcagccacaggatgagcaggatatttaa

SEQ ID NO: 15277 - DNA, 237 bp, Glycine max
  Peptide Sequence Number=SeqID_132055
atgcctatttcgccagttctactagctgaacctatgggggatggatgtatgcatggccatgtgatggatgggatgaatgctgcatgcacagtgggtttcgccaatggtggtggcgaaatccacatgcccgtgaatgcttggcgatatgcatgtttcgccaatcttaatagcgaaacccctaaaataaaagactcactccggactatgtttgaaaagagacccattttggccatgtaa

SEQ ID NO: 15278 - DNA, 1813 bp, Glycine max
  Peptide Sequence Number=SeqID_132056
atgggaaactgcaacgtgtgcgcgaaagctgacgtggtagaagatagcaataacaacaggaacaagaagtctaatgaaacgaaccgcgctaggaagaaagagccgaaaccattcacggacgaaccggcccggtcgacggcggctccgatccgggtcctgaaggacgtgattccaatgagccaccggacgcgcataagcgacaagtacatactgggccgggaactgggccggggcgagttcggaatcacctacctctgcacggaccgggagaccaaggaagcccttgcctgcaagtcgatctcgaagcggaagctccggactgccgtggacatcgacgacgtgcggcgcgaggtcgccatcatgtccacgctgccggagcaccccaacgtcgtgaagctgaaggcgacttacgaggacaacgagaacgtccacctcgtcatggagctctgcgaagggggagagctcttcgaccggattgtcgccaggggacactacagcgagcgcgccgccgccgccgtggcgcgcaccatcgccgaggttgttaggatgtgccacagcaatggcgtcatgcatagggacctcaagcctgagaatttcctcttcgcaaataagaaagagaattctgctctcaaggccatcgatttcggcctctccgtcttcttcaagccaggggagaggttttcagagattgttgggagtccttactacatggcgccggaggttttgaagcggaattacgggccggaggttgatgtgtggagtgctggggtgattctttatattttgttgtgtggggttcctccgttctgggcagagactgagcaaggtgtggctttggcgatcttgaggggtgtgattgacttcaagagggaaccttggccgcaaatatcggagagtgccaagagccttgtgcggcgaatgttggagccggatcctaaaaaccgcttgacagctgaacaggtgcttggtggaaactgggaaggtggggaatttggaatgaaaaccacttcacactttcttggtatgactataatactagaagaacatccctggctgcaaaatgcaaagaaagctccaaatgttccattaggagatattgtcaggtcaaggcttaagcagttttctgtgatgaatagattcaaaaagaaagctctgcgggtaattgcagatcatttatctgttgaagaggtagaaataatcaaagatatgtttacattgatggatactgacaaagatggcagagtaacgtttgaggaactaaaggctgggttgaggaaggttggttcacaattggctgagccagagataaagatgctgatggaagtggctgatgttgatgggaatggagtacttgactatggagagtttgtagctgttacaattcacttgcaaaaaatggagaatgatgagcatttccacaaagcattcaagttttttgacaaagatgggaatgggtatattgagttacgtgagctagaggaagcattagcagatgagtcaggagaaactgatgctgatgtattgaatgacatcatgcgtgaagttgacactgacaaggatggtcgcatcagttatgaggagtttgtggcgatgatgaaaactggaactgactggaggaaagcatctaggcaatattcaagggagagattcaagagtttgagcctaaatttgatgaaagatggctcgcttcagcttcatgatgaaattactgcctcatgccatgcgctcactcagttactcatttttcttgcaccacctattgtgcttgaaatatcgtttgcggaatctctccaaggaagcaagttttgggcag

SEQ ID NO: 15279 - DNA, 1002 bp, Glycine max
  Peptide Sequence Number=SeqID_132057
atgcatgatgaaatttctactttagaaaagaatcatacaagggtgcttactgatttacctcaacataaaaatgtgattggttgcaaatgggtgtacaagatcaaacataatgcagatggctctattgaatggtataaggctcgcttggttgctaagggctatacccaaattgaagtgatcttaatgaagaggggtatatgggtctacctccaggccagtcatcaatggtatgctcaactatctacttttcttatggcttatggcttcaaacaatttgttgctgactattctctcttcactttgaaaagagaaaattcattcactacattattggtctacgttgatgatattgttctgagtaggaatgatctctctgttatttctcatatcacaaaattattggatgacacttttaagatcaaagaccttggtaatttgaagtattttcttggatttgaagttgctcatggaacctctgttgctcctggtttgggtattttctttccttctaccagtgagcttcaattcaaagcctttagcgattctgattgggctagatgtattaatactaggaaattcattaccgatttttctgtttatcttggttcatcacttatatcatggaaatctaagaagcaagccacagtcttgagaagttcttttgaagctgaatatcgtgcccttactattgtaacttgtgaaattcaatggctcacatatttgcctcatgactttggtattattcataagcctgctttggtgttctgtgacaataaatcggctctccacattacagctaatcctgacttccatgaaagaaccaagcatattgagatttattgtcacttggttcatgacaagctgctttcgggtttgatcaagctcttgcctattgcttcagcacaacaacttgttgatgtttacacaaaggctttagctcttggtgcttttcattttatcttttccaagttgggtataaatggcattcattccccaacttga

SEQ ID NO: 15280 - DNA, 420 bp, Glycine max
  Peptide Sequence Number=SeqID_132058
atggagatatgggccattcataatggtcctactgtcaatgcttggcatgataggtggttggatgagcgaacaatgttatttgatcaagctattgttttccctgctcatattcataattgttgtgttgctgacttagtggataacaatggagattggaacctccctctcttgaatatgttcttgcctcatgatatagtcaagagaataaagatgcagaatatggtgttgcagattgattctaaagccgttgttactgctataaaggggaacaggtggggctgtgtttcgggtagaaggctagttcgaactattcgcatcttgttgccttcctttaaccacattcggattcatcatcatagtcatagagagaaagattattactggctgattatggttgttctttggggggtgaatatgtga

SEQ ID NO: 15281 - DNA, 177 bp, Glycine max
  Peptide Sequence Number=SeqID_132059
atggtacaatttgcttggcattcgatgctccctcaagctccaatagagcacatgtttgttcaacatttggtcatgactgacaacttagaaaaaggacttctcaatgtccttccagcaattgcaagaaaatccaggaacttgcctcatgaatctgtgactcaggccagtgggatttga

SEQ ID NO: 15282 - DNA, 258 bp, Glycine max
  Peptide Sequence Number=SeqID_132060
atggtggagggatttgaagattgtgtatgtggggatgaacacgagggaaggaatgctttccctagattattcttaaactccgaacaaaaaaggagatggtgggaaatatgggaacatggaatgaggaaaattggtcatggaatcttacctggagaaaaccgtggtttgaatgggagaagaatgaagtatatgaatttcatgcattattggaaaagacgatcattagaagggaagtcttggatagttgggagtgggtga

SEQ ID NO: 15283 - DNA, 210 bp, Glycine max
  Peptide Sequence Number=SeqID_132061
atgacggcctacggtggtagaggtgaaaacaagaggtggcaaataatgataacagacctgatgcacacatcagctcaatttgagtcgatagctataacgagacaagtcaaaagggtcaaattcaatttagcttctagaatgaatcccaagatcgatgaaaacctgatttttataagttttgtggatttttgccaactaagactagattaa

SEQ ID NO: 15284 - DNA, 1848 bp, Glycine max
  Peptide Sequence Number=SeqID_132062
atggggactcaaagaggaatagctcttctcagtttcacattcttcttgttgttgagctcagcaaatgctttgctttctcctaagggagtgaactttgaagcttcatatcttttcaagagttttgaatttggtctcactcttattgcagtgcaagccttaatgggcataaaagattctttagaggatccacatggtgttctagataattgggatggggatgcagttgatccatgtagctggactatggtcacttgttcttctgaaaacttggtcattggactgggcactccaagtcaaagtttatctggtactctatctccaagcataggcaacttaaccaaccttcagattgtgctgctacagaataacaacataagtggaccaatcccttcagagttaggcaaactttcaaagcttcaaacgcttgatctctctaacaacttcttcagtggggggattcctccctctcttggtcacctaagaagcctccagtaccttgatttgtcatacaacaatcttagtggtccggtgcctagaattttagccaaatcattcagcattattggaaacccccttgtttgtgccacgggaaaagagccaaactgccatgggatgacattgatgcctatgtccatgaacttaaacaacactgaagatgctttacaatcaggcagaccaaaaactcataaaatggcaattgcctttggcttgagtttgggatgtctctgcctcatagttcttggttttggacttgttctttggtggaggcacaaacacaatcaacaagcattctttgatgttaaagaccggcaccatgaagaagtctaccttggaaacttgaagaggttccaattcagagaactccagattgctactaacaacttcagcagcaaaaacatactgggaaagggtggttttggaaatgtctacaaaggagttttccctgatggcactcttgtggctgtcaagaggcttaaagatggtaatgccattggaggagagattcaatttcagaccgaagttgaaatgatcagcctagcagtgcaccgaaacctcctcagactgtatggattttgcatgacaccaacggaaaggctcttggtttatccatacatgtccaatggcagtgttgcttcccgtctcaagggtaagccagtgctggactggggcacaaggaagcacattgctttaggagcaggaagaggactactttaccttcatgagcagtgtgatccaaagataatccatagggatgtgaaagctgccaacatattgcttgatgactattatgaagctgtagttggagattttgggttggcaaagcttttggatcaccaagattcacatgtcacaactgcagtgaggggcactgtggggcatattgccccagagtacttatccacaggacaatcctctgagaagactgatgtttttggatttggcattctcctccttgaattgatcacaggccaaagggctctagagtttggaaaatcagctaacaacaaaggagccatgcttgattgggtaaagaaaattcatcaggagaaaaagcttgatatgctagtagacaaggatctcaagaacaactatgacagaattgagcttgaggaaatggttcaagtggctctcttgtgtactcaatatcttcccggccatagaccaaaaatgtctgaagtggtacgcatgcttgaaggtgatggactagcagaaaaatgggaagcttctcaaagagttgacacaacaaagtgcaaaccacaagagtcctcttcatcagataggtattctgatctcactgatgactctttgttgttagtccaagccatggaactatcaggacccaggtga

SEQ ID NO: 15285 - DNA, 1143 bp, Glycine max
  Peptide Sequence Number=SeqID_132063
atgtcccaactttccgacaccactaagtatccgccacgtgtcgcagagagattctcccgctggcacaaaacactaactcccccaatgttggagggccaagcaacaacgcccacgtggccgcgcatgtgcgacacgtgccgctccgtcccctccaccgtcttctgccgctcccacaccgcctttctctgcgccacgtgcgacactcgcctccacgtctctctcacgtggcacgagcgcgtgtgggtgtgcgaggcgtgcgagcgcgccccggcggcgttcctctgcaaggccgacgccgcctccctctgcgcctcctgcgacgccgacatccacgccgccaaccccctcgccagccgccaccaccgcgtccccatcctccccatcgccgccgccaacaacaacaacaacgacgacgacgacgttgctgacgttgacgacgaagacgaaaccgcttcatggctcttgctcaaccctatcaagagtgctactgtccctaacaccaataacaataacaataataacgggttcttgtataacggtgaggttgatgagtatttggaccttgttgataattgtaactcttgtggtgataataatcacttcgcttcagctgctgctactactgatcattacgctcagcaccaacatttcgctggtgtttctcagaagagttatgctggggacagtgttgttccggttcagcaacaccagcattttcagcttgggttggagtttgacaactccaaacctgccttcagttacaatggttctgttagtcaaagtgtttcagtttcatcaatggatattggtgttgtacctgaatcaccaatgagggatgtctcaattgcccatacaagaccccccaaagggacaattgacctattttctggacctccaattcaggtgccttcccatttttctccaatggacagggaggccagagtcctaaggtacagggagaaaaagaagatgagaaaatttgagaagacaatcaggtatgcctcaaggaaggcctatgcagagactagacctcgtataaaaggtcgatttgccaagagaacagatgtagaagctgaagtggatcagatgttctcgacaacactaattacagaagttggatatggaattgttccctctttctga

SEQ ID NO: 15286 - DNA, 600 bp, Glycine max
  Peptide Sequence Number=SeqID_132064
atgttttcgttgagtaagagtgagcgcaaaaaaaattgggaagagcgtcttggaataaagaaaaaaccattcaagagggtggtgagaatagcaggtcccaagacacaattggagcgaggcttaagcccaaaggcccgacccaacttaactctttgggattctgagaaggagaaaaaacctttgccgccactcattgtcgtacattttgaagcaaaaataatggggaagaagagaaaacacagtgagactactcaaagtgtggcacagcccaaaaaggaagatgctgctccagagagaccagctaggacccttttggggtggaaggataagaatcaagttgaggataataataatgctgattcaccaatatttaggaacaaagagaagctattggtcacttgctctaggcgcatcaattacaggtaccggcatttgatgttgaatttggtgacacttttgccccattgcaagaaggataacaaagttgaatcaaaggaaactaaaggagccaccctcaacgagcttgttgagctaaaaaattgttcctcttgtttattttttgagattcatgcttgttataatttgaacaatgactgttga

SEQ ID NO: 15287 - DNA, 339 bp, Glycine max
  Peptide Sequence Number=SeqID_132065
atgcagaatggtactccatggcctaggaataatgtcagagatcatcacggaatgatacaagttttccttggtaaaaatggtgttcgtgacatggaaggaaatgaattaccttatcttgtctatgtgtctcgtgagaaaagagctaaatatcatcaccacaaaaaaggtggagctatgaatgctttggtgagagtttcaacaataatctccaatgctccttatgtactgaatgttgattgtgatcactacataaataacagtaaggcccttcgtgaagccatgtgcttcatgatggatcctacatcagggaaaaaaatatgttgcgtacagtttccttaa

SEQ ID NO: 15288 - DNA, 138 bp, Glycine max
  Peptide Sequence Number=SeqID_132066
atgaaaggtttagaaggcatccaaggaccaatatatgtgggaactgggtgtgtcttcaggagacaagcattctatgaatatgatgcctctacattgaagacaacacctagaaagacatgcttaaggcagcaggaataa

SEQ ID NO: 15289 - DNA, 1488 bp, Glycine max
  Peptide Sequence Number=SeqID_132067
atgtggttgggaggcgatgtgtcgtgtgcatgtggatgtccagactttgagatgatttatttttcttttgtgaaccttgctggtggttatcataaggtagggtttataaggaaggatatttataatgaacaagctagaatgaggaaattgaaaacaacggatgcgggtggtgcattaaagtacccaagtctattatgtcaaaaggatccaattatggttgtaacttacactgttgatgaaagggaacgactgcaatatttgttttggtgtgatgctgaaagtcagatgaactacaaggtgtttggtgttaaccaccataaccatactatagtgtttgctgctgctgttgttacgaatgagactgaggagacatatgtgtggctgtttgagaaatttcttcaagctatgaatggtaaagctcctttttcggtaattgctgatggagatgttgctatgaagaattccatcaagagggtgtttctgaatgctcatcataggttaagtgtgggacatcttatgcgcaatgcaaccagccatgtaagggacaaaggtgtcttaaaatgcttaaagagttttatgctcagtgatattgaagttgttgaatttgaagaaaggtggacgaacatggtgggcaaatatgaattacaagataaccattggatcactgatttgtatgctaggaggaaaacgtggtccccgactcatatcagaggaaatttctttgctggcatccaaactacatctcgttgtgaagcgttccatagccatgttgcaaaatatgttgatgtgaagttaaatttgactgagtttgtcgaacaatttcaaagatccttgactctacagtcccttgaaaaatctgttggtacaatccttactaaggagatgcttttacttcttaagcctactattgcaaagacagttaggttcaaggtcgttgattgcaaggagatgacaatgtttagtatttacacagtggtgaagtaccgcagtgaatctatttggtggtcgaagaatgctaaggaacccataaaaggaaagtacctcggtgcatccttatattgggaatcagaagatattgctagatatgcaacattgttgcaattatctagagaagtttgtgaagctggttatcgtgtggaagaagactttgatgatcttgtagttttgttttcaaacgaagttacgaggttaaagtcaaagaacataaatgcaggtgttcaaaatgaaatggagacgcatgttgaaaccgtaaatgaatttgatggtgttttgaatccgcctgttgtacgagcaaagggatgcggtcaaacaatgaataatgaatccaatagtcgaaggaggatacaaacatgtggcatttgtggagcaactggtcacaacagacgaaaatgtaccgttttatctcaaaattcaatagatgcaggtggtcgagtaggtattcctccaagtcaccaaacatgcaatgctcctaaaatgacagatgagtaa

SEQ ID NO: 15290 - DNA, 246 bp, Glycine max
  Peptide Sequence Number=SeqID_132068
atgaagctttggtgttgtccatggctatgcttcactaaagaagatgaagaagagtgcaatgttccaaaacctatgaaggaagatgacgttttcagaaaccatgtcattttttatgatggaaataatattcacggtggcgactacaagcaattcatgattgcgtgcgctaatgcattgggctcgtggctcgaaatgtggtgtaatcatggggctaaaaagcaatcaaaatgtgaaagaggatattag

SEQ ID NO: 15291 - DNA, 591 bp, Glycine max
  Peptide Sequence Number=SeqID_132069
atgaagagccaggatttggtcacggctattgtttgtttggcatacaatacagagcaatcgatggctgaaatagttgagtgcacttcatccagattaggtttgtcctatgctcctgaggggggcctaatgtcgatgatgtatgggggtggaaagttggcagaagggctaacaaagctgtccattttgccctcgttacttgtccaccaaatgcatttgtgggtgaaacacaagtggtgcaagatgaagttgtcatcctatcttgctttagacttttgtactttggtgtcttctgaggatgatgttttccaacttgcacagcttgcttcaaaagttgttaaagatcctaagttaactgttgatcagctggagaaactattggtgaaatccagtatacttgaagatgcgcagaagtctaaagctaagctgaactataggctggtttccactaccaattcaattccaagccttgttgaggagattcagcttggatttagtagaagagcaaaatgggagatggacaaaggtaaacatgcaaaggttgcagcagacatagaagataggttttttaagctgaaagggttaacattttga

SEQ ID NO: 15292 - DNA, 408 bp, Glycine max
  Peptide Sequence Number=SeqID_132070
atgtcaaatattgcgtatgttactaaacttggactgagtctcattgttgtagcttctcataaaagattggctgaagacgctcgtccaacacatccgattgacattttggcttcttggttcgtgtcaaggcattttgcgctcagtgaattagttgtttttttcggaggtgacgtgcttttgcttccacaaataggaacatggtctcttgtattgtttggagagctacatgcctcctgtcaaacaatgttgcatatggccttcaaaatgtccttgtttctgtcttctaaggcatccaatctcttgtcaagacctccctctagcaactacaacagtatatacagatttaataggttgcaaatttccattgacaatgtttacaaacattatgatgaaggttgtacaatatga

SEQ ID NO: 15293 - DNA, 360 bp, Glycine max
  Peptide Sequence Number=SeqID_132071
atgcaggggaaaataccctttgaaacaacattgccatctcggaagatgacttacagtgtcggtaggtcagttgaaaggatgttaaagatgccaaagattgattgtcaaccacatatgtcaggtgtgcctaaatttaaaatctatgccaaccttggcgaagtcaagaatatcagggcaagtggtgttcatgaaaaaccaaggacaaatgcaactacaaataggggaaatggggaattacttccaatggggatgtcgtgtgtgtttaggccaactagcgacatgaaactgtccatcgacaaagcacatgtgtgtgcatatatttttaacccgaagttagacaagatatataccaatttatga

SEQ ID NO: 15294 - DNA, 333 bp, Glycine max
  Peptide Sequence Number=SeqID_132072
atgaactcaaccatgagtgaatcaggagcaggtggtttcaaaaccttgagttctcccattccttacctctttggtggcttagccatcatgctagcactcatagcagttgcattactcatcttagcttggtcttatcgtaaacaatactatactacttcttctaactcagccagtgatgaagagaaaccaccacaaatcaagatggtggaaaaggaggagaatgtttcagagccaaagattgttgtgatcatggctggagagggcaaccctacttacttggccaagccagttccatccacaagccataatgaacaagccctaatttcaaagtag

SEQ ID NO: 15295 - DNA, 576 bp, Glycine max
  Peptide Sequence Number=SeqID_132073
atgaaggggtgcatgaataggtcaaggcttaagagcatgcatgatgtgcaatacaagtccacaaataaaggacaactccttgatcacacatacatgagctacatgaggaaggagatcaaagcatgcaacagagtgacattgagttggttagaagggatgtatcacacctatgttgctagtaagtcatacgtatgggcagctagggcatatttgttgcatttggtcggtaataccatattagccaacaagagcttgacgcatgtacacatttgctacttgcactacctcagtgatctagattgttgcaacgagtacacatggggagcaactacacttgcatttctttatgatcaacagtcatatgcaagcaagtatggcaaccaacaaatgagaggttatatgacgttgctcattgtgtttgagcatctatcaaccatttcttgtagtgagaagatggttgatgttttttggtcaccatatgcatcacgcagagacatcagaccttttgaggactttggctacatcaaagttgggacaaacatgtggtcgtatctatcggagagggttttgagatag

SEQ ID NO: 15296 - DNA, 264 bp, Glycine max
  Peptide Sequence Number=SeqID_132074
atgggtcagatatgtgttgcccctggacagtgtgcaatatattacatggagtggatctacataatttctcatcccttcatgagtttggcacagcttggggatccacctagacatccacttgtggtgcacgatgacacatttattgaattagatattcctcaacacccagtggcggcagaagctatgaacgaagcacctacaaatgcacctggtcatgtagagcagtctcaacatgcaatggaaacactagaccctaggtcgtga

SEQ ID NO: 15297 - DNA, 792 bp, Glycine max
  Peptide Sequence Number=SeqID_132075
atggcagcgtcagtttcgtgctcatggctaacccttccctcccaaatgaggagcctctccctcacatcctcttcttcatccctttgcatctccaattccgcttctctcagtttctccagaaacctctcacgccctttcttctcaaaaggtaactccttgtcgctaagcacagtactgaggcgcgcgtctgtggtttgcgaggctgcgccgaagaagaaggtggattcggcggtaaagagagcgcgccaagccgagaagcaccgcgtttacaacaaagctcgcaaatcggagattaaaacacgtaccaagaaggtgactcacatagggaaatgtgttatgtatgtaagaaaacggggagggagagaaagaagaaaaatagatggtgatgatatgaagtatgactattgtgatatctttttcttctggtgtctaaaattaagtggtcacagcatgaaactattactagactttagagtggaaggcatgattgctcttatttgtcccttctttagagtcacttattctagcaaagcgtggcatgtcgtgcatgacgtgcatgatgttttggaagctctagaagtacttaagaagaaatcagatgcgcaggccgaagaaatcctcccaattgagaagttgattggagaggcatactcaataattgacaaagctgtgagagtgggcacactgcacaggaacactggagcaaatcgcaagtctcggcttgcccgaagaaagaaggcagtggagatccatcatggctggtataccccagctcctgaagccattgtctga

SEQ ID NO: 15298 - DNA, 204 bp, Glycine max
  Peptide Sequence Number=SeqID_132076
atgagttttggatgtttgctagtagatcccaacggtcacaatcttgggaggattgatggggacccggtgttgagagaaacgaggatatgggctacgtgggagtacgtgagctcagatggaggtgggcaacaggggatggtgggtttatgcgcgcattgtggacgtggaaaacttgttgtgcaccatcgcccgaccgccacctag

SEQ ID NO: 15299 - DNA, 1002 bp, Glycine max
  Peptide Sequence Number=SeqID_132077
atgaagaaggctgtcagcaaggcaccagtcctgagattgccaaacttcgcattacactttgtggtcgaaacagatgtgtccagagtgggaatgggagccgagctgaaacatgagttgttgcttcaaccagaattcatcaccttcatgcaagagatttcggtcaatcttactgatcatcctgattgtaccactgtgcaaggattgattctcaaaaagggatgcatatggctacctaaaggacttcgtttcattccaattttgctcaataaatttcatgtgacccgcacaagagggcatattggaatcacaaagacattggtgcaaggatgcatatggctacctaaaggacttcgtttcattccaattttgctcaataaatttcatgtgacccgcacaagagggcatattggaatcacaaagacattggtgcaagatctcaaagaggatcttaaggaggatctctccttagacttcattgaagaacttctggcgtatcgtggtcataatgctatcttaatggtcgtggatcacttttctaagggcattcatctaggaatgcttcattctcactatactgctcactcagttgctcttctattcatggaacttgttggttatgttcaaaagcttcagaaagaagttgctcaaggcataggaaccatgaagcattttgcgaataatcatagacgagatgttctacagaagattggcatggtggcttacaagcttcaactacctaaagggtctcatattcatccatcctttaactactcctttctcaaacctttccactcttcctcctccacctctgagccagccgtggagttaccgcccacgacaatagaaaaccagcctgtaattgctccactcgcaattatcaacactcgatggcattacacttcgagtgaacccaaaccacttgttttagtccagtggaagggctggcctccggagaatacaacatgggaggactgggaaactttgaaagatgcatcaccttga

SEQ ID NO: 15300 - DNA, 126 bp, Glycine max
  Peptide Sequence Number=SeqID_132078
atgacgttggatacatgggctatgtccagtggggagttcaggaagaacctgctttcaagaattccttgcaaaattgcacttgtaaaaacgacgaccgttccaagaataaacgcacatgttttttaa

SEQ ID NO: 15301 - DNA, 240 bp, Glycine max
  Peptide Sequence Number=SeqID_132079
atgtcatttgacgcagcgattgaggtgaggaaccatgtttccccagagccagaggtggaggacgccggagttgcttcgttggcgaatccaaaggcttgtgacaaaatcggaatgcaaaatgattttaaaggttcaaaggtagcaagcaaatctgaaaatcgaaagcagccggacctcatcaatccaatttggatacacttaggagacattctccagggcgacacaaattctaattcctaa

SEQ ID NO: 15302 - DNA, 693 bp, Glycine max
  Peptide Sequence Number=SeqID_132080
atgaacactgagcatgtttcaaagcatttggacaaactcattgttagaaaatgtttgcaacacccaagccttctagatatccagggagctacattactactctcaggttcatcacctgctgctcgacatgttatagatgctgcttttgaaggacaaggaccaacagggcatggcagcttgaaggagcatattgccctcaaggttaaaatagctgaaactgcatttatgatgttatgtgctaataacttctcttctaagttggaacttacatggtctcttaaatggcaatcacaggcagcattgcatgctctaggaaatatctcgggaaaaaccagatccgagaatagcatcatactcaatgctgaagcagaaggtctttttctgtcagtactgcagcaggattcagaaatgcgtctagcgggctatagaatgctaagtgaattggttgcccgaccatggtgcttgatggagatatgttcaaaacaagagattataaataaagtgaccgacccaagtactgaaaccacaaaaataggtatggaaggcagatatgactgctgcaaggcaatacacaagtcattgacagtgtctagtagagtttctgctaatccagcttttgcaggaatagctgcaaaggttagataccagacctttctgccatatcatagttttgaaaaccaaaccggtgaataa

SEQ ID NO: 15303 - DNA, 150 bp, Glycine max
  Peptide Sequence Number=SeqID_132081
tgcctcgagagatgcatcagtgtgtgtatatatactctgatttggatgcaagaagagttcaaattgtgttggagcaaaataccatcatgaagctaagaagcattctccttattgtgtgggctttgtttgctctcttgagccacgcttatg

SEQ ID NO: 15304 - DNA, 181 bp, Glycine max
  Peptide Sequence Number=SeqID_132082
atggggctaatccttatccttaaagattctctgggaaagggctccgtaacatctatctcaaaagaaggaaggacattctattatgccttctccccattcccggccgtagcacgggcaaatctatcttcaacgggtgccccgactgcttatttcctaggagctattcctaccattatcccac

SEQ ID NO: 15305 - DNA, 234 bp, Glycine max
  Peptide Sequence Number=SeqID_132083
atgtcatgtacacctttgttgtatgattatttgaggatattgccatgctatgtacatctccctgttgcgcttttgcgcatctacatcatgtcgtcacacatgcattgtatggtctcgtcttttgtcacgggatgccggaaggtccatatcaccttcttaactacacacatggggcactgcaccgccaaatgcacaagtaagaagaaacaatttttcgatctctcgtgtccgtaa

SEQ ID NO: 15306 - DNA, 426 bp, Glycine max
  Peptide Sequence Number=SeqID_132084
atgaggcgtatgcctactgcatcagcccgtaggcaacaggttcatcaaatgactgaggatgtccctgatatgactgaggatgcacctgagatgactgcggacgtacaggctgatgatggtcctgagggtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 15307 - DNA, 534 bp, Glycine max
  Peptide Sequence Number=SeqID_132085
atgaccgaccgtctcgatgagtcgatctcttgctttctcataagggtgaacccttgggtactagtaccctcaccttcagaggactacacgtcctcgcctttaaaggactacacgtcctcaccttcagagggtcgcacgccctcgccttcagaggactacacgtcctcgccttcagaggactacacgtcctcgccttcaaagggggacatgccctcacctttagaggactacacgtcctcaccttcagaggactacacgtcctcgccttcaaagggtcatgtaccttcaacttcagaggactacacgtcctcgccgtcaaagggtcatggatcgcacccacaaagacacccagtggacctgaagaagtccaacagggccctggggtttccagctctggttacgggcctctgtcggccctacagggcgcccgttccccccagcaagttcatgtcgtcgtggcatagggattgtgcccacaagacacctagtggacccgaagaaggccaacagggtcttggagttgccaactcttaa

SEQ ID NO: 15308 - DNA, 870 bp, Glycine max
  misc_feature (839)..(839): n is a, c, g, or t
  Peptide Sequence Number=SeqID_132086
atgtgctcgaacctctcctgctctgagacggatgcagtgaatgttgaggaacagggtgaaggtcaaggtattggacccagcagtcctcagggatcgagtcaaagaagttcatctgaagaacacttttccgatgaagaggccatacaagaggctgaagctggaggttcagacattttcccagcgtcttcgacatctaagctttccgctagcatagggatcgcagaggatacattcattcaaatgcaagacgaagaccctgctgcagcccttcgactcctgctgaacaccagtcaagccaacacctcaagtgaaaagaatcctggtgcttcgtcctcatctgatgctgatataacctctacagtacgccaagattgcctgcttttgaagttatcaatggaatacgcacgggcagacgtacttaaatccattgaagagaacccttctgctgcttttgggcacctgaactttttgaagaaattgcataacccccttacttctgatgagattctgggcaaagttatacaaatcgagtccattatcgatcaatttgcaaatactgtgcagaaaaaacgcgaaaatggcgccagactcgatgcccagaaacaggcacatatccttctgctcgagaaagcccgagcggctcaacgtgaagtcgagcgtctcaccaaagaagcgaaagaaggatcttctgagatcaaagcctgtgatgataacatctcctcctgggaggcaactattacaaatttgctgtctcaggtcgatgatctaaggcagaaaattgtaacagagcaggccaagcgcaaagactccaggagaaggctgctgattcgattcagaanctggttgccgaaaaagggagggaaggcctga

SEQ ID NO: 15309 - DNA, 546 bp, Glycine max
  Peptide Sequence Number=SeqID_132087
atggggcctcaccacccatcaatgcatggtgttcttagacttattgttactctagacggtgaggatgttattgattgtgaacctatattgggttatttacacagaggaatggaaaaaatagcggaaaaccgaacaattatacaatatttgccttatgtaacacgttgggactatttagctactatgttcacagaagcaataactgtaaatggaccagaacagttgggaaatattcaagtacctaaaagagccagttatatccgagtaataatgttggagttaagtcgtatagcttctcacctactatggctaggaccttttatggcagatattggtgcacaaacccccttcttctatattttcagagaaagagaattaatatatgatctatttgaagctgcgacgggacccatgcttcggcttccggaatacaatgggatctccgtaaagtggataattatgaatgttacgaagaatttgattgggaagtcaatggcaaaaagaaggagattccttagctcgttatttagtcgattggtggaatga

SEQ ID NO: 15310 - DNA, 345 bp, Glycine max
  Peptide Sequence Number=SeqID_132088
atgggaggagggcctcctgctatggtggaaagggagaaatttgatcatatagaggaaaggctgagggtcattgaaggaggtggaaattatgcctttgctgacatggcagagttgtgcctagtgcctgatgtggtcattcctccgaagttcaaggtatcgaattttgataagtacaaggggactacttgccccaagaatcacctgaagatgtactgtaggaaaatgggggcatgtgcgaaagatgaaatttttttattcatttcttccaagaaagtcttactagggcagccgtcacctggtatactaatatggaaccttcccgggtccattcctggaaggacctaa

SEQ ID NO: 15311 - DNA, 144 bp, Glycine max
  Peptide Sequence Number=SeqID_132089
atgatggaaaataagccggttaatttcgtgggtcttaataagctggttcttggcacaaaatggatgaatgggatgaacaagggtgaagatgaaaggaagaaaagaatcactctttccagggagggcaacacacaaaggttgtga

SEQ ID NO: 15312 - DNA, 384 bp, Glycine max
  Peptide Sequence Number=SeqID_132090
atgagtgaaatagaggaggtgcatgagcagatgaaggttgacatggaggccatgaaagaacaaattaccacaatgatggaagccatgatgagtatgagaaggatgatggaggttaatgctactacatttgttgctgcaagtaccgccatagaagtggacctgactcacccatctggcctcaatcaagtaaatcatctagtctcggatatggtaggtcaaggatgtgaggcattgggaagtacgagtggcccccattttgtgcaggcccagagcaagcattctttcccaccatatggcttgcctcccaactatacaccacctaatgttgcacacgctcttgacgagaacgtcgataactttgatcccatacccattgaaagctga

SEQ ID NO: 15313 - DNA, 405 bp, Glycine max
  Peptide Sequence Number=SeqID_132091
atggcctctggtaatcaattaccaaggggtgtaatcgattaccaggctttaaaaaaacgagatcaggaagctaagagggcttctagtaatcgattaccaaggggtagtcacaagccactggtaatcgattaccagatcgcgatggcggcgctactaatccatgatcgtgtggagatggagtgcctagagggagcttgggagaccctcgaaggcaatgcgaggtgccgatttcgaggcacgattcgattcacgactacttcattggtgcatccagatgaacccgcgcgcacgcttcagcgcactgtggagtggatattacccatgcctacaccataccgtctagtggagccagtccaagtgatcgatgtgacgtcatccgaggaagaccttgaggaggatccctga

SEQ ID NO: 15314 - DNA, 207 bp, Glycine max
  Peptide Sequence Number=SeqID_132092
atgctcactactgctagctggttgctgagtaaggatggtaataggtcggcgtacgacattgggattggggtgaattctacaggtttcctttctgggaaattcctccgtgggttggtgtttatgttaggattaggaattggatttggccaaggtgctcttggtcgaaggggcgttgggcaggggggaggatcgatattggccgagtag

SEQ ID NO: 15315 - DNA, 276 bp, Glycine max
  Peptide Sequence Number=SeqID_132093
atgagggagacacatgaagcaccccagaaccacgatctagccgacttcgaacctcaccttggatatgccactaaggggaaaagtcccttctgctatggtggaatgggaaaatttgatcatatagaagaaaggctgagggtcattgaaggaggcggagattatgctttcgctgacatggcagagttgtgcctagtgcctgacgtcatcaatcgtcctaagttcaaggtgccaaatttcgataagtacaaggggactacttgtcccaagaaccactga

SEQ ID NO: 15316 - DNA, 701 bp, Glycine max
  Peptide Sequence Number=SeqID_132094
gggacatcccttttagaaaatacaggtttgctggatttgcagatgttgtggctggtcagtttgaacgtggactattggttgatgttattggtgttgtggaggaggttgtctttcggcaagtttcaggaaaaggtagaagggtagttttcaaattaaaggacttgagccagcaattgctatcttgcactttgtgggatgattattgcttgcagtttgtgaagttcttagatgattatgaaggtgatggtccaattacagttctattaagccattgtaggatcaaggaagcgcagggatcttattctgcatcgatcaacaattctttcaaggcttcaaagttaattattaaccagcctgtgatggagattcaagaattcaatgaacggcttgcagagttgggcattgagccccggtcaggttttaaatcccatggtgaagggagtacacaactttcaggttctatccaattatcatcaaaagaatcattctttggcaaggctgaggcaaagactattgctgagattaacaccatctctgaagaaattgtttgtgtcactgttggcacaattactaggattgttctggacaatcattcatggtgttatacaacttgcattgagtgccataaaaaaagtgatgcagagatgacgccctttacatgtgtatgcagcaaatacaataaggaagctgtgcttaggtga

SEQ ID NO: 15317 - DNA, 954 bp, Glycine max
  Peptide Sequence Number=SeqID_132095
atgcaaaaatcggcacaacttcctgtacgcgcgggtcaatttgcgagtgggcttccaaagtcaggtcacgtatgcagcaagcagaaattagctttcggcacggctcgtgaaagcgcggtttgccctcatggaatattccggatatacctaactttacccgcgtcgtcagctatctcgactacccttaatatccttagcggcatttttgactgcgttaatagcgataacaaggagacatgcgatatggcttatcagacagtgaatcctgcgaataaccagcttattaaaagctatcccgcacacagcgatgcggacgtggaggcggcgctgcggcaggccgatgcgctttatcattctgcgtgggcgaaaggcgatattgcgcagcgtctgccggtgctgcataagcttgccgaccttatcgacagccggacggaggagctggcgaaaatcgccagccaggagatgggcaagctcattaaacagagccgcggcgaggtcaaactctgcgcgcagatcgcccgctattatgccgacaacgccgaacggttcctggcgccggtgaagtatccctccgaccttggcgaagcctgggttgaacaccatcccatcggcgtcttaatggcggtggagccgtggaacttcccctattaccagttaatgcgcgtgctggcgccaaatctggcggccggtaatccggttattgctaaacatgccagcatcgttccgcaatgcgccgagaccttcgcgcatctggtgcgcgaggctggcgcgccggaaggggcgtggaccaacctgtttatctctcaggagcaggtggcgaaaatcatcgctgacgatcgggtgcagggggtggcgctgaccggctcggaaaaagcgggcggcatcgtggcgtcgcaggcggcgaaacatatcaagaaagcgacgctggagctgggcggcaatgatgtgtttgtg

SEQ ID NO: 15318 - DNA, 393 bp, Glycine max
  Peptide Sequence Number=SeqID_132096
atggcatccttcagccagcttcagtcacagatgcaatctcagggacctcctgagcctctggttggtcttggtccctccggtcctggggtgagcacaaaggggacttgtgttgatccctcaggaaatgatcctgagacgggtgactctaacaggtgcggcttgtacatagaagcagatcctgcccgcttggttgccgtggggagagtttatgagggatccactcttgttcataacactcctttgttgcctggccaagtaaaggtgagtgtggacgaggttaaagatgcagatgctccagttcttgtacccactgatgaggtttccttagtggggcagacacttcacactttccttgcttggccgacacatctggtcaagtctttatcacaccag

SEQ ID NO: 15319 - DNA, 492 bp, Glycine max
  Peptide Sequence Number=SeqID_132097
atggctccgcccgcgcgtctcggcgatgggacgtatgccgcgctgagcacgcccccctacctcgtgcgtaaagaccacccgtcgatgctcatggcgctcgggtggctcccgccgaccgacgccgtcgaccccgacatcatgcgttcgacgctcgaggcggtctgggcgcggtgggatctgcagtcgagctgggggtgggactatccggtgatggccatgaccgcggcatccctcggagacctcggccgcgctttcgacgccctgctgctgccgtcgcccaagaatcagttcctcccgaacggccatactccgcagatcccgggcttcctgtcgttgtacctcccggccaacggtgggctgctcgccgcgatcgcccatatcgtccaggcgatcgaaggcggcgcatccgagccgcacgggtggcgcgtgacctacgacgcgcccgacacggcatccactgggaagcctcgcgccgcctcccgcgtctcctga

SEQ ID NO: 15320 - DNA, 594 bp, Glycine max
  Peptide Sequence Number=SeqID_132098
atggcatcccttgcccagtattatgaccagcccgtaaggtgcttcacatttgaggacttccagctagtgccgactgtggaagagtttgaggaaatcctgggatgcccactgggaggaaggaagccatatcttttctttgggttctatccatccacgacaagagttgccaaggtagtgaaaatctcagcacaagagttggaacgtctaaagcaaaacagaaatggagtagtcagagtaccaaggaagtgtttggaggaaagggcaaaggccttggaaaatcaagttgtcctctttccgaatatggaagggttagtggacctagcagcgattgacgctttcctcgcctttcatcatggcaaggaaagcccggtcgtcgccattttggccatgtatgacacattcgaccggggatgtaaaaagagcagcgcaagaattgtttgttgtgcactggctctctatgtgtggctggtttcacacctttttttctccaagaaggtaggcccgtctatccgctacaaggtcaccgctcgtgcgtcgaaaagggaaagggtaattgattcattgcaccaagaggcaacaatgtggacggactga

SEQ ID NO: 15321 - DNA, 446 bp, Glycine max
  Peptide Sequence Number=SeqID_132099
atggatggcgctaaagcgcgcgacctatacccggccggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggccattcggggcctcttccccgggcgtcgaacagtcaactcagaactg

SEQ ID NO: 15322 - DNA, 132 bp, Glycine max
  Peptide Sequence Number=SeqID_132100
atgcggaaattgattaaggaaatgatggaatataaggtggctaatttcgtgggtcttaataaggttaagtggtggctggacagaaatatagaaatgacaataactgaagctacagggctccaaatgaggtga

SEQ ID NO: 15323 - DNA, 837 bp, Glycine max
  Peptide Sequence Number=SeqID_132101
atggttgaggaaagtgaagaagacgaatttattgcgatcgtcaactattcgatcatcggacttattcagcttgaaaaaggtctttccaacgatttcaatgaaaataatgatgaaattttaagcctttatgacaaatatgcatctgaagctcaggctctgatggaaagaaaaaatcatgattatggcgaagcatggagagatatgagaatttcttccataacagatcttatttaccagaaggtcctgagaacaaaacagatcgaagataaccagggaaaaacgatcgtttccgaaggcctggatgccaactattttgatatgctgaactatgctgttttctttatttttatcctgtccgggtttgtaaaagctgtggatctgaaaagaattcgcccggaaagacgaatacagcagcacaacgaaaacacctacggccaaggaattatgcacgagcctcttatcgatttccgcgattataaaatcggtacggatattaaagcagaaaaagataaaatcagtaaaaacccatcggaatataaaaccttctactcccttaaaaatcaaaaaaccggggaggttttaaaggtaaatcaggatgattacatcaaagaaacaaaatattgggctgacggttctccatggaagattgaagaaggaaaaaacgaatctgtcatcgtaaaagaaggctacaagtctgagattgtaaaatttaaaattgaagatcctaccggccttgaggttactgatgagattattaaagctccaaaggctgttttggtattttcttatcaccctaaagagctttctcaggagttgatccagaaagttgaagctaag

SEQ ID NO: 15324 - DNA, 561 bp, Glycine max
  Peptide Sequence Number=SeqID_132102
atggggcctttgattgccgtgcgtctgcatgtgctgacgcgcaagaccctgggtggcctgcacaccgaccttgaggcgagggtgctggacgccggcggtgagccggtgccggggctttatgccgctggcgaggtggctggtttcggcggtggcggcatgcatggatataacgcgcttgaaggcactttccttggaggatgcctgttttccgggcgcgttgcggggcgcagcacgggcgagccgggcatagagaccgttctggcgaatgagactctgatgcgtgccttcctcgatgatgcggccttcatccatcaccagaatgcggtcggctttgagaacggtggcaaggcggtgggcgatgacaatggtggtgcggctgctcatgagcgcatcgagagccttctgtaccagtgtctcgctttccgcgtcgagcgccgacgtggcctcgtccaaaagcaggataggtgcgttgcgcagatggcgcgggcaatggcgatgcgctggcgctgcccgccggaaagcgtcacgccgcgctctcccacctgggtgtcatatccgtcg

SEQ ID NO: 15325 - DNA, 456 bp, Glycine max
  Peptide Sequence Number=SeqID_132103
atgcccggctcgcccgtctgcaattccagacggggcccgaagaactgcgcgcacaggcctgagttacgtcagcacgctgcgccccgcaacgcgcccggaaaacaggcatcctccaaggaaagtgccttcaagcgcgttatatccatgcatgccgccaccgccgaaaccagccacctcgccagcggcataaagccccggcaccggctcaccgccggcgtccagcaccctcgcctcaaggtcggtgtgcaggccacccagggtcttgcgcgtcagcacatgcagacgcacggcaatcaaaggccccatgacaggatcgagcaggcgatgcggtttcgccgttcgcatcagccggtcaccgaggtaacggcgcgcaccgtggatcgccgttacctgcgtatccttgctaaagccgttttcaatctcgcggtcgcgcgcttcgatctgccggcggatgtg

SEQ ID NO: 15326 - DNA, 109 bp, Glycine max
  Peptide Sequence Number=SeqID_132104
atgaggattcactgttatcaagcgagtcggagacccagcatgaccacagatcaacctccactccctgtgtctcacacagacccgggtatagagcccaatatctcaacat

SEQ ID NO: 15327 - DNA, 290 bp, Glycine max
  Peptide Sequence Number=SeqID_132105
agccatttgatataggagaagaggcagaggagacacagctgagacaggtagctgctaccactcctgagcaatcccttgaggctacttcagagccttctgcaccagtggtaaacccaccctcacctcagccagcatcacacccctccactcctcttctacagattctagagtatccaactacaccagtcctagctgtggacacttctcctcctactactccagttcttcagttgacagatgaggaggatggtcaaacacagaagacacaggaccaatcacaggaattttaa

SEQ ID NO: 15328 - DNA, 483 bp, Glycine max
  Peptide Sequence Number=SeqID_132106
atggctccgagaaagcttttcgcaaagagatccaggaaggacaaagcggctaaagggaccagtgccgctcccgagtatgacagccatcgtttctggagtgctgagcaccaacagcgtttcgaggccatcaaaggatggtcattccaccgagagagacgcgtccagctcagggacgatgagtacaccgacttccaggaagagatagctcgccggcggtggacgtcgctggtcacccccatggctaagtttgacccaaacatagtcctggaattttatgccaatgcttggcccacgaaggagggcgtgcgggacatgcgatcatgggagggccaggagtgcgagtatagccagaggaggaaccgggccgatgggtttgatgaggaggccattgcccagttgctgtgcataccagcaacatcttgcccagcgatcataattccgacctccctctgccgaagtgtcagttggtgtatgccatcctga

SEQ ID NO: 15329 - DNA, 210 bp, Glycine max
  Peptide Sequence Number=SeqID_132107
atgattttgggtgttatctttggcaaagttcaaaaggcaaagagcaagagccagaggatgacaagggcaaaagggtccacccataatgcttctcctgttctaagttacctaccgacaagagacaaggtaggggcgaaggtgactgtgttggcaatagtatggactccaaacactcatgaatcaagggaagatgtatgtgaagattcatag

SEQ ID NO: 15330 - DNA, 753 bp, Glycine max
  Peptide Sequence Number=SeqID_132108
atgacaacccgaattcgcgtcggcagcgcaccatttaacgttggcgacgagtatgcgctgctggcggcgcatgacagcgacggcgcggtcgtcaccttcaccggcaaagtccgcaaccataatctcggcgacagcgtggccgcgctaacgctggagcactatcccggcatgacggaaaaagcgctggcagagattgtggcggatgcgcgtcagcgctgggcgctgcagcaggtgacggtgattcatcgcgtaggcgaactgttccctggtgatgagatcgtgtttgttggcgtcagcagcgcccatcgcggcagcgcctttgccgccaggagcaggatgaacaccaccacgatattacgaggcgcagcgctgctggctgcgctggtgctggccggatgcagcaccaaaaaggagccgcagctgccggcccgccagcccgctgacgtgaaagcgcaaattcagcaattgctgcccgcccatgtgacgcaaaaatcggcctgggccgatgacatctataccgcgctacgcgtgcagcacatcgacgccagcgccagcaacatttgcgcggtgatcgccgtgaccgatcaggaatctaacttcagcgccgatgccaccgtgccgggtctgccaaaaatcgcctgggcggagattgaccgccgcgccgccagcgtgcacgtgccggcgtttctggtgcgcaccgcgttactgatcaaatcctccaatggcgagagctacgcggcacgtctcgataag

SEQ ID NO: 15331 - DNA, 273 bp, Glycine max
  Peptide Sequence Number=SeqID_132109
gttctgccaccagaggcttcaaattatttatctagatcaaaagaatatatgattgtagatcgtggtcgtggtagactttacgaatggatgatcaccatgaataatggtctatcatgtgttgttaagtcctggatccaatatttagctgatagacatttgaagcctggagatgaggtcgtcttcttctacaactttgaccaacatttatgggaggtcctctataggaagcaagttaaatggaatcaggaaaaggacgaagctgactccacttga

SEQ ID NO: 15332 - DNA, 583 bp, Glycine max
  Peptide Sequence Number=SeqID_132110
agggctgcacaccctcgcctttagtggattacacgtccttaccttcagagggctgcacgcctttgccttcagagggccacatgccctcacctttagaggactacatgtcctcgccttcatagtgctgcatgccctctccgtgagactacacgcccttgccttcaaaggactgcatgccctcaccttcagagggctacacgccttcactttcagagtactatacgtcctcgcctttaaaggactacacgtcctcgccttcagagagttgcatgtcctcgtctttagaggactacacgtccttgcctttagagggcttcacgccttcgccataagagggctacacggactacatgtcctcctcttcagatggctacatgccctcgccttcataggactacacgtcctcaccttcaaagggctgcacgccctcgccttcaaaaggttgaacgccctctccttcagagggcttcacgccctcaccttgagaggactacacatcctcgcttttagaggactacacgtccttgccttcagagggttgcacgtccttgccttcagaggactactcatccttgccttctga

SEQ ID NO: 15333 - DNA, 147 bp, Glycine max
  Peptide Sequence Number=SeqID_132111
atggaatttgggagatgtgtcactttatcgatcataatagtagggcataggattcccgctattaggaagaaaaggcctgggggacggatggagttggaagcaccatatgaagtgggatggcgggagaggagcgagatcgctctcaaa

SEQ ID NO: 15334 - DNA, 710 bp, Glycine max
  Peptide Sequence Number=SeqID_132112
ggctccatgccatcgccatcagagggctgcacgccctcaccttcagaggactacacgtcctaaccttcagagggctacacgccctcaccttcagagggctacacaccctcaccctcagaggaccacacgtgctcgtcatcagagggttgtatgccaacaccatcagaggactacacgttctcgccttcagagggctacacaccctcacctttggaggactacatgacctcacctttagagggttgcacgccctcggctttagaggactacacatcctcgtcatcaaagggctacaggcccacacctttagagggttgcatgcccacaccttcagaggaccacacgtactctccataagagaactacacgtcctcgcgatcagagggctgcacaccctcaccttcagaggactacacgtcctcgccttcacaggggtacacgtcctcaccttcagagggctacatgccctcaccttaagaggactacatgtcctcgccttcagagggttgcacgcccacgccatcagagggctgaacgcccttaccttcagagaactacacgtcctcaccttcagagagctgcacgccctctcctttagaggactacacgtcctcgccatcagggactgcacacccacaccttcagaggactacacgtcctcaccttcaaagggctacgcgtcctcacctttagagggctacacgccctaa

SEQ ID NO: 15335 - DNA, 1146 bp, Glycine max
  Peptide Sequence Number=SeqID_132113
atgaatcaagtctcaccatccacttctattcctgattttcatctcactgctcaacaatatagtcaactcatgagcttgcttcaaatacacacttcaaatgctgttactcctgatattgaatcttccaacactggtatggtcttgtctgcttctttaactaaatttcctcaaaattgttggattattgattcgggtgccaacactcacattgtttgtgccattgatctctttgattcctatcactatgtctcaaatcgaattgttaaattgcctaataatgcagttgtctcagtcattgcagttggcactgaaatgcctcattgcaagaagattggtagaggggatctcattcatggactctatgttttgaacctcaaggatacacattccacttgcaatgtttctgatcataattcttgtataaattttgtttccaacacttgtactccagccattgattggcataatcgatttggccatgtatcggacagtgttttgaaaatattgagtaataaaattccttttgctttacctaatgagttctccaccaaaagttgttatgtgtgtcctattgctcaaccctttgacttgattcattgtgacatttggggaccttataagcattcatcaacttatgctaactatcgatacttcctaacaattgtggaagactgttcaagatttacatggatttttctgctcaaacataaatctaaagcatcaactgtaataatgaaatattttgcaatgtccatagtggctattaccttctggggaaagtgtgtggttactactactttccttatcaacagattgccttcaccattactgaaacagaatactccataccaagttctttatggttctgcacctaattattcaatttcgagatcttttggttgccttgcttttgcaactactttgaattctgaaagtactaagttctccccaagagcagtaccttgtgtgtttgttggttatccacaaggaatcaagggggatctagtttttcatgagaacattttcccttttcaaactttaccaaatacatctcaagaacctgatttccttaatgacctagctgtttccctacctattcctgaatctatgtccttaaccattcaacctagagccactgtgaaatga

SEQ ID NO: 15336 - DNA, 909 bp, Glycine max
  Peptide Sequence Number=SeqID_132114
atggcagttgagatcaaagctttggaatccaataacacatggactttggttcctcttccaattggtaaacaatgcattggctgcaggtgggtgtacaaagtgaaattcaagcctgatggcactgtggatcgctacaaaactagattggtagctaacgctgctaaaaactggccaatcttacagcttgatgtggataatgccttcttgaatggtgatctatttgaggaagtgtatatggaacttccaaaagggtacacttcagttgataaaaaccttgtttgcaggctcaacaaatccatttatggccttagactagcttctagacagtggttttataaactctctacaacattaattgagaatggtttctttcaatcaaagaatgactattctctttttaccattggcaaaggcctaggttcaatccttgttcaaactgaagatccttggttccttacaatattttctgggcctggaagttgcaaagtccagcaagggcattattttggctcaaagaaaatatgccctttctctgttagaggatactggttttcttggttgcaaaccatcatatcttccaatggatccaaatttaaagctcaacatgctcagtggcgcttacttggtcacctcatgtacctcactatttcaaggccgaatattgttacatttaccgttaacaagctaagccaatacatgcagcatccaagaatacctcatctagatgatgtgcatcgtctcctacaatacatcaagggcactccaggtcacggtcttcattttctagccagtaactccttcaacttatctacctatgcagatgctgattggggagggtgtttggacacacgcaggtcgacatctggttcatgtgtgtttctaggagatgctttaatatcatggaaataa

SEQ ID NO: 15337 - DNA, 366 bp, Glycine max
  misc_feature (326)..(326): n is a, c, g, or t
  Peptide Sequence Number=SeqID_132115
atgttaataacttttggtctcctgctaagcgagaaaggcgcgctaagcgcaattccaaccgaggggaatttcactgagcggcccaaagttgcgctaagcctaattctaaccgagaggaagtgtgctgagcgcccagaaggttataaatacgtccttagcgtgaaaaacacgattttcactctcctcttcccccaaaaacgtctcccaaaccctaaaaccttattttccaccatccaagaccactggtggccgccgttgcttactgttggacccccacaccaagaggaacactttaatcggagcgaaatcctcagaatcctcctcanagattcgatggagaaaatccctcaatcctccatttcatag

SEQ ID NO: 15338 - DNA, 534 bp, Glycine max
  Peptide Sequence Number=SeqID_132116
atggtaggagatggtgatggtggtggtgaatatcatcaattggatggaactcagcgtctgttattggacataatgactacacagatgcaacgattgttgaaccgtaacaatgaagagctctatggacaaatagaaggtccggagaaccaactgaatcagaatactggaaggcattttggtgggaacagagtgggcaatgttggacccaggcaaaacaaaatggagggagtaaaactcaatgtaccccctttcgaaggcaagagtgacccagacgcctaccttgattgggagatgaagattgagcataaggtgaagttagcagtagctgaattctcagactatgcctttgtttggtggaataaaaatcaaagagagatgatgagagaagagtggcgggagatagatagatggactgggatgagaaggctacaagagaaccatgcgatagaaactcccaaggctgtcccagggaagtttgactatggacgagtactacaaggaggtgaagatggccctagtgagggccaacattga

SEQ ID NO: 15339 - DNA, 915 bp, Glycine max
  Peptide Sequence Number=SeqID_132117
atggctaaagttaagtatgtgaaaatattgcatgagcaggtgaaggctcaaattgcaaagaaggatgaaagttatgtcaagcaagccaacaagaacaggaaggaagtggtacttgaaccaggtgagtatggagtaagttcttcatttaatgttgctaacttcactcaatttgttgcagggcacgtcttaaagacgcattcgtgggttggtggagttatgccgtggcacgaaattttagggtggaagcgattcagggggttccatccaacaacccctggtggaacagaaggttgtcccatcgatgattcctcatcggaggagacacatcgtgaggcttccgacagcaggtcctcttccatcgagaggttagtagatttgtgccatgccaaagagggtagctctcggccccgtgaaagggtgggaccctttgttgctcctttggaaaaggaacctatccctatcatgacaatccttccctcttttccttcgacagctataggaaggggtgacggtggtcttgttaggatttttcctcgtaataggcatagccgtagtgctgggacatccccacctcctccctttgttgttggttacaagtgggtgagggacgatgtcctgaagtattgctccttagtaacatttattgtgagcgtcggggctctttggggccagttggagctagctaaactaggagattcccacaagatggggaatctcgtcggacctgctggggagggaggtcaaactaaggtcagagttgaccctcctcgactttctgaagttgacaaggctgtagttgttgaggttatacccaacgtgccgccacctcatccaaccaagagaaaacacaatgaaggggttgggggtccagtcaacgcaagaagtcaagggcccccttcagtctctaagctatga

SEQ ID NO: 15340 - DNA, 426 bp, Glycine max
  Peptide Sequence Number=SeqID_132118
atgacttccatgcatgaaccagagatcaaggaaaacaaattgaaagatgagattttcgatttgaacaaggatccaaatgaaaactttgtagaggattcattggacaaggctattaagaatgaagaagatgaagattcctttgataagattgttgaagactcattggtggctagcaaggatgaaaatgaggttggagaaaccctttttaggcgcaagcagaaatcatggcttgaggaagatttaacagaaaacaaagaggtttgtacagatggttgttctccttcaacttctaatggcttcatcaacaacaatcttttttatcttaacaaatatccggatgaagcgcatgattttggttttgaaagtgaagatatgaagaaagagcatttttcaatgttgaagatttattttgctagattctattaa

SEQ ID NO: 15341 - DNA, 540 bp, Glycine max
  Peptide Sequence Number=SeqID_132119
gaaccattgacactatcatctccacttcagaaagttgaggaagcaatagggacaacgggaaacattaggaagttgaagaaacattcacaccttgaggaagttgatgaaacattaacacatgaagaagtcgaggaggagctagcactaactttgacaataggagttatacaatgccattcaaatgcacttaagccatatttaaagcctgagaacatgattgcttgcttaaagtttttcttgtcaatgctcgatgataggatcatgccttatgatccaaagtttaagtctatggaaaatattgtgttcattgatgagaaatggttctacattagaagaacttccaaaaaattttacttgcttgcaaaggaggatgagccacataggacatgtaaaagaaaaagtttcatagccaagcttatgtttttagttgcagtggttagacccaggtttgaccatgaaggaaatgagacatttttggggaagattggtgtttttccttttgtaattgatcaaccagcaaagagagctagtgtgaattga

SEQ ID NO: 15342 - DNA, 363 bp, Glycine max
  Peptide Sequence Number=SeqID_132120
atgaagacagatgatcttcctgagtcaagtttgctaactgcattgaatggagcaagatttgtctattttgataggagattgcatgagactgctctagttgttgcacatgaggaagttaaggagaatatacctatcttaatggatgcagggaggcttagagaagggttggatgatctcgtgaaattagctgattatgtggtgtgcgctgcacggtttctgcaggcacctatctgtgccaaatttgcaccagagaaaatgctgtgctttgctgctactgtggcagcttccaagtgcagagttcttggagcaagaagcggtcttcctcaccgcacagatccatgcttggcatccttcatgcaatag

SEQ ID NO: 15343 - DNA, 3621 bp, Glycine max
  Peptide Sequence Number=SeqID_132121
atggaagaactagatttccgatggtcttctcaaatacattttctgaaaacactgaatgtttctaacaatggggctgcggctgccaatcctgtagttgggtcccatatttgggtggaggatcctgatgtggcttggatagatggtgaggtcttggaggttaaaggagaagaaattaaagtcctttgcacttcagggaagacgtactttgatttcttgaacatgaatgactggtgggaatctttcaagtatagcataatgaagatatgtgtcttgttcaaagttgttgttaaagcttccagtatttatcataaagatacagaagtcccaccaagtggagtggatgatatgagaaagcttgcatacctgcatgaacctggagtcctagataatctgagatcaagatatgatataaacgaaatttatacttacaccgggaatatattgattgctgtgaaccctttcataaagcttcctcatttatatgatagccatatgatggcccaatataaaggagcagcttttggtgagctaagtccacatccctttgctgttgcagatgcagcatataggcttatgataaatgagggaatcagccagtcaatattggttagtggtgaaagtggagctggtaaaacagaaagtaccaagttgctcatgaggtatcttgcttacatgggtgggagagctgctgctgctgaaggtagaactgttgagcaaaaggttctggagtccaatcctgttctagaagcctttggcaatgcaaagactgttaggaacaataattcaagtcgttttggtaagtttgtggagattcagtttgaccagagtggaagaatatcaggagctgctatcaggacttatctgcttgaaagatcacgtgtttgccaggtgtcagatccagagaggaactatcattgtttctacatgctctgtgctgcacctccggaggatgttaaaaagtacaaattaggagatccaagaatgtttcattatctgaatcaatcaaattgctttgagttggaaggggttgatgaatctaaagaatatagggatacaaggagagcaatggatattgttggaataagttctgaggagcaggatgcaatatttaaagttgttgctgcaattttgcatcttggcaacattgaatttgcgaaagggaaggagatagactcatctatgcccaaagatgaaaaatctcggttccatctacagactgctgctgagcttttcatgtgtgatgcaaaggcacttgaagattctctttgcaaacgtgtaattgttactcgtgatgaaacaattacaaaatggctggatccggaagctgctgcactcagccgagatgccttggctaagattgtgtacacaagattgtttgactggttggttgataaaattaataattctattggtcaagaccccgagtcaaaatccttaattggcgtgctggatatttatggttttgagagtttcaagactaacaggcaatacaatggtaattctgagagtagagctaccccaagtcagagaatgaactctggattcccaattctaaccaatttcctcctccatgcaagtgcgcaatgcttgactggggattactctaatggacaaaagctttttgagcaattttgtattaatttgaccaatgaaaagcttcagcaacattttaatcagcatgttttcaaaatggagcaagaagaatacaaaaaagaggaaattgattggagttacattgaatttgtggacaatcaagatattctggatctcattgaaaaggtaacttatcaaactgaattgttcctcgacaagaacaaggattatgttgttgcagagcaccaagcacttctttatgcttccaaatgcccctttgtatcgggcttgtttcccccttcacccgaagaatcttctaaacaatcaaagttctcttcaattggttcacgatttaagcaacaattgcaatctttacttgaaactctcagtgccactgagccacactacattcgttgtgtaaaacccaataatcttcttaagccagcaatttttgagaataaaaatgttctgctgcaactacgttgtgggggagttatggaagcaattaggataagctgtgctgggtatcctactagaaaaacctttgatgaatttgtggatcgatttagccttcttgcacctgaagcattggctggaagttctgatgaggtcactgcttgcaagaggattctaaagaatgttggacttgaaggctatcagattggtaagacaaaggtgtttcttcgagctggtcagatggcagaactagatacccgcagaactgaaatcttggggaggtcagcaagcattattcagagaaaagttcgttcctatttggcctgccaaagtttcatcttgcttcgtttgtctgctgtgcagattcaagctgcgtgcagaggacaacttgcacggcaagtgtatgagggaatgcggcaggaggcttctagtttagtgattcagaggtgcttccgcatgcatattgcttggaaggcatacaaagatctgtatacctctgctatctctatccagactggtatgcgggggatggctgctcattgtgagctacacttcagaaggcaaactaaagcagcaattgccattcagagccactgccggaaatacttggcacaacttcatttcgcaaaattaaagaaggcagcaattacaacgcaatgtgcatgcagaggaaaagttgctcggcgagaattgcgaaagctcaagatggctgcaagagaaacaggagctctccaagctgccaaaagtaagcttgaagagcaagttgaagaccttacattaagattgcagctggaaaaacgtttgcgggttgacatcgaagaagcaaaagcacaagaaaatcaaagattacaatctgctttgcaagagatgcaacttcagtttaaagaaactaagctacttcttgaaaaggagagggaggctacaaaaaaagcagctgagagagcggctgtcatacaggaagttccagttgttgacaatgctttgttggagaagctcagaagtgagaatgagaaactcaagaacatggtgagttcgctggaaaagaaaattgatgaaacggaaaaaaggtatgaagaggcaaacaaaattggtgaagaaaggttgaagcaagctttggatgcagagtcaaaagtaatccatttgaagactgctatgcaaaggcttgaagagaaattcatagacatggaatctgcaaaccatattcttcagaaacaatctctattaaactcatctgtgaaaacaatagcagagcacctgtcttccccattggacgagaagttagaaaatggtcaccatgcggcagaagagcaggaagctgttgatacatttgttacacctgtgaaacaatttggtactgaatcagacagtaaattgagaagatcttacaatgaacgacaacatgagagtgttgattcacttgtcaactgtgttatgaaaaatattggattcaatcatggaaaacccattgctgcattcaccatttacaaatgtcttctccactggaaatcatttgaagctgaaagaactagtgtatttgatcgcctcatccaaatgattggttccgaaattgag

SEQ ID NO: 15344 - DNA, 2475 bp, Glycine max
  Peptide Sequence Number=SeqID_132122
ctatgcgttctctctctaccggctcggtctgctgccgtctccaccatgaccgccggcggctgctctgccggaatttcgccacctgccggtcactcctcaaagcctcttctctctcctgacgatgctcttcgctggtgtcgtgttcggcgagagagaatgccggtgtccgtcgtcttcctcctcgctcttctcaacttgcttttctcttgccaagacattccttttgagatcctctctgtggatgctactgttacatatgacataataggttctttgcatgcagtgaagtctatttctctgagtgtgtcatttgcttcatctgaacgggctaaaatgtggcttgtgaaaccttcttctggaccatcttctgcacccgtgccatctccatcttatcatggtcctcatgtgactccaagaccaagacatcattatcatcaccgtcaccatcacagcatgaggccttatgtagcagctccacccccttcaaaagatcaagcttgtgaccaaacctgtactgatccgctcacatcaagtccctttggttcaccttgtggttgtgtatttcccatgaaaatcagacttacactggatgtagctccttatgctgtttttccggtaatgactgagttagagaatgaaattgcattaggcacatatttagagcagagtcaggtgaagataatgggtgccactgctgacagtcaaaatcagggaagaactattgttgatattaacttggttccactgggagagaaatttgacaatacaactgcagctcttacatatgagaggttttggcacaagaaagttcctctaaataggagcctttttggcgattatgctgttgtgtacattatttatccaggaatgccatcatcgccaccatatggatctttaactgggagcagtcctagtcaaagtgttgatggtattctgccagtcagtgccaactttgtcagcaagaaccagaaaatgaatctcaggaccataatcatcattgctttatcttcctttgtactcttgctggttttggtgggagcattttcaattattttgaaatggaggaagactgggagaccctcaagtgctgttggccctgcattcacatcatctctaaacaagagatcaggcttggggtctatgttgtcaagtagtattacaagctcgacatcaatttcacttatgtccacaatggctacttcccttctctctgttaaaacattttcactttctgagcttgagaaagcaacagataagtttagttcaaagagagttctaggtgaaggaggatttggacgtgtttatagtgggacattggaagatggggctgaaattgcagttaagatgctaacaagggataatcatcagaatggagaccgtgaatttattgcagaggttgaaatgctaagccgtctgcatcaccgtaacctagtgaaactgattggtatatgcattgaagggcgcaggcgttgcttggtgtatgagcttgttcgcaatggcagtgttgagtcccatctgcatggtgacgacaagataaagggaatgctagattgggaagcaaggatgaagattgccctaggagctgcaagaggactggcctatcttcacgaggattccaatccccgtgttattcaccgtgacttcaaagctagcaatgtgttactagaagatgactttactcccaaagtttctgattttggcttggcaagagaagcaactgaaggaagtaatcatatttcaacgcgggtgatgggaacttttgggtatgttgccccagaatatgcgatgacaggccatttactcgtcaaaagtgatgtttatagttatggtgttgtgctgcttgaacttctcacaggcagaaagccagtggatatgtctcaacctcagggacaggagaatcttgtaacttgggcgcggccaatgttgacgagtagagaaggtgtagaacagctggtggatccatctttggctggaagttacaactttgatgacatggcaaaggttgctgctatcgcttcaatgtgtgttcactcagaggttacacagagaccttttatgggtgaagttgtgcaggctctcaagttaatatacaacgatacagatgagacttgtggagattattgtagtcagaaggattcctctgctcaggaatctgattttagaggtgaccttgccccttctgatagcagttggtggaatgcgggagggctaacccctcgaataacttacgggcaagcttcttccttcatcactatggaatacagttccggtccacttgaagaaatggagaacagacccttttcaacttcaagcttgattggggatgaaatatctttaccgattaggcatgggaatagatcagggcccttaagaacagtccgaaacaagctgtccttatatagatttacaggaagtcggagtgagcatggaggaccttcttccaagcccaattggaacgatggttactgggtttaa

SEQ ID NO: 15345 - DNA, 1488 bp, Glycine max
  Peptide Sequence Number=SeqID_132123
atggtgttttctggtatagtaacaaaaagtgttagagcactcatcttgcctttcttctgccctactctcttttttaccatacagaatcaagacgacaatgatcatatggcctattggctgtcaaatacttctgcgttattgtttttacttgaacaaagcctgaaatctgggagttcagcaaaagctaccccagctagaaaactgcctaatccaacatctctttttggaagaatgactatgagttttctttcatccccttcttctgccaaccttgctgctcctccagcagatgttgtacgcaaggtagaggctaaataccctgctttgcttttcaagcagcagctcacagcctatttcgagaaaatatatggcatcattcgagataatttgaagaaggatttaacaccggttcttgcattatgcatccaggcaccaagaatatcaaagggagggttacgttctaaccgatcccttgctaaggactccccagtagttcactggcagagtattattgaatccctcaatacactcctctgtacactgaaagagaactttgtgccaccagttcttatccaaaagatctttagtcaaacattctcatatattaatgtgcaactcttcaatagcaatggggaatatgtgaaagctggattagctgaattagagttgtggtgctgccaagcaaaggaagagctccaactaattgcctggagcacaaacttgcagtatgcagggtcatcttgggatgagcttaagcacataagacaggctgttggattcttgggacacaaaccaagtaccaccactaaacaaggagaggatcatagcaaattaagcacagtagccaatcaagatgggcacaacaaaattgagcgtagccaccaagctagaataggggtgcagcaatctaagtgcgactgccaaacaagaagaggggcacaccaaaccaagtgcagctcccaaacaacatcaaagcaaaaactaagggaccagtcaaaaatctataggacacggttattcatcagaagtataggatttcctatgatgaaatcatcaatgatttatgccccttgtaagggatggattagaaggagattagggatattgatatatgcatggtcacttcagctcactgcatctcaatgttttcctttccatttttcttcccctcaccttctggttctgcttctccagatcttgagtgtccagcagctatatagaatatgtacactttactgggatgctaactacaatactcgaagtgtatctccagatgtcctttcaagcatgaggatgctaatggctgaggactccaacaatgctcagagtgattctttcttgttggatgacagttccagcatccccttctcagtggatgatctctctacatcactgcaagagaaggacttctcagacatgaaaccagcagacgagcttctcgagaatccagccttccagttcttaaaggagttggcgcaggaagcttag

SEQ ID NO: 15346 - DNA, 144 bp, Glycine max
  Peptide Sequence Number=SeqID_132124
atgaagtcgttgagaggaaaggagatcgcattggtgaaggtacagtggggaaccgatgagggtgattctacatgggagttggaggataggatgagagaattgtacccaaaaataggagtagtgggggcaagatacgcgagttag

SEQ ID NO: 15347 - DNA, 423 bp, Glycine max
  Peptide Sequence Number=SeqID_132125
atggaaccagatgtccagcactcacatactgtaatccctatgctgcaaagtttatttagggggcagttgatgatcatgtataacccacaagagttggctcacaataggccaatcatatctatggagcattttcttgaaaaagtggcctggcctgaagctcagcttccattggagaaatcccatgagcttgttcctcctgagcccacaccaacaaggactaagccaattccagctgaaccacaacctccagtagtggatccacctctttctcctgagctcgaaatattgtctcctccaccagctccagctccacctctgataatcgtctctgatgaatcatctgatgaagctgctacccctcctgattcaccatcttgcaacatagatgatggtgctgacttttctgattggatgaactgctga

SEQ ID NO: 15348 - DNA, 336 bp, Glycine max
  Peptide Sequence Number=SeqID_132126
atgggtaaagtggaggaggtacaagagaagatgaaggccgacatggaggccatgaaagagcaaatggccacgatgatggaggccatgatgagcatgaggaagataatggaagccaatgcagttgtagttgccgctaccagtgctgtcgctaaggtaaactcgatgcccccatctgtcctcaagcaaatgaatcatccaacctcagatatggtaggcaaagctttgggaagtacgggcggcccccattatgcgcaaattcaaaacaagcatgccttcccaccatatggcttgcctccccaactatacaccacccaatgtggcatacactcccaatga

SEQ ID NO: 15349 - DNA, 176 bp, Glycine max
  Peptide Sequence Number=SeqID_132127
accacccggttgtgcacgtaacagcccccctcccataggtgatcagcctgggagcccaaaggtgttccctaccagtgccaaagaccctggaaggtcagtgcacagtgccccccacgatcatacacaacatccaacgtatgaacgtggccaaaagctagtgccaaagaccctggaag

SEQ ID NO: 15350 - DNA, 252 bp, Glycine max
  Peptide Sequence Number=SeqID_132128
atggaggaactagaaagacatatttggagggcattgtcaacaaatttttgctctaaaggagatatagtgttaataactgcttctagcaatattgttgctttacttattcctgaaggaagaaccatgcattcaagatttgcaattcctatcaatgttgatgaggactcaacttgcaatatcaagaaaggaggccaattagatgagttaattgcaaagactaagctaatcatatgggatgaggctccccaatga

SEQ ID NO: 15351 - DNA, 372 bp, Glycine max
  Peptide Sequence Number=SeqID_132129
actcatcttctccttgaagtggcgtctcctctctctcttcctttctccattccgctgccattcatcttccaagaagcaaaggaatccattgatgaagaagatcctaggcctacaagctccaatggagcttgcatcaccaaggatataatcaaggaggcaatgcaagttatcatccatgaggcaatgcaatttttcggcaaggaggaaatttttcttagaaccaagggtccaaatttgtatgaaagaatcaccaagctggaagacactctggctcatcttatgcaattagctgagaaacctaatggagagtttgcaaccaatacagagaaaaatcctaaggaagagtgcaagatgatcttcaccaggagcaag

SEQ ID NO: 15352 - DNA, 458 bp, Glycine max
  Peptide Sequence Number=SeqID_132130
attcattggaggagcaggcatcacagggatcgttcgtccctcatggatgtcaggatgtcctaactaccatcattggccgaccagaccaccctggctatgtccgtgctgctggatctgtagctgacctaacaaatcagggaccagctagaggagtcgatcacagaaaaagtgactcaacagctgatggcatctttcagccagatgcagtcccagtttcaatcccagatgcaatcttagggacttgcactgcctctagagcctatgggaacgatcctaagacggatgactcagacaagtgcaggttgtacatcgaagcaaatcctccctgcttggttgccctaggaagagtttttgagggatcaacaattcacaacattcctttgttacctggccatgtgaaggttggtgttgaggaggttaaagatgcacaagctcccgttcctgtacccactgatgag

SEQ ID NO: 15353 - DNA, 1317 bp, Glycine max
  Peptide Sequence Number=SeqID_132131
atgcagtgccactgttatgtgtgtgattatgtcgcaccatgtccgaagtggggcactggctttttaggtacagatcactgtcatgcgaccgagaaatctgagacatggagaagtctgaggaaaaatttcaagttgggcaagactgctccattaccggcttcaacaaaccactgtactttgagtgatgtcacaaattcccaacaaaatcatattcttccttttcgtgtgatgtctccaaattccatgttgctgaatcagacatcaatatcaactgcaacacatacatgctccccagtaaatttcatacctcaaaatcaagcctctaggccaattactactataatgcatacatgctcctcactaaattctaacttccaaaaccatgtatccaggccaaatactgtcccttccattgccaccaactttacaatcccgtcttgtataaaccatggaagatatggagagttggtatctactttggtgagaaacagataccagtctcattctattccaccgcattcgctaggtgtgcacaatcgtgccatccaaagggtgcggcaacatggagttggcactttagtgcctcagttccattctcacacatttcttaatgggttaggcagtgttggtgttgggagcaccttgccaatgaaccattctactcatggcgcttctggtggcttcatcaataatgacaatccagcacagcaatatcccaattatcatgctgcaacaggattttcaaataatagcagaacttcttatggacaaaatgcttatgcttatgtcccccaaaattttgggtaccctaatccattctctcaactgaataacctcagctccgtcagcaattatagtactgctcatgaaacccaagcatcttatcaatcaaatggtagccagaatatttatgcatattctgttcaaggtgacaatgctccttcaagtaataatgtggctggcctgagtagagttgaaaatgcttgtggaaatgtaacccaaagtggaactacaaggcaatattcttgccaacagaaacctcatgatgcgagtctaattgaagctgcattgaaggcagacaggattggggatgccaatcaaagcaatcctcatcaacaaagttcagaatctatgaacatatcatccagtgccacccagtttactggaagcacccgtcttagcaatgaaaactctgtcccggttggagctgatggagctttggcatctgaactgaatgcatctcctgatcttagcacatttgatggggccttctactttgattttgaaaccacttgggattgtctggcacgtgtctag

SEQ ID NO: 15354 - DNA, 648 bp, Glycine max
  Peptide Sequence Number=SeqID_132132
tcctcaccatcagaggactacacatcctcgccatcagagggctgcacgccctcacctttagaggggctacacgtccttgcctttggaggactgcacgtcctcaccttcagaggactgcgcgtcctcaccttcagaggacagcgcgtcctcacctttagaggactgcatgtcctcacctacagaggtctacaggtcctcatcttcacaaggctgctcaccctcgccttcagaggattacacgtcctcaccttcagaggacaactcgccctcgcctttagagggttgcacgcccttaccttcagaggactacgcacgctcaccataagaggactttacatcctcacctctaggggaccacacgttctcaccatcagagtgccgcacgcccttaccttcagaggactacacgtcctcacctttagaggacgacacatcttcaccttcacaggactgcatagggctacacgccctcaccttcagaggactacacgtcctcgccttgaggactacatgccctcacctttagaggactacacgtcctcgccttcagaggcctgcacgccgtcgtcttcagaggcctgcacgccgtcatcgtcaaaaggcgacacatcctcaacttcggagggctgcacgccccctcacctttag

SEQ ID NO: 15355 - DNA, 192 bp, Glycine max
  Peptide Sequence Number=SeqID_132133
atgagttattggagcgcgtggaaagggaatggaaggtgttgtttgtgcgttaccaactgcaacttgaagtcgaagttgaagggaaggttcttctcgtggggatcaaagacggaaggttcttcttgggtttccttctgctgcatcgagaagcaagacaaccacattctccagatgctcatgtttcgatattaa

SEQ ID NO: 15356 - DNA, 2076 bp, Glycine max
  Peptide Sequence Number=SeqID_132134
atggactcaaaagaagaggctgaacctcatgaggataggcccacatcgccaatgcgggtcctgcagcaattatctgaaggggcattcagagttgctggggaagcatttcacaatatgtattcgggtggtgggtcaagcaaatcacaaatggggcctggtgcacatagacgaagtcaaagtgaacttgttactagaggagttgagcgtactaatagctttcagaaattaagatctcatgtgcataaggcttggcggtggggtggcagattccgccaagaagtttccccggcgagtttcaacccggaggtcatggccaaccagaaacggcagtggtatcagcttcatcctagaagtctggtgtctttgtgtaccatacacatatttgtcagaaatggttgtgtacattataaggagccaacatcgctctttgaacattttttgattgtggggctgcatccagatgctaatttggaagatgtggagcatgcatttgtaagaaggaaaaagtgggaaaaggaaaaacctgaatttctagattacaaaatgttacagcaacaaaggccaccagaaccaacattggaacctcagttgctattcaaatatcctcctgcaaagaaactaacaatgcgtatgaaggatttagctcccttttgctttcctgaaggtgttaaggcatggctgttggagaggactccgtctctaagtgaactaaatgaacttgtctatggacaggagcatttaggaaaagatgatctttcatttgtctttacaatcaaggcagcagacaatacaacactttatggagtttgcttacatgtgcctgaaattgttcagaggccccctggtatcttaggcatatcatctcctttttctcatccctctggggcatgcagccgttttctggtttctgcacctcgctgttactgtcttctgactagagttcctttctttgagttacactttgagatgttaaacagtctcattgcacaagagcgcctgaataggataactcagtttataaatgaggtgacaatcactggcagcactccatcaacacccaaactaggtgatcaaatgagttcgaatgctaactctccggatagagagtcatttagtgactggatggattgtgcaataccccttgatggtgcagctattattactgctgctgctgcagggattatatctgatgatgaaatcatacagttatcacctaaaatatgggattctcgctgtcaatctcctgttagggatgtagacaaggatggcaggaagaatctgcaagatcatgataattgtgcttttgaggccccagaaaatcttggttctatagaaagaatgcatggaatttgcgaaaatgaccaagtttctccaaaagttggaacacctttttctgctcggagtcgtgtcttggagcgtcttggaagttccgaatcacttttcagtccagttagaagcatggcatcagataacgaggaagattttttctcaaacaatgaaagagattacggggacgaattgttaatggaatgggccatggagaataagaatgatttgctacagatagtgtgtagatatcatgctgaacctattccacctcgaggaagtgaattagtcttccaccctctcgaacatttacaagctattcagtacatacgacattcagttgcttctcttgacttcagcaatgattgttcaaattgttctgaaccagctcaggacaatgcaaagctggcagctgccgaggaagccctgtcattatcagtatggacgatggcaactacttgtcgagttctgtcccttgatagtgtgctggcattaattacaggagttttgttggaaaaacaagtggtaatagtgtgcccaaatctgggtgttctatctgccactgtgctttctcttattcccatgattcgtccatttcagtggcagagtttattgctccctgttttacctgggaaaatgattgattttcttgatgccccagttccatatattgttggcatacaacataaaccagatgacttgaatatgaaaactactaatcttgttcttgttaatataccaaaggatcag

SEQ ID NO: 15357 - DNA, 186 bp, Glycine max
  Peptide Sequence Number=SeqID_132135
atggatgataaaataagaagatgtgtttatggagaagtttatgctaaaaaggccaagctctttactcattactgtttgaaagatattgatttcgaatccctggctttgcagctatttgtagatacacagctcttcactgttttatcagactcacgtttgtcaagctttgagagtggcgagtcatag

SEQ ID NO: 15358 - DNA, 1941 bp, Glycine max
  Peptide Sequence Number=SeqID_132136
atggcggatttagaaaatttgcttttggaggcggcggggagaacacgccattctcgtcaaacttcaagaagaggacatggcgatggtgggagtgactctagggatgatgattcggagaatgaacatgattatccaggtcgaaaggcctctggcttgcaagttccccaaaagaagtggtttgatccaatggaaagagatgatggtgagagaagtaaggatgaaggggatgatgatgttggtggccggtcttatcacgagggtgatagtagtgatgaatctgattttggtgatgatctttataagaatgaggatgacaggcataagctttctgagatgactgaacttcaaagagagatgatattgtcagaaagggctaccaagaagcatgataaagatttattggggaagatagcatcaaagcgtgagaagggaaagacaactgtagccgggaaactgacttcacctctcacaccatcccatgtgcgttcatcagccagatctgccaacaggtcaactgccaaggatggtgcattaaatgaattgcgtgcgaaacggttaaagcagcaggattcagaagcaaaccgcaggccaagtaaggcatctagaagttcagggcctgggcttgtttcaccaaagcacagacctttcccaagtcttggtagctcaagtgatagtgaaactgaaagtaagtccctgagtgataatgaagggtcaagtgatgacgacagaatcattgatagtaatgatgacaggataatgctaggatctgaagggcttttatttgagcatataaaagaaatcaccattcggagatcaaaacttgcaaaatggtttatggagcccttttttgaggagttaattgctggttgttttgtaagagttggtattggtcgctcaatgtcagggcctatctacgggctctgcatggtaaaaaatgttgatgccacagattgtgatcagcagtataaattagaagataaaaccacacacaaatacttaaatgttgtctggggaaatgaaacttctgcaacaaggtggcaaatggctatggttagcgactctcctccagaggaggaagagttcatccagtgggttaaggatgtagagcgaagaggtggccggatgccaacgaagcaagaagtggcagaaaaaaaagaagctatacaaaagaccaacttgtttgtttactcagcagctactgtgaagcaaatgttacaagagaaaaaatctgccaaaacaagaccactaaatattgcagctgagaaggataggttaaggactgaattggaaatagcacatagtaagaataataaagctgaagtgaagaggatcatgacaagattgctagaattggaggaatctcggcaagctaagacgatggatgccagggctttgaagcttgctgagatgaatagaaagaacaggtttgagaacttcaaaaatgcttctgaattgaagccagtaaataaagaattgaaagcaggggaggcaggttatgatcccttttcaaggagatggactagatcaatgaattactacgcaggaaaaccagctgaagaggctgcaggtgaaattaatagtgccagtggtgcagtggctgatacaggcagctaccacacgggagcatctgagaccgtgacggctggtatggcagctactactgcagctttgaaagctgctgccggtgctgggaagttagtagacacaagcgcccctgtggatcaagggacagagtcaaattcgctgcacaattttcagctgccaatatcattagctatactccaaaagtttggtggagctaaaggagttcaggcaggatttatggcaaagaaacaaagaatagaagcaacagtgggatttcaagtcctgaaaaatgatcgtcagaagcatgcactgacattaacagttagtgattacaagagaagaagagggcttctatga

SEQ ID NO: 15359 - DNA, 189 bp, Glycine max
  Peptide Sequence Number=SeqID_132137
atggctgcagactccaactcaaaccttagaatcaccattcaaaggaagtaccaattgaagtttgatgcagaagattcatgctacttgttgaaagggaaggtgaaggcatacccaaaagggtcatcagagtttgtggagtttggtgctggggaccttgtcacaattccaaaaggactcggttgcagttga

SEQ ID NO: 15360 - DNA, 2463 bp, Glycine max
  Peptide Sequence Number=SeqID_132138
atgacagggtttcctggccctcgccgcgatcacgcttcttcttcctcctcctcgcacaattccaacagcagaatatctctcttatctaatgtgttgaatttggccagtggtagcaacgtatttaatttgcttgcaaggagggagatctcaccccgaacaagatatgtggcaaaatggcattggggagaacccggtgaagcttcaaaatcaaagtctattccttattctcgtcctaaaaaagaagttgtgagagatgcaagacgtggtctcctctcatgggttgaggctgagtcattgcggcatttgtctgctaagtattgtcctttggtgcctcctccaaggtctactattgcagcagcatttagcccagatgggaaagttcttgcctccacacatggtgaccacacagtaaagataattgattgtgaaactggaagttgcttaaaggtgttagttggtcataggagaacgccttgggtggttaggttccatccattgcacccacatatacttgctagtgggagcttggatcaagaagttcgtttatgggatgctaacacatcagagtgcataatatctcatcatttctatcgtcccattgcatctattgcttttcatgccaaaggtgaaataattgctgttgcatctggccacaagttgtacatatggcaccacaacaagaaaggtgaagcatcctctccaatatttgtgttgaagacaaagcgctcccttcgtgctgtgcattttcaccctcatgccgcaccatatcttttaactgcagaggtcaatgatcttgattcttcagattcctcaatgacagaggctacatctcttggttatttacaatatcctccgcctgctgtttttgtcacaaatattcatcctacagaacatattaatttgtccagcgaactaccttatgtgtcattacctttctatgtaatgcctgcatataatgttgatgagtcaagagcagaactacagcatgctagtcatgatgttgtctcaggtagcatgcaaattgagtcttctgccatggtacagttgcaagcagacccaagtgcagcagagcattatgagactacagtgtctcccatggatacattctctgagatgccctctagctctcaaactggtgcagaatatcctgctcatactgctttctctaatggaatgggaattggcctcagtaatctcacaatggatggtatggagaccgatgaaaccagacctgctgaaggaaaccaacatgggaacttgactaatacctattctcttaatggcatgctacatggactgtctaggcaaactgcaaaccgtggggttccctcagagtttggtcaatttcatcagttttttccttcaagagatccaagtggatgggagattccttttctccatggatggataatgggtcaaagccaagttggtgttccttcaatgcttcctcacatgggtgctagtcgtgacaatctatcccaacagattggttcttcttcttacataatggcatctaatcattccacttctaatgttgatgcagcgatgccatcttcagcaatacctggcagcatcagcataccgggttcttcaatgagatcaggtttacggaatcacttttcacaatcccgtgtacctgtatctgaatctggcaatcttgctgcttctattaataccccacatgatggatttgatatgcaaaccatcgtaagtcgaattcagtcagaacttgccacatcagtggctgcaacagctgcagagttgccttgcactgtgaagttaagagtgtggtcacatgacataaaaaatccctgtgccccacttaatgctgatagatgtcgtctaaccgtaccgcatgctgtcctctgcagtgaaatgggtgctcatttttcaccatgcggtagatttttagctgcctgtgttgcatgtatgcttccccatatagaagcagatccaggattacaaactccagtacaccaagatcctggtgttgcaacatcaccaacccggcatccaatttcagcacaccaagtaatgtatgagctgcgcatatattccctcgaggaggcaacatttggttcggtgcttgcttcacgagcaattagagcagctcattgtctgacttcaattcagttctcacctacatctgagcacatactacttgcgtatggtcggcgccatggttctcttcttaaaagtattgtcattgatggagaaacaacattacctatatatacagtgttagaggtatacagagtgtcagatatggaacttgttagggtgcttcctagtgcagaagatgaggtcaatgtggcatgctttcatccttttgccggaggaggactagtttatggaacaaaggaaggaaagcttagggtcctccagtatgacggtgctcatgcagtgaatggcgctggaccaagttactttcctgaggagaccatcgttggagtcagtcagtga

SEQ ID NO: 15361 - DNA, 582 bp, Glycine max
  Peptide Sequence Number=SeqID_132139
atggctccaaatcttcatgatcaagtggaagagcctagacgatgcagctccagtagcgacacaacattggtggtggtggatgtcgtaacgattgggatcatactcgaccctttcaacaccgttgagggaggaagctatgttttgtttgagattgttagtgttacaagctcttggctccgccacctcaacgggttacacgatccgaggagttgcagtcctataatctgcacggggacacctgctaggtggtgtcccccattttcggtattgcacggggacgaggacgacgtcaatttattggatacggctggccaagacggggatgatggtggtattttgcgggaacgtattggggacggttacttggacatttcagcttctgaaggctcgcttagcgagattagctcgctaagcgagaagacaatctactcgctagacaagtttgcggcatgctgggcgagcacatctctgactgatcctattctagggttttccaacatgctaagcgagctgcatgctttgcttagcggatgtcactcgctaagcacatatgtctctcttagcgagacatcaactacttga

SEQ ID NO: 15362 - DNA, 1572 bp, Glycine max
  Peptide Sequence Number=SeqID_132140
atggagaatccctgtgaggtgctcggttccaaagggttaattagaaggcatgaatttgtgaggatcataatccagtgtctatattcattagggtacagtagctctgcatcgtgtttggaatcggaatctggtatttcgtacaagtccaatgaggttaagttgcttgaatcacttattttgaacgggagttgggacgaaagcattgattatctcaattccataaaggatgagttgggtgaaaccagggaatctgccctgtttcttgtgttcagacagtgtgttatggagtatttgaattgcggcgagtatgccttagctttaggggtgttaaggaaacaagtttctgccttggatgcgggcaagtgcaaagttcacagcttcgctaagtgcttgctttcgtttaaggatagggagttaggtgcagttgatggtggcgatgttgttgtgcatgatttgcgaaagaagttattagcagatttggagaagttgtttcctcctccgatttcggtgcctgaaggaaggctggagcatttggtagaaaatactgttatgtcttgggttgattcgtgtatgtatcatagttcgtcgagtccaatttcactttatgaggatcatcattgcagcagggatcagattcctactacaacgactcagatattgactggacataaaaatgaagtttggtttgttcaattttctaataatggagagtacctggcctcttcatccaatgattgcaccgccatcatatggaaggtgctggaggatgggaaattgacattgaagcacacactttatggtcaccaacatgctgtatcttttgtagcatggagtcctgatgacaccaagttgcttacatgtgggaacacagaagttttgaagctgtgggatgttgaaacaggtacatgcaagcacacatttgggaatcaaggctttgttgtcagctcttgtgcctggtttcccaactcaaaacagttcgtgtgtggcagttctgaccctgaaaagggcgtttgcatgtgggattgtgatggaaatgtgataaaatcatggagaggaatgaggatgcccaaggtcgtagatcttgctgttactccagatggtgagtatcttatcagcatattcatggataaagaaattcggattctgcacatgggaacctatgctgagcgagtcatttcagaggagcacccaatcacatccctttcagtttcaggagatagcaagttcttcattgtcaatctaaacagccaggagattcatatgtgggatgtggctgggaaatgggataagccattgaggtttatgggccacaagcaacacaaatatgtgataaggtcatgctttggtggattgaataacacgtttatcgccagtggtagtgagaattcacaggtatacatttggaactgccggaactccaggcctgtagaggttctatctgggcactccatgactgtgaactgtgtgagttggaaccccaaaataccacaaatgttggcatctgcaagtgatgattataccattcgtatatggggacccagcttacaaaaaaaagaaggccaacttgagtag

SEQ ID NO: 15363 - DNA, 276 bp, Glycine max
  Peptide Sequence Number=SeqID_132141
atgatgctagttcaacttcaggatctaacatttcttgtagctattgtggaagagataaccacattgtggataattgtttcaagaagaatggatattctcctgacttctcagctcataagggaggtagaggaggtcgtggctcttatagcagagcaatcaaaccatggagtttcagctccaaacaacatctctcatatcaacaaacttggtacagtctcatctagtgatcattgcacaataggaaatagccaaccagaagatgattggtatagttga

SEQ ID NO: 15364 - DNA, 1098 bp, Glycine max
  Peptide Sequence Number=SeqID_132142
atggctctttcctgcaaacatccacacctgttcaaccatattaggacttttgtgaatgtgaaggtgaaatgggtccaagacccatatcttgataatgcagtcctgaaagagaaagatctcaaacagacaatttccctcaggaaccaaatcatttcatctccttccaaatccctctccatctatactgcttctcaactaaaagcttccctcaaccttcccactacaactaccaaattcgttgacaaatatcattgtgttttctcacaatttcaacctggtcctggtcttcctccagttgtcaagctcactcctctagccttgtccctccacaaagaagaaatggctgttcataactctcccattaatcgtgaagacactgttcagaggctcgcgaggcttctaatgcttgctggcatgtcaaaattgcctctttatgtgattgagaagctaaaatgggatatgggacttcctcacgattatgtgacaacccttttggctgaataccctgattattttgatgtttgtgttgtggaagatccatcatctggaaaagaattacttgctttagagcttgtatcgtggaaaaaagagctttctgtgtctgagatagaaaagagggcaattagcttgggctatagtggagataaaagaaggcatgatattgcatttcccatatttttgccaaaaggttttgatttagagaagagggtgaagacttgggttgagaattggcaaaagttgccttatgtttctccatatgaagatgcttttcatcttgactcaaatagtgaccaagcagagaagtggacagtggcaattttgcatgagttgctttctctttttgtgtcaaagaagacagagagagacaatttactatgttttggagagtgtttggggttggccttgagatttaagaaggctttggttcatcatcctggtatattttacatttccaataagattaggactcagactgttgtacttagagaggcttatagaaaggattttttggtcaagaatcatccattggtggccacaatggtggttgattgtggatcaaattgtggctgttggggatacaatttttcacagggataa

SEQ ID NO: 15365 - DNA, 288 bp, Glycine max
  Peptide Sequence Number=SeqID_132143
atggatgcatcaatactcttggagatgtttagcattgtgttcctccttaccatcaatggaagtgacagagttggatgcacattagtcaaagaggcaggccaagtttgttttgatggttatttggtgacgatgtacttacctccagacattatcaaatctttggagtcagttattgaacatgttccttacaatgagtttgtgggacccctacatgttgatctccccttcacccttggcctactcgatgtatggggaatgcgagggttattgtacaatgttccatgttga

SEQ ID NO: 15366 - DNA, 597 bp, Glycine max
  Peptide Sequence Number=SeqID_132144
atgagcccgtttgagcgcatcaagccgtgggcggtgtacgtcaccccgcaggagacggtgcaggtgacggcgctgacgacgtgggagctggcagtctgcgctgcgccgggcaaaggcacatacccgacgcggctgattgcgccgcagtacatggacggcgaggcgcgcggcaaggggcacaaccagcgctatgtgcataacattctgccggaaggtaaatctgccgacagcctgctggtagtggaggtctggaccaacgaagggtgtaccagttcctacccgagccacaagcacgacacggataatccgccgcaggaaacctatctggaggagacctactaccatcgcctcaacccggagcaggggttctgcatgcagcgcgtctacaccgacgacagaacgctggatgagtgcatggcggtctacaaccgtgatgtggtcatggtgccgaagggctaccatccggtggcgacgatggccgggtatgacagctattacctcaacgtgatggccgggccggtgcgcaaatggatgttcacctgggaagaggaccacgcgtggattaatcgcgattatcccgcggatggcgggcgctga

SEQ ID NO: 15367 - DNA, 519 bp, Glycine max
  Peptide Sequence Number=SeqID_132145
atgacgtggccgccacgcagcgagccatcgcccgggcgcacggcgacgtggtgctgtgaagcgggcaatgatgcgcgggtgaaatcgctggtgtatgtggcggcgttcgcgccggactccggccagtcgacggcggttctcgcgggaagcgtccctgcgccgccgggcagcgcgggcattgccaaaacggcggacggctatttatatctgccaacggaggccgtcaggaaggacttcgcgccggatgtgaaaccggctgaacaacagaccattgcggccacgcaggggccaattaagggcgacgctttcgcagaaaaagtgactcacgccgcgtggtacaacaaaccgagctggtatgtggtgagtcagaatgatcggatgattaacccggcgcttgaacgtgcgatggcgaagacgatccatgcgaaaaccacggaggtggcggcgagccacgtgtcaatggtaagccagccggagatcgttgcccggacgattgagcaggcgattgaagcaaagtaa

SEQ ID NO: 15368 - DNA, 603 bp, Glycine max
  Peptide Sequence Number=SeqID_132146
atggataaaattccgtcgaaaaataggattaaattctgtcagaaagttttgaattccaaccgattttatcgaaggaatcagatccattatccccaattaaaagacccaaaccctagccctctattttttcactttgcgatattcctctatgtgcctcagtcttgtggccacaaccgtcgtgcctccattgtgccttcactatctgcccatgccgccaacagtttggttggtgatggtggcggtttggttggtggtggtggtttgggtctcgagtgtgctttggtctgtcttgggtggtttggctcacaagtggtttctggtgctttggttgatgatggtgctggtgctttggttggttgtggtgctggtgcaaggttggcaagtaagtgtttcatttatttttgtgttgatgaggataggattagaggaattggaaatgttgcacttttccttttccaagttggctattttatgaggcgtggtgtcactctcaaatttaataacttagggaaattagtatcttcctcaaattgtgcacacgtggcttccttattgacaatttgccttcaagaagccttgagaaaaagcatcaagcatgtttga

SEQ ID NO: 15369 - DNA, 141 bp, Glycine max
  Peptide Sequence Number=SeqID_132147
atggagaaatatctgaaactctatagctaccattacctgataaatggattcgccgtgctggttacccaacaacagatgtttaggaatgatttccttgaagacaagctaaaacctttcctcaaatcagatcttgaaccatga

SEQ ID NO: 15370 - DNA, 390 bp, Glycine max
  Peptide Sequence Number=SeqID_132148
atggcatatgaagttgtagattgctcccatggcaagcaaagctgggaactgtgtaaagagaagtacgaaccattatggctcaaaggaggtaaccattgtgatttagagctctttcctgagtacatcaggcatgtaaagaagttcataacaatagttgagaagtctccatcgcaacgatacaacttccgacggagcacagatcaatttatgcagccatggaagagcacaggcaggtcagaaaagctgaaaaacttgtctaataattctggtatgttagagaagttgagaatgacctttgatcacaaggaaaggtctaggagaagaattgatcatcaattagaaaaagcaaggaagagtgttgataggctgaacataataacgagtggatag

SEQ ID NO: 15371 - DNA, 399 bp, Glycine max
  Peptide Sequence Number=SeqID_132149
atgaagagccaagcatcagacttgcctagagggctggtttcctcagtatcatttggccatggccccaacaatggcatgaacttggacaaaagtggtgttcttgactttaagcacctcatgatgatcttcttctgtaggactaatttgaaaaacgaggaggatggtgaagctgcaactgaggagaaaagcaaaagcagaactgagttcttgatcctcacattaaagagcaattcggaggtggtcgccttttggcctgtatctcatctcgccctggccaatgtggttgtgctgatagaaagatatgaagggttaaaagataaagaaactcgggatattactgtagaagaaggttgttttattgatctggaaagcagagtgccttttacaaagagatgctaa

SEQ ID NO: 15372 - DNA, 363 bp, Glycine max
  Peptide Sequence Number=SeqID_132150
atgatattggtttgtctgcttagtaagatctggactcacgacccctacaacagagagggcatcttcgtaggatgggtgtggtttggttttgtgccaatagagtatggacttcatgtatgcccaatttactttgacctgcctatttacttcacacaagaacgtgtgcctggttatagttgtgtttctgacaaacctccaccttcgtcccttgggagttcttttggagattatgtgatgcacaatgatgagtatgaagggattatgattgttatttcttctcctatcagtgtcttatgcgatgctttagaggacaatggcaccgaggaagatccggaggaggacccatctgacggctcttcttag

SEQ ID NO: 15373 - DNA, 150 bp, Glycine max
  Peptide Sequence Number=SeqID_132151
atgtgggtattcgaggaaaaattaccaagtggggagaagctcacagatgttatcaacaaaaccaatgaaaatgtcaagtatctccctggaatcaagcttggtaaaaacgtagttgctgatccagagcttgaaaatgcaggcattaattaa

SEQ ID NO: 15374 - DNA, 171 bp, Glycine max
  Peptide Sequence Number=SeqID_132152
atggaaggaggcaagcctgatggtgttcgaggcaataagctttgccgcaacactgccccaattgccgctaccaacaacgggctggaaaacaagagagaagtgcgaagggtggcacagaagatcgagaagacgctgaaggaagaagagaaaagacatgcacaaaatgcataa

SEQ ID NO: 15375 - DNA, 882 bp, Glycine max
  Peptide Sequence Number=SeqID_132153
atggttgattatgcagttaaggatgccaacatgctagtatttgtaactccgcatcaattcatggaaggaatatgcaagaggcttgcagggaaaataaggtcagatacagagggaatttctcttatcaaagggatggaggtcaagaaggaaggcccaaccatgatctctactctcattaccaaacaactaggaatcaattgttctgttttaatgggggccaacatagcaaatgagatagcattggagaaatttagtgaagcaacagttggatataatcaaaacaaattagcagcagagagatgggttgagttgttcaatactccttatttcaatgtgacagccgtcgaagatgttgaaggggtcgaactctgtggaactctgaaaaatgtagtggccatagctgcagtttctgtgaatgatcaagaaattgcttgcaatgtgataggttttgttgatggcttggagatgggaaataatacaaaagctgcaatcatgagaattggcctgaaagagatgagggcattttcaaagatgtggtttccatctgttaaggacaacaccttttttgagagctgtggtgtagctgaccttatcacaacatgcatgggtgggagaaataggaaagttgccgatgcttatgccagaaatggagggaagaggccttttgatgagcttgaagcagagatgcttcaaggacagaaattgcagggtgtcttaactgcacaagaggttcatgaggttctaagtcatcgtgggtggctacacatgtttcctctcttctcagctgtgcatgcaatcagcacaggtcgccttccaccatcagccatagttaaaatcagcgacctaaagcccaggcatggacaattacaaagcatgctttag

SEQ ID NO: 15376 - DNA, 174 bp, Glycine max
  Peptide Sequence Number=SeqID_132154
atgcagacattcctaataacatctctgaagcatgtgatgccatcatttgctgttgggaaatctcctgaaaatgtgaatgttgcttctaatcaattgtggctttggtctaatgtatcttcatcaccttgtagacagtttattcattatgaactaaacttgtggacaattctatga

SEQ ID NO: 15377 - DNA, 312 bp, Glycine max
  Peptide Sequence Number=SeqID_132155
atggattacataagggcaagtataccctatgcacgcattaatatcgtcactactagaaaagcgggattctacattagtgtcgcaacgtgcccttcgcgggcgagcgagggcgaggctcacgggtgcgctttccaaaggaggaaagatgtgcggagtcgccaccaacgtttatttgtggaaaacgtcgggaaaaccgaaggaaaccggtcgacaaaagcgggggctcttgctcctacgtaccctctatcaaaggggaaatcagacctacgtagttctttcttaagcgtgaatcaagcgattctttttacttga

SEQ ID NO: 15378 - DNA, 405 bp, Glycine max
  Peptide Sequence Number=SeqID_132156
atgaagtcatcagacattaaagcatggtgtttgaatctccacaagataattttctcaaaaacctgctttcacagttccaatagtggatgttattttgggttttttttagtaagaatgttagaagagattcaagatttttctactcttgcagctaaaccagcaaaacttgtgaaacattgtcagatgagtgccccctataacaccacagttctttatccaagcaaggaagatggaagacactgctcatatttcaggaagtcaagtaggaaaggtcttctaggtgttgagcttgatcagctgagtggtgtaaagcaatctaaaataacctggctagaagagatccaagcaccaaaaaacctggtggttagaagaggtctttacaaaggccctactataagacgatga

SEQ ID NO: 15379 - DNA, 480 bp, Glycine max
  Peptide Sequence Number=SeqID_132157
gaccccctgcgtgagttgattaagaccctcgttgacatttacgacaagcctgttgagtttgtgtgggatgttagtcaatttgggattccaaatgtagattcatcattgttcttaacatatactgatatcaacgaaataacatcaagcgacaaatgcttgaacatagccatacttcaattgtggaccatgtatatgaatgagtggagtaatagcttgggtcaacaatcggtgtatggattccttgagccacaatctatacacaatgcaaaggatagacgtgggcaatatgaagaatatattgaaaaatatcttaaggaatcacaacgacaactgtacttaggagcttatttgaatcaggcccattggcaaatggttgtgttgtgtcctaaagacaatgtcgtggtctggttttgttcggtgcgtagaaggcctgatgttcatataaaaactgcaattaacaagttaagtaatatattttaa

SEQ ID NO: 15380 - DNA, 243 bp, Glycine max
  Peptide Sequence Number=SeqID_132158
atgacatcaagaaaaagagctagaacggaggacatcccttcatcatccactctagctcctctgtcagtaaccgtaggacaggatgcccaaaactcactaactttagttcctatgctacaaagcttattccgaggacagtttattatcatgcacagcctgcaagagttggctcacaataggccaatcatatccatggagcattttcttgagcaagtagcttggcctgaagctcaacttcctttg

SEQ ID NO: 15381 - DNA, 135 bp, Glycine max
  Peptide Sequence Number=SeqID_132159
atggttctactaagtgcacatcgatgcgctaagcccaacatcttcactaaagcgctaagcgccgctgccttgctaagccccaaatgcttactggagtttgcaacttcatgttgggttagcgcgaggctaggctaa

SEQ ID NO: 15382 - DNA, 312 bp, Glycine max
  Peptide Sequence Number=SeqID_132160
atgactcgtagtggatggatttttgctgcgctcgagctaccggtacggtcaaaaggcaaagggaaggcgaaggtagatataggcgagagagataagatgagcctgatcgcgaatgacgaggcccctgctggaaaaatcacaaaggaaggcgacgacttcagcaaaaaagagatatcagctgaggaggcgactgaattcctaaggatcattcaacagagtgagttcaaggtgattgaacaattgaacaaaactccagctaggatctctctattagggttgctcatgaactccaagcctcattgggcgctgtag

SEQ ID NO: 15383 - DNA, 150 bp, Glycine max
  Peptide Sequence Number=SeqID_132161
atgatcgaatacattagtcaggttataaaatttaacatgttggaaagggaatgtccaaatgcgcacgagtggcgtgacggcggctccggtagtgaacggtggcatgagccgttagggcaggcgtgtttgtcctttgctccgccagcgtga

SEQ ID NO: 15384 - DNA, 1011 bp, Glycine max
  Peptide Sequence Number=SeqID_132162
atggaggacgctacctttctccatcagtggcacctgagttctattgatgaccctaacttactaccaatagctgctgcttttggagaaacattacaacatcatgcattcagtacttatccaaacttcaaccccaaaacttccatggaaactacacttgctgacgatgaaagaggcacaaaacaccacagaaacatcagcttgaatcccaatagcaaaagtgctcagacatcatcagagacacaatttgtctctttcccaaatcttttctcatttgttgattccaatcacacaactcctccacctgacactatctctcaaggaaccttggggaatcataataactatgtcttcaaggcatgccaagaagccaaaaagactgggaaacgttataaacattctcaacctcaagaccacatcatagctgaaaggaagcggcgagagaagctcagccagcggttcattgctttatctgcccttgttcctggactacagaagacggacaaagcttctgttcttggagatgctatcaaatacttgaagcaattgcaggagaaagtaaacgctcttgaggaggaacaaaacatgaagaaaaatgtggagtctgtggtaattgtgaagaaatgtcaactatccaatgatgttaacaactcttcttcagaacatgatggttcatttgacgaggcactgcctgaaattgaagcaagattttgtgagagaagtgtcctcataagagtacactgtgagaagagcaaaggagttgtagaaaacacaatccagggaattgagaaacttcatctaaaagtcatcaatagcaataccatgacatttggaagatgtgcccttgatataacagttattgctcagatggatatggaattttgcatgggagtgaaggatcttgtgagaaacctacgctcagcttttacatctttcatgaggttgaaaagttcaaccggacgtaagttgaaaactcttgcagctcttgtaccactatacttgtatacttcatag

SEQ ID NO: 15385 - DNA, 813 bp, Glycine max
  Peptide Sequence Number=SeqID_132163
atgcagtgcagctttgactcgactaagctagcactgcttgctaagccattgtttgaaataaattgctctgggctaaatggcatcaaggaaaaggaagagcactgcttcaaggccacagagttagagaggtgtaacctacataaacgccttgccaaccttcaggagggaagcatagatgtggcggtggttaaagaattctatgccaacttatacagcccggaagaccagagccctaagcaagtgaaggtaagaggacatttaatcaggattgatgttgatcgcctgaataccttcttagagaccccagtagttttggagggtgcgacactgcctacctattccagatttacgaggatgaggattgatcctcaagagttttctacccgtctctacatccctggtaggggttttgttctgaatgcagagggccatccttggaagcttttgaggaaagatctcaccactcttgcacagacatggagtgtcctctcctacagcaacctgactcccacttcccacacctctgatcttaatatggacagagccagaggggccaggaaggtaagagctcgactagcagatgttccttcttcttctgcaccaccagctcctcctacttctgccatgcctacaccagctgcccatgactctcaacgctttgaagccatgcttcagagtattcatcaaggacagattttattactgcagagcctacaggtggtagttcctctagggtccattctatcggtagaacaattcattgagaaggtatcctggcctggaacttgtaccttctactgtgagagagggtga

SEQ ID NO: 15386 - DNA, 669 bp, Glycine max
  Peptide Sequence Number=SeqID_132164
atgatgcttggcagctgcaaaggacctacttcatttgaggatatcaggattgttgcgaatatccaatatccaacatatagagaagcatgttttgcaatgggctttctacaagatgacagagaatatgttgaggcaatcaaagaggccaaggactggggcacaactaattatctaaggaaattgtttgtattaattctgttaacaggtgccatgagcaaacctgaagaagtttggaatcaatgttggcattggctagctgatgacattgcatatcaatatactaaatcaacaatcagctcagatgaacaaaaaacaatttatcatagaattatccaagctgtcaacaacaatgaaggtggaatgttttttctatacggatttggaggcacaggaaaaacattcatatggagaacattagcaagttcattgagagcagaaaatcaaattgtaattattgttgcttctagcggaatagcctctctattattaccaggaggcagaactgcacattccagatttaaaattcctgtaccaatttttgaagactcaacatgtaatatccatcaaggcaccgaattagcagaattattgaaccagacaagcctaataatttggggtgaagcaccaattgtaacgacccgcctcgtcgctacggtatccacactctaa

SEQ ID NO: 15387 - DNA, 171 bp, Glycine max
  Peptide Sequence Number=SeqID_132165
aacttggagaacacgggtagcgcagtccacgaaaacattgaggatttcgccgccttcaaacaaatggaccatagtggcaaaggaaaagcaaggttaagagagaacacgaacgtttcagaaagcgtgattgcacagaggaggaacaagctcaagacaacaaagtgcagatag

SEQ ID NO: 15388 - DNA, 657 bp, Glycine max
  Peptide Sequence Number=SeqID_132166
atgacttcacaaattgctacagagatgaggtggcacaaagatagaaaaattgaagatgggcaattgagacatccagctgattcaattacttggaaaactcttgactcaaaatatccatcttttgcggcggatccacgtaatgtaaggcttggattagctagtgatgttgtagttccttataacttgccgccttggatgtgcatgaaagatccttttttcatgatgtcactacttattccaggtcctatggctcttggaaatgatattgatgtgtatttacaacctttaattgaagaattgaaggaattatgggagaaaggtgtagtgacatatgatgcatcaaccaaagaaacgtttaggttatatgcatcaattttatggactattaatgattttctggcatatggaaatctcagaggatggagcactaaagggcgatatgcttgtccttgttgtaacatggatacatggttactaaatgaaggaaaattttcttatatgggaagtcgtcgatttttgccgcatgatcattcttggagaaataatgcaaaagcatttgatggcaagaaagaaaaacaatctgcccctaaaccattgtctggggatgatataattgaacaatatcaacattttgaccagtttacactcttcaaataa

SEQ ID NO: 15389 - DNA, 250 bp, Glycine max
  Peptide Sequence Number=SeqID_132167
aaaatcaccattaaaggacctcattgaagctcaaagatctagcctccatagaagccccacaagcaatcttccatcaggaagtgatttgcaaaatcaagtcatgacatatctatgggtcagaattaggatgaaacacttacctatagcatgttcgcattttagtgaagaaaacaccgagactatttttagtctcacagttaacaagaactacgtaggtctgagttcctcatcacaaattgaggatacgtag

SEQ ID NO: 15390 - DNA, 216 bp, Glycine max
  Peptide Sequence Number=SeqID_132168
atggagaacaaaaacaacaacagtggcgagtcggagctgcgggtggtggttgtcatcttcctcttgaagggcagatcgatcctcctcggtcgctgccgctccgctgtcggcaatgccaccttcacccttctaggcggccacctcgaattcggtcactcccttactctctctcatattatgttttttttttcgtcaaacattttgaaaacgaaataa

SEQ ID NO: 15391 - DNA, 255 bp, Glycine max
  Peptide Sequence Number=SeqID_132169
atgagaaagatatggggatttgaagatttgggtatggagggcgccgtcaaggagaaagggaggaagaaggagctgcccaaggagagagaaggtgcaatatttataggcaaggacgagctacaaaggatcaagctgaatgttttgatgatgccaaaggatcacatgcttctaaaaaaggatcacatgtttctcaaagctttattcaagacaaagaaattaaagatattcaagatggatgatcatgaaagtttctaa

SEQ ID NO: 15392 - DNA, 444 bp, Glycine max
  Peptide Sequence Number=SeqID_132170
atgaaacctgtagatatttcgaatcctgacgtcgatgccctctacctgatgacattgaccattccacaacttttcctcaagccattgcaagtgccttgggatgctagtgtgtttggggtgtataatgataacttctcattgtacataaagcatgaacatctttctaaaatagctcacagtggtcaatgtttgagcatctctgttacacaattgtggattcttgcacattggcaaatggtcatcattttgcctaaggatgatgttgtcatctggttttgttccttgcacaataggtccaacaactacttgaaaggaattattaacagggattcaacaacaggacaaggaagtaaatccaaggctgttgctagatggatcatagttaaatgtaataagcaaaaaggaagcagtgagtgcgagtactgtgtagtgcattggatgtaa

SEQ ID NO: 15393 - DNA, 476 bp, Glycine max
  Peptide Sequence Number=SeqID_132171
atgaatatcttgacgacacacgatcaaggatgggaacaggagttaagtccttataatcaatatgaagaagaaagaactcctaatcttgaaagtatgtttgaagaattcagggcataccatgctagctcaaaagctaatcaaaattcaatgaaaaatcatgaaattcattttggtacaagctactcaacagaaaactttcaagggagacaagagttacaaccttactatcaaaatgaagcaaaaggaggtcccaatctggataaattgttgatgcaattcatggaaacaactaaatcaactcaacaagcactccaaagtgtagaaatccaggttggtgagctggcagaagcagtaactcaatttatgtccagacaagaaaaatcatttgtagaggttgaagctcaaaagaaaagccctgtaaaagagcatgagtcaagagaaaaagatgaggaacaagcacaacaacaatgggagaa

SEQ ID NO: 15394 - DNA, 246 bp, Glycine max
  Peptide Sequence Number=SeqID_132172
atgacaatgtgggtgtcgaggaagcggtttccgacagatttcaggcgggaggagaaagagaagagcgatttcaggcagaaggatgacaaagagaagagagagggcaaggcgcataatatatcgagacgctcaaaattgaacaacggaagcgctcgagaagttcaaatggtcataaattttgactcggtgtccaatttaggcgcatggtatatcgagacgctcgaaattgaacaacggaatctctag

SEQ ID NO: 15395 - DNA, 840 bp, Glycine max
  Peptide Sequence Number=SeqID_132173
atgccatcacctttagagggcaacacgccgtcaccttcagaggactacacgtccatgccttcagaggactgcacgtccttgccattagaggactacacgtcctcaccaacaaagggctacaggtcctcaccttcagaggactacacatcctcgccatcagaggactacacgtccttgccaacagggggctatatgtccttaccttctaagggctacgcgccgtcaccttcagaggactacggctatgcgacctcaccttcagagggctacacgccctcaccttcagagcactacacgtcctcgccttcagaggactgcacgtcctcgccatcaaaggactttacatcctcgccaacagagggctacatctcccaaccttcagaggaatacacgtcgtcaccattagagggctacgcgccctcgccttcagaggactacacgtcctcaccttcagagggctacacacccacgccgttagaggactacacgtcctcgccatcagaggactacacatcctcaccaacagagggctacatgtcctcacctttggaaggctacgcgccatcaccttcagagggctacacaccctcgctatcagaggacaacacgtactcgctgtcagatgactacacgtcctcgccaactgagggctacatgtcgtcaccttctgagggctacgtgccctcaccttcagagggctacacgccctcgccgttagaggactatacgtcctcacctttagagggctacacaccctcgcctttaggggactatacgtcctcgccatcagagggctgcacgtcctcgccatcagagagctacacgtcctcaccttcatag

SEQ ID NO: 15396 - DNA, 234 bp, Glycine max
  Peptide Sequence Number=SeqID_132174
atggaagaacagcaaagagggctacgttgcttctgtcaatgtgctcactcacagaacaggaaagaggggctagggttcaaacgaagaggggaagcaagcaatatttttaaccaggtcatcaagtatagtgggaattggaaaatattcaagttcaatgatgatgcaaaagatatggatggatttaaccgatccggagtaataatattgcagagaggtgagttcaaacctttttag

SEQ ID NO: 15397 - DNA, 663 bp, Glycine max
  Peptide Sequence Number=SeqID_132175
atgtttcccctatcaaatccgaaatccaaatccaaaccccacagtctcacaccttgtcaccctcataaggctaaaacaaggaaacattataaactgaacaagtgtaagagactaaactccttaggcattcacccttttgtgttatcaaaagcttcccacaaaacattctcatacaaagccaaaaattggtgcgactttcttcaccgtttccttaaacattgtcccgacgcgccgaaaacattgaagcatattcggttttattgtttacaaaatagagggagtagcgtgtcgcttatggcgaaggtgacaatgaactctcacgcgtcggcactgtactcactcacagtgatacaattcaatggaagcggcgacatgaaaaatgacaaagaccttcgagcaggtgtgattctttgcccacacgtggctttccttggtcacatcgacgcgcttcagaagcttggtcattgcttgcaagacggttacaacattaaacaaaatgcaatggagggtcgacggtttttggtgcaagccaacgtgcatgaactcaccgtcgtgctcttcaccgagaataacaaagtgtccctggctaatatggagccaccaacttgttccctactcgaggctcaggttagtaaccaggttgggttgtccaatgttaagtga

SEQ ID NO: 15398 - DNA, 312 bp, Glycine max
  Peptide Sequence Number=SeqID_132176
atggctgaggaactacacaggggcgctatgctagactacgacgatcctagttatctcttcttggcgaagttggaggaactcagtctccttttggatataaacattgtggggaaaatacttctccaggaaaatttccttgaacccctcccaagtgatagcagatccctgagttgtcaaactccctcgagcgttgttccatcaatgctttgcactagactacaacatagccattcttctgcttccataggatctacgctgccacagaaaaatgggggatcattcatacgaaatttagataacactgcgtattga

SEQ ID NO: 15399 - DNA, 1683 bp, Glycine max
  Peptide Sequence Number=SeqID_132177
atgtccctccaccgccatgtttgcacaaccacctcaaagctctcagcagcagcagcagcagcgatcccttggaagtacaagaagttcgcgatagcacagggccagaagtccctcactgactacctccacgctactcgctgcatcccttacgcctacgctgacaaaatcgccaagaactccctcacatccctcaccaccctcatcaccactactctcggtggttccttctcccctccccacttcccccacaaccttaacaagttcctcaggtaccaccccatcaacgaattcgagttcttcttcgagagcatcggcattcatccctccaagctcggttctttgctgccccaagacaatttttttttctcagaagatgatacccttttgaatgctgctcgtgttctccatgaatttgggtttccctgggacaggcttgggattttgtatgtggagagtggctgttttttcaagtgcggtgcttctgagttgaagggtaggctttgtgggttcaaaaggtatggtttttgcaatgcgcaggttgtggggatatgtttggcttttccctttgtgtttgatggccaaaagggtgatgaggttgaggctttgttttgtgatctgggattgctgtttggggagcttggtttggctgagtgtgttgaggggaaggggaacaatagtgttgatgattggattggggtgtgtaggaagataaggttgttttatgatttgaatggtgggaggagcttagtggaactcgttggagggaacaatggtgttggtgtaggtgtcattttggagcatggggaagaggagttggttcaagcaactgagtatttttgtagttttggtgcgaagaaggaggatgtggcgcggttgattgtagatggacgggagttgttggagcttgatttgaagacacgggtggttgatgtggtgaagctgttgaaatactttggaatgagctccgacgatgttgaggatgttaggagggattatgctcatgtgttggggacagttaagatgggtaatctgcccaacgtgatgagggctttgggtttacatgaatggttctttggtaagatcaaggatgggaatcattgtttgttagttagttttgttgcgagctatcccaatgaagtccaggatgaaggctatctaggttgcttgaaggcgattcaggagtcgagaaccccaactcacaatattagcaagttgaatttcttgcacgccattggctttggcgaaaatgctttgaccatgaatgtgtatgctcagatgcatggaacaagtgtcgagttacaaaagagatttgattgccttctacgtcttgggattgagttttcgaaggtctgtaagatgatcacgatttatcctaagattcttagccaaaaccctcaaaatttagagcaaaaggttaatttcttttgtcaagaaatgggacactcgctggagcatttggtaacttttccagcattcttgtgctttgacttagagaaccgcattaagcctaggtacaggttccatatgtggattatggaaaagggtctgtcttccaaaaaatattccattgcaagcatggttgcgacaagcaacaagaattttgttgctcgtgcttttaaaattcacccagctgctctgaaacattggtttgagcaattctatccaagaaatttgcaagtgtga

SEQ ID NO: 15400 - DNA, 195 bp, Glycine max
  Peptide Sequence Number=SeqID_132178
atgttggaggatgatgctcctctttcttacttaaaagtaacgctgcattccattatggccttaaccaatcttgagttacaaagcaggtgcattagtagcaccttgatggcgcaacaaaggagatacacctccacagaggaggtgcgacccctgatgccaccgggcgctaggcctcgtggcgcgaggctcccatag

SEQ ID NO: 15401 - DNA, 699 bp, Glycine max
  Peptide Sequence Number=SeqID_132179
atgagtacacagtcatcatctgcattgaatgttgacccacttgttttgttgggatgcacagtaacatatcaatttaaggtggcattccatgttggtaggaatctcattgagataccatcattgtatcatagacaatgggctccacattacccactttatgtgctgcttgactacaatggagacaagcactatataaggctcagaaaacataataacaaattctactttgctgatggactgaagggcttcaggagaaccatgggcattcataaaggtgtcatgatcacatttgttgtgcctgagaagaattggatgttccatatccacttcatgccaccactgcatagaaaaacatgtggaaggcctctcgcgaccactagaactcatgtctttactgtagatgttacccaacgtttgatctcacgcacttatccattggtgctgccaccagatgctctgaattttgttgatgcatcaacaaaatatatgattgtccttggtattcatggtcgtcgtcacctttggaagatgactatccataatgggctacaatctcttggtcacccatggtaccattacttaaccgtaaatgagttgatggccggtgatgaggttgtcttctattacaggcctaaccaacatgtatgggaggtcatcttcaggaagcagatgacatggaatgaagatgagtccggttaa

SEQ ID NO: 15402 - DNA, 476 bp, Glycine max
  Peptide Sequence Number=SeqID_132180
gtaccgatcaagctaaagggaaagtttatcggactgcggtaagaccggcgattttgtacggaacagaatgttgggcggtcaagagccaacatgagaataaagtaggtgtagcggagatgaggacgttgcggtggatgtgtggtaagactcgacaggataaaattagaaacgaagctattagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagaggttataaaaaaggatctcgaaattaatggtttggatagaagtatgctacttggtggtaaaattactaacattaattttaacgatacctattactgtccatacaattcattgttcatacatgggtaa

SEQ ID NO: 15403 - DNA, 558 bp, Glycine max
  Peptide Sequence Number=SeqID_132181
atgtctgccacatccgtcaactccgaacgagcacttgcccctcctgccattcccttgccccctccccctctctctaacttcaaaattggcctctatcaactctctgtcagccccgacaaagacaacaacatcgcccatgctcgcaccgccattcaggatgatgcatcaaagggcgcccaacttgttcttttgcctgaaatttggaacagtccttattccaatgatagtttttctgtctacgctgaggatattgacgccggtgcttctccttccactgccatgctatctgaactctctcgtatcttgaaaatcactattgttggttgttttattctagaaagttatggaggtctcttgtacaacacttgttgcgtctttggcaccgacgaaaacctactagccaaggaccgcaagatacatctttttgatattgacatccctgggaagattacttttattgaatcaaaaactcttactgttggggagactctgacaattgtggacacaggctgtaatccagaaggttcactagagattaattatccgattgtgtcttga

SEQ ID NO: 15404 - DNA, 2412 bp, Glycine max
  Peptide Sequence Number=SeqID_132182
atgaacgacactctccggccattcctgcgtaagtttgtcgcatttttcttcgatgacattctggtgttcagccccgacttggccacccatgttacccatttggatactgttctggcaaccctctcagcccgcaagttccttttgcgacattccaaatgtgaatttgccaagtctcagcttaattacttaggccatgttatttctgcccaaggggtagccccagaccctgcaaaaatccaggccatgttagcttggccggttccaacttccccaactgctcttcgtggtttccttgggttgactggtttttataggaagttcatcaaggggtatgctacagtggcgtcaccactcacggcccttctgcgcaaagacaattttcagtggtcccaggctgcagaccttgcttttcagacacttaagaacctgatgacacaggcccctgttttgtcaactcctgatttctccattccttttacacttgaaaccgacgcatcagcttcgaccattggggcagtgctcttgcaacagggccatcccattgcatactacagcaaaacactctgccctcgattgcaacattcatcggcatatgttcgcgagcttcatgcaattacctctgccgtgcgcaaatggcgccattacttgctgggcaattccttcattatactcacagaccataagagtctcaaggaccttatgtcccaagtcattcagacccccgaacaacagaattacttggtcaaacttctcggttatgactatgaaatcaaatacaagccagggtcaaccaacattgttgctgatgcactttcacgcatttctgatggtgtttgcttgtctttttcggtccctcaccttgattttcttgacaagcttcgtcatacattaactcaggacccccaatatattgaattacttcaggcgattcaatcccggccaacagaacacccttcactttcggttcataaggatttgattttccgtcagggccgcatttggattccttttccaaacccctttacgtctatccttttggctgaatttcattcatcaccactcggcggacatactggtgtggcaaaaaccgttcatcgcgttcgacagaactttgactggccgaacctgcgtgctgacgttcgtcaattcgtttctcagtgtcccatatgtcagctaacgaagtatgaaactaagaagcctggtgggttgttacaaccacttccccctccggctgcggtttgggaagacttatccctggatttcatcataggtttaccctcttcccaaggcttcattgtaattttggtcgtggttgatagattttcgaagggggctcacttcggcgccctcccaactcattactctgcattcaaggttgcttcgctttttctggacatggtgtgcaaacaccatggttttccctggagtttggtttccgatagggactacatttttctcagcaccttttggcgtgagctttttcgattaagtgggacgaagttgcgtatgagtacagcttatcatccccaatctgatggtcagacggaggtcctcaaccggattctggagcaatacctccgttccttcgtccaccacaaaccttccctctggattcgcttccttcctcttgctgaatggtcttataataccacaatccactcaagcacgggattttctcctttcgaggtgatttacggctggccgccgccgtcgatatcccgatatatccagggtacatcatctattgatgcagtcgataacctgcttgttgatcacacagaactttacactgctttgcttcatcacctccataaagcccaggagaaaatgaaggccaacgccgacgcccaccgccgtgatgttcagttctttgtcggcgactgggtttacgtccgcctccgtccttatcggcaaaagtcggtagccaacacttttcacaaactttccaaacgtttttatggcccgttccaggtgattcagcgtattggtgcagtcgcctacaaactccggttaccagcgtattcaaggattcaccctgtctttcacatttccctgctgaagccccaccacggccctttaccggccgaatatactcatcttccaccggacgccattgagaacaacccagttatctccccacagtctattgtggattggaaatgggacgagtctgttaccccagctatcaaaagggtgctcgttcaatgggacggcttggctcctaaagatacctcttgggaatcttgggacgaactgcgtacttcttacaaccttggggacaaggttgttttcggggtagagggtgttgatagcaatacccaggacaataaccacacaacagcaaatagcaatgttcacaacaggcctacaaggatcatacgaatgcccaaacacttacaagacttcgtatag

SEQ ID NO: 15405 - DNA, 984 bp, Glycine max
  Peptide Sequence Number=SeqID_132183
atggccactcagccattccggaaagccatagccaaaccttcttcttcatctacacctccaattccaaacctttcccttgtatcctgcatcacctcaatccttcaaaacctaaatccccaaagcccagattactcaccccccaaacagttctcatctcaccacaccccaaacttggttatcaacgttatcaagaaccagaacattccccaccatgcccttcacttattcaactgggcctccaaccacaaccactactcccacacactcttctgctacgctgccatcactgacctcctgctctctcactccctctccaccactccaactgactctccgacaacctcatcagcatgttcatcaacgctctcggccaccgcggcaacatctggggcaccattcactggttccatggagcgaataccttcacaaaggacactacgtgtattcctgcaacgccatattgggtgtcctcatgagggccaattgtgtcaacattgccaaggccatctacgatcagtgggcatggtcgagagtgcacgcaaggtgttcgaggaaatggttagtcacgggatgaatccagatgtgaaagcgtatcgggttgtcgtcgtcaatgagtattgcaagattagaaaaccaagtgaagcagtgttgcttctgagggaaatggtggtgaggcgtgttaagccaagtatgtcaagctttaatgcagtgtttagagttcttgtggatgaggggaagcttaataaaagagttattcttttgaagcagatgcctaagatgggatgctcgcccaacttcttgttttattgcacaatgatatgtggtctttgtaaagtgaagggtaggatgcaacaagttgaagagctcattttggatatgcttcagaatgggcataacctggatgccactatgtataattgcttactcgcgggatattgtcaagacagggatgaagaaaggacaccaaagatagttatgacataa

SEQ ID NO: 15406 - DNA, 573 bp, Glycine max
  Peptide Sequence Number=SeqID_132184
atgggctcaaaaatctaccctaaggttcatgagaaccctaaggccttctttatcaactctagcccaatcctcttggagcctcttgctcatggctctgtaaaacatgggccttcgcttaaaaagaggttctatcaagtcaaaatcaagagcttagaggtcactagtttacgagagttggggcaattaatgggtcaacttcaacggcaagccttccgcaaagcctatggtaagatttgggacctagctagggtagaagtctccatggaaccgattgcatccctttcccaatattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaaagtgaaaatctcagcacaagagttggaccgtgtaaagcaaaacagaaatggagtagtcggagtaccaaggaagtgtttggaggaaagggcaaaggccttggcaaatcaaggcgaatgggctttcttttattga

SEQ ID NO: 15407 - DNA, 288 bp, Glycine max
  Peptide Sequence Number=SeqID_132185
atggagaggcacaaatgctggcctggctcttgcagtaccaactcaaaggaattgactgacatgactttcatatgcttaaatcaggtgggaatttaccttccttgctatgacatactccgcaattggttggaggaatttacagctaaaaatgcaccaaccacaactacttatgtacctctagtagctggttcattggcacgctctctagcttgtgctacttgctaccctattgaacttgctagaactcgtatgcagtggaaggcaatggagtggagaggaatggcttga

SEQ ID NO: 15408 - DNA, 218 bp, Glycine max
  Peptide Sequence Number=SeqID_132186
acgcatgtgatcttttggcatcatcaaaacatcggcttgatcctttgtctacaggatttacgttggtagacctaaagaaacttggttaccacaatgaccctttcatcatggcagaacaagctagacaaggcaaaacaattggtgttaatgcagaagatgttgattcatacatggacacctatgttagtcctttgaccgctcaaatcactcctaatgtt

SEQ ID NO: 15409 - DNA, 348 bp, Glycine max
  Peptide Sequence Number=SeqID_132187
atgttgcagcaatactaccgtgcaagtgttataaagaaaatatttcaaaggattgattgcgagcacatacctacacctagttcaactaatgatgttgcacaaattcataaacctactaaggcttcatgcatagatagcattaaatctccaccccacctaatccttaatgatgtagctccatgtgcagcttgtaggccttggatcttcttcatcaatggagtcctttgcttcttgaagatcatggcagcggaatggagaagaaaaagagttgagaggagatgccacttcaaggagaagataagtcaagaagaagctcaccaccataggaagtcatggataagagcttga

SEQ ID NO: 15410 - DNA, 291 bp, Glycine max
  Peptide Sequence Number=SeqID_132188
atgcatgaattgcttctctttatggacaaatttgcaataaatgcttggatgttcagtaacatggagagttacttctcaatgatgtatgaaacaaggggtagatgtcaaaattcaaaacaattgctagaacaccggttcaagcttgcaacaaggataactgtggaggaggctgtggataggggtgctcatgatttagtttttttagcatccctagttgtggaactatgccgcagacgggatgttgtcatcgtcaatggtagcatggcaaagctgcggcagaagagatggtag

SEQ ID NO: 15411 - DNA, 909 bp, Glycine max
  misc_feature (687)..(687): n is a, c, g, or t
  Peptide Sequence Number=SeqID_132189
atgaagtggatgacattcatgcaaatcgtaatgatcattatgaaggcttatgggaaaacattcctgccttattgtgttttagataagcatatggctaaatcaccaagctcccctcttcctgattcattagctccttcagagtttacctctaagaggattagacaatgtacacaactcagaagattgactgctaaatactcaaatcaattgaggccagtggttcatgtgaacccttccactgaaaaagctttaggcccacttaaagagaacttccacacctatttggggatagtagctcaagaaaggttgagacaatttgatattccaaaaatgtccaatgccaagaagaaggtcatttcattggtgggtacaagatggaggcaatttaagataagccttaccagtaaattcgtatacgcaaaaaatgagggtctggatgaaaagatatgggaggaattttttgtaaactgcaaaaccccttcttggaaggaatcagaaagaaagctcaagaatgccaaaaacacaacatgtggcaacacgtattgtctcgtggcggattccatagaagagcagatgacacaagacacctttgttccccatggatgtcaggatatattgactactatcattgggcgaccggggcaccctggtcatgttcgtgctacgggaatggagacctttgaagancggtggaagaaagaaatagatgatgaaagcaaatgtagagaggaaaaacttagagaggagttcaaagaggttctacacaatgagttgagccagagggcatcccagcaaccacctgcaataaaggaagttgaaccttttatcagtgcccgtgtgagcacaaagggaagctatgcaaggactgctactaatcctttaagggggaacctcacactactgatataa

SEQ ID NO: 15412 - DNA, 268 bp, Glycine max
  Peptide Sequence Number=SeqID_132190
gatgtgcggaaaaaggcgcaagccattcacaaatagaacactgccccccacgttttgtctcgtgggggattcctttgaggagcaagtgacacagggatccttcatcccacatggacgtcaggatgttctcactgctgctattggacgtccagagcaccctggacgtgtccatgctgctggagccggtgtcaccatcaagcaatactttagatcggctccatggacgtcccgcaactcttccttgctgcctcctgaagaattacagtag

SEQ ID NO: 15413 - DNA, 381 bp, Glycine max
  Peptide Sequence Number=SeqID_132191
atgacgttcatcagctactttttcttatgctggtatctatattggcaggatggggatgttgatttaaatgcctctcctcaagcactagataggctattgggttgtttccttgcattcaaagtgaaggtgcaaccaaggttcaggaattctgttgttcttaaatattcagatgaatcagacttgatcaatgttgtgctagatatgattcccgatagtgagccatgttgcaagatcaagaattcaatacttgagtcgactgatcctacagtgcttgaatttcaatctttgtctattaccgctgatcatgatcggtcaatgcttggctcaagtgagcctacagagcttgaatctcaatctatgtctgttaccgggggatcatga

SEQ ID NO: 15414 - DNA, 1092 bp, Glycine max
  Peptide Sequence Number=SeqID_132192
atggcgaaaggcaatatccatccggtcagcaaagcgatgctgcgtatcgggtgggaaaatcggccggtcaacgtccagagcagtggcggccagatgctggccgcgagagctgaatggccgctgaatccggtgaaatcaaagcgctcgctgccgatgccccagcccataaaggccagtttggacaggcagaccaccccgccggtgaatccgaagatcagcgcccactgccaacccgccgcgcgggtggcgggagacatgagcagcaataaaaacagaatcagcgcgcagggcagcaacaacatgctgtcgccgaaaaaagtcagaaaataccaatccagcacatcaatctccgatgaaagggggcggggagcaaaagtcagcgccggggagtgtaacccgttacggcgcgttgccctagccgcgagattcttaaaatgccgcgtgcccgtggcgtggcagcccgaattcgcccgccgccgcgcaatatacactggcgcatctgcctccggaaaaagccttattgccagcacgttgtaccgcgaactccgcgagcaggtcggcgatgagcacatcggcgttattccagaagacagttactataaagaccagactcacctgaccatggaagaacgggtcaaaaccaactatgaccacccgagcgccatggatcacaacctgctgttccagcatctgcaaatgctgaaagccggcaaggcgattgaactgccgctgtacagctacaccgagcatacgcgcaagaaagaaaccgtccatctcgaacctaaaaaagtgatcattctggaaggcatcttgctgctgacggatatccgcctgcgccaggagatgaacttctcgatctttgtcgacacgccgctcgatatctgcctgatgcgtcgcatgaagcgcgacgtcaatgagcgcggccgctcgatggattcggtgatggcgcaataccagaaaaccgtgcgcccgatgttcctgcagtttatcgaaccttccaaacaatacgccgatatcatcgtcccgcgcggcggcaaaaaccgcatcgcgatcgatattctgaaagccaaaatcagccaattctttgaataa

SEQ ID NO: 15415 - DNA, 996 bp, Glycine max
  Peptide Sequence Number=SeqID_132193
atggcggccgatatcgacctgcagcagttcccgcaccagatcggcgccaaggtgacccagttcaattaccaattggcgggggcagatattccgaacggcggtattcaaggcgagggcaatgctcaggtggtctatcagcagacgccggcgcagattgccgtcagccagctgaacgtcagtgccaataacagccagttgaccggcgatatcagcgccagcctgggggcggtgcccggctatgtggtgaacctgaattcggctaatctcgatctcgacgcgctttccggttggcaatccagcaccaataccgccgagcagcccgccgtgaccgccgcgccggtgatcgccagccaggttgacgatcggcagcagaacctggaagcgctgcgcgatttcaatgcacagctgaatctgcaggcggcgcagttgacctaccgcggtatgaacgttacccagttagccgtcgcggcggataatcaacgcggcctgctgacgctgcataaacttgccgggcgattggccggcggcgatttctccttgccgggatcgctcgatgctcgcggcaataaaccggtgataaacgtgcagccgaccctgaaccaggttgagctcggcacggtgctcaaagccttcgacatgccgcagatgctgaccggcaaattcagcatgaaaggagatttgaccggcgatcgcctttcttcacagtcatttgagcaccgttggcgcggtacggcgcagttggcaatgcaggatgcgcagttgcacggcctgaacattcagcaattgatccaacaggcggtggcgcgcaacgataacagcgtgcgcgggcaagacagctatcagcgctataccgaagtcaaaagcgtctcggcgcgggccagactgagccagggcactgtcaagctcagcagcctgacggcggattcgcctttgctggcgctgaccggcgccggcagcactcgatatgccgggaaaacagtgcgatatggcgcttaa

SEQ ID NO: 15416 - DNA, 514 bp, Glycine max
  Peptide Sequence Number=SeqID_132194
atggaggtacagtatgggagttacagtgaaccagatggtagcaggctgcaaaaggaggcaactactgatgatcgagttggtacaagagaatcaaacatagaaaatatgggaaataaaacagctgctgttggagggtggggcactacattttggaaggactgccaacctatgtgccctccgaatgatgggtctgatgataatttgtcagaagacagaggggaaagtttagactcagaagatgatgatgatggactaaaggactcaggaaaaggttcaataggccattctggtattcctgctgaagagatgttgtctgatgaatattatgagcagaatggggaagagcaaagtgtctccttgcattgcagggttgttcgtcaacccactggatcaaattcacggcctcaacagatgtcttctattgtcaaaagtcgtatgcataagtcgaggatttcagatgatgctgaagataatgatggcgatgctgattatgaagaagaggatgaagcagatg

SEQ ID NO: 15417 - DNA, 357 bp, Glycine max
  Peptide Sequence Number=SeqID_132195
atgacaccatgtgaaactaactcatgggaaaagtgcttaaagaaagtcatcctgtcatgctggagtaccttcaaattttcctttacttcattcaatctcctcactaatcggaaaccttatcggaacaaatccagaaacagcaacaacaagaggctcaaccttccaccagcaggaagcgcgcgagacagagttcaagcgattaggcgaaacagaggaaccgcggggcacaggctagcaatcgtgcgcaccttcgccgtcgagggatcgccggaaaccgaatatccggcggagagtatcgagaagagcgaggcgagaatattggaactccggcggagaagaagtgctgctggcgggtaa

SEQ ID NO: 15418 - DNA, 633 bp, Glycine max
  Peptide Sequence Number=SeqID_132196
atgactctcgaggaatatgaaaaagtactagaagagagaagaaaggctttccacgcacttaagactaaggagagaaaggtagatactaaatttttcgaatccttgcagcatctctcgaacaagaaagacaatgatgacaactttattaagttgggaggtgataacgacaagcgtagagagacacttgacaaggaagataaattaaaaaagggcatgggggacttcttggacgaaatgttaacaatgatgagtcagaccaaatcaaatgaaaatggagaggagagctttgaggagttgcaaaagctttttgaagacatgtttcaagcggatattggattggatggaggcccttctcttgcttcttctgattcctcaacttcatttgcttacatgacttatagtgaaatttctagttcaaataaacgcaattcctctgagatgaatttcgggaaggcagagaattcttttgtctttgatgccagttaccagaatttctgttttgggctttatacactcataggtggtaaaaataagctcaaagttgacaaatgcttcacaactcctggaatggcacctaatcttggaaaggttaaatatgtttttacatcggtgcctatgtcaccaccgatgtag

SEQ ID NO: 15419 - DNA, 1197 bp, Glycine max
  Peptide Sequence Number=SeqID_132197
atgatcatcatcaaaacaccaaaggcagttgcatctacaagatttgtgtatggtaactccgaaggtcaacgtgaacatgatcctccggtgaaatatgacgtagataaagaaacttgggagcaatttgctgcaagccgcaaaactcctaactggcagggaattaggaagaagatgcaagagatccgaaaatggaatgactgcccccatgtactttatcgtggggggtatgatttgcttgaaaagaagatgatggacgagaagatgaacaaaagacaacatgacgcaatgacaactgagaatacaccaaactctggggatcccccaactcccattcaaggacatgtcaagtggattgcctcattggaagaacaaatgagacagggtacctttgtcccccatggtcgtgaagacatactgaacactgccatcgggcgaccggatcatggaggccgtgttcgggcagcggggtttggggtcacaataagtcaatactttggaagggcaacacgtggctccagttgctcatcagggtcgatcaaccaagtattgaaagatgagttgaaggaacaaatcatacttgagatgtcacaaaggggatcgttgatcccaacacatattcaaccagatatacatgggttagtagcacgagtgagcacaaaagggagcaatgcggagagtgttgtcaacccatgtctgcctaatgatgttgctcctgtcgaaccccctatagggttgtatgtgccacgccaagattcaattgagttggtggccttgggaaaaacatatgatggaggctcgaccatacacaatgtggcttatgcagacgatgtcgtaagggttagtgttgagcaagttattgacggtgacgctgaggtcccattcccgacatcagagattaagtgtgtcaggcaggcccttcacacattcattgcatggccaacaccacttcatgagggcagtagtccaactaaagacactgaagctgttgaagcggtcaatgatgttgttgtagatgaccccttgcacgagttgattaagagcctagttgacatttatgagaagcctgtagagttagtgtgggatgctactaaatttggaattccaaatgcaactgcatcattgttcgtaacctgtgctgatgtgaatgaaataatatcaggcgtacaatgtttgaacatagctatactacaattgtag

SEQ ID NO: 15420 - DNA, 105 bp, Glycine max
  Peptide Sequence Number=SeqID_132198
atgtatggtgacgtaggcactgatgtagtaagttgcgctttctacatcattttccagaaagcaacgatgttgaatatgggaacttctacaacagtggtgacgtag

SEQ ID NO: 15421 - DNA, 219 bp, Glycine max
  Peptide Sequence Number=SeqID_132199
atgagaattcaactcaggatctccatgagaatacttctcaaggacttcataaaatgcacttgttgtgttcatatgattttcaaattcttgatcattaaagcaacaaccaggatttatgatgagaatcctgaaactggccaaatacaggctaaaggctcaagtggagaaggacgaaggcccaagtggagaaggacaaagcctccaagtggagaaggatga

SEQ ID NO: 15422 - DNA, 708 bp, Glycine max
  Peptide Sequence Number=SeqID_132200
atggattatttcaatgcaccaggaagaaaccatctctttgttccagggccggttaacattccggaccagatcatccgggccatgaacagaaacaatgaggactaccgttctccagcaattccagctatgacaaaaactttgcttgaggatgtcaagaagattttcaagaccactactggaaccccatttctcatccctacaactggtactggtgcttgggagagtgctctcacaaacacactgtctcctggggatcgaattgtatcgttcctgattggccaattcagcttgctttggattgatcagcagcaacgcctgaagttcaatgttgatgttgttgagagtgaatggggccatggtgctaagcttgatgttctggaatcaaagattgcttcagatacttcacacactataaaggcaatttgcattgttcacaatgagactgcaactggggtcaccaatgacttggccaaagtgagacaaattcttggccctaaagctattgaggcctcaaaacatgctaaatcacttagagttttctttgactggaaagactacctcaaattctaccagctaggaacctattggccatacactccttccatacatttgctgtatggtctgagagctgctcttgatctgatttttgaggaaggactcgaaaatgtgatcgcaaggcacagtcgtttaggcaaagcaaccaggtaa

SEQ ID NO: 15423 - DNA, 132 bp, Glycine max
  Peptide Sequence Number=SeqID_132201
atggtgcggttcgtctatgctcttatctttgggtttgtggctttgaattgcttgcaagtgtttgaagaatccaatgctcaacgcttaccgcaagatgaagttaatattggaacaacaaaagaacttttttga

SEQ ID NO: 15424 - DNA, 297 bp, Glycine max
  Peptide Sequence Number=SeqID_132202
atgtcgaattcgcttaatcaaaggctggttgtgagagatcgtggacgatttcagactgttgatttgctttgcatcgaacggatgagacttgggatggggatctacatcttcaaggcaaccaatgtggcaacatatctagagataaagactttgacactatgtggagtgcctaagggtgaggaggatagagaagagaccaaagcggtgcaagcttcaagaacgagaatgattggtggtgggataaagagcaatggtggtggttggaggagaggctttgggggtgggggcatgcgatag

SEQ ID NO: 15425 - DNA, 148 bp, Glycine max
  Peptide Sequence Number=SeqID_132203
atgtcgaggcgggtccaaatcgacgatgccaaaaacgacgacgtaccagacggtgattcctctccggttgaaccggacaagctccgtaaacgggaccacatcaacgtcccttctcaccccttcttgatgaagcttttgaacaagcaag

SEQ ID NO: 15426 - DNA, 1254 bp, Glycine max
  Peptide Sequence Number=SeqID_132204
atggtagtggttcgagaaaaagatgtctgttgggaatatgctgagaaattagatggaaacaaggtaaggtgtaaattttgccaaagagttctgaatggtggcataagtaggttgaagcatcatttatctcgattcccaagtaaaggggtaaatccttgtagcaaggtcagagatgatgttacagatagagtaaggggtataatagcatcaaaggaagaggtcaaagaaacttctagtgcgaagaagcaaaaaatagcagaagtcaagtctcccagtaatctttcagcaagtaaagctcttgtatctttggatgcagcatcccctgtcatgaagattttccctactggccatcctatgaccccttcctctacaaataaccaagagattgcagagaggagtattgctctattcttttttgagaataagctagacttcagtgttgcacggtcttcatcctatcagttgatgattgatgccattgctaagtgtggtcctggatttactggtccatcagcagaaaccctaaaaacaatatggttggaaaggatgaaatcagaagtgggattacagacaaaagatgttgagaaagagtgggccaccacaggttgcaccattctagcagacacatggacagattataaatcaaaggccataattaatttcttagtctcatctccatccaggacctttttccataaatctgtggatgcctctgcgtacttcaagaacaccaagtggctggctgatctttttgattctgtaattcaagagtttggcccagaaaatgtagtacaaattattatggacagcagtgttaactacactgttattgctaatcatattgtgcagagctatggaacgatatttgtatctccttgcgcctctcaatgtttaaacctaatcttggaggaattctccaaggttgattggattagtagatgtattttacaagcacaaaccatatcaaagttaatatacaataatgcttcattgctcgatcttacgaagaagtacactggaggccaagaacttatcaggactggaatcacaaagtctgtatccaccttcctgtctttacagtctatgttgaaattgagaacaagattgaagaatatgttccacagccatgaatatgcctcaaacacctcctatgcaaataaaccacagagtctttcctgtattacaattgctgaagatggtgatttctggaggacagtggaagagtgtgtggccatctctgagccttttttgaaa

SEQ ID NO: 15427 - DNA, 531 bp, Glycine max
  Peptide Sequence Number=SeqID_132205
atggactacgatttcagaagcaggtcgggcccacaacctccgatgtaccgtccgccaccgccaccgtcaccgatgtaccgtccatcaccgtatcaacagaatcctactccttcttcaggacttggcgttagggttggtataaagccggaatataggatcacaccgccgcctcatttatcatcacttgctggagataatccacggagcaacttccaatttgattttggattggagagaaaaattttagctgaagcagagaaggataacccaaattggagcaaatttggatcagaaaatattccaactaaagtttctgattcatcaacagcaaaggttactgctttggatcccattgtgagcaaatttatggccatggggcttagccgagaggctgttctcattgccgttgaaaattatggtgataatccaaccaaaataatagaattgcggaaaaagtatgattatgtttctgaaaaatattgtcatacatccttctctctgtattctgtaatgaccattctgattgaataa

SEQ ID NO: 15428 - DNA, 699 bp, Glycine max
  Peptide Sequence Number=SeqID_132206
atggatgagaataagtgtaagaaattcttagatatagtcgataaaaagtggagagaccaactccattcacctctacatgcagctgctgccttcttgaaccccagtatccaatacaatcctgaaataaaatttatttcttctataaaagaagacttctttaatgttctggagaaattgcttcctgtaccagatatgaggcgtgacatcaccaatcaaatctatacttttacgaaggcacatggcatgtttggctgtagcctagcaaaggaggcaaggaatacagttgcaccttggctttggtgggagcagtatggtgactctgctccggggttgcaacgagttgccattagaatattaagtcaagtttgcagcactttctcatttcacaggcagtggagtaccattcggcaaattcactctgagaagcggaacaagattgatagagaaacattgaatgaccttgtttatataaactacaatctcaagttagctaggcagatgagtgcaaagtcttcagaagttgatctgcttcaatttgatgatattgacatgacttctgagtgggtggaggaaaatgaaactgcaagtccaacacagtggctggatcgttttggtcctgccttggatggcaatgatttgaatacaagacagtttggttcttctatatttggtgcaaatgaccctatatttggattgtaa

SEQ ID NO: 15429 - DNA, 120 bp, Glycine max
  Peptide Sequence Number=SeqID_132207
atgaagggtagagttaacctagggttagaaagtgagaatgtagtcctgacttatgagaaagcttgggctgtgcaagagaggaaaacaaatgaccaaagtgaaggcaagaaccatttctag

SEQ ID NO: 15430 - DNA, 449 bp, Glycine max
  Peptide Sequence Number=SeqID_132208
gtgcatctttgaagaaaattgaagaaggaaagggcatcattgtgcgatttgttattggtagaagtgaaaatcgtggagacagtcaagataaagacattgatcatgagaataggctgactaatgacttcttaattctcgataatcatgtggaaacaaatgatgcattcccaaagaaggtcaaattgttctttgctcatgctgcagacaaatgggatgctgagttttatgcaaaagtcaatgatgatgtctatgtaaatattgatgccttgggagctacacttgctactcatttggacaaacctcgtgtttacatgggatgcatgaaatcaggcgaagttttctctgagctagaatattttatgattctcatactggtatctgtgaaatatgacaggaaccataaatggtatgaaccagagtggtggaaatttggtgacaaaaaatcgtaa

SEQ ID NO: 15431 - DNA, 246 bp, Glycine max
  Peptide Sequence Number=SeqID_132209
atgtatgattccccctatgttatgtttgcttttggccaagaccttaacttcctagctattccgttggctactatagagcaatggaaatgcgttttattgctaaaccaaagtggaagaagaatagcttgggaagggctatggtgtggtaagactcaaatccaagacctccttatcactccaactcttatgcctctcctcccaatcacaagatcaccttatatctccccacagctatggtggttataa

SEQ ID NO: 15432 - DNA, 504 bp, Glycine max
  Peptide Sequence Number=SeqID_132210
atgcagagcagaggatcgagtcacagagtctccagtatgggcaataatcgatcccgcattcccgcgctcctcatctccatgttcgctgctttcgcttctatctacgttgctggaaggctgtggctggacgcagagaatcgcgtttatctcatcaaagagcttgataggatcaccggccagggacaatctgctatatctgtggatgatacattgaagatcatagcctgcagggaacaacataagaagcttgatgcccttgagacggaacttgctggagctaggcaagagggctttgtttcaaatcccttgatagagactaatggaacttactcgacgagaaggccgttggtcgtgataggtatactgacaaagtttggccgccagaagaatagagatgcaatccgcaaggcatggatggggagtggtaaatatattctttgctttgtcttccttggtgccacttgtcttgagtatacatttgtctatgtgttggtttcaaaatga

SEQ ID NO: 15433 - DNA, 207 bp, Glycine max
  Peptide Sequence Number=SeqID_132211
atgaagaatgaaggggttaaaatcatcaatggcagtcatggccatgagagaagaaaaaaagaaccaaccaggcatccgaaagatccccttaaaaatcgattcataagaacgtcaccacaaaggaacccggctcctaagggttggacgttcatgctcttgtgccagggtgttgatggattgaaaagtgcaccaatgcgtcccaagtaa

SEQ ID NO: 15434 - DNA, 2616 bp, Glycine max
  Peptide Sequence Number=SeqID_132212
atggcgagaagacacagccgcagcagcgagtcgagtgaggatgacgtgaggaaacgccgtggtagtgaatctgaggatgaggagagggataggaggtatcggcgcggtggttggagtaataagaagagttccggtcaccgtagtagcagggagaacggtgatggcagtgattcgggagaagaaagaaatggtgctaagagggatgggaagagtaagagtagggagagaaaggagtctgaaagctctgaggaggaaggtcagattgtgagcaaagagaggattagggaggagaagaaggaggatgcaagattgcagcggcgtcatgatgggcgtggagggagagacaacgaaggagatgaccgggatggtagggagtctcatcgagggaatgaccaggatgaaaagcgaggggagacagagagtcacagattgcatcatggtgatagatggcgtggaggtgatgaggacaggcagaaaattaatgatcgtcgtgggcgacatgattcggaggaagaggattacagggagctggccaggaaatcggaaagggatagagataataatagggatagggataggagacagagagttgaaaagggtggtgacaatgagagggatcgccgcatgcgtcataattcggaggaagaagatgctagggagttggctaggaaattggatagggatagggatagggacagggacagggataggaggcgtagagttgaaaaggatggtggcagtgagaggaaccatagggagaaggatgtgagcaagcggcaagaagaaagtaggaagaaagaggatggaaatggaagaatggttgaagatgaaaaacctcaacgacaggcaacaataccgggaggtaacctgaatggtgatgcatctaatttgggaaagagtggaggtgtttacattcccccctttaagatggcaatgatgatgaaagaagttcaggataaaagtagtgttgaatatcaaaggttaacgtgggatgctttgagaaagagcattaatgggcttgtaaataaggttaatgctactaatataaagaatattattccagaattgtttgcggaaaacctgattagaggaaggggactcttttgtcggtcatgcatgaagtcgcagatggcatctccgggatttacagatgtttttgctgccttggttgctgtcgttaatactaagtttcctgaagtgggggatcttttgctaagaaggattgttttgcagctgaagagagcttataagcggaatgacaagcctcaattactagcagctgttaaatttatagcgcatctggtgaatcagcaagcggctcatgagatcattgctcttgagttactcacagttttactcgagaaacctactgatgacagtgttgaagtagctgttggttttgtcaccgaatgtggttcaatactgcaggacctctcacctaaaggccttcatggtatctttgagcgttttcgtggaattcttcatgaaggagaaattgacaaacgtgttcagtttctgattgaaggtttatttgcaataagaaaagcaaagtttcagggctatccagctgttcgtcctgaactagatcttgtggaacaggaagatcagataactcatgaagtctccttggatgaggagatagatcccgagatttcccttgatatattcaagccagaccccaatttcctggagaatgagaagcgttatgaagagttgaagaaatcaatgctgggtgaggaatctgaagatgatgaggaaggcttggattctgagtcagacgatgatgatgatgaagatgatgagtctgacgaagaggaagaagaacagatgcaaataaaagatgaaacagagacaaaccttgtcaatcttcgaaggacaatatatttaacaattatgtctagtgttgattttgaggaagctggtcataagcttttgaaaattaagctagagccaggtcaagagatggaattgtgcattatgcttttggaatgttgtagccaagagagaacctatctcagatattatggtcttctggggcagcgtttctgcatgatcaacaaagtacaccaagaaaattttgaaaagtgctttgtgcaacagtactccatgattcaccggcttgaaacaaataaactgcgaaatgtgggaaagttttttgctcatttacttggcacagatgctctaccttggcatgttttatcatatatacgcttgactgaagaggacacaacttcttcttcacgtatatttattaagattctcttccaggaattatcagaacatcttggaattcggctgctaaatgagcggttaaatgatccgacgatgcaagaatcttttgaatccatatttccaaaagataatccaaaaaacacacgattctgcattaacttctttacatccattggtcttggtggtcttactgagaacctacgtgagtatttgaagaatatgccacgtcttatcatgcaacaacagaaacaagtttcagaatctgaatcagatgatgagtcaggaagttctgattcatcagattctggaacagctagttcagactcagactcagctagttctgatgaaagtgacagaagacgaagaaagcggaggagaaagtga

SEQ ID NO: 15435 - DNA, 368 bp, Glycine max
  Peptide Sequence Number=SeqID_132213
atgggggagggtgggggtagggatgaggtttcgtggaatgcaatgatcgtggcatgtgggcagcaccgggagggaatggaggcagtggggttgtttagggagatggtcaggaggggtttgaaggttgatatgtttaccatggcgagtgttttgactgcgtttacttgtgttaaggatttggttggggggaggcagtttcatgggatgatgattaagagtgggttccatgggaattcacatgttgggagtgggttgattgatttgtattccaagtgtgctggcagtatggtggaatgtaggaaggtgtttgaggagattactgcaccggatttggttctttggaacacgatgatttctggattttcact

SEQ ID NO: 15436 - DNA, 678 bp, Glycine max
  Peptide Sequence Number=SeqID_132214
atgggtccacttaaaaaaagatgtccaaggctcaatagtcaaaacatgcttggcgcagttcctttctggcttcattgggtgaagccgaaaaaaccttgtataggggaactgattttattgaagtcattgcctgataaattgatgtaccttgaatgggatagattctatctcaagtctttgccgtctaacttttgtgctgaacaaattgtagagctccacatgcctgatagcaagcttaaaaagccttgggacggggttcagaatcttgctaatttaaagataattagcctttgtggttgtcgaaaccttattgagatccctgacttatccaatacagaaaaacttgaatctgtttttctccacgaatgtgtaagcttgcatcagctccatcatgttcatgcaaaatctctccaaagacttttagcctatggttgttcatctctcaaggaattctcagtgatatcagaggaaataacagaattgaacttaggtcacacagctatatgtgcattgctgtcatcaatttggcagaagaggaaacttactattctttctctagacaattgtaacaatcttgagtttgttgggatcaacattgtccacttatcatctttagaaaggttaggcctatcaaaattaactgcatttctctggagacagactttactcaacagctag

SEQ ID NO: 15437 - DNA, 306 bp, Glycine max
  Peptide Sequence Number=SeqID_132215
atggcaagggatagctgcctcactcgtgtcaccgccggcgccgctatgggcggcgctgtcggcggcgccgtcggtgctgtgtatggaacatatgaagctattaggtacaaggccctaatttcccaaacagtaaccgtgcctgtcccagctgtgcatcaactggctgcaaactttctggcaatgcctaatactgtgcctggactattgaaaattaggcatattggacaaactacacttggaagtgctgctatttttggtcttttcttgggtgctggaagcttgatacattgtgggaaatcatactga

SEQ ID NO: 15438 - DNA, 1067 bp, Glycine max
  Peptide Sequence Number=SeqID_132216
gtgatgcattggctatcaaatctgacgttccttacaatcgtgtttcagtgaataatgctcttgttgctatgtattccaaatgtggaaatgttcatgatgcaagaagggtttttgataccatgccagagcataacacggtgtcgctgaattcaatgattgcaggctatgcacaacatggtgttgaggttgaatcgctcaggctttttgaactgatgctggagaaagatatagcacctaacagcataactttcatagctgttctttctgcatgtgtacacactggaaaagttgaggagggtcagaaatatttcaatatgatgaaagaaaggttttgtattgaaccagaagctgaacattattcgtgcatgatagatcttttgggtcgggctggcaaactcaaggaggctgagaggattattgagacaatgccatttaatcctggttctattgaatgggctactttgcttggtgcgtgtaggaagcatggaaatgtggagctagctgtgaaagcggccaatgagttcctccggctggaaccttataacgctgctccgtacgtaatgctatcaaatatgtatgccagcgctgccagatgggaagaggctgcaacagttaaaaggctgatgcgggaaagaggagtgaagaagaaaccaggttgtagttggattgagatagacaagaaggtgcatgtctttgtggctgaagacacttcacatccaatgataaaagagattcatgtgtacatggggaagatgttaaagaaaatgaagcaagcagggtatgtaccagatataagatgggcattggtgaaagatgaagaggtagagccagatgaaagagaaagaaggttattgtatcacagtgagaagctagcagttgcattcggtttgatctccactgaagaaggggtgcctatactggttgtaaagaacctaagaatttgtggtgattgccacaatgccgtcaaacttatttcagccctcactggcagggaaatcactgttagagatacccacaggtttcattgctttaaggaagggcactgttcatgcagggactattggtga

SEQ ID NO: 15439 - DNA, 117 bp, Glycine max
  Peptide Sequence Number=SeqID_132217
atgggtgatcaagaaggcccatggcctagggcagtgacctccattgcacttaggaggggtgctgttctaaggagatatcctaaacctgctacaatggaacgggaattgtgctactaa

SEQ ID NO: 15440 - DNA, 267 bp, Glycine max
  Peptide Sequence Number=SeqID_132218
atgagagagaataacaacgaggttgtaatcacggcaggggaagaagagaatcacgtatcgggagggcatcttcgtcattccagggacggaatctggtggtcagttgcgaaatcattgccacgatccacggcggttctcatcttccccgtcatgctcatcatcggcgcgttgacttacacgcgcacgctagacacacatatgctacttaattgtttgtttcgtacgttaatgctgtctgaagcagagacacgttggggaattccttag

SEQ ID NO: 15441 - DNA, 228 bp, Glycine max
  Peptide Sequence Number=SeqID_132219
gttttttcatacctaccgccggttttcttgatgttgtggttgtctgaacgcgtctggggagagttggaaaaggtcctggccccttctccttattctcctcttcctcattgtcattcaatgtgggttaagacttttagagtgcaagaggcttatgcagtgaatctaacgggaaagccatcccttgaaccactagatttctttcttcctttggtggacattaataagtga

SEQ ID NO: 15442 - DNA, 264 bp, Glycine max
  Peptide Sequence Number=SeqID_132220
atggtagacgacgagattcagctagaacggtcaagtgcgtcaaaaatgaaaacaaggactggaatgtgcccagaaggaaccaacgaagctactgggctggtccagcgtgtgatagagattcaggccatgcgacttctagggatgggtcgtgctcttcaaggcgcacctaactctgggttcgtcgaaagaaaagacggcggcagacgatggtcagagacggtggcaatgccggagacagtcaaaacgggatcgtacccgctctaa

SEQ ID NO: 15443 - DNA, 375 bp, Glycine max
  Peptide Sequence Number=SeqID_132221
atggtgaattcctcccacttccttttcattcaggaacacgtcatagaattttggcaggaggtaatggatgcgttgggtccaaatattaaaattgctgtggtagagggaggtatcagagtggaagatgtgagggtggaagaagtcaaagtgaaagatgtcaaagagagcaaacctatggctactgtgttttgccacttcggttcgtgggtcacaagtatgcacgtagtggtggtgaatggttgggtggttgctctggtggtgtttcgtgtggtggtgttgttgggtggttgggtggaggtggggcttggtggtcatgtaggtttgggggagaggttactagggtttgctggagagaggaagggtaagaaggagtag

SEQ ID NO: 15444 - DNA, 360 bp, Glycine max
  Peptide Sequence Number=SeqID_132222
atgaatagcctaaagtactaccaatacgcagtgttctctttcgttgttgttggtcgtgctcgtcctcctttctctcggcgatccgaagcgcaaaaccaccgcaatccctacgaatttcgtgtctcgatcccgaatctcaagattcttagattctcttcgtggcacaggatggctttttcttttgttttgttgttgcacgctcatagtcatagggatagctattctgcttatatagttaaggatgttcaagttcattcttggagatggttgagggcaaggaggaaaggttttacttattctttgacatcatggatatcaaatcctagaaatgtcttggagaaagttcaatacatcttttga

SEQ ID NO: 15445 - DNA, 3222 bp, Glycine max
  Peptide Sequence Number=SeqID_132223
atgtgtccatccatctctgtagctctgaaccaggaaggcctctctctactttcatggctttcaagcttcaactcctccaactccgctacggccttctcttcatgggatccaacaaacaaagatccttgcacatgggactacataacatgttccaaagaagggtatgtgtcagagatcataataacatccattgatctacgtagcggcttcccctcacggctcaattctttttaccacctcaccactcttatcatctcaaatggaaatctcactggtcagattccaagttcagtgggaaacttgtcctctttggtcactttggaccttagcttcaatgctttatcaggaagtattccggaagaaataggaaagctatctaatctgcagttgttgctgctgaattcaaattccttgcagggtggaattccaaccacaattggaaactgttcaaggcttcggcatgtggcgcttttcgacaaccagatctctggaatgatacctggagaaataggccagttgagggctcttgaaacactaagagcaggaggaaatccaggtattcatggagaaatcccaatgcagatatcagactgcaaggcccttgtttttctgggacttgcggttactggggtttccggggagattccaccaagtataggagagcttaagaatctcaagacaatttctgtctacacagcacacctcacaggtcatatcccagcagagattcagaactgctcagccttggaggatttgtttctgtatgaaaaccagctttctggaagtattccttatgaattaggctccatgcaaagcctcaggagggtgttgctgtggaagaacaatttaactggcaccattccagagagtcttgggaactgtacaaatctcaaggttatagatttctctttgaattctctgcggggtcagatacctgtgactctcagtagtctactcttgttggaggagtttcttttgtctgataataatatttatggagaaataccttcctatattggcaacttttccaggctgaagcaaatagaattggataacaacaaattctctggggagattccacctgttatagggcaactgaaggaactcacactcttctatgcctggcagaatcaactgaatggaagtataccaacagaactatccaactgtgagaaacttgaagcactcgatctttcgcacaatttccttactggttccattccaagttcactctttcatctagggaacttgactcagttgttgctgatatcaaacagactttcaggtcaaattccagcagatattggaagttgcaccagcttgatcaggttacggctgggatcgaacaactttaccggtcaaattccatcagaaataggtcttttaagcagtctgacctttcttgagttgtcaaataatctattcagtggagatattccctttgagataggtaactgtgctcatctagaattgcttgacttgcacagcaatgtgctgcaaggaaccattccttcctcgttgaaattcctagttgatcttaatgtcttagatctttctgcaaacagaataactggaagcattcctgagaatttgggcaagcttacatctctaaataagttgattctgagtggaaaccttatctctggtgtgatccctgggacactggggccgtgtaaggctttgcagttgctggatataagtaacaataggatcactggttctattcctgatgagattggttatttgcaaggattagatatcctcttgaacttgagttggaattctcttactggccccattcccgagaccttctcaaatctctcaaaactatccatcttggatctctctcacaacaagctcacaggtacactcacagtactggttagtcttgacaatcttgtgtctctaaatgtctcctacaatggtttttctggttctcttcctgatacgaagttcttccgggatatacctgctgctgcatttgctggtaaccctgacctttgcattagcaagtgccatgcaagtgaaaatggtcaaggcttcaagtcaataagaaatgttattatctatactttccttggggtggttttaatttctgtttttgtcacttttggagtaattttaactctcaggattcaagggggaaattttggaaggaattttgatggaagtggtgaaatggaatgggctttcactccattccaaaaactcaacttctccatcaatgacattttgacgaagttgtcagaatcaaacattgtgggaaagggttgctcgggaattgtttatcgtgtggagactccaatgaagcagactattgcagtgaagaagctatggccaataaagaaagaagagccaccagagagagatctctttactgcagaagttcagacccttggatcaataagacataagaatatagtaagacttttaggatgctgtgacaatggaagaactagattgctattatttgattatatatgcaacgggagtttgttcggattactccatgaaaatagattgttcttggattgggatgcaaggtataagatcatactgggagtagctcatggtctagaatatcttcatcatgattgtatccctccaattgtccatagggacattaaagctaacaacatcttggtaggtccacaatttgaagctttccttgcagattttggccttgcaaaactcgtgagttcctcagagtgttcaggagcatctcatacaattgcaggttcttatggatacatagctcctgaatatggatacagtttaaggatcacagaaaagagtgatgtgtacagctatggtgttgtgctccttgaggtcttaacggggatggaaccaactgataacaggattccagagggtgcccacattgccacatgggttagcgacgaaatccgagagaagagaagagaatttacatctatccttgaccagcaactagtattgcagagtggaacaaaaacctctgagatgcttcaggttctaggagtggctctcctatgtgtgaatccctccccggaagaacgacctactatgaaagatgtaactgcaatgctcaaggagatcaggcatgaaaatgatgatttcgagaaaccaaattttctccataaaagcgtggttaccaccaatccaaaagcagcagttcactgttcaagtttctccagatcatgtgaacctttaataatagaatcaacatcttcttctgtatag

SEQ ID NO: 15446 - DNA, 612 bp, Glycine max
  Peptide Sequence Number=SeqID_132224
atggcattgagactgagactcaaagtgtcttcaattgggtcaccttttctgcagttaggttcttctgcaagtgcagcatgctctgtttccaaacttggttttcatccaccacgcttgcaactcaacaaaaattcacacccaataaggctttttgttcgggctgctagaattgagtccaaaggtgttaccttgggtttcaggaccccacaatttcagcttccggagccccttaccgggacgacctggacattggatgattttgaagcttatccagctctactggttatgtttatatgcaatcactgtccatttgttaagcacctgaaaaaagacattgtaaagcttacaaagttctatatggaggtagtcaaatcaattaccctggaagaaatatttttccttcttcaggagcaggttggacttgcacaaaaaggacttgccgtcattgccatatcttcaaattccgtagccacacacccccaggatggtccagaattcatggcagaagatgctaaactgtttggttatcctttcccatacctatatgatgagagttttccaaactctatcattgttaactcattgacaagtgcaccaaagtgtctcaagtaa

SEQ ID NO: 15447 - DNA, 120 bp, Glycine max
  Peptide Sequence Number=SeqID_132225
atgaggattgaagaagatcccagagttcaggaaacaagtccgaaagtgcaggaaataatagcccataatccattggaagaacattgtatgggtcctgctgcacaacaactgccaacgtaa

SEQ ID NO: 15448 - DNA, 144 bp, Glycine max
  Peptide Sequence Number=SeqID_132226
atgtctgggcttaatgaggctatcacctgcttagtggatttcgcgctaagcgcgcctttgggtttctttgtggactttcttcacgttaagacttggccgctaagcacggaggaaaaagttaaccctaaaggtgtgtttgtttaa

SEQ ID NO: 15449 - DNA, 138 bp, Glycine max
  Peptide Sequence Number=SeqID_132227
atgcagttggatgagaattcaaaagtcgtgaaggtggagtttttttatgatccggcagaactgttgggaggtctcctgaaaggtcctgaggatggaacaccggctagagctagcagcacaagttcaaggaagccttga

SEQ ID NO: 15450 - DNA, 333 bp, Glycine max
  Peptide Sequence Number=SeqID_132228
atgaaggaactgggagtggttgcagtgatgttgacggcacagttactggatgtgatcgtcaacactctgagccaagcagccatgaagaagggcatgaataactttgtattcgtcatgaagagaacacttcctccactctcgtataacaaccttggcctgttatttgttgttggcttgttcagtgttattggagcagccatagtagttattggtttttatgctgttatttgggggaaaactcaagagaaggtggaggaagattgtacagtttacaactctgagtcatacaatgatgaggtccctcttttacagaacaagaaaatgggggaataa

SEQ ID NO: 15451 - DNA, 855 bp, Glycine max
  Peptide Sequence Number=SeqID_132229
atggggaagttgactcttccgtttgtgggaatgattatggcagagtttgctcaggcttttgggtatgctgggatttactacggctcagctacactcagcacgtccatactcaacctcgttcctggttttactttcatacttgctgttctttttagaatggaaaaattagactggagaaaattaagtagccttgctaaattgttaggaacaatagtatcaattgctggtgcatttattgtgactttgtacaagggccctgcacttttgatgggagtgtcatccgcaaacacatctcagcagccacttttatcagaagattctaattggatactcgcaggtttatttcttgcggccgattgtgtaatggcttcagcatatattattgtacaggcttctattcttaagaaatatccagcagagttgattgttgtattcttttattgtttctttgtggccattcaatctgctgtgacctgtttggttgtggaaagagacatcagtgcttggagcttggaacctaagctaaggttgcttgcagttttatactcgggagtctttggctctgcatttcaagttggtattatttgttggtgtttgcaccagacaggaccggtttttgtttccatgttcaagcccttaggaatactcatatcagtggttttaggtgttctcttcctcggggatgcattctatcttggaagtctgataggtgctaccgtgattgttgttgggttttattctgtattatgggggaaagccaaagatattgaagatgctgggctcagcttggagtcaaagggcaaacaggccccacttttggaggaaaacagccatgaagacatacaagggcattag

SEQ ID NO: 15452 - DNA, 378 bp, Glycine max
  Peptide Sequence Number=SeqID_132230
atggggggtgcactcaagaaacttcatctacaatacattggaaggtggggtgaacttatcaagtatggggtgcactccggaatcttcctcaagaagcctttgggcggcaaccacatccattttgttaaaaaatggcatccggggcatccagggcttccgggggtgaacttagtaattaagggtgcgctcagaaatcttcctcaagaagcctctgggcggcaagcacctcccgtatgctatgcatttcaaggatccctaacccctatgctatgcatttcaagccgaggtgcttccgtaacgcttccgagacgtttccgtgaacaaatccatgaagattttccatcgttcttcgtccgttcttcggtcttcaaccggtaa

SEQ ID NO: 15453 - DNA, 1212 bp, Glycine max
  Peptide Sequence Number=SeqID_132231
atggcagaaaatcttttacaattccctcaacaaaacaagagtctgaaagaagttggtgaacaatattatgatgatctattatcgaagtccttctttcaacaatcaagtgaagatgaagcattgtttttcatgcatgaccttctcaacgatttggcaaaatatgtttgtggagacatctatttcagagagttcggtattcaacaactgggagaactcaatcttcgtgaaagtctatcaattggggagctgcaaaatattgagaatccctcatatgcattggcagcagatttgaaaaataaaatacaccttgtggggctgaggttaggatggaattggaaccaaaaccagatccctgatgatccaaagaaagaaagggaagtacttgagaatctaaccttcgaagtactggaaaagtttgtcaatcagcaactatggtggtacagaatttccaaatgtaaatattgcctatgtttgcctccccttggacatttgccatttctcaagacactgaatattcaaaggcttgatgggatagtgagtattgattccagttttcatgggagtggctcttcctcatttacatccttggaaacattggagttttactgtctgaaggaatgggaatgtagagctgtgacaggtgcttttccacgtcttcaacgcctatgtatagtggaatgccccaagctgaaagggtccctaccagagcaacttctttgtttaaagattctgctatttctaactgcaaacagcttgtggcttcttgaaatttgtgaattagaactacaagactgtggaaagattgcctacacattgaaaattgtccaaagctcaagtctttccttgaagaaggagctctgggagccaacacccctaaaatccttgtatattcaaaatctagatgttgagtcttttcctgatgaaggtttgctgccactttctcttaaacgtatacaaatcgataaatgccgaaatctcttaaacttctacaacaagggcctctgccagctctcctctcttgaggaattgagtcttggtaacaaccccaacctccaatgcttaccagaggagggtctacctaaatccatttcaactcttgatattttggactgtacattgctcaaacagcgttgcctgggaccaaaaggcgaagattggggaaatattattcacattaaaaacgtatgggttgatcataaactagtacgatga

SEQ ID NO: 15454 - DNA, 141 bp, Glycine max
  Peptide Sequence Number=SeqID_132232
atgggagatgcaaaccttagtttggcacacttagggaggctaactccttacccaaaattcaatcttgacaagaagatgcttgttttaaggtatcaagcaagactcttggaatactttggaatatcactttctcatgtttga

SEQ ID NO: 15455 - DNA, 288 bp, Glycine max
  Peptide Sequence Number=SeqID_132233
atggaagcaaggaagaagaagaagggtttcagaagcagagaagaagaaaggtttcggggtttcggaaacaaagaagctgaagggatgtcgtctcaagtttcgaagcatgttacagagcaagagtctggtcaggacctgttcgaatcgaaaagagagaagagtcttttgaaagggattcccaggttcaaggaagtatttgcgaagtacaaggctaggacaggaaagagggcttcgaatcattgggcgattcgagttggtgtatggtcgagtcgaagtcaaggcagctag

SEQ ID NO: 15456 - DNA, 528 bp, Glycine max
  Peptide Sequence Number=SeqID_132234
atggattcaaatgcttgtctaccacacttgctagtgttagcaataacattggtattggttagtcatgcaatgggagattcagctcaagacaaacagagatgtgcagaatccctaacaggtgttacaacgtgtctgccatatttgggtggtgacacgaaagcacccacagcagattgttgcagtggtctcacacaagccatgaagaccaacaagaagtgtgtctgcgttattctcaaagacagggatgatcctgatcttggcttaaagattaacatgacaattgctgctgcacttctgcacttggatcctaaatcacctgaagctcaagcttttaatcaaattgatcagaaatccaatggtggttctatccgtccttcgcccactccttctgttgaaggaagttcccagaatggtagaaagcaggggacagatgaaacggccacagctaagaatagtgcatcttatatcaggaagagattgttagaaagtttggttgcagttgcagggcttctaatttggctttcatga

SEQ ID NO: 15457 - DNA, 642 bp, Glycine max
  Peptide Sequence Number=SeqID_132235
atgacactaatgaaccaaagttcagatccttgtatctattctgtagcacaaaatagtacacattactcttccggatatagtatagttattgtgctactatggctgaaaggaagagaagatgagtaccgaaacattctgggtttggtaacaagcattgatctgtcaagtaacaaattattaggagaaatacctagagaaatcacaagtctaaatggattgaactttttgaacttatcccacaaccaagtgattggtcatattccacaaggcattggtaatatgggatcattacagtccattgatttttctaggaatcaactttctggtgaaatccctccaaccatttcaaattcgagctttttgagcatgctagacttgtcttataatcatttgaagggaaaaattccaacaggaacacaattgcaaacctttgatgcctccagctttattggcaacaatctatgtggtccaccactgcccataaactgcagctccaatgggaaaactcatagttatgaaggaagtgatgagcatggagtgaattggttgtttgtcagtgcggcaattggatttattgtgggattctggatagtgattgctcctttgctgatttgtagatcatggcggttgatcaatttgtag

SEQ ID NO: 15458 - DNA, 651 bp, Glycine max
  Peptide Sequence Number=SeqID_132236
atgggaaatgcagcagtgactccatgctttcatccaaagaattcattgttatcgtcatcctcatcgtcgaaacttattttctgggatggcaccatgagatctctcaagggtaagcacattgctagtgagatcatgcttgagttcccaaacaaggtagtttgccatgcaaattccttcttcattggacacccaattcctgctttagccttagaggacgaactcattcaaggtgaagcctattttgttctcccaattgatagcttcacatgcaaaaccctatctgtgtcttcactcttgtccttgggatcacacccaaataacaaatccaccatcaaatttggggagtgtgcttttgagtacttgaaaggttccaatggaaggatgctgataaaggtcactcctgagttcatcacaagcctagtcaatagaagtaaaagaccatgttgccccagcagcaatgttgacaacaacttcctatgtagcactcctgagttgagaaaacactatcaaatgcttgtgaagtctaaggaccaagtttggtcacctaagcttgaaaccatttcggagtacaaggttaagttttcaccgggtagatttataggtttagaaaggaaagaaaaagaaaaggcagaggttgtatctactagatag

SEQ ID NO: 15459 - DNA, 969 bp, Glycine max
  Peptide Sequence Number=SeqID_132237
atgaagatcttaaaagggtatataaaggatctacatcgaactgaagcatctattgttgaaaggtgtgttgcaaaagaaactattgagttttgtttagagtacattgaaaaggcaaaacctattaggattcccgagtctcgacatgacaaaagaaagggagatccttgtgaagaaaggtggttagtggttctacacgaaaaaaccattggtgttaatgttgaagatgatgattcaaccgttgatacttatgttagtccttcctccacacaaatgccgcctaacatcaacggagaagaagaagttgacgaccacatagctacaccacccatctcccctcttcttcctcctgagtcattaacaccttcgccatctacgtcgaaaaagacaagaaaagtaacacgactcagatcattggctaccagacctgttggggcggagagatcagtggtttatgtgaatcctgctactgggaaaattgatggattacctgaaagagtaggcctcacaaggaagctttgtcgtccatggacatcgagatgtactaattgctaccattgggtgaccagagcaccctggtcgtatccatgctactggaaccggtgtcacgatcaaacaatactttggaccagcttgaagaagctccctcacgtctacatccatgactctagaagccctagagcaactgacacaaaaaaccagggactggctggaggaggactcgcactgtctcctgagcttgaggttggtttttctggtactcttgccagaacaaagggaagttgtgtcaatccctcgaggcaggacccagacacagtttatgaggggttgacgaccacccacaatgtccctttgggcaatgatcaagtgaagatcggtgttgagaaagctcgagatgctgattctcgtgttcttgtacccactcaagaggttcagttaatgaggcaaacacttaataccttccttgcttga

SEQ ID NO: 15460 - DNA, 2184 bp, Glycine max
  Peptide Sequence Number=SeqID_132238
atgggccacatcatctcctccgacggcatcgcaccagaccccgataaaattcaagctatggtcaattggcccaccccgacatccaccactagcttacgagggttcctcggtctcacgggcttctatcggaagttcatcagaggctacgcctctatcgctgcccctctcaccaatctcctccgcaaagaccagttcgtttggtcgccggctgccacctctgccttcaaccaattaaagtcatacatgacttgcgcccctatcctaaccactcccgatttcaccattccctttatcatcgaaacggatgcatccgcatttgctatcggagcggtcttggtccaacaggatcatcccattgcgtactatagcaaggtcctctgccctcggttacagcgtgcttcagcatatgtccgggagcttcatgcaatcacctcggcggtccgcaagtggcgccactatcttctgggttcttcattcaccatccttactgaccataggagtcttaaggagctcatgtcacagacaatccagacgccggagcaacagacttacctggtgaagcttcttggttacgattacactatccgttacaaacctggggcccacaatgtcgtcgccgatgctctatctcgagtccctaccggcgaattcctctcccttaccgtgcctcactgcgactttctcaataccctccgccaagctttaatggctgacacccaatatcaggaattactccacgaaattcaaactacacctgccgcccatcatggtctctccattcgtaatggactcattcttaaagaccatcgcatctggatacctttccccacggccctcacatccacattgcttgaggaattccatacctctcccctcggaggacacaccggagttgcaaaaaccctccaccgcctccgacaaagttttgactggcccaccatcaagaaggatgttcagcgttttgtgtcccattgcacagtctaccaacaaaccaaatacgaaacgaagaagccctctggtttgctgcaacctttgcctatcccggcaaggatttgggaagatatgtcaattgatttcattaccggcctcccgccatcacagggccatactgtcattatggttgtagtcgaccggtattcaaaaggggctcactttggcgctcttcccacccatcacactgctcatcaggtcgccgtccacttcctcaccctcgtctgcaaacttcacggttttccgcgtagcttagtctcagacagggacgctttgttcctcagccaattctggaaggagctcttccgtctcagcggcacccagcttcgaatgatgacagcgtatcatcctcagtccgacggacaaaccgaggtcgtcaatcggactttggaacaatatctccgcgcctacgtccaccacaaacccagccactggtttcgatacttgcaccttgcggagtggtcttacaataccacggtacattccagcacgggttttaccccgtttgaaatcatttatggccggccccctccttccacggttgactatatccgcggttcctcccccattgatgctgttgactcactgttaacagaccgaacggagcttcacgcactcctccagcggcgcctccaaaaaacccaatcttctatgaaggccaccgccgacaagcaccgccgcgacactcaattctccatcggggattgggtttatctccgcctccgcccctatcgtcagaagtccttagcccaatcatacacgaagcttgctaagcgtttctatggcctgtaccaagtgactgatcgtatcggccccgtcgcttacaagcttgccctccctgccacctctaggatccacaatgtcttccacgtgtcattattgaaacttcatcagggcccctcaccaactaccgacgctccacttccccctctggccgttgatcaccatcccctcgtcagtcctttaaccatattggactggaaatgggacacttcggtcactcccccgctacgcttggtgctcgtccagtgggccggtttacctccggaagatacgtcctgggaatcttggtctgagttacagtcaacctacaacctcgaggacgaggttgtttttggaggcgtgggtgttgatagcattatgcagaacaaggccacagataccaataacagcagcactaacaagcccaagaga

SEQ ID NO: 15461 - DNA, 300 bp, Glycine max
  Peptide Sequence Number=SeqID_132239
atgggtggtgagggtcgaaagaaccgcgtccagatgagggacatgggaatgaaggtcactgctatagacgaggatatcgtcaaaaaatactgcaacaaattttcggagaaacggccggagagtgtcgttcatggcggattggaaggtggagggcgcattgcagaagccgaagggcattacgcggaactcgtaatgaccctggtgccatgcgaatctgatggaaaccctaccggaggtcgagcttcgagaaccaggaggcctttccaagatcgtcgaggagttcgtccaccgtcggcatag

SEQ ID NO: 15462 - DNA, 645 bp, Glycine max
  Peptide Sequence Number=SeqID_132240
atggggaatgcagccgtgactccatgctttcatccaaagaattcatccttatcgtcgtcgtcgaaacttattttttgggatggcaccatgagatctctaaagggtaagcacattgctagtgagatcatgtttgagttcccaaacaaggtagtttgccatgcagattctttcttcattggacacccaattcctgctttagccttagaggatgagctcattcaaggtgaagcctattttgttctcccaattgatagcttgatcacatgcaaaaccctatctgtgtcttcactcttgtccttgggatcacacactaataacaagtccaccatcaaatttggggagtgtacttttgagtacttgaaaggttccaatggaagggtgttgataaaggtcatgcctgagttcatcacaaggctaatcaatagaagtaaaagaccatgttgccccagcattaatattgacaacaacttcctatgcagcactcctgagttgagaaaacactatcaaatgcttgtgaagcctaaggaccaggtttggtcacctaagcttgaaaccatttcggaatacaaagttaagttttcaccgtgtagatttataggtttagaaaggaaagaaaaagagaaggcagaggtttttatctactag

SEQ ID NO: 15463 - DNA, 414 bp, Glycine max
  Peptide Sequence Number=SeqID_132241
atggtgcagcgtctcacctaccgcaagcgccacagctatgccaccaaatccaaccagcacagagtcgtcaagactcccggtggcaagcttgtttatcagaccacgaagaagagggccagcggacccaagtgccctgtcactggaaagaggattcaagggttaaaggtaaaatgcacacataagactcaagggttattttcaagtcttaagattccacatttaaggccaacagaatataagagatcaaggttacccaaaaaccgaaggactgtgaaccgtgcatatggtggtgtgttgtctggcagtgctgttagagagagaatcattcgagctttcttggttgaagagcaaaagattgtgaaaaaggtattgaagatccaaaagacaaaggaaaagcaagctttgaagggctga

SEQ ID NO: 15464 - DNA, 183 bp, Glycine max
  Peptide Sequence Number=SeqID_132242
atgaagaataagaaggttgcagaagttggtgtctcgctaagcgagccatatgcacttagcgagcaacatctgctaagcgaggcttgtatgcttgagagcctatgcaatagagagacacggaaaggaaaaataggacaagggagcataaaaaacctcaactttcaagaggattttaggttttag

SEQ ID NO: 15465 - DNA, 327 bp, Glycine max
  Peptide Sequence Number=SeqID_132243
atgaagcccgaaggccttgcgtttcacgtgaagggaggaggaagtgcggacaaggttatggagggattcggattggaagtggtggccgagactgtggaggagggcgacgagttcgatgacagtggtggggttccaagtgaaccatgggacttggctgattcctgtgtaaagctaggaggcgaggggagagaggtggggataagaggtggaaggggagaggaggtgggagagaatgctgagaaaacactgaggaatagaagttcaataccatgcgtggatacaggaaccaatccatttaaggttcaacttacaaaattcacgttttag

SEQ ID NO: 15466 - DNA, 417 bp, Glycine max
  Peptide Sequence Number=SeqID_132244
atgattgatagtttagttaaggaacatagattctttccatccgggggattgatgtttgagtatttttctgctgaatgccacaagtcaaatagatgttcacacttgaagttcaaggaaacttcgtggatattacataacaagagtcatatccaccaaacaaaacacttacataatcttcacaataactcgttcaatcaagtttcagaggcgatgatactcgaagtggtttcactggaagcctttacaagtctctttgtgaccagggaatccacaccttcatggatgatgaggggctcagaagaggggaagagattagacatgctcttttcaaggcaattcagcagtcaagaattgccattgttgttttctctgaaaactatgcttcctcaacttactgtcttgaagagcttgtcatga

SEQ ID NO: 15467 - DNA, 3219 bp, Glycine max
  Peptide Sequence Number=SeqID_132245
atggctgatatattccagtatgaacatgaagttattcagaaaattgttgaagaggtgtccagaaagataaatcgtagccctttacatgtggctaattatccaattggattggagtctagagtgcaagaggtgaactcacttttggatgttggatccaatcaaggagtaagcatggtggggatttatggaattgggggaatagggaagaccgctattgcttgtgcagtgtacaatttgattgctgatcaatttgaaggtcagtgtttccttggtgatatcagagaaaaatcaaagcatggcttagtagagcttcaggaaacaatactttctgaaatggttggggagaagagtatcaagttggggagtactaatagggggaaggcagtattgaaaagcaagcttcaacgaaagaaagttcttttgattcttgatgatgttgatagattagagcaattaaaggcacttgctggtgatccttcctggtttggtcatggcagcagaatcattgtcacgacaacggataagcatttgttacgtgtacatggtgttgaaagaaggtacgaagcaaaaggattggatgataaagaagctcttgagttgtttagttggcatgcttttaaaagcaatgaggttagtccaagttacatggatatctctaagcgtgcagtactttattccaatggccttccattggctttggaaataataggttctaacttaaatggtaaaacaatgcctgaatggcaagcagcattggataccattgaaagaaatccagatgaagatattcaggaaaaactaaaagttggctatgatggtttgaaaagaaatgagaaggaagttttccttgacatcgcttgtttctttagaggctccgatttgaaagatgtcacaagtttattgttccaaggtcgtggtttctctcccgagtatgttattcgagtgttgatcgataaatctctcataaagattgataaatacggttttgtgagaatgcataacttggtagagaacatgggtagagaaattgttaagcaggaatcaccatcagaacctggaaaacgcagtagattatggctttatgaggatattgttgatgttttagaaaatgacaagggaactgatacaattgaagtaatcatgctacactcgccaaagaataaagaagtacaatggaatggaagtgagctcaagaagatgacaaacctaaaattactatctattgaaaatgctcacttttctagaggccctgtgcatctcccaaatagtttgagagtactaaaatggtggggatatccttcaccgtctttgccacctgaatttgattcaaggagacttgttatgttagacttgtccaatagttgcaatataatgggcaaacaactcaaattcatgaagttcgagtctttgagcgaaatggttttaagaggttgcagattcataaaacaaacacctgacatgtctggagcacaaaatttaaagaagctgtgtcttgataactgcaagaatttagtagaagttcatgattcaatcgggcttcttgacaaaattacatggttcactgctgttggatgcaccaatctaaggattcttccccgtagcttcaagttaacatcacttgaacatctgtctttcaaaaaatgctcaaatctccagtgtttgccaaatatattagaggaaatgaaacatgtaaaaaaacttgatctgtgtggaactgctattgaagaattgccattttcttttaggaaacttacagggcttaaatatctagtgctggacaagtgcaagatgcttaatcagatcccaataagcattctgatgttaccgaaacttgagaaattgacagccataaaatgtggacggtatgcaaatttgatccttggtaaaagtgaaggacaagtaagattgagttcatctgagtctttgagagatgttagattaaactacaatgatttggcacctgccagcttccccaatgtggaatttttagtgctaactggcagtgctttcaaagtccttccccaatgcatcagccaatgtcgctttctcaagaatctagttttggacaattgcaaggagcttcaagaaatcagaggggttcctccaaagataaaatatctctcagcaataaactgcacatcattgtctcatgagtctcaaagcatgttattgaatcagagattacacgagggtggtggcacagatttttcccttccaggaacaaggataccggaatggttcgaccattgtactacaggaccattgctgtctttctggtttcgtaacaaatttccaaggatggctctagctgttgttggagttttggacaagcagggaagctttcccatgtcaagattccacttgctcattaatggcattcaaaagctgcattgccttttcaccgcacaatcaaaactaaccacgtatcatatattcctgtccgatgtgcagctgaaatcctacaatggcgaattgcaaagtgtgtatggggaggatgggtggaaccatgttgagatttcatatgtgagaccaagtgcctttccacattcatgcagagccaagagaggaaccatcaaattgatgggggttcatgtttacaagcaaaaaacaagcatggagggtgtccggttcacgaatccttggtctccaaagagatcatacagcgaagtttccaagcctagtttgaaagaaaattttcagtcactggccaaaagaagccgtggatcacaaggcatggaaatttgtgaggcaccacgcatgaagcagcatgaagtgaatagtggttatcacagtgtatcacagagactatggttagaaatttgcagcattgtagctcctgcagatgttaaagtcctaatgtggagcatttgccaaaatgctttgccaacttttgaatatcttttcaggaggaagcttgtaaatagtccactctgccccatttgtggaacagaacctgaaaccgtcgaacacgcgttcctgttttgtccgtggacacgacccctttggtttggaagtgatttccagtggtgcattgatgccaaaacagttcaaagctttcaactttggctttggcagaaactagtggagattcaaagggtatatcaagaaaatgccaaccaagtatctgctcaggtgggaagtatttgttgggctatttggaaaggaaggaatgaatttattcttgaaggaaaacctgtcaatccattgattttaaggtaa

SEQ ID NO: 15468 - DNA, 2172 bp, Glycine max
  Peptide Sequence Number=SeqID_132246
atggaagtgtgtgaggatgtgatgggtaaatctagatggacttatggtcatagttctagttctgagagctcaaatgatgaagaaaatgatgacaattgctttgattttttttcaaaagattatatgacatctcagccttcattttcattagagcctactattaaggacccttctggagtacaatactctcaaactcccctgagtaagaagaaatcaaatggctcacaacaaaggaggcggaagttaaagttgccatgggaaatggggtcatctaaatcttttgagagtgagaagaagcctaacatttgttattcttctaaccatgaatttgtaaacaattttgaggccaagaaactgccgcttgcaggtggaacaccacattggggactgccacctgcagatggggcaccggataagggattgttgtttgttggtggggcaccagaatgggaattttcacatgtgggtggaataccatattggggactgcttcctgcaggtggtgcaagcgggactccgcttgagacaccacaatggggactgtcgcctgcagggggcggaacaccaaaatggagattgtcgcatgtaggtggaacaccacattggggactacaacctgcagggagtagggcaccaaaatggggattatcgcatataggtggaagatcacattggggactaccacctgcaggtggtataggtgggactcctcttgagacaccacaatggggactaccgcctgcagggggtggaacatcagaatggggattgtcgcatgtaggtggaacaccacattggggactacaacctgtaaggagtggggcaccagaatggggattaccgcatataggtggaacatcacattggggactgccacctgctgggggtgggacaccaaaatgggaattatcacatgtaggtggaacacaacattggggactgttacatgcaagtggtgtagacgggacaccacctgcaggtggggcaccagaatggggattgtcacatataagtggaacaccacattggggactgtcacctgcaagtggtgtaggcgggacaccgcttgcagctccctttgctcatcattttcatgtcccacctgggccattgattcataactcttgggtttataattctgtgggagatggaaataatgaggcaactgccaataatactattgctacaatatctgatgaagctagaggggaaattttgaggaaatttcgaagctttaaacaatttgacgttattgaagacgtttcagaccatcactttgttcatgccaactcttccatggaacagcattgggctaaaagaatccagggagagtggaagtcattggagaaggatttaccagattcaatatttgtcagagtttatgaatcgagaatagatcttctaagggccgtgattattggagcagagggaacaccttatcatgatggccttttcttttttgatgttttcttcccgagtggctattcgcatgtacctccacaagttcactaccattctggcgggcttaggctcaacccaaatttatatagtagtggaaaagtttgtcttagtcttcttaacacctggaccggccatcaaaatgagcagtggattccaggtgtttcaacaattttacagcctttctttaatgagcctggatatgcacatttaagcaattcacaatatggtgaaattagttctttgaagtacaatgaggacacattcatcctatcattgaggacaatgatatacataatgagaaggcctccaaagaatttcaaggactttgttgctgggaacttttgcagccgagctcatgatattctggtggcatgcaaggcatacattgatggtgctcaagttggttgtgtggtcaaaggtggggcacaagatgttgatcaaggtggcagtagcagctcagtccagtttaggacatctttagctgcatttgtgaatatgcttgttaatgagtttacacaagttggagctaaggattgtgacaaagtctttccattaactgctgtgggaaattcgtccaatgaaatgctaaaaacagtgggaaatccatccggtgtaaagctgacagcagtgggaaatatgtcaggtgaaatggtggcagcagtgggaaatgcgtccgatgaaatgcttgttgctgctgcagcaattccttga

SEQ ID NO: 15469 - DNA, 702 bp, Glycine max
  Peptide Sequence Number=SeqID_132247
atgaatttgagaagccctggtatgcaagtccaattaattggtatcttggtatcgataatgggagcagtggtagcagagttcttcaagggaccacttgtaagaccctcttctcatgaccaccttaaacacgctaataagcaatatctggtattctcctcaacaccagagttttgggttcttggtggcgctttgcttgctgcttctttcttctctctttcaattttcaaccttttccagaaagaaaccgtcgagcgatatccggaaccaatgaaagtgctttcttattctaacttacttggaaccatccttagtgcaatagtctcgtggatagtagagagggaaataaatgtttggaagataaagcgtaacaaggatctcattctcattgttctaactgcactcgttggtggtgtgattcgtcccaatattcatgtatggttcactcgaatcaagggtccactttatgtgccacttttcaagccctttggtattgcctttgccactacttttgcactttgcttcttttctaacagtcttcattatggaagcgtgataggaacaactacacttggaatggggtattatacagtaatgtatggacaaatcaaaggaaatgaagaagagacaagctgtgacgattgctcatcagattctttggacaagaagatacctcttttgcaagaaaagatggaagaagtgtga

SEQ ID NO: 15470 - DNA, 1083 bp, Glycine max
  Peptide Sequence Number=SeqID_132248
atggaggctaggactaagatgtctgaagtgctaccattcatagtgatggtgattatggaaggttggaccataggactcacgatttttgcaaaaactgcaataactaatggaatgagtccatttgtgttcattgtttataccaatgctctggccactataatactgttcccttgtttctttttaccacaccaagaggacagaaaggagaggccatcttttactttctctttgttcatgcggttcttgttcctcggttttatagggatgacgatgactcaggcctttttattcctgggtctaagctatagttcgccaatacttgtgtgtgccatgagccacttgatcccaacgtttaattttctgctctctctcattctcaggaagacagagttgaatctgagaagccctggtatccaagtccaagtgattggaatcttggtatcaataatgggagcagtgttagctgaattctttaagggaccacttgtaagaccctcttctcaccaccttagacacactgataagcaatatctggtattctcctcaacaccagagttttgggttcttggtggcgctttgcttgctgcagcttccttctcagtttcaatttccaactttattcagaaagaaactctcaagcaatatccagaaccaatgaagctgctctcttattctagcttacttgggactatccttagtgcaatagtctcggggatagttgagagggacataaatgcttggaagataaagcgtaacaaggatgtcattctcattgttctaactgcactagttgggggagtgattcgtcctaatattcaagtatggttcactcgcatgaagggtccactttatgtgccacttttcaagccatttggtattgcatttgccactacttttgcagtttgcttcttttcaaacagccttcattatggaagtgtgataggaacaactgtacttggaatggggcattatacagtaatgtatggacaactcagagaaaatgaagaagagacaagctgtgacgaaagctctgattctttggacaagatggtaccccttttgcaagaaaagatggaagtgtga

SEQ ID NO: 15471 - DNA, 1185 bp, Glycine max
  Peptide Sequence Number=SeqID_132249
tttttgtcactattggattccagtgcagcatttaactgtgaagttattcgggactgctatgaggcttttgcattatattgctttgaaagatacttgatagcttgcttaggtggtgaggacaaaacaattcaatttatggaaagtatgagcctaacagaatccagcactcctctcctaaaagaatcgtatgcgtatggagttgtagagcatccatttcccataaattgcttcttaagagactggtatcttggccctgacttctatcaatccgtgaaaattggcattgtacaatatatgatactgaaaatgatctgtgcattgctggcaatgattctccagtcttttggggtttatggagagggaaaatttgaatggaaatatgggtatccctatttggcatgcattcttaattttagtcagacatgggccctgtattgccttgtacggttttattctgtcacaaaagataagttggagccgatcaaaccattggcaaaatttctgacttttaagtcaatcgtcttcctgacatggtggcaaggtgtggctgttgcatttcttttttccatgggagcatttaaagggtcattggctcaagagctgaaaacacgtatacaagactatatcatctgtatagagatgggcgttgctgctgttgtgcacctttatgtctttcctgcagtaccttacaaaagaggagagaggtgtgtccgtaatgtagctgtgatgaccgactatgcatcactaggatcacctcctgatcctgccgaggttcaagattctgaacgctcaactagaatgcggctgggtagacatgatgacagagagaggcgtatgaagtttacccataatgttcgtgatgtggttcttggaagtggtgaaattattgtcgatgacatgaagtttacagtttcacatgtggtagaacctgttgaaaggggtattgcaaagataaacaaaaccttccatgagatatcagaaaatgtgaaacgccgtgacgaggagtggaggagaagcaccaaggtcaaggatgacagttaccttgttcccctgcgttcgtggagagcagaattttctgatgttcatgacagacttggggaaggaagtgtcagtgatagtggtttgcctagcagtaagagacagcatctccaatccaaagcgtcagcatccaggatgagaagatag

SEQ ID NO: 15472 - DNA, 3438 bp, Glycine max
  Peptide Sequence Number=SeqID_132250
atgggagtggcgagactaatggaactcgcaagtagcaatgacgtcttctccacgtgtcaaatccagggcaaactcgccagtgggactgacggctttgcacgcatagcattagcagcaacgccaccaccaacactcacatcaagaaaacctagggtttgggtttgcggcatgagtcgccgtggcatggacgacgacgatgaggaggagtacgaggaggaggacgagcaggtcgccgacttcgacgaggaggaggaggaggacaaccaccgaggacgcgggggtggtggcggcaggaagaggagaagatctggattcattgacgacgacgccgaagaggtcgatgaggacgaggacgaggaggacgacgatgacgaggatttcgatggacggggtggtggtggcggtcggaggcgccagtacaagaaggtttccgcttctaatttcttcgacgaagaggccgtggtggatagtgatgaggaagaggaagaagaggagggagaagacgaaatgagactgccagctgcaacagtagcattggatgacgagcatcaatgtcaaccattgttgatgcttgataaggatggcaagatgattgcagtagcatttgtgggtgatgtcgtgattattgccgtggaggtggcaacaactgtaatggtagaagacttcatcgttgaaggtggagcggatctgccagaagaagatgatgggagaaagatgcgtagtagccgtatgctgccacaccaccaagaggatcatgaagatcttgaagctatggccagaagcatccaggaacgatatggaaggcgcctaacagattatgatgaagaaacaacagacgtagagcaacaagcccttttgccatctgtgagagatccaaagctgtggatggtcaaatgtgcaattggtcgtgagagggaaacagctgtttgcctcatgcaaaagtacatagataaggggtctgaattgcaaatcagatcagctattgctctcgatcatctcaaaaactatatatacgtggaagcagataaagaagcccatgtcagagaggcttgcaaaggtctacgcaatatatttggccaaaaaataacacttgttccaatcagagaaatgactgatgttttgtcagttgaaagcaaagctattgatcttgctagagatacttgggtcagaatgaaaattgggacttataaaggggaccttgccaaagtagtggatgttgataatgtgcggcagagggttactgtcaaattaattccaaggatagacttacaggctcttgcaaacaaattggaaggtagagaagttgtgaaaaaaaaggcttttgttcctcctcctcgttttatgaatgttgatgaagcaagggaactgcatatccgtgtggagcatagacgcgatgcctatggggaacgatttgatgcaattggaggcatgatgttcaaagatggattcttatataaaactgtatcaataaaatccattagtgctcagaacatcaaacctacttttgatgagcttgaaaaatttcgtaaaccgggtgagagtggagacggggacgtagctagtctatcaactttgtttgcaaacaggaagaaaggccattttatgaaaggtgatgctgtaattgttataaagggagatttaaagaacttgaaggggaaggtagagaaagttgatgaagataatgttcatataagaccagaaatggaggatcttccaaaaactattgctgtaaatgaaaaggaactttgtaaatattttgaaccaggaaaccacgttaaggttgtttctggtgctcaagagggggctacgggcatggttgtgaaggtggagcagcatgtgttgatcttaatatctgatacaacaaaagagcatatccgtgtatttgcagatgatgttgtagaaagttcagaagtaactactggagttacaagaattggggactatgaacttcgcgatcttgtattgctagataataatagctttggtgtgataatacgtgtagaaagtgaggcatttcaggttcttaaggggattcctgacagacctgaagttgtgcttattaaattaagagagatcaaatgcaagatagataagaaaataagtgtgcaggataggtttaagaatacagtatcgtcaaaggatgttgtgcggatcgttgatggtccctgcaaaggaaaacaaggtcctgtggagcacatatataggggaatcttgttcatctttgatcgccatcatcttgaacacgcaggctttatatgtgctaaggcccaatcgtgtgtagttgtgggaggttcacgctccagtggtgaaagaaatggtgatgcctactcaagatttgccagtcttagaagtccaagtcgtattccaccgtccccaaggaggttttctcgaggagggccaatggattggagacataggggtggaaggggccatgatagtttggccgggacaaccgttaaagtacgccagggtccctataaaggttaccgtgggcgtgttatagatgttaaaggcacaacagttcgtgttgagttggaatcccaaatgaaggttgtgacagttgaccgcaaccatatatctgacaatgtggctgtaaccccatatcgtgatacatctcgctatggaatgggaagtgaaacaccaatgcatccttctcgaactcccttacatccatatatgactccaatgagagatcctggagcaacacctattcatgatggaatgagaacacctatgcatagccgagcatggaatccttatactccaatgagtcctccaagggataactgggaagatggaaatccaggctcttggggagccagtccacagtatcagcctggaagccctccttcacggccatatgaagccccaactcctggtgctggttgggctagcactcccggtggaaattatagtgaagctggaacaccgcgggacagttctgcctatgccaatgctccaagcccatatttaccatcaacacctggtggacagcctatgacaccaagttcagcatcttatcttcctggcacccctggaggacagcctatgactccaggcacaggtggtatggacatgatgtctccagttttaggtggggaaaacgaagggccatggtttatcccagatatattggtcaacgtacacagggctggagaggaatctattggagttataagagaggctctcccggatggctcttacagggtaggtcttggatcaagtggtaatggtgaaacgattacagcccttcctaatgaaatggaggctgtggtaccaagaaaatcagacaaaataaagattatgggtggggcattgcgtggtgcaaccggcaagttgattggtgtagatggtacggatggaattgtaaaggtagatgacacattggatgtgaagattttagacttagttattttggcaaaattggctcaaccatga

SEQ ID NO: 15473 - DNA, 1608 bp, Glycine max
  Peptide Sequence Number=SeqID_132251
atgagttttaaccttggcacatggagaaacaacccatcacattggttttgttccataaggaaccacattcagcaaggatcattgagatgtgctcttcttgcgtataaacaaacccggcatgaaggagtatatgattccagcgttgcccctctgttattcaaggcttgcgcttctcttccattccttcattacgtgaaggccttgcatgcagagtccatcaaggccggttcagagagcgacgtgatcatcggaaccgcattgctcacaacttactccaaatgcggtgtcgttagggatgcgcgtaatctgtttgacacaatgcctgagagaaatgttgtgacttggaatgccatgatcagtgggtacttgagaaatggagacacggaatctgcttatcttgtgtttgagaagatgcaggggaaaacgcaagtgacttggagtcagatgattggtgggtttgctaggaatggtgatattgccactgctaggaggttgtttgatgaggttccccatgagttgaagaatgtggtgacatggactgtgatggttgatgggtatgctagaataggggagatggaagctgccagggaggtctttgagatgatgcctgaaaggaattgctttgtgtggtcatctatgattcatgggtacttcaagaagggcaatgtcactgaggctgcggctgtttttgactgggttccggttcggaatttggagatttggaattccatgattgctggctatgttcagaatggatttggtgagaaagcactgctagcttttgagggaatgggagctgaaggatttgagccggatgagttcactgttgttagtgttttatctgcttgtgctcagctggggcacctggatgttggtaagcaaatccatcacatgatagaacacaaagggatagttgtaaatccgtttgtgttgagtggattggttgacatgtatgccaaatgtggtgacttggtcaatgcaaggctggtatttgaagggttcactgagaagaatattttctgctggaatgctatgatttcaggttttgccatcaatggaaagtgcagcgaggttcttgagttttttggcaggatggaggaatcaaatataaggcctgatggtatcacctttcttactgttctttccgcttgtgctcataggggtttggtcactgaagctttggaagtaatatctaaaatggagggatatagaattgaaattggcatcaagcattatggatgcatggttgacctattgggcagagcagggagattaaaagatgcttatgacttgatagtaagaatgccaatgaaacctaacgacacagttttaggggcaatgcttggagcatgccggattcattcagatatgaacatggcagaacaagtaatgaagttgatctgtgaagagcctgttacaggtgctagttctcacaatgtgcttttgtcaaatatctatgcagcttctgaaaaatgggagaaagctgaaaggatgaagaggatcacggtagatggagggtctcaaaggatacccggatgtagttcaattatctttagtgactcttgtggatttaagtgcacaagtcccacattaaaatcaatggactaa

SEQ ID NO: 15474 - DNA, 2391 bp, Glycine max
  Peptide Sequence Number=SeqID_132252
atgggggagggatgttgtacgcagccttacccttgcatatgcaaagaggctgtttccggattcgaacccatgaccaacaagtcaccaaggcacaactttaccgctgcaccagggctcgccctcaagaacccaaaaggattggatatgtgggcttgggccgttgcagttgcactagccggaattacatgttttggttgcactaatggatttgataaaggcttggaggttgggaccttgtccttttttctacttctcccaacactcgcggaactagaaagcctctacttccaattccacgtggcaaaaaggagagactctgattctgagccgcttctagaaccttccattgtccaagaagtttcattccacgacgacaacgaagaagaagaattccttgacgaatttgaatacgttctcgaatgcacagatgaagacgacggtgacggtgacgaatactatgaggaagaagaggaatacgaagaggaggctggtggcggaatctccctcaccggaacgtggtgggataaaaaagcactagccattgctaaagaggttactctctccttcgatggcgaattgcaaatttatgcttttagaacactggtcaactgcaccatccaagtgcgcattgagaacctttccaaaaagtctggttcccccagcatggaagatattgaagccttctctacaacatatagagcaaagttggatgaagcagaaattgccaaagttgttcccgacaatatatgtttggaggtgtcttctcctggtgttgaaaggatagttcggattccagatgacctagatcgattcaaggaccgacctatgtatgtgaaatatgccattaatgatgatcaaaataatccagctgcagaaggtgatggtgtcttcaagcttgaatcctttgacatggaaacaaaatgttgcacctggggtttagcagatgtgaaagtcaatagacagaaagcagggaaaggaagaccactgaataaaaagcaaattgtgtccggtgtgggacttggagttgttgagatgaaaaggtgttggttggttggggtcttgattgtggtggggtgtgcctgcatgttgggcactgttggagttgaagggcaccctgatgaggatctcatagtaagtttacctggccaacccaaagttgagttcaagcaatatgcagggtatgttgatattgatgtcaaacatgggagaagcctcttctactattttgtggaggctgagaatgttcctgacaagaagcctctcactctttggctcaatggaggcccgggatgttcctccattggaggaggtgccttcactgagttgggtcccttttatcccaaaggtgatggacgtggtctccgaacaaattcaatgtcttggaataaagcatccaacctcctctttgtggagtccccagctggagttggttggtcatactcaaacacaacttcagattacaattctggagactcgtccacagccactgatatgcttctgttcttgctgaaatggtaccagaagtttccttcctacagatcaagggagctgttccttactggagaaagctatgcaggacattatataccacagttagctaatgttcttttggactacaatgttcattcaactagtttcaaattcaatattaaaggagttgctattggaaacccacttctgaaacttgatcgtgatgcacaagcaacatatgaatacttctggtcacatggaatgatttcagatgaaattggcctagccattacgaatgattgcgattttgatgattatgtctttgcaagtgcacataatatgtctaaatcatgcaatgaagcaataaatgaagcaaatgaaatcgttggcgattatataaacaactatgatgtgattttggatgctactaaaataagcataggtgtagatgtctgtatgacttatgaaagaagtttttatttcaacctccctgaggttcagaaggctctccatgcaaaccgtaccaatcttccgtaccaatggtccatgtgcagtggcgacactgatcctaacatagatatccttccaattcttaaaaagattgttcaaaaccatattccagtttgggtattcagtggagaccaagattctgttgtgccattactaggttctcgaacactaattcgtgaactagctcatgatcttaagttcaagattacagtcccatatggagcttggttccacaaaggccaggttggaggttgggtaaccgagtatggaaatttgttgacttttgccactgtaagaggagctgctcacatggtaccctatgcacaaccttcaagagcactccatcttttcagttcatttgtgcatggaaggagattgccaaatacaacaagtccttcaattgatgattaa

SEQ ID NO: 15475 - DNA, 1455 bp, Glycine max
  Peptide Sequence Number=SeqID_132253
atggaaatatggaatagttggtgggttttgcaaattatgcagttgctgggtttgtttagtttttggatctcatttgcaaagtttaggactttattctcaagagcttttggttatggtcacaaagttgtgaagggtgattgcaatgcttggatctttgtttccttcaatggtttggtcacagttagttctttcatattcttcctcttggtcctttcttgggcttatttatatgcaattcccagttctcaatcattgattcggagtcatgagattcccaacaacagttctgactcatttgttcagagtcatgagattcccaacaacagttctgactcatttgttcagagtcatgagattcccaacaacagttctgacacacttgttcagagttatggtgtgattctaaaacccaatgtttcaatggacacatgcaatgtgtttgaaggaagttgggtgagggatgatagctaccctttgtatgatgcttctcactgcccttttgctgaaaggggttttaattgccttgctaatgggagaaaagatagaggttacacaaaatggaggtggaaacctaagaactgtgagattccaaggtttgatgtccgtggaatactcgaacgacttcgtgggaaaagggtggttttcgtcggcgattctttgagtaggacgcaatgggagtccatgatatgtttgctaatgacaggagttgaggataagaagagtgtctatgaaatcaaaggcaacaagatcacaaaacagataaggtttttaggtgtgaggtttagtacttttgatgttagaatcgatttttatcgatcagtgttcctggtgaggcctggttctgtgcctagacatgctccccaaagggtgaagactgcactgagattggacaagattgatgatattagccacgagtggattgattctgatgttcttatattcaattcaggtcactggtggacacggactaagctttttgacattttctctaaagagaagcaaagaatcaggtttggtaaggttggtaactcactgaagtttggaatgccaattaactctggtttcaacacagctttactcacctgggcatcttgggtcgagaatacaattaatacaaacaggacaagaatattcttccgcacctttgaatcatctcattggagtggacagaaccacaattcttgcaaagtgactcaaaggccttggaagagaactaacggcaaggatagaaacccaatttcaaatatgatcaacaaagttgtcaaaaacatgagtgctccagtaacagttctgcatgttacaccaatgactgcatatagaagtgatggacacgtgggcacttggagtgacaagccatctgtgcctgattgtagccattggtgcttagccggtgttcctgatatgtggaacgaaattctcctctcatatttgctacctaaagaaggagcatattag

SEQ ID NO: 15476 - DNA, 1935 bp, Glycine max
  Peptide Sequence Number=SeqID_132254
atggtggtctcatcctctgcgcgcgattacatcaatcgcatcttgcaggacatctccggcatgaagattctcatcctcgattctcaaacggtaggtattgtgagtgtcgtgtattcacagtcggagcttcttcagaaagaagtgtttttggtagagttggtagattctatttccaagtcaaacgaatcaatgtcgcatctcaaggccgtctacttccttcgacctacatcggagaatatccagcttttgcgccgccagctggctagtcctagatttggagagtatcatctatttttctccaacatattgaaggacactcagattcacttacttgctgattcagatgaacaggaagttgtccagcaagttcaggagttctatgcagattttgttgcaattgatccttatcatttcactttgcacgtgccttcacattacatatatatgctcccagctgtggtagatccttcaacagtgcagcgcttctctgaccgggttgttgatggtctttcagctctttttttggcattaaagcgaagaccagtaattaggtatcaaaggacatctgacattgcaaaaaggatagcacaggaagcagctaaattgatgtaccaagaggaaagtggtctttttgattttaggcgaatggaagtttctccactgctgttagtgattgacaggagggatgatcctgtaaccccattactaaatcaatggacctatcaggctatggttcatgaattaataggaatccaagacaacaaagtggacttaaaatccgttggtaaatttccaaaggatcaggaggagattgtgttgtcatcagaacaagattcctttttcaaagctaacatgtatgagaattttggagatatagaggacatggccaaatttgttgataattatcctgagtacagaaaaatgcatggaaatgtgactaaacatgttactttagtaactgaaatgagcaagatagttgaagagcgaaaacttatgtcagtttcacaaacagaacaggagttggcttgcaatggaggacaaggagctgcttttgaggagcatgatagggacttgggtattatggagtgcctaagtcccacatcgagtagtatgagatgcttggtggagtacttaagtggcttggcagtgacaaatctactaaacaatgaaagcatatcagatgtggaccgactacgtttggtcatgctgtatgctttacgatatgagaaagatagccctgttcaattaatgcagctcttcaacaaactggcttccagatctgccaagtacaaacctgggcttgtccagtttcttctgaagcaagcaggtgttgacaagagaacaggtgatctttttggaaatcgagatctaatgaatattgcccgtaacatggctcgtggtttgaagggtgttgagaatgtttacacccagcatcagccacttctgtttcaactcatggaaagcattgtcaaagggaggttgagagatgtggactacccatttgttggaaatcactttcaacagggaaggccgcaggatgtgatcatcttcattgttggtgggacaacttatgaggagtcacggtctgttgctttacaaaatgccagcaataccggtgttcgttttatacttggtggttcttctgttcttaattctaaaaggtttttgagggacttggaagaagctcaaagggtagcacgttctagcaccactaaggagcttgatgtgcggaatcagactcaatccattgttgctgcagaagacgatcatcaaccatttaacagtttaggtactagttggttcattgcagatgagtgcgatttgagatacgagtatgagaacttcaatgtcaaaccggggcccctctcttttgttcgtggcggaaaaagggtgcctatgagtctagtgccaatctttcatcctagtgaatactga

SEQ ID NO: 15477 - DNA, 183 bp, Glycine max
  Peptide Sequence Number=SeqID_132255
atggaataccaagatgacactctttcgttgtgcatgccattcttcaacatcatcagcagtgaacacaacctgccctactgcctcagtgacaaagacattgggtctgaagccaatgcaaggagtgatatctttgttcattccacctcagcaaatgaaatacaagacaaagtggaccggatttaa

SEQ ID NO: 15478 - DNA, 291 bp, Glycine max
  Peptide Sequence Number=SeqID_132256
atggtatgcaattgcaacaacaaccaaccccctggtccccctcctccacttgaaaggcaaaattaccctcctgctccacctccaactcccatcatccaagagactcgtcacacggatactcgcatagtcttggaggaggaattttcctttccggttgttgcctttatcgaggaaaatgcttctactgaagttacaaaagtgatgccgaggatgttaaaaatgagaacccgaaggaagcaagtggaggcagcaggaagcgcaaggcaaattaagaagctcggtgcagagtaa

SEQ ID NO: 15479 - DNA, 261 bp, Glycine max
  Peptide Sequence Number=SeqID_132257
atggcatgcaattgcaactccaaccaacctcctcctccagttgaaatggagaatttcctccctactcctcctcccactcctaacattgaagagacctgtcctgaaatggatgttatggagatggagtttgaagaagagttttcttttctagttgttgttgttgctacagagcaaaatgctcctaatgcttttactgaagagaagcctgcagaagacaaaaatgcgaacctgaaggaagcaagtcctaacaatgatgattga

SEQ ID NO: 15480 - DNA, 273 bp, Glycine max
  Peptide Sequence Number=SeqID_132258
atggcatgcaattgcaacaacaaccaaccccgtggtccccctccgccacttgaaaggcagaattaccctcctgctccacctccaactcccatcatccaagagactcgtcccgcggatactcgcatagtcttggaggaggatttttcctttccggttgttgcttttatcaaggaaaatgcttctactgaagttacaaaagtgatgcccgaggatgttaaaaatgagaacccgaaggaagcaagtggaggcagcaggaagcgcaaggcaaattaa

SEQ ID NO: 15481 - DNA, 131 bp, Glycine max
  Peptide Sequence Number=SeqID_132259
gacaggtctcttcaatgttaggagtgggaggaggagtaggggggaaattctccatttcaactggaggaggaggttggttggaattgcaattgcatgccatggtaatggagtataatagctacttgcaagtg

SEQ ID NO: 15482 - DNA, 579 bp, Glycine max
  Peptide Sequence Number=SeqID_132260
atggaagagagaaatgataatggtgagaaactagatgaggttatgctacccggtttcaggtttcatccaactgatgaggagcttgttggattttaccttaagagaaagattcagcagaggcctctctctattgagctcatcaagcagcttgatatctacaagtatgatccttgggatcttccaaaaatggccaccactggggagaaagagtggtatttctactgccccagagacagaaagtacaggaacagtgcaaggccaaatagggtaacaggagctgggttctggaaagctacagggactgatcgccctatctattcctcggagggttctaagtgcattggtttgaagaaatctctagtgttctacaaaggaagagctgccaaagggatcaaaactgattggatgatgcatgagtttagactaccatctctcactcacccaccctcatccctcaagaagttcatggacaagactattcctgctaacggaatcctgggcaatctgcaggatcttcaagaaaaccaatgctacagctcaaagagctctctcacattcttgggtctcaccattacctga

SEQ ID NO: 15483 - DNA, 267 bp, Glycine max
  Peptide Sequence Number=SeqID_132261
atggccaaaatacagggcctaaaagaaggaaaaacttattctaatatttacaaagaagagtggacccaaccttggcccatgggctcaaaaatcgaccctgaggttcatgagaaccccagggccttctttagtaactctagcccaatcctcttggagtcttctatccaatacccttgggggtttggagaccacttaagccataaccatcatcgcttaagccacactgctcctagtaatcaccctacccacaactttgaccttgcttaa

SEQ ID NO: 15484 - DNA, 729 bp, Glycine max
  Peptide Sequence Number=SeqID_132262
atggactcaccgtcgtcatcaacaactggagacacgagcaaggtaccgataaagtcatcatcatcgatcgtggagtcattgcgaggatgcggcatttcaagtggcactcatgtggataaggaggagctgaggaaaaatctgacgatgccaaaataccttcgctttgcaatgcgcgattctatcatgttcaaggaccccaccgccggtgagaacctttgcattcgtagcaaagacgaccacaaagcggtggcaccgtccacgcctatgattgttttcatcaaccctcgcagcggcggtcgccatggccctttcctcaaggaaaggctccaacatctcatgagtgaagaacaggttttagacatgttagatgtgaagcctcatgaatttctccaatatgggctaggttgtttggagatgttgaccggtcttggtgattcttgtgccaaagaaactcgtaaaagaataaggattatggtagccggaggtgatggtagtgttggttgggtattaggatgtctcacaaaacttcacgaacaaggacgagaacctattcctccagtagggatcataccacttggtacaggcaatgacttgtctaggagttttggttggggtggttcatttcctttttcatggaaggcagccattaagagaactctttacaaggctagcatcggtccaatttgtcgtttggataggtatatattatcttacagttttgcacgttga

SEQ ID NO: 15485 - DNA, 159 bp, Glycine max
  Peptide Sequence Number=SeqID_132263
atggatagtgatgggagtgagaaggttaacaaacaattggggaaattctccaggagtgagatgtgcaagggcaaaaacagcagcactaatgacaacagcaactggcgtaggaaccctacagtgagaatgatgaatgagaaaaattgtaccagtaagtaa

SEQ ID NO: 15486 - DNA, 321 bp, Glycine max
  Peptide Sequence Number=SeqID_132264
atggttcacataagtcttctcccaatcactatgatacttggtgcctttcctaatacaaccaatgacctatgcaatggtctccatagacagaatgaatgtctttccaagaaatctgtaaatgatgtacttcctgtcttgaaactcaaagttcctctagaacatcctgatcaattctggatgtatggtttgaggctctttgaaacaacctctaactccacaactgagcaagtgcaagaggaattgtgctcagtgcgaattatcatgctcaacgcaaatctcaaccctagagaaattccgctaagtgcaaaaggtcacacttag

SEQ ID NO: 15487 - DNA, 477 bp, Glycine max
  Peptide Sequence Number=SeqID_132265
atggcctattctcaggcgatgggaggtgccttggcaatggcaaacagtttcactgacctctcttgcctgtggattgggaggaagatgccatctagagacttcttacctatactgtcaaatggtttgactgaagcaattgccttaccatatctcgggatcaaacctgatgtgctaagtttagatgacaaggcagagatacttttattcgatcagagcatcacaactgctgttgtacttggaatcatatatagtgttgccaacactttccagccacttcctgaagacttcttcaaatacgatttgagggaacctttcaatcttcaaaagggttggcttttgtgggctggaattggacttgctggtgccatacttgccatttcattgaccggagttgctgtgtctttcttcaatggagaaaccccacaaagagaggttcatgttctatttttgaaattttacaggaagatgcagatgtaa

SEQ ID NO: 15488 - DNA, 1068 bp, Glycine max
  Peptide Sequence Number=SeqID_132266
atggctgttggtcgttgggcactcacagggtacccaatgggccctttctaccatcctgcgacgatatgggccgcaatcacaggcaaactaggttgcacgtgtgagggtgctggcaagcgtcgtatattcgcaataggaaactatgtcctccgccgcatcccaatggatgatcaaacagcacctctcattcgtttagttcctagtaaaacatgtttaagctatgacctcaagagtgctaccgattggtggcctcttgtgtttctgtttgaaaggcttgcgctattgtttgacaggtcatttgcttcaagtgttgtgaatacaacattagggacgaatgtatttgaggtacccttcgttaagagggctctatctcaagtgtcctttgtgaccggtcaaccgttaggctattatggttattggcctttgttcgcgttcacccatcatgttttggtgtggtgggctgcggaacaggttagacctgggatcctgttcgacaggtatgctatattaggtgatgatgttctcatcaccgatccacttgtggcggaacagtaccggctaggcttacaacggcttggtgttaagatatccacacacaagtctttgatatcctcaactggtgctgtagagcttgacggagttcagtctgtctggagggaatcatttcttctcaatgccatgatactttctgttttgtcgagccctgctttggtctctggtttgatggttgcacgtgctaaaaatccggtacattctgttttgtttcccatcccagtctttcgcgacacttcaggtttacttcttttgttaggtctcgacttctccgctatgatcttcccagtagttcatataggagctatagccgtatcattcctattcgttgttatgatgttccatattcaaatagcggagattcacgaagaagtattgcgctatttaccagtgagtggtattattggactgatcctttggtgggaaatgttcttcattttagataatgaaaccattccattactaccaacccaaagaaatactacctctcttagatatacggtttatgccggaaag

SEQ ID NO: 15489 - DNA, 528 bp, Glycine max
  Peptide Sequence Number=SeqID_132267
atggaaaacatcccttttgacctgcctcacacaatttacatcaacattcttcacaccaccaatacgttgggtggatatgaagatatcttatattcacccctagtcaacaagattctttgggagcaaggtgtcgcaacctacccttcgatgggagggcaaggcgggataaaaagtgcgtcttctcacgaagaaaatgcgtggagtcgccaccaacgtttattcgaggaaaacgttagaaaaaccaaaaaaggcaaaggtgttgcccttgctcctacatatcctctggagaaggagatgaagatgcacaaaacaataaagaggacctctaagggtccatacatcatgttcaaatccttaaagacaaacactaaccaaatgacgaatgaagaacgatgtagaagtcgattacggtcgcaattcggtggcacctcagccacatttttctcttctttcttctttttctctctgatttctctcaatggtggaccttggaaccctttgctcaacctacctcatgcctttctatag

SEQ ID NO: 15490 - DNA, 201 bp, Glycine max
  Peptide Sequence Number=SeqID_132268
atgacggaatgtgttcggctatttgaccatccgataatcaaagttcatattttggtgcttagtggtgtggatatatgtgtgtcttggatcattcgaccaatcaaatacccaaacattttccaatacgagattaaggctttgcttggtgcacaactattcgattacccaaatatccttcagttggcacatcctagtgaataa

SEQ ID NO: 15491 - DNA, 120 bp, Glycine max
  Peptide Sequence Number=SeqID_132269
atgagatggcctttggacagttggacttaccttattgaagtcactgaacagctgccaattttgattgtgcgtgtgggtcctacacactgtcagtgcgaaaatccagctaggaaaaggtaa

SEQ ID NO: 15492 - DNA, 363 bp, Glycine max
  Peptide Sequence Number=SeqID_132270
atggtgtcaagcagacgaccagcaaggtttcaaaagcccgatttcatgcagaccaaaccaatcggagaagaaaagctggaagtgttaagggttgctgctgctgctgtttttcttaacgaacaaaatcctgaaggggaatcctcggaacaggaagtgatgactaatactggatatggaaaaaatgtgagggacgaaacagataacaatgacaatggaatggaactgctggcaacagttgcaactagaattattacgaagagggtggagaagaagaagctgaggaaggagaagttgaggaagaagaagctgccactgccactggacttaagatgggggaatcaaaaactgagggccttctcgtag

SEQ ID NO: 15493 - DNA, 405 bp, Glycine max
  Peptide Sequence Number=SeqID_132271
atgaaggaccatcatatcagattatggaagactcaaatcggaattgaattgatggatgttggtaatgattgttatatggtcgaatttgatgcgaaagatgataaggagaaagtcaccattgatgtaccatgggtgctttttgatcattatttttcagtcaaggcaaactcatttacctcaacacaccacaattgcaagaaactagctatcatactcccttaccatgtctatgcgcaaatactcccttcctccttctcctctgggaaggaagagttccgtccctcccccaaaggtagctggatgcataagctaattgaagagaaacccaccgaatctgaaaattcgaacccggcgaaagcatgtcctaatagtactggagccagcaggaagcggaaagctaagtaa

SEQ ID NO: 15494 - DNA, 420 bp, Glycine max
  Peptide Sequence Number=SeqID_132272
atgaaggtagctcgctcaggcaagctgagttgttacttcattctgaagcgaccttgctcgcccaggcgagccaggggtttgaaaaagtgtaaaaatgacccttttgccctcccttttgagtattttctgcattcttttccgaaacgtcaaaaaaccttacggattgcatggcaactagcgttaagtagctcaattcgactagcaagaatcaaaatgttagcaaataaaggtccctggacgaaattaggatgtgtggaagcaatgccttccaaggttattttgatgatgccaaagaatcaagagtcaagcaaattccaaagattcaagaatgaagttttcaagaatcaagattcaagaataatcaatatcaagattcaagactcaagattcaagaatcaagagaagaatcaatcaagataa

SEQ ID NO: 15495 - DNA, 1011 bp, Glycine max
  Peptide Sequence Number=SeqID_132273
atggacgataatagcttatgcgatattttcgacgacaaagagtttgggagcgaccattttggtggggatgatctcttcgccattttggagagcctagaatcggacttcaccaccgatttccctcctctcattaacgaagaagctgttgttgcagcagctgtctccaaagacattaataacgaggatgtctcaagattggtgtctcaaaagtcaacctcttcaagtgctccactagattccgaaactgagcttgaaacctctcccaaaaccaagagacagaagcttactcctactactcctgaggaagcaaacccagatggacaacaaaagatgtctcacattaccgttgaacgcaacaggagaaagcaaatgaacgaacacttgaccgtgttgaggtcgcttatgccttgcttttatgtcaaaaggggagatcaagcatcgataattggaggagtggttgattacatcagcgagttgcagcaggtgctgcaagccctggaggccaagaagcaaagaaaagtctactgcgaagtcctgagccctaggcttgtttcaagcccaaggccttcaccactgagtcctaggaagccccctttaagcccgagactaaacttgcctataagcccaagaactccacaaccaggaagcccttacaggccaaggctgcatcagcagcagcatggctacaacaacatcatttcaccaaccatatccaacgtctctctcgacccttctcccacttcttctgccaactcctccatcaacgataacatcaacgagcttgttgcaaactccaagtcccccactgctgacgtggaggtcaagttttcgggtcctcatgttcttctcaaaacggtgtctcaacgaattccagggcaggctctgaagattataacggcacttgaagatcttgcgcttgaaatcgttcatgtcaacattaactgtgctgcggatgataccatgctaaactcattcactatcaagtacctcgtcacatgcataacagcatga

SEQ ID NO: 15496 - DNA, 1095 bp, Glycine max
  Peptide Sequence Number=SeqID_132274
atggaccacatgggagacccgaagagcatcatacatgagctgctacaaggtttagagttggcaaggcaactccaagtgcatctccacatgccatcttcgtcccaagaaacacgtgacctattgatccagaagatcatatcaacattcgaaaaggtgcttgaaatggtaaaatggaaagggccagtgccagcgggtgagtcatcacaacatcccctaggggctgcattaatccgaatgtcagattcacctttgagcagtgaagactccgatagagatttgaaggaccaggaccccaatgctttcaaaaagagaaacactttgccaagatggacgaaacagattcgagttacaccaggaatgggagtggaaggacctcttgatgatggatatagttggagaaaatatggccagaaagatatccttggagccttgtacccgaggggctattacagatgtacccacagaaatgttcaaggctgtatggcaacaaagcaagtgcaaagatccgatgaagaccccaccattttcgaaatcacttaccgaggaaaacacacctgcacagtggccaacaacgtgggttcttcatcaccaattccactagaaaaccaggaaccaagtttgaacaacacaaatattcctcagcatcagcatcagcagaatatcctgcaaagccatgaacaacaacaaaacgaactacttctgagcctgcggaaagggttgagagtccaaacagaaaacctagattcccccgaacaaccattagttccattccgtttccctttgtccacaaacataaaaaacgaaagccatgtttttccttcccctgtgcttgaaaacttcacttctccttcttatgtttcccctgctgcatcaggaataggccacttttctgtgtctccaagtggagtagtgaacagctttgaagggaacccaaatttggcaaattctgagtctcagatcaatgatatgatccctgccactactacaacttcagcagctccaaactcatcaaccgttggcttagagtttccctttgaccagtttgaatttgatggccagaacttcacattcgataacccacggtttttctcttga

SEQ ID NO: 15497 - DNA, 1002 bp, Glycine max
  Peptide Sequence Number=SeqID_132275
atggttgttagcaacagcatgtcagaaagttgtaggtgtaatgaattggaagagagaagcatgaaagctgaaatgaggtgtgctgagttagaatttaagcttcaaaagaaagatgagcaatgtgaagtacttgaggctaaactcaaggcacttgaggatgaggtggaggttttgagagtgtctagtgaagaactcaaggagaaaaaagaagttggtaatgtaaaagagagaggggtagaagcaattattgatctgacaaatgatgatgatgatgaggttgcacaactaatgattgaaaacagtgttttggaatgtgagaagaaaaaggctgagagcgaggttgaagtatggaaagacaagtactggaaactggaatcattggtctcacagttgaagctggaaagtgacagttattccaatgaagaaaatggaaagaaatggaaagcgacagttattccaatgaagaaaatggaaagaaagaggaaagtaatgcaattgacatttgaaattgaagagattcacagcaaaaagatggctccatctacaccctttgctgcaaaatcttcttccattgttgtaattgatatcattgacagtgatgatgaacctaatattgcccaacacgctgcgctagatagtcaggttagcagaaatatttctgtttcatcatgttttgctgcagaaaatgaaaagttatctagcagttatgcccaaaacaatgaggaagatatgaattctggtgaagatctcccttttgtggtaacacctaagaggaacgaaattgtaatgttgttacaagtgagtcagaaaatgatgtgccgaggcagcactttggctgagttcctcaatcatggagatcctaggggtggcttaaagaagtctgtcaaggaattgcaagagtatgaccccaaagcagttgaacagtgcagaacttttgccattcgttattcaaagcaactataccatatctacaaaaacaaagaggatcctttctttccttaa

SEQ ID NO: 15498 - DNA, 489 bp, Glycine max
  Peptide Sequence Number=SeqID_132276
atggatgtcgcgaccttcgcggccaacacgccgccgattgtggtaccggaaacgctggatccgatcaacctgctgggcgtattgcgtcgcgctaaaggcagcttcgtcatcgttaccaacgaatttggtgtggtacagggcctgattacgccgctggacgtgctggaagcgattgccggtgagttcccggacgaagacgaaacgccggatgtggtggcggatggcgacggctggctggtgaagggcggtaccgatctgcactcgctgcagcagctgctcgaccaccatgagctggtcgatccggatgaagatcacgcgtcgctggccggcctgctgattgagcagaaggggcagctgccgctgccgggcgagattatcgatttgccaccgctgcacttccagattatcgaagccacggattaccgtatcgatctggtgcgcgtcaccaaagacaagccgcaccatgacgaggaagagggcgacgcctga

SEQ ID NO: 15499 - DNA, 210 bp, Glycine max
  Peptide Sequence Number=SeqID_132277
atgtggcagaaatcgaaaagaggtgtttttgcgcaatccgtgagtttccgtaacttcttcgaaagcaacctagctcgcctgagcgagctaggtggccaccacaccccccgttttgttgaaaaatgggattccggggcttccggcacacccctgttttgggtgaaaaaaattgtttccgtgaagaaaatcaaagccgaggtgcttccgtaa

SEQ ID NO: 15500 - DNA, 195 bp, Glycine max
  Peptide Sequence Number=SeqID_132278
atggagtcaggtgacatgcggagataccttatggtcatccgcacctttcatcaaccaagggcaaatgagcctgttggcgcgcagagactaacgtcgtcttctacatctttatgtcatcctgacccatggagtcaggtttttgctctcgttgtccaaagacattcaagcccaacgacgcacgagattcttctctga

SEQ ID NO: 15501 - DNA, 423 bp, Glycine max
  Peptide Sequence Number=SeqID_132279
atgggatcaagtcaaaagccttcacttaaaaagaggttctatcaagtcaaaatcaagagcttagaggtcaccagtttacgaaagttggggcaattaatgggtcaacttcaacggcaagccttccgcaaagcctatgaatttctaaaaagtccaaatctcggtgcaggaattagaccgccaaaggcaagtcaaaaatggggtggtcggaataccgagaaaatatttggaggatgtccaaatgttcccttgatgggaacaaggggttgtattaattataatcccgttctcgccataagacagcttggctaccccatgagaggagcgccattagacgaaagcatcacgcctttcatcgcacggggttttagtgaccacaacgcaagggtactccaaggagttcgcaaggcatgggatgcggtgtga

SEQ ID NO: 15502 - DNA, 267 bp, Glycine max
  Peptide Sequence Number=SeqID_132280
atggcgagggcgtgcagccctttgatggcgatgacatgtaggcctctaaaggttaggacgtgcatccctctgaaactgaggacgtgtagtcctctgaaggtgagggcgtgcagccctctgaaggtgaggacgtgtaatcatctggaggtgagggtgtggagccctctgattgataggacgtgtagtcctctgatggcgaggatgtgtagtcctattaaggtgagggggtgcagccctttgatggcgacgacgtgtaggcctctaaag

SEQ ID NO: 15503 - DNA, 825 bp, Glycine max
  Peptide Sequence Number=SeqID_132281
atgactacacgtcctcgccatcaatgggctgcacaccctcattttaagggactagacgtcctcgccatcagagggctggacgccctcaccttcagaggactacacgtcctcgccatcaaagggctgcacgccctcaccttcagaggactacacatccttgccatcagtcgactacacgtcctcgccatcagagggctgcatgccctcaccttcagaggactacacgtcctggccttcagagggctacatgcactcgcaattagaggactgcacgtcctcgccataaaagatctgcacgccctctccttcagagggctacacgccctcaccttcagtggactacacgtcctaacctttagaggactacacgtccttggcatcacagggctgcacgtcctcgtcataaaagatctgcacgccctcaccttcagaggactacacgtcctcgccatcagagggctgcgcgccctcacctttagaagacaacacgtccttgccttcagagggttgcacgccctcaccttcggaggactacacgtcctcccattcagagggctacacgtcctcaccttcataggagtacacgtactcgccatcagaggggtgcacgtcctccccatcaaaggactacacgtccttgccattagcggactagacgtcctcgccatcagaggactgcacgccctcaccttcagaggactacatgtcctcgccatcaggggactacacgatgtcgcctttagagggctgcacgccctcaccttcagaggattacacgtgctcaccttcagagggctgcacgccctcaccatcagaggactacac

SEQ ID NO: 15504 - DNA, 424 bp, Glycine max
  Peptide Sequence Number=SeqID_132282
cgccctgcccgtcgccgatgacgacgccgatttcttcggcaccttcgcgatctctcccgcccggccggcgaaggagcttgatgccgcctatggtcccggcctgcttgcgccagcagaacaggcaatgagcatcgcagaactcatcgagacacgtcttgccggacgggccgattatgccgaccgcgtgcgcctcggctccatcgtcctgatcgtgcggactttggacgaacatgaggcgatagcgggtgtcggaatttcgctggagccggtcgaaccggctaccaccctgccgatcttcatcagcttctcggaaattttcaaacgggtgcgcgactatctggcgcagcggcgtcagtcgcgttccaccgctaccgcacaagacgtggtcgcaccttcaaacaccgtgagagaaaatgaagcctga

SEQ ID NO: 15505 - DNA, 234 bp, Glycine max
  Peptide Sequence Number=SeqID_132283
atggggaaagggtggttacggtggcgccttccggaagatccttttagggttcttccggaacttccggaagaaggtgttccggaagatttccgaaagaagggttcttccggaagtactgaaaggtcttccggaagaactggtcttttggaaagcttccggaacacctcttccagaaactctctggatgaagtagttcttccggaaacttttcgaaagaagggttcttccggatga

SEQ ID NO: 15506 - DNA, 207 bp, Glycine max
  Peptide Sequence Number=SeqID_132284
atggccatcaaagaactgcaaggtagtggaactctcaagcgggttgcttggggactggacgtaggcacaaaggtgtggccgaaccaatttctaaggccacttgtccaacaagtggtatcagagcttcattcttgtataaagtttagaagcttccagaataatggcctcagcaaacttcttattcctagaagggaactctataaatag

SEQ ID NO: 15507 - DNA, 360 bp, Glycine max
  Peptide Sequence Number=SeqID_132285
atgttcttggaaagcaccgtcttagacttgcccgacgtgaaaccaactgtctcatgccctcactcactgctggactacgcacacaaccttcaaccctccttgagatggggtgatttagtgttcttccagaatggaatgatggagccgtggcttgagagcaaaggtttggaagatgcaaaccaggtgttggcttattttgctgtgtccaaaattggagaaacccctattgatggtaggactgataccaatcctaaacgactcattgctgcatatggcaagtgggcttctattgtagctgctagattaaatgttggaggcctctcttgcaaggtttcttctttttaccgtcatacatactag

SEQ ID NO: 15508 - DNA, 614 bp, Glycine max
  Peptide Sequence Number=SeqID_132286
atgagaatcaactcagaggcagctgctggaaaaatgaagcacaaggccaaacaaccatttagtgaagagacttataaggataagaagaatgaagatattgatgataatgtcattccctccttaaccacaggtttccttggtgttagaaaggatgctaagaaacatggaaagagagaaggcacactgaagttaaaggagaaggataatattggtcttggagaagaagggaagctgctgaatgatgagaaggtttcaaaggagatggatgatcttttggcatgttatctgactttgaatgcatatgagtatcatgatctcatcatcaaagtgttctggcaggtatggtctgacatgaggcaaggtggtttaggcactttagagctcaaccctgataggctgcgtgagctcaaagcatttgataactcaatagttggtgttaaaggcttgttgatgaagggtgtcaccgcaatgacctttgggttcttaaaagctgaaaaactcactcagaaaggtcacactcagaaactcactcacgagcaaggtagcgcgggaaggtttggtgggaaggtgtcaaggtgctgcgaaactcactcacgagaagctagcgcgggaag

SEQ ID NO: 15509 - DNA, 228 bp, Glycine max
  Peptide Sequence Number=SeqID_132287
atgcatggtagtagtaatggggtggaagaagctaaccacatgctaataggtgtttgtatgttaaacgtagttgtaaaacctggacagtggacctggtctggtggccggaaaaaagaaaaggcatatagttatatggataacaaatctccgagcaaggagtccaaggaggtgacacgtgaatcgcttattgctatttctaactctttacctgataagactctggaatag

SEQ ID NO: 15510 - DNA, 399 bp, Glycine max
  Peptide Sequence Number=SeqID_132288
atgcaggccatgatgaagcgtaccttgaatgtagcgcaagatgcgcctgagggcttgcatgctgcgatagtgagatggatcctcatacagagtgctagacgtagcactgagttttgctttagtatcaaccgaatccataatgtccttgatcacatcgtccctcctacggatgagaaagctaagaaggcgatagataatgcaaaagcagtcgatcctgatctttggcatcatcttgatgcggtcgtgttacaatggatgggcaacgacaagaaaaacaacaaaaattggggtggtcagaactttgacaaaggtggttgtggcagcggctccgacgacgggcaaggtgctggtggtggtagtcacggacagcaacaaccatctcagactccttggcaatag

SEQ ID NO: 15511 - DNA, 201 bp, Glycine max
  Peptide Sequence Number=SeqID_132289
atggaggagaatagaaagggagcaagtacaagggttattggcaatcgaaataatggtaatattttgagggctagcctatgcacacaagagtatttccattggggaaccatttatcaccaaacagaaattaacagaaaaggaaaaaggggggtagttgataagttaaatatgaagcatgcgtggttatcacagtcacactag

SEQ ID NO: 15512 - DNA, 516 bp, Glycine max
  Peptide Sequence Number=SeqID_132290
atggttagaggtggtggactccaatccatggattcagatccaattgggagcttcttctactccttgctacatgaaaaagctatagatgatgctgaacttgacaagttgttcacagcatgcaaagattggggtttctttcaggtggtgaaccatggtgttagctctcaactgcgagagaagctgaaacttgagattgagaagttcttcaagctccccattgaagagaaaaagaagtaccaaataagagcaggagatgttcaaggctatggaactggataccttgaagtcatacttcagagaattgacgaaactaggtatggaacttctggggttattaggaagagccataagcatggagatgaaggaaggctcaccccgcactctgatgccacaggcataaccatccttcaccaggtcaatggtgtggagggtcttgagataaagaaaggtggggtttggattcctgtgacctttcttccagatgcttttgtagttaacattggggacatcatggag

SEQ ID NO: 15513 - DNA, 1134 bp, Glycine max
  Peptide Sequence Number=SeqID_132291
atggactcacacaagcaactattttccctctcatgtcttcccctactacttctacttctctcaggaaacatgggtatgcaattaagcgaggctcgcttgcaacgccatgagatgaattattattctccgaaaacgttgttcgtttttggggactcgtatgttgataccgggaactatagaataaatcaagctggttcgtcgtggaaaaacccttatggcgaaacttttcccggaaaaccagccggaagattctccgatggaagagttctaaccgactacattggagcttttatcaccatcagtcctgttctagctggactgctacactttgttcgtaaaactaagtatttgggactcaaatcaccagttccctataaatttaggaaagtgatgcagcaacatttgaaatacgggatgaattttgcatttggtggtacgggagtgtttgacacatcctccaaaaatccaaacatgacaatccaaatcgatttcttcaagcaattgatcaaagaaaatgtgtacaccacctcagatctcaacaactcagtcgtctatgtctccgttgctggaaatgattacaatttctacttggccacaaatggctctattgagggtttcccggctttcatcgcctcagtggttaatcaaactgccaccaacttgcttcgcatcaaaagtttgggagtgaggaaaattgttgtaggtggtctacaacccctaggatgtcttccttcatccacagccacatcttcattccaacaatgtaacagcacctccaacgacctcgtagttctccacaacaacctattgaaccaagctgtgaccaagttgaaccaacaaaccaacaaggataactccaccttcatagttcttgacctttttgacactttcacgtctgtgttgaaccacccatctaccaataacattaaggaccctctcaagccttgttgcgtagggttaagtagccaagatttttgtgggaaagtggatgagaacaatgttaagcaatataaggtttgtgacagtcccaaatcagctttcttttgggataacttgcacccaactcaagcaggttgggaagctgtgtataagaagttgcaaaagacgagtgctcttcatcaaatccggtactag

SEQ ID NO: 15514 - DNA, 219 bp, Glycine max
  Peptide Sequence Number=SeqID_132292
atggttgggagtgtgataaagagtccagaaatatctggtcttgttcctactctacttaagggactttgtcatcctaaagagcatacaaaatattcccttaatattcttcttcaagtaaggcttttaatactgttttcagttgtggtatcacttgctaaacaatgggcatttgaagaaccttctgtggagacaataactggtgaaaatgttttgacatag

SEQ ID NO: 15515 - DNA, 1170 bp, Glycine max
  Peptide Sequence Number=SeqID_132293
atgtctcctccttcctcaaatgaatcaccaatctcccatcaaccttcttctcctcgccgttcagctagcaagacccatcctccttcctatcttttcgattatcaatacaaacttcctttaataaagtcagctaagctcaactctcttccacttgctcatatcctatccaagcttgtctctcctatgctcaaatttctccatctcatcactacctcattgctttctcatctgatgaagaaccaacctgcttccacgaagccagtaagcatcaatgttggcgcgatgcaatgtaatgcaaaattgaggccttacagtcaaatcagacttgggatgttgttcccaccccctcacattgtcgaacgatacaaagcccgtctcgttgcaaaaggatattctcaggttgaaggaataaactactttgagactttctcttcggtagttaagatgaccatagttcgtactattctcccttttacctcaatcaatcagtggcaccttcaacaattagacgtcagtaacgcttttctaccaggtgatctttcagaagatgtatacatggacatcccacctggcttgcctggttactcttccaatcagagttgcaaactacgcaagtcgctctatggtctgaagcaagaaaacgaaaaatggtatgagaagctctctcaattattactgtcttgtagttacaaacatgctcatgctgatcatagcctgtttattaaatctcatgggtttgattttactgcattaataatttatgtggatgatatagtgctgactgacaattctgttcaagaaatagactatattaagcgcacacttcattccaatttccatactaaagactcgggacaacttaaatatttcctggaaattgaggttgctcattccataaaaggcatctctttatgtcaaagaaaatactgccttgatctcttaaaggatactggcctgcttggttgcaaaccatcctctacaccaatggatagttcccttcgccttcatgttgactcttctggattccttgatgatcctcttcgttatagacgactcataggaagacttgtctatttaacgagcaccagaccagatattgcatttgcaacacaaaaactcagtcaattcatgtccaaacccaccaaggctcatcttgcagttgcttattga

SEQ ID NO: 15516 - DNA, 594 bp, Glycine max
  Peptide Sequence Number=SeqID_132294
atgcgtacctccgacgaaataggaagaacaacaactaacaaaacttcaaatacggaacacctgcttcaccgggaccaccaaatcttaaatacttcatgggaccaccaatggaaagcgcaagggaccaccaccgaaagcaaccgaaagcaacaacaaccaaaaccatcgaaagaaagcagagaaggaagaagcagtaaaataataaaaagatatcttccggaagaagcttctttcggaaacattctggaagacgttcttccggaaggagtttctgagtacttccggaaatcacaaattcttcttctggaagaagcaataatgttgggtgcacgtagcaactcccaaggcgtggtcgatgatgggcatttggttgtcgttgtaagtttgcataaccctctgagctttggtgtgggagaggaacttgatgaaaccgtagccctcatgctgtcccgtgatcttcttgttgatgattttgatgaagacgagctcgtcgacaatggtccaagagaaggaggaggagaatggaagaaagaacacatgagtagaaagaagagagcaaaaagtgaaattaaaattaatgcttcgacatgttaa

SEQ ID NO: 15517 - DNA, 1092 bp, Glycine max
  Peptide Sequence Number=SeqID_132295
atggccggcacacctagcacttcctctggtgaggaggatcccccatctcctccaccacctccacccttctctgatcctagccaaaacccatccaatcccttttatattcaccccagtgaaagcccatcttccatccttgttactcctgtactcatgggacccaactttcagtcatggtctcgttctgtacgcatggctcttgtctccaaaaacaagatggacttcctcactggctccataccgattccttcagaagcagaccctctttaccctcactgggaatgctgcaacactcttctgatgtcgtggcttctcaactctcttgcaccttccattgctcaaagtgtagtcttccttgagatagccattgacatttggactgacctcagagaacgattcacacaaggagatctccttcgggttgctgagctccaggaagaaatttattccctccagcaaggtaacctctttgttactgactactataccaaacttaagtctctttgggaacaacttgataactttcgtcccttgattccttgcccttgctttgcaaagctggcctcgatgaacactttgccatggctcgctcccagattttgcttctcgatcccttaccttccgctactccattccgctcctccttcgtcttcgcttgatggaaacccctttgtcaatgctgcttctggttctcgccgtggtcctcagcagcaaggggggactaaaacttccaagaaatgtgatcattgtggacgtcttggccacacaatggactcctgctttcagcgaactggcacctcgccactgaaatatgctcattgcgaacgtgttggtcacacagaggatgtttgttatgccaaatttggttaccctccaggggatcccaaatacccaaggcgacctcgtcttccccacaaatcttcttctggtggcagagcttctggtggtaaagccgtcaacaatgccgttgccgcacctgggaatgaggctcgcgcactacctcacattggagatgacaagcaagtttcatctcatgggaatgggcctaacatcacaccagcccaataccaacacttgatgactcttctttaa

SEQ ID NO: 15518 - DNA, 1266 bp, Glycine max
  Peptide Sequence Number=SeqID_132296
atggatcctcaagctccggcgacggccaccaccgctcgaagcgccgccgcggaaccctcgcaatctcaacccccaaaaccatcccctcctctccctctccctccaccttccacatcatcaacccctcccatctcagctcctccacagcctcccccaaacactaaccctagccctaaccctaaccccagccctgcccctggcccgggcccaattcaagccccgagccccaaaccccccactcccactcccactaccactcccacgcctccccagcccttcaaccgcgctttgtcgccgccatcgcaaccgcagttcccgcactactcctccccttctccgccttcctccgctcccggcgccgccccgccgccgcggggcggcatggcgatcggtgtgcccgcgcaccaccagagcccctcccctccgttttcgtcctccttcggtcaacattttggggggttgggtcgaaccggagtcaacgtcgctgaatctacctccaattcaagcacctctcaagtgaggacgccggtgcaaggaacggggatgttagggtctcaaatgcggccaagtggaatcggtgcacatcaacagagacccgtgcaatcgtcgcttagacctccaccaccctctgcaccgaataatcaaccggctggttcacaaagttttcaagggcatggacttatgagatcctcatcagtgggatcacctgctactccgtctccgagttcatcactaagcatgcagtcacttaatcagccatggttgtcatctgggccacaagggaagcctcctttgccatccgcagcttataggcagcaattgaacccacaatccatgcagcaaaggccacatattcctctgcagcagcaatccacaccaacacctttgctggctaatcaatcgcaggagcattttgggcaacaagttctgccacccagggctcctctacatgtacctcatcagccacagattatgagggtacacgggccaggaaatcagaaaccttcatctcttgtggcagcacaatctagtgcagctcaaccagggactcgaagtagattaacaaacacagatactgatgaatcttctaatagtattctcagcaaaagaagtatccatgagctagtcaatcagttgcctgttgaaattcaaaagaatttcattatttctcctaaaggtccatttatgaaattttctgataccccggttccatatcagacatgtaaggaattggatggtggcttacaagtgcttattgctacttag

SEQ ID NO: 15519 - DNA, 222 bp, Glycine max
  Peptide Sequence Number=SeqID_132297
atgatcctcacaggaaaaggtcctgctcttggatctctatgggttgcaaacctccccctcaaggttggattaaagctaatgttgatgtatcagttggtgctagaggacactttgctgcttgtggaggtgttttcagggattctcaaggggaaaaatgtgatggacgtatgccagtatagtgaaagcagcggtgccaaccccagcccacagaaactaaaataa

SEQ ID NO: 15520 - DNA, 486 bp, Glycine max
  Peptide Sequence Number=SeqID_132298
atggacggagatcaatggatgtatgacagtatgatgtctgaagaagttgatatggattatcaaaatgaagaagaatgtggtgtgaatgaatcacatgtgtttgacagccgagatgatgttttgcagtgggctcgatccgttgctcatgaaaacggatttgtggcggtgattataaggtctgacacaaacactggttgtagagaaaggatttcgtttgtgttaattggccgtgaaaggagtgccgagtataggtgtaggaagaaagaatttgttagaagagatactgggactaggaaatgtgggtgtcccttcaatcttcgtgggaagccattgatgtgtgggattcataatcatgaattggccaagtcattagttggatatccatatgctgggcgattgactaaagctgaaaagacacttattgctgatatgactaagtcaatggtgaaaccaagaaatatcctgttaactttgaaggagcattga

SEQ ID NO: 15521 - DNA, 283 bp, Glycine max
  Peptide Sequence Number=SeqID_132299
atggtggcagctgtagaggtggcggtggtgcatctgtggctgactgctgttggtcttgccctggctgctagaattatgatcgctgggaaagatgttgctgaggagcaatgtcatccagatctgtgtcaaggtggtcatgctagtgcacatgatccgcactcgccttcccgtcacgcttcgtgcaaagaccaatggatgccccaagaactgattgatggcatcttcaacaaaggggacccattggccccgcacccaggagcgcttatccctaattccttcctcg

SEQ ID NO: 15522 - DNA, 1023 bp, Glycine max
  Peptide Sequence Number=SeqID_132300
atggctacaccaaccaccaatccaagtcaagatccaaccaactctcttcaccttcatcattcagatggtcctagcctcgttctcacatctcaaccccttgatcacaagaattacaccacctggagcatagcgatgaagcctaaagaaaaagctcccacctatgatgcttggacacgtgcaaacaatgttgtcatctcgtggctctacaattcggtatctaaagaaatcatcaccaacatcttgtttgcaaacaccacgaaagaaatttgggacgacttgaaaactaggttttcgaggaaaaatggccttagaatcttccaattgaagcaccaattaatgtctttgcaacaaggaactaacgatatcagcacgtattacacaaaacttaagtcaatttgggaagaattggttggttacaaaccaacctttccatgcacttgcggaggtcttcaacaactccaaactcacaacgaatctgagtatgtaatgtcattcttaatgggtttcaatgatttctccctaatccttcaagaaaaagctcaaagggaaattgttgttactcactcacccaccaatactttagaaaatatagtcttttctgttaattttgcatcaaagaaccaatatgacagcaataaagggaaatacatcaagaaagaaagacccaaatgtgctcactgtgacatgttgggacacacgaaggacaaatgctacaagcttgtgggttaccttccaaattacttcaaaaatcgcactagcaactctgtgaatcaagtaaatgacacacccgaaagttcaacttctgctcgagcaccaactttaactgctactcaatgtcaacaattgatctatttcttaactaatcacatgaaaaccaaaaacaccattgatgcagtagccacaaatgttacaggtatctgtatgaatgctgattttaataatgattaccacacttggatcattgacactgaggacctcaagactttgaggaggattggcactgctaagcaaaagcaaggataa

SEQ ID NO: 15523 - DNA, 1101 bp, Glycine max
  Peptide Sequence Number=SeqID_132301
atggcaaaatgtaacaagtctcttgtcgtgattctcctcctccttcacatcctatgcttgcaatcacaagtgaatggtttttctcgtcaaccttctcgccagttaatcttcacaccccacaaacgttcggattctgatcctcaacaggtgcacatttcgttggtgggcaatgatcatatgagggtgtcatggataaccgatgacaaacactcagaatctgtggtggagtatggaacaaagaaaggtgaatatagcacaaaagcaacgggggaacacacttcataccattatttcttgtacgaatccggcaagatccaccatgtggtaattgggcctcttcagcccaacacaatttactactacaggtgcggaggatcgggttctgagttttccttcaagacacctccactaaagttgcctattgaatttgttgtcgttggggatttgggacaaactgaatggacaacatcaaccctaaaacatgtggatagcaaagactatgatgtgtttctactacctggagatctatcctatgctgatacccatcatcctctatgggactcctttggtcgtttggtggaaccctacgctagtcgtataccatggatggttacagaaggcaaccatgaaatcgaaactttccccattatccaaccaaatggtttcaaggcctacaatgctcgttggcccatgccatacaaggaaagtggctccacctcaaacctctattactcatttgatgttgctagcacccacgtcatcatgttgggctcttacacagattttgatgcacactcccaacaatacacgtggcttcaatctgacctagctaagattgataggaagaggacgccttgggtgattgcattgttgcatgcaccttggtataatactaatgaggcacatcaaggtgaaggtgaagacatgagacaggccatggaagagttgctttatgaagctcgtgttgacttggtctttgctggccatgttcatgcatatgaacgctttactcgaatttatgacaataaggctgattcatgtggtccgttgtacgtgacgattggagacggaggaaaccgtgaggggcttgcattaaggtga

SEQ ID NO: 15524 - DNA, 769 bp, Glycine max
  Peptide Sequence Number=SeqID_132302
atcatatgcacctcttgtttgcaagctgaataagtcaatttatggcctgaagcaagcttcaagaagctggttcaataagtttagaaccacattgacatctcaaaactacactcattcaaagtatgattacaccttgttcaccaaaggaacaggctcatcattcatagccattttgatctatgttgatgacattgtcattgccagccctgataagacaacaattaattctgcaaaaatcatgcttcagcactacttcaaattaaaagatttgggtgatctaaaattcttccttggcctagaactctcaagatctcaagtaggaatattcatgtgtcagagacattacactatgtcaattttggaggatattggaatgcttgcttgtaagccatctgcagtacctatggaggttgatctcaaattgaatgcagaatcaggatcacaacttctagatccaggaacttacataagactcataggaagacttctatacctaaccatcttaaggcctgatatttgttacaatgttcacaaactaagtcagtttgtatctgatcctcgctcaggacacatgaatgcagcaaacattctgttaagatacctcaagcacacagctggacaagggatcctttttaaggccaagttagacacatccatccatgcatatgtagatgcagattggggttcatgtattgatagccggaaatcaacaattggatattgtattttcttaggaaattcattgatttcttggaaggcaaagaaatag

SEQ ID NO: 15525 - DNA, 659 bp, Glycine max
  Peptide Sequence Number=SeqID_132303
gtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcgagtacgcggaacgcacgggtggcgctagtaggtcgttatcaatagaagtagttgcattcgatgtgcagtcgtccatcataggctcagtagcacttgagaagaggcatggggcagcaccactaaccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 15526 - DNA, 353 bp, Glycine max
  Peptide Sequence Number=SeqID_132304
atgggggataagcttcatcgtcgagagggaaacagcccggatcaccagctaaggcccctaaatgaccgctcagtgataaaggagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggccgaagggcgtagtcgatggacaacaggtgaatattcctgtactaccctttgttggtcccgagggacggaaggaggctag

SEQ ID NO: 15527 - DNA, 279 bp, Glycine max
  Peptide Sequence Number=SeqID_132305
atgacacactttgatggcctgtatctcttttcttctgtagtttacaaaaccaaaggtgaaacgaaagatattgagctggtagaggaggaacatgcacgcattggtgctgattcttctagtgcaacctctaataaatgtgagaattataaggaggaagcacggaatgcagcacagaagcataaagcaaagagggtggagagtgtcaatgctgatgtagaagcctttggtgatcactggaaagttcagattgctctatgcattctgaagctgaagcactag

SEQ ID NO: 15528 - DNA, 624 bp, Glycine max
  Peptide Sequence Number=SeqID_132306
atgggtgaagtagaggagatacaagagaagatgaatgccgacatggaggccattaaagagaaaatggccacaatgatggaggccatgatgagcgtgaagaagataatggaagccaatgcgattgcaattgccgctaccagcgttgttgctaaggtgaacccgacgtccccatccggcctcaagcaaatgaatcatccaacctcaaatatggtaggcaaagatttgggaagtatggatgaccccatgatgtgcaaattcaaaacaagcacgccttcccgccatatggtttgcctcccaaactatacaccacccaatgtggtgtacattcccaatgaggatccttgcctcggatatgctgctgaagggcaagcagttggtggtatacccctgcaaaacactttggagggccctcaatatcatccacaaccacaaccctcacgttccacagcggttaaaaccctcatgactatggcaggaatgggaaagttggatcatctagaggaaaggctcagggccattgaaggaggtgaagattatgcctttgctaacctaaaagagttgttcctagtacccaatatcatcacccctcccaagttcaaggtgctggactttgacaagtacaag

SEQ ID NO: 15529 - DNA, 162 bp, Glycine max
  Peptide Sequence Number=SeqID_132307
atgacgaatcaatacgctttatacacgggagcaaaagatacaagtatcattcatgatcaaaaagcacaaaaaaatcaacaggaatttaaagatcctgtgattggtcctgggtgtcctgtgtctgaacctcctcctcgtcagtcaaatgaagcacaggagtag

SEQ ID NO: 15530 - DNA, 201 bp, Glycine max
  Peptide Sequence Number=SeqID_132308
atgggggcttgttttattggcggatcattcgagacatgtcaaaatgtgcctagctatgtgactgcaatgacctcttcattaatgctcgaacttgcttcttccatgaagtcccgcaaccttcagaaggcaaggtatttggtctttgcaaaagtctcaaatggatttcagaaatgcatttccaaagtgttgtttcgagactga

SEQ ID NO: 15531 - DNA, 301 bp, Glycine max
  Peptide Sequence Number=SeqID_132309
ggaagttgagaagaggaactggcataaggagctcactaacttctcagagggaagcattgatgttgctattgttaaagaattttatgctaacctctatgaccctgaagacaaatcgcctaagcagggaacccgcaaatctagggccagaggatctgaggcaccatctacttcagctccccctacctcagctccttctacctcttctctccctccagctctagcagctccagttctttcaggtccctctgctcagagctttccttgtctatgttgcagagcctgcattagggccagctcctga

SEQ ID NO: 15532 - DNA, 825 bp, Glycine max
  Peptide Sequence Number=SeqID_132310
atggtgtgcataatcttcgacggcccattgatcgtgcttgtgctggctcaccagaaggacgaaacgttcggtgaggccgcccggggtggagacggcggcagcaacatcggcgatggcgtgctgacagacccggacaagggtgacgcagagcaggctggcgatgatcgtgtcggaaccggtcgctgcgcggacattttcgctcgcgattgtctggagataagcctccagttccttttggtcctgctcttcgggtgtctgtaccagaatacgctgcagtatcgcgcgtacggcgtttgcgctcgtgcccgtcggcatcgcgtgagccagcccgatttcggtggtcgtcaacagcgatccgcggctgccggcgctcagtctcacgcggccggccgggcctatgggcagccagatgagccccggcgaagggacatccagcctcttatcgccctgcgtgatctccgcttccccgacagaaagcaaaagcatgtgggcgctgtctgcttccagccggaattccgatacgcgcagcgaggaggcgaaggtgcgtgccgtgatctccacgcgattggcggcaaactggctgtgcagcggcattcaacctccaaaagtgcaataatgcactacactagtgcattttatatgcaactgtcattgctaaacttcgatcagcgcgtggggagtcttgaggagaaggactgcccgatcgagcgctttgggaggaacatcatgaacaatttgaagcgcagaacgctgttctgcctgctctccggtgctgccctgtctgcagtgtctttcagtcatgccactgcgcacgaccgcacttcc

SEQ ID NO: 15533 - DNA, 609 bp, Glycine max
  Peptide Sequence Number=SeqID_132311
atgaccggtagattgctggccgggtcattaacatttgataatcgcatcatgcactatataattgttagaatttttcttccccagtcttcaaatttggcacaagcctctgaggaggatttgattctgatgtgggctttccttaccggttgtcagatcgactgggctcacttggttcggtaccgaatgcataagacattacgggccaatgcacctctcccttaccctcaattgataactttatttttgcgtcattttcaaattccgcttgatgatgaaccatttgttcaagtcaagcgttcctttacaattggtgttggtgcagtgacttcctttggataccgtaaggatcggaatggtcaatggctgaagaaagacgcactccctcctcaagatgagcgtactccttcacctcctcctcagcgagatgattcagccctcatgactgaagttctttctgagttacggggtcttcgttcttatgttggtgaacgtttcgactcactggatactcgttttgccgaaatggatattcgcctcacacagcttgaagaagatgtgagttacatttgtcagagtttcgatcttccaccaccacctccaccttcttag

SEQ ID NO: 15534 - DNA, 502 bp, Glycine max
  Peptide Sequence Number=SeqID_132312
atgtcatacggagaaggtctcgggtattccgcccgtcagcgtgactcaaatgtgagtatgacagaacttgtgagcgcggaagatgacacatcaaaaaagaatgtttgtacggataaccactcgggtatttcctcccgtcagcgtgactcaaatgtcagtatgacagatcttgtgagcgcggaagatgacgtcaatctccgtgtgtcaacgggcttgcttttcgtcttacagaaagcaaaaaagaatgtttatacggataaccactcgggtatttccgcccgtctacgtgactcaaatgtcagtatgacagatcttgtgagcgcgcttttcgtcttacagacatcaaaaaagaatgtttatacggataaccactcgggtatttccgcccgtcagcgtgactcaaatgtcagtatgacagatcttgtgagcgcggaagatgacgtaaatctccgcgtgtcaacgggcttgtcggccgcgattgacgaagggcgcagaagacgac

SEQ ID NO: 15535 - DNA, 330 bp, Glycine max
  Peptide Sequence Number=SeqID_132313
atggcaaggaaaagtgtgattcagagggagaagaagagacaaaaattggaacagaaatatcatttgattcgccgatcctcaaaaaaagaaataagcaaagttccgtcgttaagtgataaatggaaaattcatggaaaattagaatcactaccgcgtaatagtgcacctatacgtcttcatcgacgttgtttttcgaccggaagaccgcgagctaattatcgagactttggattatccggacacatacttcgtgaaatgagcaacttggtagctcgcaaggctcataaccttgaggtcacgggttcaaatcccgtctccgcaacattttga

SEQ ID NO: 15536 - DNA, 300 bp, Glycine max
  Peptide Sequence Number=SeqID_132314
atgttgggaagacacatattagctgaaaggaaagtggaaatctatcacacagagctggatgaattcaagggcgggctggagaggcgtaactttcacaagtgcctcaccaacttagctgatagtagcattgacctcgcgttggtgaaggagttctacaccaacctctacagtctcgaggggccttcacctaaacaagtcagaaaccggggccacttaataaggattgatgcagacagcctcaattcctttctagaaacacctgtggtgcttgctgagggtgaatcttgcccacctacttaa

SEQ ID NO: 15537 - DNA, 261 bp, Glycine max
  Peptide Sequence Number=SeqID_132315
atgcgtagtgattgcttagtgcaattctccattctcaccctttttcggagccccatgaatggcgtcttcgttcatgtgttctccaccttcgagtcgggagctatgcgtagtgattgcttagtgcaattctccattctcacccttttgcggagccccatgaatggcgtttccgtccacgtgtcctccaccttcgagttggcagccatgcgtagtgatggcttagtgcaattctccattctcaatcttttcggagccccatga

SEQ ID NO: 15538 - DNA, 280 bp, Glycine max
  Peptide Sequence Number=SeqID_132316
aaagcaaagaagaaggggtgaggagagtagaggggtgggtgtaaagagcaaagcgcgagggctagtagccctaaggcccagcctcgtgcttggcgccaccctgcgcgttgctgctggcacgcgcttagcgcgttctctgaagttcatgagcgcgcttagcgcgactgtgctagctaagcgcgtgtttcgtcttgctcctctgtctggcagcggcttagcgcactgcacaagcctcgtgcttgcgcttgctaagctcctcgtgttatctggtaccacttag

SEQ ID NO: 15539 - DNA, 243 bp, Glycine max
  Peptide Sequence Number=SeqID_132317
atggtggttgctactggacggcgaaatgggttttggaatttattaacattctccaaaaagggtactgttaataatcctaaataccattcgggtaatatttccaaaggagttgcaaatggatccgcgggttccccaatcatggatggttctagaaccgctaagcctacgttacaggcaatagtacctagaattactactggaaaaatatataaaagatcgttgggccatgcaggttctccataa

SEQ ID NO: 15540 - DNA, 174 bp, Glycine max
  Peptide Sequence Number=SeqID_132318
atgaccccttcacagcaatatcatggcccaattccaacacctaatgccccgctgacgaagaagaagcggggaggcatcggggcagaagaaatcctgatcgccaagcacgaagatgggatcgaccatgtggcacatcctcacgacatcacggacaccaaaatgaatgatttgcat

SEQ ID NO: 15541 - DNA, 476 bp, Glycine max
  Peptide Sequence Number=SeqID_132319
atgaccgatcgtctcaatgagtcgatctcttgctttctcataaggagggttcacgccttcaccttcagaggactacacgtcctcgccatcagagggctacacgccctcgccatcgtaaggctacacaccctcaccttccgaggactacatgtcctcaccttcagagggctaaacgcccccgccttcgtagggctacacgccctcaccttccgaggactacatgtcctcaccttcagaggactacatgtcctcgtcatcagaggactacacgtcctcgccatcagagggctgcacgccctcacctttagagggctacacaccctcgccttcgtagggctacacgccctcaccttccgaggactacatttcctcatcttcaagggacaacatgtcctcaccttcagagggcgacacgccctcagctacacgtcctcgccttcagagggctacacgtccttgccttcagaggactacac

SEQ ID NO: 15542 - DNA, 1295 bp, Glycine max
  Peptide Sequence Number=SeqID_132320
gagcggctacccgacggattcgctgtccaggtggatcgtcgagtccgcgtgctcgacgagggttcggcgctgctgggcggctctccgactcggctgctgcgcttggctccggcggcgcggacactgctgtccggtggacggctcgaggtccgtgacgcgaccagcgcgcagttggcgcgcacgctgctggacgccaccgtggcgcatccccgcccggtgggcgggcccggctaccgtgacgtgactgttgttattccgtgtcgagacaatggttttgggctacgccgtctgttgcgggcgctgcgtggcatgcgggtgatcgtcgtcgacgacggctccaccatcccgatcgtggcgagcgatctagaaggcatgcattgtcacgtggaggtggtgcgccacgctgacagtcaaggcccggcggcggctcgcaacaccggtctgaagctcgcgacgacggacttcgttgcgttcctcgattcggatgtggtgccacggcgtggttggctcgaggcgctgttggggcacttcagtgatccggcggtggccttggtcgcgccgcggatcgtgggattggtgttgagtgacaacgctattgcccggtacgaggcggtacgttcctcgctggatctcggcctgcgggaggcccctgtggtgccgtacggtccggtgtcgtacgtcccgagcgcggcgattgtggtccggcggtccgcgatcgacgagatcggtggattcgacgaagcgctgcagtgtggtgaggacgtggacctgtgctggcggctgatcgaggcgggctcgcggcttcggtatgagccggtgtctcatgtggcccacgaccatcggctcactctccgggaatggtttgcgcgcaaggctttctacggaaagagcgcggctccgctgtcgacccgtcatcccgacaaggtggcgccgatggtcatctcccgctggacgctgctggtatggatcctcgcggcggtggggtcgggaatgggctacctggccgcggtgggcatggccgcattggcggccgggagagtggcccggacactgcgcggcgtggacaccccgccgcgtgacgtagttcgggtggctgctcaaggagtgggcggcgccgcgctgcagatcgcgtccgcgttgtgtcgtcactattggccgttggcattgttcgcggccgcgctgtcgcggcgcagcagacaggtactggtggtcgccgccattgtcgacggcgtcgtggactggatgaaacgcaacgacagttcggcctctcccgatgaccgcatcggtcttatcga

SEQ ID NO: 15543 - DNA, 1000 bp, Glycine max
  Peptide Sequence Number=SeqID_132321
tgtccgggcggccgccggcgattttctgcagcaacagttccagccccaaccgccccatctggtgcatgggcgagtggatggtggtcaggccgatgggcagggcgcccgccagcggcgtgtcgttgtagcccaccacggccacgtcgcggccggcctccaggccgtgctcgcgcgccgcgcccatcacgcccaccgccaggaagtcgttgaccgcgaagatggcggtggggcggtccgggccggccagcaagcgcgcgcccacgtggcggccggcgtcggtgtcgaacgggctttcgatgcgccatgcggccgggacctcgacgccgtgcctggcacaggccgcgaaaaagcccgccgagcggtcgcggcccgtgctggtgaagggttcgcccaccatcaccgcgatgcgccggtggcccatggccagcaggtgctcggccgccagccggccgccttcgaggtcatcgcaggtgacggcgcagtggtcgtcggcatggcggctgaccagcacgaacggcacgtcgcgccgcgccagttcggccagcagcggattgggcgcggcgccgtcgtggctgtgggcgtcgcccaggatcaggccgtccacgcgccgcgccagcgccatgtcgatcagcttgcgctgcttgtcgggcacgtcctgggtgttggacacgaaggtcaggtagccgtgttcggccgcggcctcgtcgataccttcgtagatggtggccagcaccatgtccgacaggcgcggcaccagcacgccgatggtgcggctgcggcgcgtcttgaggctggcggcgtgaggattggtctggccgagctgccgcgccaggctttgcaacgtgacagggcgggatttgttcatggagctggaggatacacgcacgaataccgtcccagggccttaggcggcaacctagggtttacacggtgtcgatttttgcgttcggagcacttagcattgcgcaacccaaacgtttgggtaaatcgactggattga

SEQ ID NO: 15544 - DNA, 255 bp, Glycine max
  Peptide Sequence Number=SeqID_132322
tcgatggtggagcacgcatggacagcactaggcgatccattcatgggtctccgaataagattggagaatggagaattagcgaatagcggtaggcgatcaattcgcggggctcaagagtcgatggtggaggacgcatggacagcgctaggcaatcaatgcatgggtctccgaataagattggagaaaggagaattggcgaacatagctaggcaatcaattcgtggggctccagactcgatggtggaggacgcatga

SEQ ID NO: 15545 - DNA, 288 bp, Glycine max
  Peptide Sequence Number=SeqID_132323
atgaagaatggtggaaaaccttcgcgaaatcgcctacggaaacgtctcagaagcattacggaagcgtctcgacttggattttcttcatggaaacaatttttctcactaattttaagtgattctcagatacctggaagggttgaacgaatttgttctgccctccttcccctatttataggggaaaagagggaggtggttgccgcccagcttgcccaggcgagctgggttgcttccaccagaaggcaccgccttctgttggaagatcctggaaggcccaagtgggcctga

SEQ ID NO: 15546 - DNA, 372 bp, Glycine max
  Peptide Sequence Number=SeqID_132324
atgtcacgttacagaggacctcgtttcaaaaaaatacgtcgtctggggtctttaccaggactaactagtaaaaggccaacagtcaaaagcgaacttagaaatcaatcgcgctccaaacgacaattgcttaaatacgttcgtatcgccggaaaagctaaaggatcaactggtcaggttttattacaactacttgaaatgcgcttggataacatactttttcggttgggtatggctgcgactattcctcaagcacgccaattaattaaccatagacatgttttagttaatggtcatatagtggatataccaagttatcgttgcaaacctcaagatattattacagcgaaggatgacaaaaatcgaaaactctga

SEQ ID NO: 15547 - DNA, 171 bp, Glycine max
  Peptide Sequence Number=SeqID_132325
atgtacttctttcttcagccacatggtggaattttgtgtgaatggctgatagctacaagtgttgctgcaagggccggaaaggttgtgggttcagtaatgcgttacaacaactgtggggtagttcatatcctaggagaaactcaggctataaaagtgagagggtgggattga

SEQ ID NO: 15548 - DNA, 207 bp, Glycine max
  Peptide Sequence Number=SeqID_132326
atgggcacagaaggggtgcaatacttgttaagagcattgttggcttttatgatatgtgtctcgttatcatgtttgggtgacatgggtaaggcataccttttcctgaagaacgggagacagaaagtgatgagggtgagggaggagtgtacattttttagggattatcaaattatgtgtagacaaaggtatgtatatcaataccaataa

SEQ ID NO: 15549 - DNA, 843 bp, Glycine max
  Peptide Sequence Number=SeqID_132327
tgtgctttgcacgagaaatctgcacatgttaatggaacaaaggaaccaatagatgtacctcctgaaactcctcctactgaaaatactttcaatgctggtgttgaatcttctggtgtggagcaattcacacctgatggaggagtcactctggcagctgttccctccgaaactgctaatgggaaaaggatcaggaacattgtttctgctgttaagcatgtccataccaagcggaagggaagaccagctaaatggcatgttcgtgagagaacacttgactgggtggctgcactagaagctgaacctgtttctgcatctagaagtgggacatatgaggtatacaaatcaaatagaaggcctgtcacagatgatgagactagaaagattgagtcattggccaaggcagcatgcaccgatgacagtatatatgtagtcatgaaacccacgcatgtgtacaagagattcttcgtgtcaataaggggtacatggataggaaaacatatctctccatcatctcaagatgtgatattgcgcatgggtaagggtgaatggattgccagatacagctacaataatattcgtaacaatggaggactcactggtgggtggaaacatttttctttggatagcaaccttgaagagggtgatgcctgtgtgtttaaaccagctggccaaataaacaacacttttgtcattgatatgagcattttcagagttgttccggagactgttcctctcactccgatgtctcgtggaactagaactggaacaagaactggaactggaagaaggggtaggaagccagcaacaatgaagtctattcagacacaacttagttcaccatga

SEQ ID NO: 15550 - DNA, 183 bp, Glycine max
  Peptide Sequence Number=SeqID_132328
atggacaacttcttcgccccgttttcaccatgggcaaatattatacgcaaggcgacaagctgttggtttgtgagtcaaactaaggcatcctcaagccggtcagggggaccagtcgtgttgctagaatcagccatggaaatagcaacaagagcaccaatgataggccctgcgatcactagctag

SEQ ID NO: 15551 - DNA, 384 bp, Glycine max
  Peptide Sequence Number=SeqID_132329
atggagaacaacgatggtttgtggttgctaatggtggatgtgggtgatggagaaagttcttgggactttagaaatggctttggaagaaagaaagaagaagaaatgacgtttttcctaagctacacgaaagcaaaggctgaagttcgagcacactccatacatcttctcaaagatcccaacggtcagatcgtggaaacttttcttgtgaagctgcagaccaaatgtcgagaagatccaacggttaatgaaggctggacagcgtttttcccaaggcagcttcatgcttatcgcgagtttggtgctaagcgcaacgtcgaggatagtgagccctttttaagcttgacttgcagagaatgtaaggaggatggagagagtgcggaatag

SEQ ID NO: 15552 - DNA, 378 bp, Glycine max
  Peptide Sequence Number=SeqID_132330
atgtataatagtataataacctatattggtctccactatagtgcacattggcaaatggtcgtcattttgcctaatgaaaatgttgtcatctggttttgtttgttgcataataggccagacaactacctcaaaggcataattaacagtgctttgaaaggacttgatgatactcaacaaagtaaatctaagcctgctgctaggtggattgttgttaaatgtaatagacaaaaaggaagcattgagtatgagtattacgtcatgcactggatgtcaactataatcttaggaaatttcaagaataatagggcaatgaccaatggaaccagagagattgaaggcagggcaaagtactatttgaaagttaaaaatgaaacttaa

SEQ ID NO: 15553 - DNA, 789 bp, Glycine max
  Peptide Sequence Number=SeqID_132331
atggagggagcttggctgaggtcgttttttgatgagaaggggaggcatagaagcaacattaataattcatctttaacggtgtggctcgccgcacacaaccaagttggaacaccaatcaccaatccactatatccagtgcgatatctccgaccaaagcgacgccgaatcaaagctgtcatctttgaccgacgtcactcacgtgttctacgtttgctggaccagaaaacccacggaggcctaaaactgccaagccaacggtgccatgttgaggaacgtttacgcgccctcatcccaaacgctcccaatctccgccacgtgtcactccagacaggcattacctcggacccttcgaactgttcggaaagatcgaggtggcccatgatccgcccttcacagaggacttgccacgtcttgacgcgccgaatttctattacacacatgaagacgtcttgtacgtggagcttgatgaacttggttgggaccctttgtgtttatcctggtatttgcaagcatgaggttttggcggagaggtttgggataaaggagtatgggtttttggaaggtgaggatttgaggttgtcggagatgatgaaggataagggtgtagtgtgggaagagattgtgaaggagaatcagctgctgcacacgaagcttgaagaggttggggatgggtggtttacggatgctatgttgggaatggaggccgtgttggatagcatgaacaaggcgaagagcatgggttttttttggattttaggaactctaagaaatcgtttcagaattggatag

SEQ ID NO: 15554 - DNA, 1431 bp, Glycine max
  Peptide Sequence Number=SeqID_132332
atggagcggaagcaaggattcttctccgcgctcaaagacgaggtcgttcgcggcctctctccggcgaggtcacgcgccaagagccccgccaggagcgcgtcgcccatgtcctcgctgctccgccgtcgcaggaagcactacgcgccgccgccggagctcttcattgcgagatcgggaagcctcaggcccgcggaggccctctcgccgctgaaagaaggacccgacggaaccgacgacggcggccatgactccacgcgcggagagggtaggtggggccagtggatgaaaggaccactagcgagagcaccctctgtttcttcttcttcctcctcgtcctcttgcaacaacaaaaagtccgatctgaggttgcttcttggcgtgttgggtgctccactcgcccccgtccacgtgtgcaccacggaccccttccctcacctcagcatcaaagacatccccattgagacttcttctgctcagtacatattgcagcagtacattgctgccagtggagggcagaggcttcagaattcgattaacaatgcgtatgccatggggaaggtgaggatgatagcctctgaattcgagaccgcaaacaaggtcacgcgcagccggaactcctccaaggccgcggaatctggtgggtttgtcttgtggcagatgaacccggacatgtggtatgtcgagctcgctcttggcggcagcaaggttcacgccggttgcaatgggagactagtgtggcggcacacgccctggcttggtgctcacgcggccaaagggccggttaggcccttgcgacgtgcccttcagggtcttgacccaagaacaactgcaagcatgtttatcaatgcaagatgcattggggagaagaagataaatgaagaggactgtttcatcctcaagctttttgcagacccctcgacgttaaaggcaaggagtgaaggtccagcggagatcataaggcatgttttgtttgggtactttagccagaaaacgggactccttgttcacctggaggactcccatttgacacgcattcagaacaatggtggcgaggcagtatattgggagaccacgataaattcgtttctcgatgattacaggcctgttgaggggataatgattgctcactcgggtcgatcagtggtgacacttttccggtttggggaaacagcaatgagccacactaaaaccaggatggaagaagcttggacgattgaggaggttgcgttcaatgtccccggcctttctttggactgtttcattcctccatctgagcttaggtttgcttctatgagtgaagcctgtgagcttccccaaggtcagagggtgaagactgctgtggccgcagctgcataccatgccaaagtcgctcaactacaaaaatcgcatggtagcaacacgaataacattaactggacagtggatgtttag

SEQ ID NO: 15555 - DNA, 171 bp, Glycine max
  Peptide Sequence Number=SeqID_132333
atggaatggggaaagggaaaccttaaaaaagatgggaagtggggtccagttggaatattttgttttgcggtaggaacttgttgggcaagtgatttgagtgatgccaacgaaatttgggcatgtgaaaaacacgggaacaatcaggcgtgcgtgagtttcaagtccaactaa

SEQ ID NO: 15556 - DNA, 1215 bp, Glycine max
  Peptide Sequence Number=SeqID_132334
atggagcttctaatggtggtggatgatttttttgtcacggcgtccctggcgcttcttcttaccttcatcgtcttaaagctcgtcgaggccatgaacgacactcacgccgcaccaaaacgtcacgtcgtccacctcgaaccggatcatccggtttctcgagccaagaccaaggtcggtctcattagtccggttcaggaggaaattgccacgtgtgcagtaggagccaaacacgggatagaaaaaaaggctgccgtcaaatcggttcgtcctcgtgggaaacggttcaccgttaaccccgctcaaagcaaggttaaggtcgaaccggttcctcccgctcaaagcgagagcacgatcggttttgttagtccggttcaatctgccatgtgtgtggagactgaacgcaaggtagaagaagctatggtcgaaccggaactggttcagctcgttaagaccgagggcacggttggttttattagtccgattcaagctgacacctgtgtaggaacagaagacaagaaagaagaagctacggtcgaattcgattcccacgttgttgtggagtcaccggtgaaatcagacacagacattgtcgttacagaggaaatagctgagggcaatgaaggaacacaagaattggatgattcggcggagaagaggatcgtggaaagtgttgaagaaatcaacgtggaaccttctgttgtagatagcgacggaaaagagaatgaagatgattatgatgatgattgggaagggattgaaaggagtgaattggagaaagaatttatggcggctacggaatttgttagtggcgaggaaaatcgattggggggtgtaggaagcaatttgagaatggagttgtatgggctttacaaggttgcgacggaagggctttgccgtgaacctcaaccaatggctctcaagctcgccgcacgtgccaagtggaatgcttggcaaaagctggggaacatgaatccagaggttgcaatggagcagtatatcagccttctttcggataaatttcccggatggatcaaagatacttctgctggaatgagtgaacatgaaaccacaaggcctgaagtttctgggtccgatgcttctgatttgagcacaactttgtctcatcaacaaatgatcataactgaaagggagcttgaacaagagtctgattccaaggaccgtagcccacttacagagacagatttggagaacaat

SEQ ID NO: 15557 - DNA, 471 bp, Glycine max
  Peptide Sequence Number=SeqID_132335
atgctgggtgcacctagcaagtggttgcttttgctcagtgtgtctaagacatgttcgttcagtttaaggctggaaaaaagggatcagccaccattagcattacaaggtagttcaaagatgaaaaagtcacaactgaagttgaacccttctttgagcccaagaagactacgacgttccaacactgagaccaatttgaaggggctcacgccgacccatacgttatgctctcagagaatatgcacaaacagaagtcgtagttatcatgtctcagatttggataacggtttaaagatgacaaaaggtaggttgtcatcgttggcattaagcccctatatgagaagaaagaaaacaagcggccatgtctctgactccgagagcagttttgtgaagaaaagaggaagtctttcaccattcgcattgagccctttgagtccttatgtgaggacaacctgtggccatgtctcggattaa

SEQ ID NO: 15558 - DNA, 1815 bp, Glycine max
  Peptide Sequence Number=SeqID_132336
atgagaccgaaaaatgagaatgaaagagaaatgagctttggcagtaccaaggctaggcttcacagatttggccaaaccagctctacactcctccacgaaacccaaccccaacccaagttaaatgtgagaaagcctcatttctatgaggtttattcttctgccttcagctctcacagactgagacttcccgatggatttgtctgttatatggagggaagggcatatggatcagtttcgttgactggtcctagtggaaacatatggactgtgcaattgattaagcaagacaatgatctatttttccatcatggatggtcgacatttgtggtggatcatcgactagaatgtggtgaacttttggttttcagatatgagggtcacttgcattttaccgtgcaaatatttgataaggatgcatgtgagaaagaggcagcgtttcattctgaatgcagtcaaagttcaagcgactttgataatattaaagggcagaaaagagatcgaaaggagaattcttctttgcatattgttgttgatggtgttccaaagaaaatgagaggcagtaccaatgagaaccaggaacttgaactgggtgttggtaaagaactactgctgtatgacgttgtaagaccaattagtatgttcagagaaaatgaagaaacctccaaaacatgttcagctaatgatgtccctgtgccttttcacatggaaaatagcaatgaagatgaagaggctgacatcctgtatagaagtgggaacgacgatcatcattatattctcagtggagtttcattatcaaatgtatcagcacacgatgagaaaaaagttgcccagtcatttatttcctcttttccatattttgttagaatcatgaaaagcttcaatgtcagtggttcatatactctgaatatcccatatcagttttcgatggcacatcttcccaattgcaagataaagattattcttcataatttgaaaggagaacattggactgttaattctgtgccaacaactagggtgcatactagtcatactctttgtggaggatggatggcctttattcgtggtaataacataaaggttggagatatctgtatttttgagcttgtgcgtgagtgtgaattacgtgttcgcattgctgaggtgggaaaagatgggcgagattgccaggttggaaacgtagccatgactaggcctagtgcaggacatgctgtaagttccaaatgtatgtcaatgaatcctaaagtcaactcgaaatgcataagaaaagttgatctatcagataagaagtggtcaaagattggtcaagaaactattttatccattgacttaaagaaatctagtagagcttcaaatacttctaagaagatggggctttgccctcagtcgaaagctgcccataaaaagttggctgctccaaggagacatcgtgttgaagatgagctaagctcacaggctaaagctggtttgagaatgttgtttgcacttgatgaacaaagagtagctcaagcttttagttccccttttcctagttttgtgaaaataatgaaaaagtttaatgtcagtggatcatacactttgaaaatcaaatattttaaagatttaatttacgtgaagatcgtcaccacaaccaccatcattgccggaaccactactatcatgattgtcatcatgaccaccgttatcgtcacttacatgaccgtcactcctaccattgccatcaccgtcatgaccaccgttgtgttcgctgcagtgatcaccgtcattgctaccaacttgaccgccactattgttgccttcactgccgccagacagtga

SEQ ID NO: 15559 - DNA, 153 bp, Glycine max
  Peptide Sequence Number=SeqID_132337
atgagagagggaagcaataaggtgtcatcctcgaagcgtcaacggtgggtaccggcgagagcagaggtatctgatgggaactacacagcgttactctcgtctctcagattcgccaaactcgttcgcattaaggtattaatcggtaaggaatga

SEQ ID NO: 15560 - DNA, 843 bp, Glycine max
  Peptide Sequence Number=SeqID_132338
atgaatggaagtgccatgtgtagtgaggggaagagtgacctttggccctttttgcattcaacttgcatgactctaattcccatacgcatatcaggctctgcatctttggttgcttatagagctcgaaactcttatgcacacatagcaactacattgatttcagaggatgctattgagctgcttccagaaaaatgttaccatggtcgtatgtttagaaagcgagcatgccccattgattccttaagtttgagattaagtatattggagaaagttttgaggagtcttcttgagcgtaagatacttaaagatcagctttttggccttctcaaagcaaatattaaagcatcagctgttgtgaagttccccttagaattagaaagagacctaagtaataatgccactcttaatcgtacgattcctgattggagaacgaggcctagttttgaaaggttctggtttgagatattggccagagttgagggaaacacgctcaagcctcttttaatcaagaaagttatgtttgtagattcttcagttgatcttgttatatgcgagagttcaccaattcttgtaaaatattactcatgcactcatgattggtcatgctcaaggaagtatttacgaagtacaaggctaagacaagaaaaagggcttcgaaccattgggcgattcgagttggcgtatggtcgagtcgaagccaaggcagcaagatttctggacttagcacaatttctgacaaaacttcacaaaatcagttcgacttcgagcaatgaggataaccgttctaaggagcagttatgtgcatgtaaggtgtacgtagcaggacacttggcattaggatag

SEQ ID NO: 15561 - DNA, 324 bp, Glycine max
  Peptide Sequence Number=SeqID_132339
atggataagcagcaaaggaccactttggaggagaagacactcgatcgcaggaacttcaggggccatctctataaagctttgaaggatgagaaagtcaacacttatatagacgaccagcttaagaagggagatgaaatctcatcaaagccatcgaagattatccaagattctggaataccagaaagtccaaggacagattgtaataccaatattctacaacatagattcatcccatgtgaggaagcatgcagtctggaagctacgagcagacctttgcaaaacatgagggagattctaggtgcaacgactggaaagatgctctga

SEQ ID NO: 15562 - DNA, 390 bp, Glycine max
  Peptide Sequence Number=SeqID_132340
atggcaaagctcagagacacggtgaggttgatgatgaaaggagtaatttcccttccgattccccagcatgacacgtgtcccactttgcctagaaaagtggaattaatgatgggtagtgggagatcgaggcgacggttacacagtgaacgtgcgatcatgacgccgtttcaggaaaactggctaagacaagaaaaagggcttcgaaccattgggcgattcgagttggcgtatggtcgagtcgaagtcaaggcagcaagatttctggacttagcacaatttctgacaaaacttcacaaaatcagttcgacttcgagcaatgaggataaccgttctaaggagcagttatgtgcatgtaaggtgtacgtagcaggacacttggcattaggatag

SEQ ID NO: 15563 - DNA, 585 bp, Glycine max
  Peptide Sequence Number=SeqID_132341
atgtggttttatgatcttcttctctatttttggtactatattccacctgaaacacggaaatttggagccttttttgcatcgattcccctaccgatatttgctgccatatactgtgttttatttggtatcgtggctgctactgggatttcttttatacagtttgcaaataccaattccataagaaatatctatgttctgggcctaaccttgttccttgcgatatcaataccacaatattttgtcatgaacactgcaccggatggtcatggtccagttagaacaggtggtggatggaagttcaggcaatatcttagatgcaatttaccagtccccaatgtgaagaacgaatatggctccacctggatgtttaatgacattttgaacaccatattctcttctgccccaactgtggctataattgttgggactcttgttgacaacacacttgaaggcaaacaaacagctgtggacagaggacttccatggtggggtcctttccagaataggaagggagatgttagaaatgatgagttttaccgtcttcctctccggataaatgagtacatgcccaccagatttctctaa

SEQ ID NO: 15564 - DNA, 1718 bp, Glycine max
  Peptide Sequence Number=SeqID_132342
atggtgctaacggagttcttccacgccgagatctcatcggagctatggaaaatgctggtgtcaatttcccgaaaagccctccgctgcaagtcgagcgccaagagcctcatctcctacgtccacgagctccttccgacgatcgaagagatcaagtactccggcgtggagctgccggcgccgcgccagtcgcaggtcgaccgcctctcggagatcctccgctccggcgtcgagctctcccaccaggccctctcctcctcgcgctggaacgtctaccgcaacttccagctcgccaaaaaaatggagaagctcgagaagcacgtgacaaggttcttgcaggttcccatgcaggcgcatatattggcggacgtgaaccacgtgcggttcgagatggcggagcggttcgaccgggtggaggcggcgaaccagaggatggagaagtttatcggggagatgaagattggagtgaacgggggagggtgggtggaggaggctgtgaggagtatgcaggaggatgagacgtgggttgaagggtgtaatgggaacaataacggttttggggttgggttggagttcgggaagaacaaggttatggagatggtttttacgaggagtgatgtttctgttgtcgggatttgggggattggtgggtccgggaaaaccactcttgctagagaagtctgcagagatgaccaacttaaccagtatcctcaagattgcaaccaacttgagatggtgaaaaatgcggttgtgaacgttttttttagaacattaggggagattatatttacttcatgggatgatgaatcatgttatttcaaggagaggatcttgtttttgactgtgtcacagtccccgaatctggagcagctgagagcgaggatctggggacacgtcatgggcaaccaaggtttgaatggcacttatgcggttccacaatggatgccacagtttgagtgtaaagtggaaactcaagtacttgttgttctggatgatgtgtggtcactcccagtgctggagcagcttgtgtggaaaattcctggctgcaaattccttgtggtgtccagatttaatttcccaacaatttttaatgccacttatcgtgtggagttgctgggtgaacatgatgccctttctttgttctgtcaccatgcttttggacagaaatcaattccaatgggtgctaatgtgagtttggtgaagcaggttgtggccgagtgtggaaggcttccactggctctgaaggtgattggagcttctttgcgagaccagaatgaaatgttttggttgagtgttaaaagcaggctctctcaaggccaaagcattggtgaatcctatgaaatccatctgattgatagaatggcaattagtactaactacctgccagaaaagatcaaggagtgcttcttggacctgtgttcttttcctgaggatagaaaaattcctctggaagttttaatcaatatgtgggttgaaattcatgacatcaatgaaacggaagcatatgccattgtggttgagctttcaaacaagaatcttctcaccttagtaaaagaagcacgtgccgggggcatgtatagcagttgctttgagatttctgtcactcaacatgatatattgagggaccttgttcttcatttgtgcaaccgtggcagcattcatcaacaccgaaggctagttatggctaaacgaaaagaaaatggactacttcccaaagaatg

SEQ ID NO: 15565 - DNA, 147 bp, Glycine max
  Peptide Sequence Number=SeqID_132343
atggggttcttacctccgatttggatgattgaagttgttgttggaccaagtcgggggtctttgtcatcctttgtaggagtggaatcctacaacaagggaaaacatgacaactcggggatttcagcttctagactattctccccttga

SEQ ID NO: 15566 - DNA, 362 bp, Glycine max
  Peptide Sequence Number=SeqID_132344
atgcaggttaggatgaagattaaggtggtcacgggtactcccagtggtgctgtggcggctgaagctagatggagcggttcccattgggtcatactggacaagaaattaaagcaagaggtaaagcattgcatggatgaactcaactgtagcatagtggtgatgaatggttcgcaggcaaaaatcctcaggcttaacttagggtctaattccaatgaactccaaactccttttttctctgctacctcttcaccaggtattgaaattgaaaagctaaaaagcaggagattgaagcattctaccccagtaagtagccctgaagaagcaggtacttctgctacaagaaacataggagtaaattcaag

SEQ ID NO: 15567 - DNA, 438 bp, Glycine max
  Peptide Sequence Number=SeqID_132345
atgctaagagacgaaagcgtgggttccagaagtgccaggcacagcgcctccaccgccaccgtctccaacaaggttctcgtcgccgtcaaggccgagaaggtcatctccaacaccgcattagcctgggctttaactcatgtcgttcactccagcgactccatcacgctcctcgccatttactctcctcacaaaaccggcagaaggttctggactttttctagactcgccggagactgtacgaacggaccggcgggaaagttgccggagcgaatttcggatatctccgagtcctgtgctcagatggtgcttcagctgcacaatcaaatcgagcaagtgcttgcaaaaactcgaggtttgaagctcaataagtatattagaggtgatgcaatcgctagtaagtatcgcagcataaacataaagaagttgataaatatctaa

SEQ ID NO: 15568 - DNA, 610 bp, Glycine max
  Peptide Sequence Number=SeqID_132346
atggagagggtggtgggaggggaagagcgcttcccaattccgttgcttttttcttttccattttctccgcaacaacaacgttttctcttctccactcacaatcgccactccttcgacgaagccgttccaggttgcagcgccgtttaccaacacgtgctcaagttccagcgtccaccgaccattcggtggagcccgcacctcgagaacaccgctagtttcatcggcaccgtcgcccgcgaaccgacgcgcgttaactcaacaaccggtaaattcggagtttacaccgtgcttaagttagaggtgaaggagttcgagtttgttgctcaaagttctggttatctaggtgacaagaaattggaatctgttgaagtgtttttttccaatccaaatgagtggtgggatcaaagaaagagcaagcgaaatccaaaacagcctgattttaagcacaaggataccggcgaagctctgtggctaagtgagtatgatcctccatgggttaaaagacaactccaattgtttgactcaaaaattgctggaggatctgcagtatgtggtggtagtggagatgttgggctgataggcccgagacaagagcccacaactgatccgg

SEQ ID NO: 15569 - DNA, 330 bp, Glycine max
  Peptide Sequence Number=SeqID_132347
atggcaggcagcaattcttcatctagtactagtaacaacatggaagggaattgttcctcttatagcagcgatgaagaagatttaactatggggagcgaagggagcgaagaagtagaggggagcgaaggagagagtgaggaggggctcatggaagaaaacaaagaggaaagcgaaggagagagtcaggagggacgcacagaagacgacagcaaagaagaaagtgaagtagacagcgaagaagaagagagtgaagatgatcatgtttctgctaatatgagcatgctagacggagagacaggaggagaaagcgagagcgaagatgattgttga

SEQ ID NO: 15570 - DNA, 510 bp, Glycine max
  Peptide Sequence Number=SeqID_132348
atgagcatgctagacggagagacaggaggagaaagcgagagcaaagatgatgatacattgaggagtgggattgataccaagatcattactgctcaagaagccagagacctaaatgatgttcaaggtataaagtgggcagcagaaaagaaagatcgtacagatttcaggagagctaggctacgaaggatgggagcaaagcacataacattaatgcctacattggtttggtcgacatcaaagcacgatgtctatatggctggaaatttcaagatcatacactggtctggattatcttccaagatgaccgatgtcttagatacagctgagcatgtaacttcttctgaggattatcctggaaactatgagataggatttcatcaatcacaaattaatacagtgtcagtaaggtttaacttgttgattgttggcggcaactttggacaacttatttgtaagcgcatagatcgacctgatgttagtttttgttataagatgtcctgccgaaggtga

SEQ ID NO: 15571 - DNA, 336 bp, Glycine max
  Peptide Sequence Number=SeqID_132349
atgatctgttcagaggcagggccatccagcaatagccttggcaacagtcatgaggataatagtttcgatgacaacaaacttgataacaatgaaatgttaaaaatgtggtttttaaaactgtatgagacaaaattccacttgctatttgttcttatcttgatcaatatttcttggtatttagaggcaattttgattgtcttcttggataaggagaaggtaagagtaacaaggcataatacgggtaggacatgttccatgataagatctttgactgattctagaattgctgttgataataatagtgatgacattgtattttttcattggatgaggtga

SEQ ID NO: 15572 - DNA, 273 bp, Glycine max
  Peptide Sequence Number=SeqID_132350
atgatgctttatggaggaggtgtaggaggcaaaatatggaggttggagaggtctcgagggatgggaatgaacaattggttttggtggaagagtcaattcggtaactttacggtaaaatcgacttactatgtgttattcgactataaatttggtggtcatagggttgaggatttagctctttggaagaatgagaactgctttttgtggagattgatgatcaatagattgccttcaacggataattttttgagaagaaatattgaggtggggtag

SEQ ID NO: 15573 - DNA, 144 bp, Glycine max
  Peptide Sequence Number=SeqID_132351
atgcagcagtctaaatgtgatacaaatgaggctttgatggatgagatgaaacttcaaaagataaaggttccctacggaatgcaggttctgtttgatgttgttagacatggagttgtgagaatgagtcccaagcgacaaaactaa

SEQ ID NO: 15574 - DNA, 396 bp, Glycine max
  Peptide Sequence Number=SeqID_132352
atggctctgggatctagtctgtggcagtctcctcctcctgagccatgctcctgggctgcggaggccccaccccctttagaaggagaaggctgggatcctggccaggccacctatgtatcaaactcatccatgctcatgatggatgataaaagagctggaagctggaacggagatggagcaagaagtgtcaaaataagaggtgttggagctatggaagaagaaggagttgttgtctctagtggtgctgaagtagtggggacctctgatctcttacccctagccttccttggccctttaaatgtcactgttggatcatcaagattccaacatttcttcttaatatatgccaagttaatggcagggctcaagctctcaagggatctagaatctgattag

SEQ ID NO: 15575 - DNA, 147 bp, Glycine max
  Peptide Sequence Number=SeqID_132353
atggaaaatcattccaacctaaatacacgggttaacctttgcctcatggaagtttcattgccattcattgcggtgccagtggagatgtttattgcttttgttggagctgcagatagagcagtggggaatgaagaggctcatgagtga

SEQ ID NO: 15576 - DNA, 1764 bp, Glycine max
  Peptide Sequence Number=SeqID_132354
atggtggctgcaatttctacggcgataaaccccaagcgagcgcagacgccaactccaagaagaactcctctgttaccttctgaatcggacaatgcactcgctccaccacgcaggcccaaagcacgagaagttacttctcgctacatgtcttcttcttcgtcttcgtcttcctctgtttcgtctcctccgagacgatgccaatcgccgctggtggtgacaaggacggtgaattccgcaaaaacgaagcaaacgccgacgccgactccgactccgacgccgtttgcgaagcggtcacagtcggcggaacgccggcgacaaggaactcctcgacctacgacggaagctccggcggctcagaaagtgctcttcacttccaccaggagcttgtccgtctcgttccagggcgagtcgttcccgatccaggttagaacgacgaaaccgccgccgccgtcacagagtttccggaagagcacgcctgagaggaggaaggccgcgacaacgacgacgccaacgccggtgagaaacggaaattcggatcacaccgagaatgcgaggtcattagatcggcaccggtggccggcaaaatcgcaatatgctgattccaccgcgcgaaaacaaactgacgcgccggcgagcgtggctaggtcgttgcagaatgtcatggcggacgttcgaggttctctcgacgcgacgacgttgagatcggagagctacaaaactaacggatctgagtttcagcacgaggctgagtctattgcttctgataccgaaagcgtaacttctggaagttcctctggagaaggaattcgaggttctcgaggactcgtggttccagcgaggttctggcaagagcataataaccgtttacggcgccaaacggaaactccgtcttctagaaacggcgtaattggaaacaaaggaacggttagtactcctagtcctagacttctggtgcagaagaaaacggcgttggattgtcctgtttcgtcgccacgtggagttctgaatagccgtgctcttcaaggttctccgatccgttccgcggtgcgtcctgcgtctccgagtaagctagcgacgccgtcactgtggtctccttcgagaggagtgagtccgtcacgagcgcaaaacggcgtcgtcagtggcttgagtagtaggttcggtggtggtagtgaaccttctgttttgagcttcgctgttgatgtttcgagggggaaggtagcggagaaccggatctttgatgcgcatttattgagactcttccataacagactccttcagtggcgttttgttaacgccagagctgatgctgctctctctgcgcagacattgaatgcggagaaaagcctctatgatgcatggattgctatgtcgaatctacgagaatccgttagagccaaaagagcagagtttcagttgctgaagcaacaatttaagttaatatccatcctgaaggatcaaatggtatatttggaagattgggctactttggatcggttgtactctagttcactttcaggagctactgaagccctaagggctagcactcttcgacttcctgttgttggtggggccaagacagatttgctaaatttgaaggatgcaattagctcagcaatggatgtgatgcaggcaatggcatcctccatatgcctattgtcaccaaagatgttgaatctcaattatacttgcgatgaagacatgagtgtggcttttcagtcaagaacaaaagtggtcatggatgtgatggagaaaataaggaaatag

SEQ ID NO: 15577 - DNA, 279 bp, Glycine max
  Peptide Sequence Number=SeqID_132355
atggagtcaagttccagggaaaagagtattcaaataggagcagatacaaaggaggaatgtgttattaaaaatgtcttgggatttaattggtgccattatctagaacaaggtggaaccgagggtgtagctgaaggtgtagcttctggagttcaaattggcaaaaaaatgaaacgttatcaactaccaactattgagaagaaggtcgagaaaggaattggtcttgctgccactcatgccaaggcagacgtatcaattaacaaagctaaaggaccaacttaa

SEQ ID NO: 15578 - DNA, 447 bp, Glycine max
  Peptide Sequence Number=SeqID_132356
atggcagtcgaaaccggatatgttgtggtcagaaagggtgaagagaagatgacgtttgccaatgcaaaagacgcagatgcatgggacaagatgctcgatatggccgacgcgttcaccgactggctgcagcaacatcagccagcgatggatgaggcccaggcagaagcgctgggcatgctgctggccgaacagaaagacgcggtgcaacacattctgcgcaccagcaaactgccggacgcggtgaaagacagcggcgaaaccgctgctgacgacagcgatacggctgcgccggaaaaagagaagaagccgcctgaggaacagcgcgttcgctttgcactgctgctgaatccgggccagcctctgtgctggcctgggaatcgtgctaaggatcagtgcgtgaaaagagagaaggccatcaagttcccggattgtgcgccgatagagtga

SEQ ID NO: 15579 - DNA, 381 bp, Glycine max
  Peptide Sequence Number=SeqID_132357
atggcagaactcagagattcggagggtttcgtcggaaataatggaagcaaggaagaagaagaagggtttcagaagcagagaagaagaaagcgtgacacgtgtcccactctgcctagaaaggtggaattaatgatgggtaatggagatcgaggcgacggttacacagtgaacgttcgaagcgtattacagagcaagagcctggtcaggacctgctcgaatcgaaaagagaggagagtctttaagaaggaattcccaggttcaaaggagtatttacgaagtacaaagctaagacaagaaagaggacttcgagctattgggcaattcgaactggtgtatggacgagtcgaagtcgaggcagcaagagttttggacttagcgtaa

SEQ ID NO: 15580 - DNA, 333 bp, Glycine max
  Peptide Sequence Number=SeqID_132358
atggcacaattgctacacctcaggttccctaagcaccgccgtgaacccaaaggagagatgacagttcaaccaaacgtgtatatgccttttcctatggcaccaaatttcaaatccatcttctcactgttttgttttgtgtatggaagagttcttcgaccagaggcgttaaagacaccggtaggtgacggttgtgaggatttcaaaggagaagattcttctcttggaatggctacatttgctgttgcttctaacaactctagcactcgtcaatttgcacgaagcttggcctacaaacttgcttctggacctagcaaaaagggtcctggacattag

SEQ ID NO: 15581 - DNA, 240 bp, Glycine max
  Peptide Sequence Number=SeqID_132359
atggtgttgatgctggttttgttgcttctctgtcatattgtgtggctgaacaaaaaccatgaacctcttcaaccccccaacaagagagcactggtgaaagtgcatgttttggtggtggcttcagaggagaggagggggtggttgaaaaagttggaagaaataaaggaaggcaaagggcacttgatgatatctgagatgagagaaaaagctaataggctttgtttgaagggaaaaaggtga

SEQ ID NO: 15582 - DNA, 303 bp, Glycine max
  Peptide Sequence Number=SeqID_132360
atgcaggtggatcctagtatgcgaccgttgccggattatgttcagaatgttcagagggaagttagtgctgacatgcgctgtgttctggtggaagttgcggaggaatacgagcatgtttcggtcaccctttacctttgtgtcgcttacgccgataggtttctgtcgttgaatgcagtatcaacaaaggggctgcaattgcttggggttgctgcgatgcttattgcttcaaaatacgaagagattaaggcacctgcagttgggaaattttgttacataatggattacacatactccaaggagtaa

SEQ ID NO: 15583 - DNA, 153 bp, Glycine max
  Peptide Sequence Number=SeqID_132361
atggtgcagaagcagcactgcaggagttgtcagaaaatggaactgataaagctaagagaaaagctggaagcatattggaactcttgcagcgaatggaagggggtagcagtgcagggttattgtattctatttagattggcacctgattcgtag

SEQ ID NO: 15584 - DNA, 297 bp, Glycine max
  Peptide Sequence Number=SeqID_132362
atgtcggcagaaaaatatcagtcgggcctatataacgaccgatgccaggaaatgttcggtcggcgtcatcagctgggccactgtgtttctagccgagtaaatgatgaggacatgttcaagagcaagggcaaggatccacttgaaggacttggaggacctatgacaagggctagagcaaggaaagccaaggaagctcttcaacaagtgctgtccatactatttgaatacaagcccaagtttcaaggagaaaagtccaaggttgtgagttgtatcatggcccaaatggaggaggactaa

SEQ ID NO: 15585 - DNA, 1448 bp, Glycine max
  Peptide Sequence Number=SeqID_132363
gccctcccacttcatggacacgtccaacatcatctgtggccagtgataacaagactatattttggactcctcaaaaccacgttgtagacaagaagtttcagaaaacaaaaaacaacagtgttattcaaagaactaaatctccaacttcgaaaaccttacttgagaattttatacgttgtgatcaagagacgaggacaaatgaacttgggtttgaccaagctaaaagtagaagttatgtccccaactggggcattagagataactccattcctttgggcagaactacctctatacctcctcccttatgctcacagtgtcagaataaagcaccagtatttggaaagcctccaaaacggttttcttacaaagagctagaggaagctactgatatgttctcagatgagagttttttggctgaaggtggatttggtgtggtccacaagggaatactcaaagatggtcaggttgttgcggtgaaacagttgaagtttggtggctctcaagcagatcttgatttctgccgggaagttcgggtcttgagctgtgcacaacacagaaatgttgtccttttgataggattttgtatagagagcaatttgaggatattagtctatgagtacatatgcaacggatcattggacctctacttacaggcagatgagagtatgcctttggattggaactcacgattaaagatagcaattggaactgcacgaggcttacgctaccttcatgaagattgtagagttgggtgtatagtgcacagagactttcgacccaaaaatattctcttaacccatgactttgaacctctggtggctgattttgggcttgctagatggcactcagaatggaatatagatactgaagatcgcgtcataggaagttcagggtatcttgcaccggagtatcttgacgctggaaaccttacatataaagtagatgtatatgcatttggaattgtattattagagttaataacaggtagaagaattagcgagttggaacagttcaatggacagtactcgtatctttctgaatggtttcatcccatacgcatcttagagcccagtcatatcttacaaaacgtacgttctctcaaaccatgcttcgattctgaggaatcattggaatttaatcttcagttgcaagccatggcacgagctgcttcgttgtgtcttcgtgtggatcctgatgccagacccccaatgtcaaagatcctgagagtgttggaagggggtgatcccgttcgtcctatgggtttagacatcaattcagttggtaacacaagtggccatttaagaggtttgaagtcacacactccaccaaaaggatcaattattcatttgaagctgcataggatctattgttggcaatataggaactctcgtacgcttatagaaaccttcagacaagcacagcacttggtggcaagtggtaagaactaa

SEQ ID NO: 15586 - DNA, 171 bp, Glycine max
  Peptide Sequence Number=SeqID_132364
gaacccttcaaccgaagcagaatttccaacttggcttgcggtttcggtagagaacggagaccctaatctgatcggtcattttctttcgaggcttgtgtggaatcgacaagcaaggacgaaaaggaatcttcaagtgacgcgacgaggaatccgtggggtagctcactatag

SEQ ID NO: 15587 - DNA, 670 bp, Glycine max
  Peptide Sequence Number=SeqID_132365
tgacagtagtattgttgttgtgctttcaggttcgacgacacaaaacagcgttatggatcagacactccgatgccgtttcgtgtttgagcctttcagaagacaaaacctatttatactccgcgtcgtgggacaggacaatcaaggtgtggaggatttcggactccaggtgcttggagtccatccacgcgcacgacgacgcggtgaactccgtcgtgtgcggggacggggacgtgatgttttccggctcggcggatggcaccgtcaaggtaaaggcctgaagcacgcggccgtgaagactctgctgaagcaggagtacgcggtgacggcgctggcggtgggcgaggcggggtcaatggtgtactgcggcgcctcggacgggttagtgaactgttgggggagcggcaagaattacgcgcacggcggggttttgaaggggcacaagctggcggtgttgtgcctggccgccgcggggacgttagttttcagcggctcggcggataagaccttatgcgtgtggaaacgcgagggtgtgattcacacgtgcgtgtcggttctgacgggccacaacggtccgttgaagtgcctggccgtggaggagaaccgtgaatctggcgaaaagggtgagcaggatcggcgttgggttttgtacagtgggagtttggataagtcg

SEQ ID NO: 15588 - DNA, 210 bp, Glycine max
  Peptide Sequence Number=SeqID_132366
atgagtgaaatagaggaggtgcaagagcagatgaaggccgacatggaggctatgaaagagaaaatgaccacattgatggaagccatgatgagtatgagaaaaatgatggaggtcaacacagatacagtcgtttccgcaagtaccgccactgaggtggaccagactcacccatctagcctcaaccaagtaaatcgcccagcctcggatatg

SEQ ID NO: 15589 - DNA, 217 bp, Glycine max
  Peptide Sequence Number=SeqID_132367
gtcgacaaaagcggggctcttgctcctatgtaccctccatcgaagaggaaatcagacctacgtagttctttttaagggtgaatcaagcgattatttttacttggaaggtggtcattttaaggcgttggaccttaaaaatgatcttttttacttggcgagaaaacggcttaacgatcggttaaagctcgtaaaaacggaagaaagaaaccgaaattga

SEQ ID NO: 15590 - DNA, 749 bp, Glycine max
  Peptide Sequence Number=SeqID_132368
acattgaagttaggattcggaactgtggatttgaatccgcaccatcatcaagtacaaggtgttccaagaagcttcattcaccaccacctccaacctcacatctatggccgcgattcaaacgaagcgcaagagtcgttcatggtgtcaaaagaagtgtcagggctcctaggatgagatggaccaccaccctccatgcccattttgttcacgcggttcaacttcttggcggccacgaaagagcaactccgaagtctgttttagagttaatgaatgttaaggatctaaccctagcacatgtcaagagtcacttgcagatgtatagaacagtgaagagcactgacaaaggcatcactgctgcaggtcatgggcagacaggtattggattaatgaacccaaggccaggcattaatgttcatctgcatgcactctcacctatttgtgacacacccaatttaccagaccccattcaaagttcacacaggacaccgtggcaatcatcgatagagacaaaaacaaacaatagaagacaagaagaacccgaaatcggtttgacgtattctcacctcaagggaaataataataataatgaaaccacggtggatgggcacaacaattatggagggttggattctacccctttgtcacgttccgaggaggcaatgcttgaccttgaattcacccttggaagacccaattggcagaaagaccacactgaatcatcaagagagttaactcttctcaagtgttga

SEQ ID NO: 15591 - DNA, 750 bp, Glycine max
  Peptide Sequence Number=SeqID_132369
atgacaagcaatgatcaatttacctcatggccgatttttttacaagctttacaaactcgatttgccctgtctcagtataaagaccctactgggtctttattcaagctcacacaaaagggaagtgtcgaacagtacctgtcggagtttgaagagctggtcaatcacgtggtcggacttccaccttccttcctcctgagctgttttgtctcaggcctctctccggacatccgccgggaggtgcaagctcaccaaccgttgacgctagcccaagcctctgctctggcgcgcctacaagaagactgtccaccaccaccacggcaacgcccctctccagccccgacactcggaccccctcgccataccctattaccatcccttttagcctcaccaccacgacccctaccatcacaaccaaaccctcctactccaacgttcaagcgtggactctattttaactgcgacgagaggtaccacagaggccatcgttgcgccttaagggtattcctcttaatcgcggaagacaaagactcctcagacccagccttgcctcttataaaccccactgacccgaacccagactcgacactcgcacccgacccatatctgacccaaatcagccttaattccttagcaggccatttagcgcccgaaatgctccgtttagtgggcgtgacctccggccaggcggtgctcctcctggtggatggtgggagcacccacaatttcatccaacagcacctcgtcaactag

SEQ ID NO: 15592 - DNA, 1083 bp, Glycine max
  Peptide Sequence Number=SeqID_132370
atgttgcaaaaaggcttaatccaacccaacacaagttcgttttcctcgtcggtgttgctggtgaagaaccacgatggctcgtggaggttctatgtcgactaccgagccttgaacgccatcaccattaaagaccgatttccaatccccacaatcgacgagcttctggacgaattaggcagtgctagatgcttttcgaagttggacctgttgcagggataccatcagattcgaatgcatgaggcgaataccctgaaaacggccttccgaacacaccatggccattacgaattcaaagtaatgtcatttgggttatgtaacacgccgtcatcctttcaggcaacgatggacatgatctttcagttgtatctccgacacttcatcatcatcttcttcgatgatattctcatttatagcggctcaccggaagatcatctgcatcacctcgcgacaacatttcaggttgaatatcttggccagttggtgtcgcacaagtgggtggaaccacttgctttgaaggttgccgcaattcaacagtggcccaccccgcattctatcaaagttgttcgaagctttttgggcctcgccaaattctattgccgcttcatatgcgggtatgctacaatccctgctctcatggcttttgacgagctcaaacatgctttatccacagcaccggtccttgccttaccgaacttcaagctaccattcacggtggagacagacgcatcaggggttggcatgaggacggtcttatctcaaaaggttcaccccattatttttttcagtaagcctttccctccgaaactcatgcgaacctctacttgtgttcgagagttggctgcgattaccacggcagtgaagaaatggcgtcttaaggagctgttgaaccaggtaattcaaaccccggagcaacacatgtatctggcgcatctgatgggatatgactacgatatacaattttgttccggcagccataaccaggcggaactccgccgtcaattggatgatcaccctcattatcaacgtcacctacaagaggttctcgagaattcgaccaaacatcctgggttttgtgtctcttag

SEQ ID NO: 15593 - DNA, 1386 bp, Glycine max
  Peptide Sequence Number=SeqID_132371
atggagaactttgtttggcctggtctcctggacgatgttgctcagtttgtggcgagctgtgtggaatgtcaggttacaaagtacgaaatgaagaaggcagctggactgttatgccccctttctgtgcctcatcgaccttgggaagacctgtctttggattttataattggcctgccggcgtaccagggtaacaagaactttgtttggcctggtctcctggacgatgttgctcagtttgtggcgaactgtgtggaatgtcaggttacaaagtacgaaacgaagaaggcagctggactgttatgccccctttctgtgcctcatcgaccttgggaagacctgtctttggattttataattggcctgccggcgtaccagggtgttcatctcgacatgttgcctccctctcacactgctcttacaatcgcctcattatttctcgacattgtcgtaaaacttcatgggcttcctcgcagcttggtctctgaccgcggcccactgtttgtcagtcgtttttggcaagagctcttccgggcaatcggcacccaactccaaatgagctcggcatatcacccacaaacatggggcaagcttcttccttgggttaaactatcgcacaacacctcgtggaatgggggcatgggaacgactccttatgaaatcatgtatggtcaaaagcctttcaattttctggagtatgttgccggaacctccaaagtcaatgatgtggaagaaatactaacagacagggaggataccttcaagatcattcgcaagaaacttttgaaagctcaggcaaccatgaaacaacaagcgaacaagaaatgtcgcaagctagccaaaagatattatggtcctttctgcattcaagaacgagtagacacgatggcttatcggttacaattgccggaagaagctcaaattcatcctgtgtttcactattctctgctcaaaccgtttcatggttcactgaaaggcatcgaagctactgcattgccacctcattttgctaacaaccaacccctcatttgtcccttagcaattttggattatcgtcgagcttctccaactgatccatgggaagtgcttgtgcaatggcaaggattggcaccagacaagacatcttgggaggactggtcccagttatgcagcgactatcaccttgaggacaaggtgagtttgcaaggacccagggataacaacagggacaatagccataaaattaaaaacagaggcgcaactaacagaaaagcccaaaagaaaactcaccaaaccagcatacctcaacgactatgtgtgaggaaatggacaaagcttccagctccagaggatctcgcttggatggtgctgtctatcctcaggggagatgcactaacaaatttagcgtaa

SEQ ID NO: 15594 - DNA, 649 bp, Glycine max
  Peptide Sequence Number=SeqID_132372
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtttaagcgattgtttgctaatggacatgatgcaaaaagtttagatggcatgcagatgccagaaaaagcaagaaacctaaggcttggtcttgcttcggatgtaatgaattcttttggtaacttaagcactaaccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 15595 - DNA, 171 bp, Glycine max
  Peptide Sequence Number=SeqID_132373
atggagaattggcgaacagcgctacacaataacttcgcggggctccagactcgaagtggagaatggagaattggcggacagcgctacgcaataacttcgcgcggctctagactcgaaggtggaggacacatgaacagcgctaggcaattacattcatgggtctccgaataa

SEQ ID NO: 15596 - DNA, 495 bp, Glycine max
  Peptide Sequence Number=SeqID_132374
atgtgcctcttcattctcattctcattctcattctcattctccattctcccacttgctcaagcaccatcatcctccaaggcaacgccactctccaaagccccaacaacaccttccgattgggcctcttctccttctcccccaactcctccttttacctcgccatccgccacacctccctccccttccccaacactatctggctcgccaaccgcctccacccttctccctcccaaaccgcttcatctctccaactaacccaaaccggtcaattactcttaacccactccaacaccactctctggaccaccaccatctctaacattcacccttctaacttctcctccctctccctcaagcttctcgactccggtaacttaatcctcaccgcccccaacggcgtcgttttattggcagagcttcgattcccccaccgacacgtggctccccggcatgaaccttactcgcctcaactctcttctctcctggcgaactga

SEQ ID NO: 15597 - DNA, 546 bp, Glycine max
  Peptide Sequence Number=SeqID_132375
atgatgcgatatctaaaatactcttgttttcagtgcccaccaactttagaagagcatgagtctttaacgtctaatgatggtacagctacgtcactcactactggattgctggtaggcttgaacctggaaacttccacacctgatacataccatccccctcctgcacctctaccttatgatatggtcctgggaggtccagcatcaacagattctgaatcaggcagagaaacagttagtggtagtagctttgaaacattaattacatgcaaagatcctgaagaatctgactgtaaaattaaagctaattcagcacctatatctccaagcaaggctggattgtcaaaatctaaagaatttcatgcattagtaacagaagaagaggacggctgtccaatttgtcttgaagagtatgatgttgagaatcctaaaactctgacaaaatgtgaacaccactttcatctgtcttgcattcttgagtggatggaaagaagtgactcctgtcctatatgcgatcaggtttggctttctgcatcaattccttcttaa

SEQ ID NO: 15598 - DNA, 978 bp, Glycine max
  Peptide Sequence Number=SeqID_132376
atggtgattcgaaatgttgtggcatggaacaccattattgttggctatgggaatcgtagagaagggaatgaggttatgaagcttctcagagagatgcttcgtgaagggttttcccctgatgaactgactatttcaagcactattagtttatgtggctatgtttctgccattactgaaacaatgcaagctcatgcctttgctgtcaagtcatcatttcaagaatttttatctgttgctaattctctgattagtgcgtactccaagtgtggtagcattactagtgcatgtaaatgcttcagattaactagagaacctgatcttgtttcgtggacttcattgataaatgcgtatgcattccatggtcttgccaaagaagcaactgaagtgtttgagaagatgctatcttgtggaataattccggatcaaatttcctttcttggtgttctctctgcctgttctcattgtggccttgtgactaagggacttcactactttaacttaatgaccagtgtgtataagattgttcctgattcaggtcactatacctgccttgttgaccttcttggacgatacggtcttataaatgaggcttttgaattcttgaggtcaatgccaatggaagctgaatcaaatacattaggagcatttgttgcatcttgcaatctccatgcaaatataggactggctaaatgggccgcagagaagctcttcaccatagagccagagaagaatgtaaactatgcagtcatgtctaacatttatgcttcccatagacattggagtgatgtggaaagagttcgtagaatgatgggaaacaagtgtgatgcaagagtcccaggttgcagctggatagagattactaatcaagttcattcattcgtatctaatgataagatacatcctaaagctttagaaatgcatgctacattgaaaatgctgctttggccaatgaaggaaaaaagtggtatgaattcgtga

SEQ ID NO: 15599 - DNA, 1773 bp, Glycine max
  Peptide Sequence Number=SeqID_132377
atggatgttcttacttgtatcttgatgttttctcttgttacagttgatataccaccatggttttctgcagtttccatatcattgaactcagatgtagaccttgatgtttcaagagttgaaagggtgccaaaaagctcactgccactgatatgctttagagatggcagccctcctctgccagatgctttaaacacttctctgaaggattcagctgtcaaaggaataaatggtcttgatgttgagcagtgctttcctatggagaaaaatatcactatgaaattgacaaatgaacagatatctccaggtgcttggtacattggtcttttcaatggcattggagcttcaagaacacaatcaaagatgattattcgaggttcagcatactccttcagtgccaatataagtgtggaagcatgctcgaattcaatgatgaggggggagttatgtaacagtacagtctatccactttcatgcacagcatctgatgtctataattctatgaaggctacagtgaagaagccaatgatggaaaatgcaatgacctgcaaaagtaacttagaaatgttttgttctcaggaaggcgtaccagaattttactccttggatataacaaatatggcagaagaattgaccattatggcagcaaatgttacattcaatactacagcattaaataacacttttagtgcaaatgatgttagtttaatgtgttttgctcgccatggtgcaattccttcagaaactttgcatgattattctggggatttaaataaagcccctctggttatccgttatccactgattggtcgtttgtacattagtatattaccagttaatgttacaaaaatgttgggagggacacagggtggcaatttaaaagtttgctattcaatggaatcacaagtgcttcagtgtccacttggaaaagctggatcaaattgcacaatggacagctacacacttcagacagttctaaggagaggtgcaaccccctttgaatcatattttttacctgtggctgttggtgaaggagcatcttctgccaattttcctcttgagccacttttaaacaagtcatcaaatgtgggagaaactggtgacatttggacttattttactttggatattccccgtggtgcagctggacggaatattcacatacggctatctgcagatgtgaagatcagttatgaagtctatgctagatttggtggattgccttctcttcatagctgggactattattatgctaacaggacaaggaagagtgatcaatccgtgtttttcatgctatatgattcaagtgatgacgaaattgacttttacattatttatgctagagaaggaacttggggtataggtctaagacatctttatattggcagtgattctttgaaagcacaaactgtcatgtctatttcacttgaaggatgcccaaaacaatgctcctctcatggagactgtaaatattcttttgatgccagtggattaacatcatacagcttctgctcttgtgatcgaaaccatggtggctttgactgtagcattgaaattgtatcacataaagggcatatactacaatcaatttttctcattggatcaaatgctgcagccatacttcctgcctattggtcccttcggcagaaggcatttgcagaatggattttgttcacatccagtggcattgctagtgggctatatcatgcatgtgacgttggcacctggtgtgcattgaactttaatgttttacaggttactgctctcttcctttag

SEQ ID NO: 15600 - DNA, 1365 bp, Glycine max
  Peptide Sequence Number=SeqID_132378
atggcgacggagatggaagaactcgtctcctttctttcttccacgtcgcctcagatcacaaaagccgccgttgacatagtccgcggcttaaccggctccatggagggcttgcagtccctggcaaattactcaaacgccctcttacccgctttgtctcgcctcttaacgttacccaaggaggtttcggaggctgctgcggaggcgctggtgaacctgtcgcagaattcgagcctcgcggaagcgatggttggaattggtctggtcaaaacgacgatggatgttctgtacaagcccgagtgtagcattgctcgcttgcttgtcatgctgttggtcaacctcactcaactcgaagctggtgctgcttccttgcttcagactgaagatgagaaggtgcatggtttatatgttatgaagcttgtgagatcattttgtagaacctcccatgagagtaatgatgatgcttttgaacatgttggttcaatacttgttaacatctcaaaacagcggaaagggagggagcttctacttgaccctaaacggggtctcttaaagcagataatcagacagtttgattccaacagttcattgagaaagaaaggggtctctggaactattcgcaattgttgttttgaagctgagaatcagctacaaaatttgcttttggtatcagagtttctctggcctgcattacttcttcctgtagctagcaacaagatctacagggagcaagacagattgaaaatgccacttgaacttgggactgcactctcgattgaacgtgaaccagttaatgatccagaaattcgtattcaggcattggaagccatatacttgatcatattacagtttttaaaatataatttcaaaattagtttaaaagtgtgtttgtgtggtggtgatgacaatgctgatgtcatcagtaacaatagctatagagatatcagtgattgtcgtggtgacggtggcagtggcggcagcggtggtggtggtggccatgacaatgttgtggtggcagccaatggtggcgatgttggtgttgttggtggtgatggaggtggtattagctgtgagggttttaaaagtttgtggggacaattgtccccattgtgtctcaagtggatttgtccctatggtggcggtgacgaaggtggtattagtggaggtgatggtggtgtcaacagtattggtggcaatgatgataatagtgccggtcatggggtggtggtggtagcaaatggttgcagtgtggtggtgacaatgacaatggtagtgatggtgacagtgttggcggtcgcagtggtggtggctacaaaaggtgtcattatcaaatgtgggaaatgtttatttttttatacaaaactctaa

SEQ ID NO: 15601 - DNA, 1824 bp, Glycine max
  Peptide Sequence Number=SeqID_132379
ctcctctgccggaatccgccaatttggttctgatcatctcctcacagatcctgagatcattttgcaagccaataatctcatgcagcttcaaggttattttgcctatggtttgatgcagaaattctttggcaaacgatgtaaaaactattactttagaaaccattctaaaagtgcaagtacctatcgagtccttgagtcattaagtggaatgaatggatcaacggagaagccaataaagtatgtcctttgcactgtgcttagctcttgtgcaaaaactctgaattggcatttgggtatacaaatccatgcatacatgattcgatctggatatgaagataatctgttccttagtagtgcacttgttgatttctatgcaaaatgttttgctattctggatgcaaggaaggtatttagtggcatgaaaatacatgatcaggtttcctggacttcacttattactggattctcaataaatagacaaggaagagatgccttcttgttgttcaaagagatgttaggcacccaagttacacccaattgttttacttttgctagtgtcattagtgcctgtgtggggcaaaatggtgcccttgaacattgttcaactcttcatgctcatgtcatcaagcggggatatgatactaacaattttgtagtcagctcattaattgattgttatgcaaattggggacaaattgatgacgctgtattattattttatgaaactagtgagaaggatactgttgtatacaattctatgatctctgggtattctcaaaatttgtacagtgaagatgcattgaaactgtttgtagaaatgaggaaaaaaaatttgagtcctactgatcatactttatgtaccattttaaatgcttgtagcagccttgcagtgctccttcaaggaagacaaatgcactctcttgttattaaaatgggttcagaaaggaatgtgtttgttgccagtgctttgattgatatgtattcaaagggtggcaatattgacgaggctcaatgtgtgttagatcagacttctaagaagaataatgttttgtggacatccatgatcatgggttatgctcattgtggaagaggttctgaggctttggaactttttgattgtctattgaccaagcaagaggttattcctgatcatatatgctttacggctgtcttaacagcttgtaatcatgcaggatttcttgacaaaggggtggaatacttcaacaaaatgacaacatattatggcttgtctcccgatatagatcaatatgcttgcttgattgatctttatgctagaaatggaaatttaagtaaggcaaggaatttgatggaagaaatgccttacgttcctaactatgtaatctggagttctttcttgagttcttgtaagatttatggagatgtaaaacttgggagggaggctgctgatcaacttattaagatggaaccatgtaacgctgcaccatatttaacactagcacatatctatgcaaaagatggtttatggaatgaagtagctgaagtccgaaggcttatacaacgaaagagaataagaaaacctgcaggatggagttgggtagaggtagacaagaagtttcatatatttgcagttgatgatcataattctagcatagatctacttgcttcccttagagtgcatatctataacttagcacttgatgcttatctattggcgcctcctttggctgaaagtgacagtgtccagaagccagtgctgtttgagcacaaggttaagaaaaggagtgtgtttgctcttggacttcttgctgtcatgataatttctcttttctcttctcacacttg

SEQ ID NO: 15602 - DNA, 1371 bp, Glycine max
  Peptide Sequence Number=SeqID_132380
atggtgaattgttcactgagagaagaaacatcgttgatgcagttttcaattcttttgaaaaaagtgatcatggctctagagttttacgtcgtggtcgaagctaaaatggaatccaagttctcaacaataccacacagtatacaagaagaacgtaacctacaagaaaatattgtggtatctgatgatggaaagacgtctaaagaaaatattgtggtgtctgatgatggaaatacgtctaaagaaaatattgtggtatctgatgttggaaacacttctaaagggaagcgccgaaagcattttccgtgtgaagttggacttctggaatcagtagatggccttgttgaacccaaaaattatatgaacttcacatggttttctctagagtatgttgaccatgaagatagaacgtccaaaattgatttatttgaacctcgatttggaggacatcagactctagaggaaagagaaaattcattttatgcaaaaaaccagactcttcattgtggttttgtaaaagggaaaccaggacatccaagcactggatttgatataaatgaaaaagataaggcttatatgtacagatgtaaggttgcagtttcttcttgcatttttggaagctctgatttcctccggaggcctacaagtagactgatcagtcaatattcaaaggacaatgtttgttttgttatgttcctggatgatcaaactctatccaaactttcatcagaaggaagcagtcctgatgagagagggtacattggcttgtggaaaatagttgttgtaaaaaacttgccatatgaagacatgcggagaactggcaaggtgccaaaatttttatcacatcgcctcttcccacattctaggtattcaatttggcttgacagcaagatgcgactcaactctgaccctatgctgattattgaatattttttgtggcgaaggaaggcagaatatgccatttcaaatcactatgatcgccacaatgtttgggaggaggtactccaaaataagcgcttaaataaatacaaccatacagcaattgatgaacaatttaacttttaccagtctgatggcctccccaaggttgacccatcaaagccaaatgatcctcttccgagttatgttcctgagggttctttcataatcagggcacatacaccaatgtcaaatttattttcatgtctttggttcaacgaagttgatcgatttacatctcgtgatcaactaagctttgcttatacctatttgaaacttaggagaatgaatccagagagaccaattcagctatatatgttcaaggattgtgaacgtagagcattactgaagctattccggcatagggaacttccatctccacgagagactgcttga

SEQ ID NO: 15603 - DNA, 294 bp, Glycine max
  Peptide Sequence Number=SeqID_132381
atgtctgcctcggatccatccctgaaatccacatggaatcgtgtgatcgaaataccagaaggatactgtgtttgtttctggaacaaggcgacaagggtgatatccagagaatcgccaccgctgtctttttccccgggcatcggtcgtagaacaatgtttgggtttggctatgatccgtcaagtgaaaaatacaaggttgtagcaattgcgttgactatgctctcacttgacgtatctgaaaagacagagatgaaagtttatggggcgggtgacagttgttggaaaaaaccttaa

SEQ ID NO: 15604 - DNA, 315 bp, Glycine max
  Peptide Sequence Number=SeqID_132382
atgacttgtacctcagtaggagaggggcctctttgcaagctttcaaatgtgtggcaacaacaccatctcctcccgagatacctctttctttttttgaatttgaggggcagattcttaggcaattgtaatttggctattcttggtatggctctggtttcaactattggcaggaaagtgtttcctaacactagagatgagagtttcagacattttgttgcacttgtttgtagagagagagaggtgcttgccagaaatgcagcgacaacatactatgctggcctcactgactttgtgattgagcttgtgtgccaatga

SEQ ID NO: 15605 - DNA, 1404 bp, Glycine max
  Peptide Sequence Number=SeqID_132383
atggccacccctcactttcttcttataccatatccagttctaggccatgtgaatccccttatccagttgtctcagattctaatcaaacatggttgcaacatcacttttctcaacacagagttcagccacaaaaggttgaacaacaacactggtgctgctggccttgacaacctcaggagatcagggataaagttcgtggcactccctgatggcttaggcccagaagatgatagaagtgaccagaagaaagttgttctctcaatcaaaaccaacatgccctctatgcttcccaagctcatacaagatgtcaatgcttcagatgttagcaataagatcacttgtattgttgccacattgagcatgacttgggccttgaaagttggccacaatttgggaatcaaaggggctcttctatggccagcatcagcaacttctttggccttgtgtgatttcatcccaaggctgattcatgatggggttatagattcacgtggggtccccatcagaagacaacaaatccaattctcctcaaatatgcctttgatggacacacagaactttccatggcgtggacatgataagttgcactttgaccatcttgtgcaagagatgcaaactatgaggttaggagagtggtggctttgcaacactacgtataaccttgagccagcaattttttccatatcagcgaggctcctaccaattggtccattgatggggagtgacagcaacaagagttcattctgggaagaagacacaacttgtttggagtggttagatcagcaactggctcaatctgttgtatatgtttcctttggaagtatggcagtgatggaccccaaccaatttaatgaattagctcttggacttgatcttcttgacaagccttttatttgggttgtacgtccaagtaatgacagcaaggtaagtattaatgaatacccacatgaattccatggaagtagaggcaaagttgtgggttgggcaccacaaaagaagatattgaaccatcctgcattggcttgcttcattagtcactgtggttggaattctactgtggaaggtgtgtgtggtggcatacctttcttgtgctggccatttgccaaggatcaacttgttaacaaatcttatgtttgtgatgtgtggaagattggacttggattagataaggatgaaaatggaataatttctaagggagagataaggaagaaggtggatcaactacttcttgatgaagacataaaagaaagatcgttgaaaatgaaggaattgactatgaataacataggcaaatttgctgacactagtcagaacagagtaaggccaagggcatggtttttcttgccaaaacttgtacccagtattgactttaagaaacattttcaaaacctcactagtatgtga

SEQ ID NO: 15606 - DNA, 401 bp, Glycine max
  Peptide Sequence Number=SeqID_132384
atggttctaatgctgcaaaattgcaatctactggggccagaatggcaactaggcacgctggacgaggcttgtgccacagggaactatgactatgtgatcatagcctttttgccaacccttggcgatggccaaactcctatgattaaccttgcaggccattgtgatccatacagtaaaggatgcactggcttaagctcggacattgagtcctgccaagccaaaggcatcaaggtgttgctctctttaggaggaggtgcaggaagctactcaattgcatcaactcaagatgcaagccaattgtcttctcgtcctcttggccccgccattctagatgacatcgactttgacattgaggatggatcaaaccagcactggggtgatcttgccaagttccttaaagg

SEQ ID NO: 15607 - DNA, 3447 bp, Glycine max
  Peptide Sequence Number=SeqID_132385
atgagtaaccagaaaaagaggaatttccagatagaggcgtttaagcaccgcgtggtgatggatcccaagtacgccgacaagacatggaagattctcgaacatgcgattcacgagatttacaaccacaacgctagcggtctcagttttgaagagctttacagaaatgcatacaacatggtgcttcacaaatttggggagaagctctactcagggctggttgcgaccatgactgggcatctcaaagctatagctcaatctgttgaagctgctcaaggaggttcttttctggaagagctgaacaggaaatggaatgatcataataaggcgttacaaatgatcagagacatactgatgtacatggataggacctacattccaagcacccagaagactcctgttcatgaacttgggctgaacctgtggaaagaaaatgtcatttattccagccagatcaggactcggctattgaatacacttctggaattagtacatagtgaacgcactggtgaagttattgatagaggcattatgagaaatataacaaaaatgcttatggatttaggcccttctgtttatgggcaagattttgagactcattttcttcaagtttcagctgagttttaccaggcagaatcccagaaattcatcgagtgttgcgattgtggtgattatctgaaaaaagctgagaggcgtttgaatgaggaaatggaaagagtgagccattacttggattccaggacagaaaagaagattactaatgtggtggagaaggagatgattgaaaatcatatgctaagattaattcatatggagaattctggcttagtgcacatgctttgtgatgataaatatgaagatatgagtagaatgtataacttgtttcgtcgtgttactgatggtctttcaaaaattcgagaagtgatgacttcacatatgcgagagtctggtaaacaacttgttactgatcctgaaagattgaaggatccagtcgaatatgtgcagaggctcttagatgagaaagataaatatgacaagatcataaacttggcattcatcaatgacaagtctttccagaatgctttgaattcctcatttgaatatttcatcaatctgaatcctcgttctccagagttcatttcactatttgtagatgataaactccggaaaggtctaaaaggggttagtgaggatgatgtagaggttactcttgacaaggtgatgatgctgttccgatacctgcaagaaaaagatgtttttgagaagtactacaaacagcatttggcaaagcggcttttgtctggaaaaacagtttctgatgatgcagagagaagtctcatagttaagctcaagacagaatgtggttaccaatttacatctaaattggagggaatgtttacagacatgaaaacctctcaggacacaatgcagggcttttatggctgccaccctgaactaagtgacggtcctacgcttactgtccaagttcttacaacagggtcttggccaactcagtctagtgttacatgcaacttgccagcagaaatgtctgcgctgtgcgagaagtttcggtcattttaccttggcacccatactggcaggagattgtcctggcaaactaatatgggcacggcagacttgaaagcaacctttgggaaggggcagaagcacgagttaaatgtctctacttaccaaatgtgtgttgtcatgctgtttaataatgctgatagactgagctacaaggagattgagcaagcaactgagattcctgcttcggatcttaaaagatgcttgcaatcattggctttagttaagggaagaaatgtccttagaaaggaacctatgggtaaagatattggtgacgatgatgcattctatgttaatgacaagttcagcagcaaactttacaaggttaaaataggaactgtagttgcacaaaaggaatctgaacctgagaagctggaaacccgacagagagtggaggaagacaggaagccccagattgaagcagcaattgtgaggatcatgaaatccaggaagcaacttgatcataacaatcttatagcggaggtcacgaagcagttgcaatcgcgtttcctggcaaatccaacggaggtaaagaaacggattgagtctctcattgagcgggactttttggagagggatgatagtgacagaagatttgctgcctcccctgccccctctatttccgttgctgcaccaaccacaaaggagacaaaccagaaaactcatagcactaaaaaagtgaagattgatgggaatgaagattttgccagtgatgcttttgttgtggaaactactccaaccctatacaaggactgcttggttggtaaggacgtggccatgaaggaacactttttggacctcaatatagaccctaaggacattatagatggtgtgagagaggatatttgtgcttgcttggacatcgaggatgaggaaactatgcacgagcaccccttcaatccaaaacccaatattaaggtggttgtggtcacttatgataggcggtccgtgacttatttttttcactacttgtccaaagatagaggctcttatctaatcctctccaacacttcaattcaaaatcgtgggaagttcaccagaatttgcatggaattagatctcgaatgtgaacttgtgtcctccgtcacggtgcttggaacgaatttcaatttggagtacaagggtctccatcttatttgttttcattgtggcaaatatggtcataaggattctcaatgcctttttgcctcccttacttctggaaccactcatcaactaggtgcttcctctggtgcttggaacgaatttcaatttggagtacaagggattcctatgttgcccatggaattatacaatagtgaatttctctacaaagttggtgatcttttaggaacaacattgaagatcgatgttaacatgccaattcaaaatcgtgggaagttcgctagaatttgcgtggaattagatctcgaatgtgaacttgtgccctccgtcacggtgcttggaatggatttcaatttggaacaaattcctgatggttcccctgaggatcttgagccttcctccactgggttaagatttggtgttttggaaaccaaaccaatccttcctattgaaacccttaagcccaatccagaatctaccctgaacctgaacactcatgtgcctagccatgggcaagatggtataatctcccctggtagccctcctgaggttcctccattcatgggcaatcctatccctaggaaaccacctaaccctcttagtgaagttcctatgttggtggatggtgaaaaaaatgttgaggttgaggtttctcaggctattgttttggatacccatttgatgattatccctgtcgctggagctctatctcatgataaccaatctatggttattcctgttaatgaaggcatcccttga

SEQ ID NO: 15608 - DNA, 366 bp, Glycine max
  Peptide Sequence Number=SeqID_132386
atggtgatggtggaggtgacattggtggtggtggtgattgttggtgtgacgatcagtgatgacgacattagtatagatgaaggtggtggtgacgaaggtgatattaatgatgagggttttaaaagtttgtgggggcaattgctcccatcgcgtctcaagtggattcgcccctatgatagtggtggttgcggtggtaacaatgttggtggtgttaatgacaatagtgatgatatagataaaggtgggatgatacttgtgttcgttgcaatcatcactggccaacttggtgccgcaccttcccctacctccaccacatttgctagccaccacaataataaaattgagaaatacaacatcatgatatag

SEQ ID NO: 15609 - DNA, 1593 bp, Glycine max
  Peptide Sequence Number=SeqID_132387
atgggggatagaaatactcattacttccatcaatctttcctcactaaaaggcataaaaacaagattgatgtgtttcaggatgataatcagatatggatttacgatgaggatcgtatcaggaatatggtccaaagccactatattgatcttttctcctcagaggaccatggggtgctggcgctacaaaccatatctactttccctttgatatctgagggtgattatgattttcttaacatggagttcacctttgaggagactaggtttgcactctttactatggggaattacaaaagccctgggcctgatgggtttcacccagctttcttcaagtctcaatgggagattattgggaaattgatttttggcttcattgttcatgttaggcataattcaaccaatatcacctctgttaatcaggctctcttgactcttgttccgaagaccagtgatgcctcctctatttctcagttcagacccattgcatttcggaacttgaatgtccctatcactaagaatctggacacttacctcagttttaagattcttcctaagaggaaaactgttagtcatttctctttcttggtggacaaagttcggaagaagctttctggttggaaagggagaaagctttacatggctggcagagttactatggcacagtcatgtttgctcagcttccctccttatgttcttcaggctactcttatttcgattgctacttgtaatgagatagaaaagatttgtagagactttattttgtgcagtgatgctaataacaggaaaatccaccttatgtcttgggagatgacttgtaaacccaaagatcaaggggggcttggatttaggagtttgaggatgcttaatcaagcttacttcttgaagttggatgcttggatccctggagtacctgcaattgactccctgattcctgaggatattcatagtcatgtctcaaacctccctgtttctgcatatggtgttgatggtcactggagatgggaaggtcttaatgtgttagtgccaccatatatttgtgctatgattgcttctattaacccgccttccggaactgatgatgatacgcctctgtggaaagactctctggatggtaggttcactattagtaatgcttatcattatttatctaacctcgatgaaccttcttctggccctgttaatttgttgttcgctagtatttggaagctaggctattgtaatgtgatattggctgagctttggagcttgaagtatggtattaagttggccatagatcttaatacccagttttctttgttcgaaatggatgcacgtgaggctgttcatatgattgatgtgatcaagagtgttcctagttctttgagacctttagctgcggatatcaggagggtgctttgggctaatggttggcaaagttctattgttcacattaatagggaagctaactctgctgctaattgggctgccaaatttggacatcaaaggaattggtcatctttcttggtggatgagataccctttgttttaaaagctcttgttgctaatgatgttaggagagctgctgctagccctctaaggctgccttactcttaa

SEQ ID NO: 15610 - DNA, 457 bp, Glycine max
  Peptide Sequence Number=SeqID_132388
caaccctctagacccggataagtccaacagggccctcggatttcccgcgttgatcacaggactctgccagtcgttcgaagtccccgtcgcacctagcaaggccgcagatgcgccgccaccccatcaggctggtccagccggatcatttgatacggagcagtatttgcggcatttggttcgccagcaggcggccaaccaccgggctcatgtacaaactaatgattgtctttaccagatgagcctcagcctgcagagccagggttttacttcttttccgtgccctactccggaccagttcagggcagaggtcgcatggcctggagattggcctgaggcccgggcaagagaggcgccagcagaggcaccagcagaggctcccgacgaggcagatgaggcccgcgaggacgaggagatggccgatttacttgatttcttaggaggaagcggggccacatga

SEQ ID NO: 15611 - DNA, 219 bp, Glycine max
  Peptide Sequence Number=SeqID_132389
atggagcttgaagaggaagtcgtccgagagcttgagatgagtttgaagcttcccaaatatggagagctaaatcttctgttgtacttcatttcagtgtgctttttccttgatcatgtagatgcatgctttgttaggataattcaacagtggaaactgttctggtcgagtttagtccaacaagaggaatctgaggatgatgcttggtcgggattaggctag

SEQ ID NO: 15612 - DNA, 939 bp, Glycine max
  Peptide Sequence Number=SeqID_132390
atgacagaggatagcagcgttagggtttcttcttccgacaaaacctccgcggccaacgatgcttcgcagacgcggcagagaaagaagagaaagtgggatcaaccggcggagtcattgatgccagttgggatggcagttcctggagcactccctttgagcaatgccgtgtctcttggaggggttgcatttcctgccatggctccgatgatctccggagctcttttgaggaatcctctggcagcttcttctcagcttccgcaacacacagttgcagctgctgttgccgcacaaaaattgaatcaaatgtttagtgcctttgaaatggcaatcacacactatatggaagtccaagtaaagtgcaagcagagattacctgaacctgattacctgattcatttgtacttctcagagtcaatgctcatacataggttttcagagtgggttttgggatgtgggcaaaagatccaagatgaattaataattgctcgagaaattgtcataaatgatgcagagtcttctgttcgctacaagttgacaaaacgccagacacaagaggagatccagaggtgcactggtgccatagttataactagggggaagtatcggctacctaatgcgccacatgatggagggaagccgctgtatcttcacatctctgcaggagctcatataaaagagacagcagaacggattttagctgttgatcgtgctgctgcaatgattgaagaaatgcttaaacaggagcaaaattcacagtcaatttcttccgcctcaccttctgctttggttaatatactgaagatgctgagtacatgcgtgtttttgggctttgatgctgatccttctttgaacattgttgctcgtatacgtggaccaaatgtgctgaaagtgatattcagatggatggaattggaaaatggttcttctgatgacttttga

SEQ ID NO: 15613 - DNA, 510 bp, Glycine max
  Peptide Sequence Number=SeqID_132391
atgcggttggctagctcatcctccttcaacgaagaaatcaagcaaatctaccatatctccatcatcctcaactccaccttcgtccccttaggcatctccttgagcatatgtaggacatgcctcctccaaaaaattaggcctatccccaggtcatgcgacagtggctctgaactgctcgggagtaggccatgggtaagggttagggtcctagcgatgctggtgcagtgtatactaatagaagttgtcattgaactgcatctggcccttatgaattggcagagacctatgatcaatgttgaaaatcccagtgccctgttggacttatctgggtctactggaccaactaacatttgggtagagggagatcagagttatggtcactgggaaggtgttactgagcaggcacatcatctagatttgagtcagagtggtcatgctaatgtgcatgatccatacccgcctccctgctcgctccgtgaaaaatcatgtcccggagagcaaagtagttga

SEQ ID NO: 15614 - DNA, 246 bp, Glycine max
  Peptide Sequence Number=SeqID_132392
atgaagattaagtttaatccttctccattgcacctcactcccatcgtcatctctaacctcatgaatcagcagcggcgatggagatggagatggagatggagatggatgctagttttgcgactatggagcgaaggcgttcattctagagaagcggttgaagacacattgaaggttctggagatgatgattgctatggaaacacaatttgtctttgaggtcgaagacacattcaaggcccttgcttga

SEQ ID NO: 15615 - DNA, 1062 bp, Glycine max
  Peptide Sequence Number=SeqID_132393
atgaatgaaacaggagcaacagttgtactgagaggacgtggttcaggaaacaatgaatgcttgaatggagaagatggacagcagcccctgcatctgtttttgtctagtaacaatgcgaaaagtcttgaagatgctaagcttttggctgaaaatcttttggatacaatctgtacggagtgtggtgctttaagggtttcatcatgtaaggtttatagtgctgttccacctccacagcaggtatacactgctgttccacctccccagcaggtttatagcggcccttctttgttgaagcagattcctactgccatttcacccccacaacaagtttatagcgctgttccacccccacagcagttgttgactggagttcagagttctggaattgacctagaggcaggtactagcctaacctctagttcaatgtcagcagctggggtcttgacaccggttcctccagcttccttggttggagtgactggtgtcactggttccctcactttagggactccatcacaatctataggacatttaagctctgggcctcaagcaaacatgattggttatactcctccccctttagtatcaggtggtactagctatattggatatggtggattatatcctcaagctacccctttgcaacaagttgcccttgccttgagacactcacctcctgtcacatctacagatgctcccacaacatcagcatcaaatggagaatccaggccaacctcaagctctgatcttgaaaaggagaaacggccgcctcagagacgaaaatttcaagaattgccagttggttcaaaaggcacaacaaaactcaatcagggttttcagttttggaggagtaggagggtgcttgtggcttcacagcatatgccctgtccaatccaagatgttattctgatattttctttcattggtaaaattgctgcaatatattttgtggcatgcttttcagccatgccctcctctagtcctgcatatatggactgtcaatttcctgaagaaaagggtttaccataccagcaccaaattgatgccaattcgttaaattga

SEQ ID NO: 15616 - DNA, 583 bp, Glycine max
  Peptide Sequence Number=SeqID_132394
atggtagagttatgcctagtgcctggcgtcatcatcccttcgatgttcaaggtgccagacttcgataagtacaaggggactacttgccccaagaatcacctgaagatgtactgcaaaaaaattggggcatacgtgaaagatgaaaaattgttgatgcatttcttccaggaaggtcttactgaggcaaccgtcacctggtacactaatctggaaccttttgaagtccattcttggaaggacctagtgatttccttcattaggcagtatcagtacaattctgatatggctccagacagaatgcagctacagaacatgtgcaagaaggaacatgaatctttcaaagaatacgcccaaaggtggagggatctggcagctcaagtagcgcctccaatgatggagagggagatgataacaatgatagtagacacgttaccagtgttctactatgagaagatcatgggttacacgccttcaagctttgccaatttagttttcaccggcgaaaggatcaaagtgggtctgagaagaggaaaatttgattatcttgctttgatgaataggaagtctggggcaaatggagaga

SEQ ID NO: 15617 - DNA, 636 bp, Glycine max
  Peptide Sequence Number=SeqID_132395
agggtacatctacttgggggttgttatactgagaacaagagagggtacatctcttgtggatcagttcaagtggagggtacatccatttggttattcaaagagaacaagggagggtacatcccttgtggatctttggcttgtaaaggattttacaaggttgaaagaaatctcaagaaccgattggttgcttggggactaaatgaagctgagcttgctaaagagaccaaaaacatcatatcaaagccctcagtactcatgggattgcaaaaccacaaggatgttttggtagtggttgatacagaagactacccttcctttctggaatttcttaaaggaaaccaggatgatataaagttcaagataaagcttgcatggaaagcttttaacatgttgcttcctatgactcaacagtatctgagtggttgtggaaacagagtgtgggaggtacttctgtttctagtttataaattccctcctagcttgacaatgcccctctcactcaaaagtcctctcggttatggtgaaaatcctcatcaaaaagctgcattctatgttgacaaaagcctttctgaagttaatgctggtggaattgctacagccatccaacaccatggaaaggtgggaatcaactactaa

SEQ ID NO: 15618 - DNA, 804 bp, Glycine max
  Peptide Sequence Number=SeqID_132396
atgtgtaagaatgtgaccgggggtggaacttctgtatgcagaagagcacaggtttcagcaatggcgttcttaaataaaattggaaatctggtcaagaattctgctgtcaagcacatcaatcaagatttttcagtgtctaccccatcacttttccaagcaattagatccatgtcatctgcaaagctttttgtcggaggtatttcttacagcactgatgatatgagtttgcgagagtcttttgctcgctatggagaagtaatagatggtaaagtcaaggtcattatggatcgtgaaactggcaggtcaagaggttttggcttcataacttttgcaacaagtgaggatgcatcttctgccattcagggcatggatggtcaggatcttcatggtcgcaggatacgggtgaattatgctacagaaaggtcacgtccagggtttggtggtgatggtggatataggggcagtggtggcagcgatggctacaataggggtggaaactatggaggtggatataacagtggcagcgatggctacaataggggtggaaactatggaagtggcaattataatgttacaagcagctatagtgatggcaatgctgaaactagttacactagtggtgctaatgctggtaattaccaattcaatgaaaattctggtggagtttttggctcagctagcggtgaattcagcagcaaccaaaatgacgcaacaggtgcagacaatgatgaattcattgagccacttgaagacaatgtgagggagaacaatgatgaacctactgactacgctcagaaccgctga

SEQ ID NO: 15619 - DNA, 2042 bp, Glycine max
  Peptide Sequence Number=SeqID_132397
atggctgtagaggagtctgagcctgtgattggggagctggaaagggaggagaatttgattgctgcggtaaggcatattgtgaaggcactggggccaaataagacccttactagtgatgccaagaaaattctggcagatcttggcactagattgtcctccatgtccgtacctagtgagaaggaggaggggaaacaagggcaagggaaggatgatggtgataattgtgatggcggtggtgatctttatgatgaggatgatgatgatgatgagggtattagtgctattgaagaaaagcttaatgtgattcaggagaaaattatgagatgggaggaagatcagtccatgatttgggatttgggacctgaggaagcatctgagtatctgaatgctgctaacgaagcccgccggttgattgagaagttggaaagtttgaatttgaagaaagaggatcaagagtacaagtttatgcagagggcgtatagtgttcttcaaacagctatggcgcggcttgaagaagaattcaggaacttgcttatccagaacaggcaaccttttgagcctgagtacgtctcttttcgctccagcgaggaagatgctgttgatgagaactccatagtctctttaggtgatgaatcagttgaggaatcacttcaaagagatagtgtcagcagagcttctgaggagcatatcatttatttggttcatccagccgtgatcccggatctcaggtgtattgcaaacttgctttttgcttctaattatgttcaggaatgctccaatgcttatattattgtccggagggatgccttagatgagtgcctcttcattcttgaaatggaaaggctcagcatcgaggacgtcttgaaaatggagtggggtactctgaactcaaaaatcaaaagatggatttgggctgtgaaaatttttgttagggtgtatcttgcaagtgagaggtggctcagtgaccagctttttggggagggtgagcctgttggtctatcttgttttgtcgatgcatctaaggcttcgatattgcagcttctgaatttcggtgaagccatgtccattgggcctcaccaacctgagaaattgtttcgtgttcttgacatgtatgaggttctacaagaccttatgccagacattgatgctttgtattcagatgaggttggttcctcggttaaaattgaatgtcatgaggttctgaagagattaggtgattgtgtgagggtgacatttcttgaatttgaaaatgccattgcaacaaatgtatcatcaactccttttgtaggtggtgggatacatcctttgaccaaatatgttatgaattatcttagaacccttactgactacagtgacatactcaatctgcttctgaaggaccaagacgaggatgccatttcgctgtcacctgacatgagccctggtacagaggaagatagcagaagccagggatctccaggtagagtttcctcaatggcccttcacttccgatcaattgcttcaatcttggaaagcaacctcgaggagaagtccaagttatacaaagaagtctccttgcagcacttgttcttaatgaacaacctgcattatatggctgaaaaggttaaggggtctgaactcaggctcatacatggagatgaatggattcgaaagtgcaattggaagtttcagcagcatgcaatgaaatatgagagagctagttggagtcccattctcaacttgcttaaggatgagggaattcatgttccgggtacaaattcggtctcaaaaagtcttcttaaagagaggctacgaagcttctaccttggctttgaggatgtttacaggatccagacagcttggattatcccagatattcagcttcgtgaagatttgcggatttctatatccctcaaagtaatccaagcttataggacgtttgtcggaaggcacaatagtcacataagtgacaaaatcattaagtacagtgctgatgatttagaaaactaccttttggatttctttgaaggatctcaaaagtggttgcaaaatcctcataggag

SEQ ID NO: 15620 - DNA, 1002 bp, Glycine max
  Peptide Sequence Number=SeqID_132398
atgactaatgaatcctatacttgtatgcttatgtgttcaattcactgttcagctcaagattctctggaatttgttatccaatggctagaacgattccctcgttacaaaactcgggagctctatatcactggagagagctatgcaggtcattatgttcctcaattagccaaggaaatcatgacctacaatgcaaaaaccaagcaccccatcaatctcaaaggaatcatggtaggaaatgcagtgacagacaactactatgataacttgggcacagtgacgtattggtggagccatgctatgatctccgaccagactttccggcaactaatgagtagatgtgattttcacaggcagaaggaatctgatgagtgtgagtctgtgtatagctatgccatggatcaagagtttggtaacattgatcagtacaacatctatgatcctccatgcaacaactctgatggtagtagtagtggtagtggctctgccacccgccgcaccatgcggttacctcaccgaccccatgtggcttttaggcattggtctggttatgatccatgtacggaaaagtatgccgagatttactacaacaggcctgatgttcagaaagcactccatgctaacaaaactggcattccatataggtggactgcttgcagtgaggttttgaatcggaactggaatgatacagatgtatctgttcttccaatttatagagagttgatagctcacggaataagagtttgggtgttcagtggggacgtggactcagtggtgcctgtcacagcaacaagatatgcccttgcacagcttaagttgtcaactaaaataccatggtatccttggtatgtcaaaaaccaggttggagggtggacagaggtgtacgaaggggtaacattcgcgacagtgagaggagcaggtcatgaagtgccactattcaagccaagagcagcccttcagttattcacatcattccttacaggaaagcctcttccaaagtcctag

SEQ ID NO: 15621 - DNA, 942 bp, Glycine max
  Peptide Sequence Number=SeqID_132399
atgatgaattattttttgtggggatcaactttgcaacctaggaagggaataaatttcctttatagggacaagcttacaatgaaaaagaaatttagagatcatcaaagacatgagtggcaagctggttttattgaagtaacattcaatcattcagatgcacatgctattcaatctattcctctcattaattcatctgataatgataggttgatctggaaattttccctaaatggttcctattctgttaaaaccgcctaccacaacatcatagaagccatgttaggcaccgaactcttgaaagctaatgggaattggtcagcagtttggaagttgcatactcctcccaaaattaaacacttcgtgtgtagatctcttagtgcaaagctttgggatgtcatccaacctaagatcaaaactgccgaaagctacaatgattttatcttcaaccttctcgagcaactccatcctcataagtcaagtcaatcagctatgatcctttggtacatacggaaaactcgtaatcaaaaagtctgggaaaacgttgaaacaacttcctccattgttgtctccttagcgcttcaatcctattcagagtggttatctgccgatgcaagcaacaacatttatatttcagcgtctccgccttctacctcccaacagatatggactcctccagcaataggtctccccaaatgcaactttgacgcaattattttcaaggatcagaatgtgtttggtatagggatgtgtcttcgtgatgacaatggaaccttcatcaaagccaaaaccaagcactatcaaggcacacctcaaccgcaggaagctgaagtttatgcactccatcaagctctcgtgtggattcagcaattcaaaatgatgaaagataatctggcagcaacaaaacctagggcttccctctccactatccaaaagtctttgtaa

SEQ ID NO: 15622 - DNA, 1683 bp, Glycine max
  Peptide Sequence Number=SeqID_132400
atggcgtgtgatgggaagcttgagattgtggttccgtcttttgttcactaccttgaggttctagaaggtgctgatggggacaaaatgccaggctggcctgctttccaccaatcaactgtgcattctagtcctcttctatatgacattgacaaagatggagtgagagaaatagctttggcaacctacaatggtgaagtgctgtttttcagggtttcgggctatatgatgtcagataagcttgaagttccgcgtaggaaggtgctaaaaaaatggtttgtgggcttggatcctgacccagtggaccgttctcatccagatgttcatgatgaccaacttgtccaagatgctactatcaagaattctatgtctcaaatgaatggaagtagacatgaagccaaatcttcagctgccacatcaacagaaaaccaccttgagacaaaaaatttgtccaatcctgagccagaaaagaaaataaatggtagtcaagtagatgagagtattaaggtgcctaatcctgagccagaaaagaaaataaatggaagtcaaatagatgagattattaaggtgcctaatcctgagccagaaaagaaaataaatggaagtcaagtagacgagagtattaaggtgccaactgttgtggataattcctctgtgaatgctgggtctctggaaactgttcatgctgataataaaaccagcactgggagacgtcttctggaagataacaattccaaaggagcagtgcaaggcagttctgaatccaaagttaaagagggtattcatgctgcaactgtggaaaatgatgaaggcctggatgcagatgctgattcatcttttgagttattccgtaatagtgaagatctggctgatgagtatagttatgattatgatgattatgttgatgaaacaatgtggggtgatgaagaatggactgaagttaaacatgaaaaattagaagattatgtgaatgttgactcacacatcttgtgcactcctgtcattgctgatatcgacaatgatggtgtttcagaaatgattgttgccgtttcttatttctttgatcacgagtattatgacaaccaggagcatcggaaagaactgggtgatattgacattgggaaatatgttgctggtggtattgttgtttttaatctggatacgaaacaagttaaatggactgcagaacttgatctgagtacagatacttcaaacttccgtgcctacatatattcttccccaactgttgtagatttggatggtgatgggaatcttgacattcttgttggaacttcatatggcctgttttatgtgttagatcatcatggtaaggttagacaaaagtttcctcttgaaatggctgagattcaaggagctgttgttgcggctgatgttaatgatgacgggaaaattgaactagttacagctgatacacatggaaatgttgctgtatggactccaaaaggagatttaatatgggaaaaacatctaaagagtcttattccacaggtagagaaaaacataaggggaagtggatgtatcactccagttctatatttggttcacttccctttggctttaggcattctcttggatgtgttggaagatgaaaagaggcttaaagatgaagagattgagcatgctacaatagaagagtccatgcagcaatgtgctggcctccaatga

SEQ ID NO: 15623 - DNA, 297 bp, Glycine max
  Peptide Sequence Number=SeqID_132401
gtgctgcgaagcataagagacaacatcaccgaggaagatttgttgaatgaaataagtgagataattcgccttcccatgtatgctgaccggatcagaattgatagtaaagcgaatcagcatgctaatgtcgcaaggcgaagcatgtttgacggtagcccagtcactgctactcattctactagtagctctggaaatctaccatggaaggatgaggaaggtggcaactgtgtgaactgtttggcagtggtgaaaatgtgtaaggttcagataaatggatgtggaaagaaacagtgttaa

SEQ ID NO: 15624 - DNA, 177 bp, Glycine max
  Peptide Sequence Number=SeqID_132402
atgaaaggccttttgttacaaaaacttgaaagcagtgaagtgcttcttagtccaatagctcttaaggtggttggccccttgcttctagactcaaattcttcaagggatggcaccaatcctccttccaattccctatatggcaacccacaaacaaggaaacaaagagacaagaaataa

SEQ ID NO: 15625 - DNA, 981 bp, Glycine max
  Peptide Sequence Number=SeqID_132403
atggcagatgcgttagcaactttatcctccatgtacgaagtgagtcaccggaacaatttgccaacaatcagaattcagcgcctcgagaggcccgcccacgtgtttgcagtcgaagaggttgttgatgataagccctggttccatgatatcaagtgtttccttcaaagccaggaatatccacccgaagtatccaacaaagacaggagaactttgagaagattgtctggtaatttcttcctaaatggggatgttttgtacaaaagaaactttgacatggtactactcaggtgtgtagataagcaagaagcagaatttttgatgcatgagatacatgaaggctcctttggtactcactccaatggacatgcaatggcaaggaagttgttgagagcaggttactactggatgtcgatggagacagattgttgcaaacacgcaaggaaatgccacaaatgccagatttatgctgacagaattcatgtaccaccaactacacttaatgttctttcttctccgtggcccttctctatgtggggcatcgatatgattggtagaatcgaaccgaaggcttcaaacgggcatcgtttcattctagtggctattgattacttcaccaagtgggttgaagcagcatcttatgcaaatgtgactaagcaagttgtggtccgctttatcaagaatcagatcatctgccgttatggtgtgcccaacagaatcattacagataatggaacgaacttgaataacaagatgatgaaagatttgtgtgaagagttcaagattgagcatcacaattcttctccttacagacctcagatgaatggcgcagttgaggctgcaaacaagaatatcaagaagatagtgcaaaagatggtggtcacatacaaagactggcatgagatgttacctgcgtacttcaacaggggcaacccccttctctttggtgtatggtatggaagcagtactccctgtggaggttga

SEQ ID NO: 15626 - DNA, 206 bp, Glycine max
  Peptide Sequence Number=SeqID_132404
gagaccttggggacgtcaggcaagctcctgacagtcaaccaataaaagaacaaagaccacaaagcaaggaggcttgtgtggtggctggccagctatggatcttgagtggtatctggaatttggcctctggtaatcgattaccaagggaagttgagatggcctctggtaatcgattaccaaggggtgtaattgattacaaggcttag

SEQ ID NO: 15627 - DNA, 685 bp, Glycine max
  Peptide Sequence Number=SeqID_132405
atgacgtgtggatcgctactgccggccaggtggccgcgcactggcagacgcagccggataacgatgccgatcatccggcagaggtgtttgcccggctcagcggaggcgaacatggacaccacgcttgatcggctggcggatttcatcgcggccacccgctttgcccagctgccggaaccgctggtagcgcaggcgaagcgccatctgctggatacgctcggcgcggcgctggcgggctgtgacagcccgatctggcgcgaatgccgggcgctggtggctgaagagggcggcagcaccgtggcgcagctgtggggctgtgcgcagcaagcttccccgcgccaggcggcgtggctcaacggcgtggcggcgcacatgtatgaactggacgacaccggcggctgcgatcactccggtgccgtggtgttaccggcgctgctggcggcactgccgctggcgacgcagccggtcgacggccgggcatttctcaccgcgatggtcgtcggttatgacatcggccgccgcgtgctggaagcctgcgggggttatgcggcgcacaacggtgcgggctggcactcaactgccagctgtggcgtttttggcgcggcggccgccgtcagttgtttactgcggctgccggccgcgcagtgtgcctcggcgctgggcatcgcagccagcttcagtggcg

SEQ ID NO: 15628 - DNA, 648 bp, Glycine max
  Peptide Sequence Number=SeqID_132406
atgaccatttatgcagaaagtcgaagtggtgatagtctagaaaccagcggctcagagctatccgacgaggagaataaaaatctaagatgtgtactatctgaaagtgataagtcgttgttggtagagttaggcgagcactccattgagtgcctactggttcacaccctaggccatctgtttaatctggaaaatattgtcagtcttgctagtttggttgatcgtatagaacgcaatgtaagggattatgcctcatcgtcaacattgtattataatagtagggtatgtaatctaagtatggatgctgttgataaaggtactaaagcatctaaaactagagcttatccctttggtacagcattagttgaatttttagtgagtcgtggtctattgcgcttagtaacatataatgttgatttattaaatttctctgatgatagtggtccaaagactgttgtcaaaaatgttgtcaaaaagggccataattactataggagctctttagtatatgccgaatgcttgtttaaccccgcattacttcctataaagttaaacctacctatggtatttccacctaaagattgggagccccacaaacctgaacagaaaccaaccctacgggccaaatctacagcactcaacggagtatga

SEQ ID NO: 15629 - DNA, 438 bp, Glycine max
  Peptide Sequence Number=SeqID_132407
atggcattgaaatcagcagcaatcacactcacatttttatccttagtctctttaccactagcaagtgattctaatggtggcataattgcaatctattgggggcagaagaataacgagggcacgctggccgaggcttgcgccacagggaactatgattatgtgtctcaagacatcacatattgtcaagccaaaggcatcaaggtattgctctctttggtaggaggtggtggaagctactcaaatgctgataattccactcaggatgtatgtcaagtagctgctcacctttggaataacttcttggggggacaatcatcgtcgttgggtcctcttggccctgctgtccttgatggcattgattttggtattgtacatgacattgaagatggaccaaagcagtactcgcgtgatcttggtataaccctaaagtgtacataa

SEQ ID NO: 15630 - DNA, 147 bp, Glycine max
  Peptide Sequence Number=SeqID_132408
atggctgagcagttgaaattcccgattgcaagtttgccagcattagaaccatttcctagtgctaacaagactaagcacaagaatctgattgagagtgatgatttcaatgccattgtgaagagggaaatacctatgaaattgttttaa

SEQ ID NO: 15631 - DNA, 1164 bp, Glycine max
  Peptide Sequence Number=SeqID_132409
atggagtcaaaggattctaagtctagtctccatatgatagatagtttgaaagcacttgatgagaatgatgaagatcttcaaatgcaccctcaacatcaaaatttagcactagttgaagggactgactggacggggggcaagtggatctttaagaagaaatctggatcatccactaaagaagtcatcggttataatgcatgtctagtagttaaaggctacaatcaaaaggaaggaatggactacaacaagatattctctccaaaagacattctgatgcaacaagctaaaggttttgaggtggaaggaaaggaaaattttgtctatagattgaagaggtctctttatgggctaaagaaatcaccaaggcaaaagtacaagatattcgatgagttcattgtctctaatgggtacatcagaagtcccaatggctcacatgtttatcatagcacggtggaggatggttcccacatctatctactactctatgacatgggagctactgaaaagattttgggcatggagatcatgagggatcaagatcaaaaagtgctaaatcattttgggatgacatccgcaaaaccaacatgcactcctttaacaacgtccattcatctatctaaactctatactactcaatcagaaccagagaaggaatacatgtctcatgttccttatgcaagcattgtaggcagtctcatgtatgctatggtatacactagaccgaacctaacacaagtaatcggtgttgtgagtaggtatatgggtaatcttaggaaggaaaattggcaagctatgaaatgtatattcaggtaccttaaaggtacaactaatattcgactcgtctaccatggagacacgtcatgtgcttttgttggttactcagattttgactatgctgcaaatttggatgcaaggagatgtgtgattgggtaccgctcacgattggcaactctcttggctatccatatttgcatgatcccaaatgattgtgttcgtgctagagggggtattgcagtgtctatgcgcagtttgtgtgaggcagtcgaagagaattccgaacatagaacatatgttcttacgatgcagattaaagagaagtggttgagtctgggaagtgatgatatcggtcgtggtgcatacaatttgggttatatggcattgtag

SEQ ID NO: 15632 - DNA, 2337 bp, Glycine max
  Peptide Sequence Number=SeqID_132410
atggctggaagtctgtcaaaaatcattccggatatgtcgaaaatagaacctctagacggctcaaattataggagatggtctcaaaaattgttgattttgtttgaagccttagaggttgattatgtgctatttgaagatcctcccgctgatgtcaacgcttctgaatcatctactcctgaaactcctgctacccctgtcgtcacaccgcttcctgcagaaaccaagaaagctgacgaagaagcaaagaagaaatatgaaaaggacaacaaaactgctagaggtcatctgctaactcatatggcagataatctgtttgatcttttcattaatcaaaagtctgcgaaaacaatatgggacactctgctgaaacgttacggcgatgacgatgctggaagaaagaaatatgtggtaggaaattggctgcgtttccaaatgatggatgacaaaccaatcatggagcagattcatgagtatgagaatatagttggtgatatactaaatgaaggaatgaagatgtgtgagatattgcaggctaatgtgcttctagaaaaatttccaccttcgtggagtgactatcgcaaccaactgaaacacaagaagagggacttgtcacttcaagaattaataaatcatatgaagacagaggaggccaaccgacttaaagataagcatgcaaacatggtcgacaacaaggtggactggattctagataccggtgcttctaaacacttatgcgccaacaaagagctttttcaccagattgaggatgctgatgacggagaatgtgttttcatgggaaattcagctacagctggagtgcttgtatggggatgtcttgctaaggtagctctaccagatttcaagaggactaatgtaggtaccaaaacttttgattgtgtgtttattggatatgctcaaaatagtgctgcttataggttcttgcgtttgaatgataattctatttgtgaatctagaaatgcagaattttttgaacaagaatttcctttaacaaaacatgttaatgaattgatttcttcttgtaatactacttcagtgcctttacatttgcgtacttcttcctctgtaacaaatgaacaagttaatgaacctagaagaagtaaaaggaagagaatagaaagtagttttggaccagattttgttactgccttcgtggttgaaaacaatgatgtcgataaaataaatgatgtttttgtatctacttttctcattgaggaagatcctaaaacttataatgaggctgtaacttccattgatgccaactttttggaaaaaggcactgctattcatggacttatagtgcatcaaatggatgtaaagacagcttttcttaatggtgacttgagagaggaaatttatgtggaacaacctaagggttatgtgattcaaggtcaagagaacaaagtgtgtaagttgagaaaatcattatatggccttaaacaggctcccaaacaatggtatgaaaaatttgaccaaactttggtaagtgatggttatattgtgaattcatctgacacttgtgtttactctaaattgtttggacaagaatgtgtgataatatgtttatatgttgatgacatgttaattttcggtactaatgtgactgtagtggaaaagaccaaattattcttatcttctcattttgatatgaaagatctaggagaagctgatgtgattcttggagttaaaatgagaaaaagtgataatggtttttccttgtgtcagtcacattatattgaaaagatacttaaaaaatttaactgttatgatgaattacctgtgagaactccctatgatcctagcatacatcttaagaaaaacaatggttctagtgtttcacaaactgaatatgctaaaatcatagggagtgttatgtttctcatgaattgtactagacctgacatagcatatgctgtgagtagactaagcagatatactcacaatccaggattttgtgatgcaaattgggttactgataatgatgaagtaagttccactagtggatatgtttttactttaggtggaggtgccatatcatggaagtcttccaagcaaacttgtatagcacgttcaactatggaatcagaatttattgctcttgatttagcaggtcaagaagctgaatggttgagaaacttgttggcagatgtgccattgtgggggaaactgtctataccagtttctcttcattgtgactctaaagcagctattggaattgctaagaacaagaacaacttggcagatccgttcactaaaggtctaacaaagaaagttgtacttgaatcgtcgagggggatggggcttaagcctttgtgttga

SEQ ID NO: 15633 - DNA, 381 bp, Glycine max
  Peptide Sequence Number=SeqID_132411
atggactgtacacgaacagctgaggagaggacagcaaaaaattcaatttcccaagaaaccgccaaaataattcactctatcagtgttgtccatacattaagggacaatgttatgaatttcaatatggcaaaaccaagctttggacataatcataggaacgcaacacaaacatccacaaaggcaaaagggaataactttgaagatgctcataacttaccttcagcaactgagtccaagatttttcaactccaaactccttcattatccaaacagcaaaataagaaagacacaggcaacctttcaaggctcatatttgggaatttcgagaagaccatcgggcatcaacaaatatctgtatgtctcgctccgcatatcatatga

SEQ ID NO: 15634 - DNA, 672 bp, Glycine max
  Peptide Sequence Number=SeqID_132412
atgtcgaatttgtatggagattatcaccaaaagattgattacgtgttcaaggtggtgttgattggggactctgcagttggaaaaactcaattgcttgcacgctttgctaggaacgaattcagcctcgattccaaggcaaccattggagtagagtttcagactaaaactctcatcattgataacaagaccatcaaggctcagatatgggacaccgctggccaagaaaggtatagggcagttacaagtgcatactatagaggtgctgtaggggcaatgttagtgtatgacatgactaagcgccaatcgtttgaccacatggtaaggtggttggaagagttgcgaggccacgctgaccaaaacatagtgatcatgctaattgggaacaagtgtgatttggggagccttagagcagtgccaatggaagatgcagaggaggttgcacaaagagagaaccttttctttatggagacatcagcacttgagtccactaatgttgaaacttgctttttgactattctaactgagatataccggattcatgccaagaaatcactcactgctagtgacgatgataattggggttcagggcttctcaagggaagcaggataattgttcccaaccaagagatagataatggtgggaaaaagggtggttgttgttttgcctcctag

SEQ ID NO: 15635 - DNA, 903 bp, Glycine max
  Peptide Sequence Number=SeqID_132413
atggcattgaaatcacctatctcagtcacattcttgtgcttagtcttgttagcactagcaaatggttcttatgctggcaaaattacaacctactggggccagaatggcgacgagggcacgctggccgaggcttgcgccacggggaactatgactatgtgatcatagcctttttgccaacctttggcaaaggccaaactcccatgattaatcttgctggtcactgtgatcctcatagtaatgatggatgcactggcttaagctcagacatcaaatcttgtcaagccaaaggcatcaaggtattgctctctttgagaggagatgttggaagcccctcaattgatccaagccaagcagccacttacctttggaacaacttcttggggggacactcatcaaccactcgtcgtcctcttggctctgccgttcttgatggcattgactttgacattgaaggtggatcaaacaaacactggggtgatcttgcaaggatccttaaagggtacggcatggccaaacaaagcaagaaagtgtacataactgcagcacctcagtgcccatttcctgatgcttggataggaaatgctctcacaacaggcctttttgactttgtttgggtccaattctacaacaaccctccttgccaatacaattcttctggggcaattagtaaccttgaagatgcatggaagcaatggatcacaagtatccctgccaacaagatattcttggggttaccggcttcgccactggctgcaggaagtggcttcattccttctgctgatcttatttccaatgtgcttccagccattaagggttcttctaaatatggaggtgttatgctgtggtcaaggtattatgatgttctgagtggttacagctcttctattaagaagtatgtttga

SEQ ID NO: 15636 - DNA, 309 bp, Glycine max
  Peptide Sequence Number=SeqID_132414
atgccgaggctgtggagcttcttggcgattcgttcaatggcggaggagattgacaggttcgggtttgaatctcgggaggggagcaacgaatggggaatctggaagcaacatttcagtagcagttacttacttcatggaacatggatgaataaaaatatgagggcctgttgccaccccttgatgctccacaccatttgcgcaaacatgaatagggtccttatcgagaagttctgcttgagatgtttgatgattgcctttggtggactggctgtgttggaagagagtattgaagaagatgataacttaaag

SEQ ID NO: 15637 - DNA, 120 bp, Glycine max
  Peptide Sequence Number=SeqID_132415
atggaatccttagctgaagcaacctcgggagtcataggatcacttttgagcaccactatgttgtgccctcttgacacttgcacgaccaagttccaaagtacagggcataatcaattataa

SEQ ID NO: 15638 - DNA, 345 bp, Glycine max
  Peptide Sequence Number=SeqID_132416
atggttggtatcaacgcaaccatcaagccttacgataccaactcctggggcggctggaccttcgactacgacaacactgcctattcgatgtatcattccggcgagaagtggaatccctacgacaaggacgaaaagctggacaagatgctcgaagcacagcgttcggttcttgaccgtggggagcgtgaaaagctcctgcaggaaatcgcgcattacgcagccgaccgcgcactcgaaatgccgctctataacctcaaggcgatcttcggcgtcaacaagcgcgtgaagaacttcgttccggttcccgacagccgtctgcggttgacggacgttaccgtcgagtaa

SEQ ID NO: 15639 - DNA, 468 bp, Glycine max
  Peptide Sequence Number=SeqID_132417
atgtctcttctagtgttatttgttgtagcactgtggcgagggtgtgtgatgtgtcatgctagtaaatttgagcagttcattactattattatgatggggtgtctggtgaaagaaacattgggatgcggaaagcaattgcccaatcaaaatgggcaaaaacactatgagaacttggaggatatggtgcatcaagcaaagaaagtggagagacaacttgagaggaagcattcctacaggaagacctattactatgactcttctagtggtaaggacaagtccaagaaggacggatcttccccacctaagcaacaaggttcaaaatttccaagtggtaaacatgttcctaacctagcacttcttctacttctaggagtagttcaattaaatactttaaatgcttgggtaaagctcccacagaagcatgtcacatcttgttgggtaaaccgtgacaaattgaaagaaatgtga

SEQ ID NO: 15640 - DNA, 231 bp, Glycine max
  Peptide Sequence Number=SeqID_132418
atgggggtggaagaggagaaccatgagacagacacacgaatgacaaatgatgatgttttaggagatgagatacctactgatcagcaagatgcattgcgtcagttctgttatcaaacgcttaaattgggtgttggggccaggggacacacacaatttccaggttcacacccagtttctctcaacagggttttgctaacaagtgccctaagggaattggttaaagagcattaa

SEQ ID NO: 15641 - DNA, 366 bp, Glycine max
  Peptide Sequence Number=SeqID_132419
atggacttgaatgcctcgccggttccggaggaagatgaagatatttttgaggagaagatacatgttgaagagtttcatgaacctgaagaacgcatagaaactggagctgatatagcacgccgggagcgtgaagaaagaaagagaaggttgaagagagaacgaccggatgatagacctgtacatgtgtcacagtcacatgcatacgatcagttatttcataccaagaaccaaagatcatatgataaaagcaggcttcctccaggctatggcagctgtgagacacagggatttcatggcatctgcaatgaccatggtggaatgtctcttgagaagaaagaggcaaaggggttgggtcatgtgacctga

SEQ ID NO: 15642 - DNA, 955 bp, Glycine max
  Peptide Sequence Number=SeqID_132420
atggctggaaatctatcaaaaatcattccggatatgtcgaaaatagaacctctagacggctcaaattataggagatggtctaaaaaactgttaattttgtttgaagccttagaggttgattatgtgctatttgaagatcctcccgctaatgtcaacgcttctgaatcatctactcctgaaactcctgctacccctgtcgtcacaccgcttcctgcagaaaccaagaaagctgacgaagaagcaaagaagaaatatgaaaaggacaacaaaactgctagaggtcatctgctaactcatatggcagataatctgtttgatcttttcattaaccaaaagtctgcgaaaacaatatgggacactctgctgaaacgttacggcgatgacgatgctggaagaaagaaatatgtggtaggaaattggctgcgtttccaaatgatggatgacaaaccaatcatggagcagattcatgagtatgagaatctagttggtgatatactaaatgaaggaatgaagatgtgtgagatattgcaggctaatgtgcttctagaaaaatttccaccttcgtggagtgactaccacaaccaacagaaacacaagaagagggacttgaagggacaacaatctaacaactcgaaacttgctgcaccacatgctcctcaagcacatctagcagaaaatgaagaagtgatagctgctgtggtagtggaagcaaacatggtcgacaacaaggtggactggattctagataccggtgcttctaaacacctatgcgccaacaaagagctttttcaccaaattgaggatgctgatgacggagaatgtgttttcatgggaaattcagctacagctggagtgcttggtaaaggaacgattctccttaaacttacttctggaaaaacattatctttgagtgatgttttgtatgttccctctctgcgtaggaacctaatttctg

SEQ ID NO: 15643 - DNA, 597 bp, Glycine max
  Peptide Sequence Number=SeqID_132421
atggccgagcgtaaactacccgcgctcattacccgctatggtgacgagcacccagacgtgacacttgaactgttgccgggcatgacaatggaacagctgatcgagcaggtgacgacccgcgagaccgacgttgccttcatccgcgcgcctcttcccacgctgccgcagaccttgcgaaccatgccgttcgaccgatcgaggctttgcgtcgctttgccggaacgtcacgtactcgccaatcgcccgcaggtttccgtcagcgatatcctgcacgaaaaactgctgctgccggttgacgagattggcctcggcctcagcagcagcgcgctttcgcttttcgaagatgccggctgcacgccgcaagttggcttgcgcatcgccaacgtcaatacgattctcgcgctcgtggaggccggtgcgggcatttccatcctgccggaaagcacggtgctttccgcaaggggcactgccgccgtgtcactcgatagcgcggaggcatggtccgactgcgtactgctcgtcaggcgcggcgcgcttgccctgcatgtcgaagctttcgtgaatatggcccgccgagcctacagactgagcctttga

SEQ ID NO: 15644 - DNA, 837 bp, Glycine max
  Peptide Sequence Number=SeqID_132422
atggatgtaaagacaacttttcttaatggtgacttgagagaggaaatttatgtggaacaacctgagggctatgtgattcaaggtcaagagaacaaagtgttggaaaagaccaaattattcttatcttctcattttgatatgaaagatctaggagaagctaatgtgattcttggagttaaaatgagaaaaagtgatagtggtttttccttgtgtcagtcacattatattgaaaagatacttaaaaaatttaactgttatgatgaattacctgtgagaactccctatgatcctagcatacatcttaagaaaaacaatggttctagtgtttcacaaactgaatatgctaaaatcatagggagtgttatgtttctcatgaattgtactagacctgacatagcatatgctgtgagtagactaagcagatatactcacaatccaggtggaggtgccatatcatggaagtcttccaagcaaacttgtatagcacgttcaactatggaatcagaatttattgctcttgatttagcaggtcaagaagctgaatggttgagaaacttgttggcagatgtgccattgtgggggaaacggtctataccagtttctcttcattgtgactctgaagcagctattggaattgctaagaacagtgtttataatggaaaaaggagacacatacgcattagacacagttcagtcagagaattgttaaaaaatggtgtgatctcattacagtttgttagatcagagaacaacttggcagatccgttcactaaaggtctaacaaagaaagttatacttgaatcgtcgagggggatggggcttaagtctttgtgttga

SEQ ID NO: 15645 - DNA, 990 bp, Glycine max
  Peptide Sequence Number=SeqID_132423
atgggagaggagcttgctggtcagctgcttaagattcagcagcaatatccagactacgtgaaggaggtacggggaagaggattgttcattggagtggagtttaacagcaaaaatttgttccctgtatctggctatgagggaaaatctgcactatcacccgagactctgttgaaatacatagatgaacttccattgtgtgcaaggtattacgggactgtttcgggcatgggtgttgtggttgcagcttgcatcctgcaaccttatgtcatctccagcaattcccaacattggaaagcaagactaaagattccaccagctgatactcgccataggatagaggatgtaacggcaactaaaggaaatgagtttgaggattactttttgaagcatgagctgctcatgggaatatatgagaagggttttgaaaggccttctcccatccaagaagaaagcattccgattgctcttattgttagtgacattcttgctagggctaagaacggaactggcaaaacagctgtattttgcattcctgcattggaaaaaattgaccaggacaataatgttattcaaggctcagctggagttgtagtaacaagccgaactttcaagtttgaagggcacatcaattgttatactggtcccaacctgagaattggcattgcaaacttctcaagtgtgcaaagagcttggaaagcacttgaaaattcaagttatggttacaacagaatattagatcttgccaaaaaaggtgtttgtattctgaaagattgtgctatgcttgttatggatgaggccgataagcttctgtccccagagtttcaaccttctatagagcagctgattcattttcttcctacaactcgtcaaatcttgatgttttcagcaacatttcctgttactctaaaggatttcaaggatagattttcttatatgctgcctttgaaatatgatgatgctgatgatgggttctgtttcagcagcaaataa

SEQ ID NO: 15646 - DNA, 204 bp, Glycine max
  Peptide Sequence Number=SeqID_132424
atgattggaaattcatttgctcatatgatatcaactaagcctgttgatcgatatacaagaccagaatttacagagaatgggccattggcaattgattctggtagacacccaatcctggagagcatacacaatgacttcgttgccaataatatatttctgactgaagccttgaatatggcgattgtgatgggccccaatatgtaa

SEQ ID NO: 15647 - DNA, 159 bp, Glycine max
  Peptide Sequence Number=SeqID_132425
atgaaagctaagactaataatgctgaagctttcttcttctctgttattgttcacagtaccttcggtggaaatccactggccagtgcagttgcaattgcctcactagaagtgataaaaattgagagactcgttgagaggcatcatcagcatctgaaataa

SEQ ID NO: 15648 - DNA, 450 bp, Glycine max
  Peptide Sequence Number=SeqID_132426
atgtacttcatgcacgcgttccttttgtcgcctgcacttaacaatgctttgctgttaaggctggaattgatggcctcttggatatttcacgaagagcattttgtgaaactagtgaagtgtaatctttcttggaatgcagcatatcatatatgtgttctcaaagcatttggtgttactttcacagccatccacaatcttgcaaacaattatcgagaggattttaagttgcccaatttaaagcttacctataaaaacaggcagggattccactttgttataccacagaagaatattcaaggaaagcttccaagcaagttcattcaggttgtaaaacatgggaacaacattcgttgttcaagtttagaactagcatttttgaacgctaggaataaatctgcagccgcagaatgctatacaagaacagaggtttgtctggaaggtagtacttga

SEQ ID NO: 15649 - DNA, 213 bp, Glycine max
  Peptide Sequence Number=SeqID_132427
atggagcgcactgttgtgatggagagagatgttggctttgttacggaagcgatagtgatatctgccacaaaagtctggtacaacactgctgtggtgaagaggagaagagggcatgaggctgagagtgaaaagtttgaggttttgatgagagcaaagttttggaagaaagagtttgtggggagtggagatgaaacaaggtttgaggagaagtag

SEQ ID NO: 15650 - DNA, 624 bp, Glycine max
  Peptide Sequence Number=SeqID_132428
atggtgccactatacttcgcaatgctggtggcctacggctcagtcaagtggtgcaagatgttcaccccggaccaatgctccggcatcaaccgcttcgtggcggtgttcgcagttccggtgctctccttccacttcatctccatgaacaacccttatcagatggacgccaggctctttggactggctcatcactctcttctcgctcgccaccttgcccaacacacttgtcatgggtatcccgctgctccaagccatgtacggcgacttcacgcaatcgcttatggtgcaactcgtcgtgctccagtgcatcatatggtacactctactcctcttcttgttcgagtacagagcggcgacggttctgatccaacggcagttcccggggccaacggcggcgtccatagcgaagttcgaggtcgacggcgatgtgatatcgctcgacggccacgacatgccgctgcggacggagtcggagaccgacgaccagggccggatccgagtgcggatccgccgctcggtctcatcggtgccggagacgaactcctctatcggcggcaacactgccgttgtcacgccgcggccgtccaacctctcgaacgcggacatattctcgatcaacacgcc

SEQ ID NO: 15651 - DNA, 174 bp, Glycine max
  Peptide Sequence Number=SeqID_132429
atggtagttacacaggtacagcttgaccgtgccaaggataccagaagagagcttggaatggaaataattgaggaacatacggtgatggaatattctaagatgagatcatcagacaaagggcaaactactttctacacatgtaccggttgcggtcatcagtctcaggagaattag

SEQ ID NO: 15652 - DNA, 390 bp, Glycine max
  Peptide Sequence Number=SeqID_132430
atggtggtaattagtggaaatagtgtggtcattgttgaggtgcttcaaattcaagcttttcatttcccactcccttggttgctccacatattgttccagttgaggtttcagcttcaggggagaagctctgtaacgaagggaaaacaagggagggttaaggagacagagggtgttttgaatggagcagtttattctcactgccatggctttttctcagttcagaagattctcaggaagaagcccaggttttttgtacaacaggaagaagcgcaggtggtgataacaaagaaaaccaaaaaaggtcttagaagattaaaacggtactcccttgacttggttccattgtctgtgcttaaagtctttataactattgttagtcaaaagctttaa

SEQ ID NO: 15653 - DNA, 249 bp, Glycine max
  Peptide Sequence Number=SeqID_132431
atggtgctttgccaaaaaaatgatgggatgaaattgaaggaaacccaaaccttcccaatctcaaacccaaacaatagtggtcaagaacagagcagaagagaagacattaaacctgttatcgtcaacacacgaggagaccaaacatgcaaagaagaacatagaagcgatggcgaaagagagctagagcagcagtggcatgagagctcaagcgacaacaacttaagggacctaaagcgacaacgactttaa

SEQ ID NO: 15654 - DNA, 363 bp, Glycine max
  Peptide Sequence Number=SeqID_132432
atgaatgacttggtttatgtgatgtataacttgaagttaaaaagtaaacaaaatagaaaaagtattgctcttccatttgatgagattgagtctgacgatgaatggataactaaagagggatataatgatgaggatgagcaacctcaaggtgaaggtgatggtggcaatgttgaattagtgggagatgttggaggaagtttaaatgatctagttgtagacgcttttgatctagataatttaattttggtggaacctaatgatgatgcacaatctgaggaagaccttgatgatgatggagatggtgatgaaagtgatgatattcatggagatgatcctattagaggattggacatgtttctttga

SEQ ID NO: 15655 - DNA, 417 bp, Glycine max
  Peptide Sequence Number=SeqID_132433
atgacagataaagaaatcagcttcagagacagcaccaaagtctcaaagcctgcagaccccaaagacacagttgctagtagccagaaaatgccacatgcctttgtcatgatgaggctcatactcgtcgtagtaggaagaaaactttcacgaaaccctaatacatactctagtgtgttaggacttctttggtctctaatctctttcaaatggaatatggaaatgcctagtcttatcaaagcatccgtcaaaatcatctcagatgcgggccttgggatggctatgtttagcttagggcttttcatggcccttcagcctcgtatcatagcctgcggtaccaaaagagcagtcatgggcatggtcattcgcttcgtgtgtgggcctcttgtaatgtctgcctcttctatttccattggataa

SEQ ID NO: 15656 - DNA, 1152 bp, Glycine max
  Peptide Sequence Number=SeqID_132434
atggcagaagttgaagacagagacaacaacactcgtcaccaccatcattacatttcttcaacaacaacaacacaatctccaatgaacaatttcccgcgagatctgttaagaaccttcatgggagtgaacaataataataataataataataatagtaataataataatcaccacaatttgcctatgccagtggtgaagttagaggaggagttagaactaagtctcgacctttcgatgaatggtcgatttggggtggaccccacggcgaagaagataaagagaacaacttcgataccggagtttgcaagcgacaaggagatgggatttgctacggtggggtgcacggggtctctggtgaggacgtgttcgcttccgacggagaccgaggaggagtggcggaagaggaaggagttgcagacgctgcggcggatggaggcgcggaggaagcgctccgagaagcagaggaacatgaaagccttgagagaacaacaacagagggttgttggtgttgttgggtcccaagggagcaatccggtggatcaaggtgcaggggagtacggtgaggttgcagttgcaccacccttggcgagaactgtgtcgttgaccacacgtgtttgtggactcggcttgaatggggacagtgaaaaagagaagaagagtggaatagtgttgccacctccctcgccttctcagggttccattggttcttccggaatctctgaagctgagtctcaacagggtcaaggaacaacacctatggatgttagaagccctactagtgctaacttgttgccagacagtgaactgaaatcaccagcaggtgttgctgagaacaacacaggcaagaatgctgctgctgctgtagtgacaatgagaagtcaatctaacaaacattcaccaccacagagcagaaccaaagacattgtgaggaacttgttggaagacatgccctgtgtctccaccaaaggagagggccctaatgggaaaagaatagaaggctttctttaccggtatggaaaaggtgaggaagtgaggatagtttgcgtttgccatggcagttttctcaccccttctgagtttgtcaagcatgccggtggcggtgacgtggcaaaccccttgaaacatattgttgttagtccgagcttgttgtga

SEQ ID NO: 15657 - DNA, 231 bp, Glycine max
  Peptide Sequence Number=SeqID_132435
atgatgggaagaaaaagcaaagagtattcgctagctaagataccgaatctatcaaacagattgtccataacaaccaggggttatctttggcatgttgatatccttaccgataactctcttatattacatatttcttggcttatgaagggagagaaaaagctacaacctcaaagaagaatcagtgcattgaggaaaagtatgatcgaaactataataaccctactagactag

SEQ ID NO: 15658 - DNA, 609 bp, Glycine max
  Peptide Sequence Number=SeqID_132436
atgaccggaaggctacttgccggttcattggctcttgaaatctgcatcctccattatctaattgtctgtatcttactccctagatcttcaaaccttgcacaagtttctgaagaagatctaatagtcatgtgggcctttcatactggccgaaaaattgattgggcacatctagtccggtatcgcatgcataaggcattgcgattaaatgctcctttaccctatccacacttagttactttgtttcttcaacattttaacatccctctagattctgaaccttatgttccaatcaagagatctttcttgatcggtgctgttgtggttacctcctttggttactgcaaagagtgtgatggctctttggtaaaaaagggtgttcaaccaaatgatgatgaaggacacttaccggttgaaggggactcttctttccttcagagtattttggacaggtttgatggacttcaaacctatgttggtgagaggattgtcatcataaaaaaggaggagattgtggaaccaatgacttccaagaattattttgatgatgccaaagaatcaagagttaagcaagttccaaagaatcaggagtcaaaaagcttcaagaatcaa

SEQ ID NO: 15659 - DNA, 207 bp, Glycine max
  Peptide Sequence Number=SeqID_132437
atggagaacaatgatgggtgttacactgccagtggtggaggtctcggtgatatgactcctgttgaggctaggaatttgattgagaagatggcttccaactcccaacaatttagtgcaagaaatgatgctattgtccttagaggagtccatgatgtggccacggattcatcttcatctgttgaaaataagaagcttgagggaaaatga

SEQ ID NO: 15660 - DNA, 100 bp, Glycine max
  Peptide Sequence Number=SeqID_132438
atgtcatcacgtcggctcggcagctcctcaccagaatcttactccttacaccctgccactgtcattctgctcccacgaacaaggttcgtgatcatcacag

SEQ ID NO: 15661 - DNA, 633 bp, Glycine max
  Peptide Sequence Number=SeqID_132439
atgaccccatgctttataactggcatgactttcacattctttgtcacaaattctatacaccactctatcccccgttctctctcgcccgctttggtaaggcaagatagttctggccaacatggtgcaatcaaggaaattcagaggaaaaggagggtgtggcttgggacattcgagacagctgatgaagcagctagagcatatgatgaggccgccattttgatgagtggaagaaatgccaaaacaaacttcccagttggtgaaaaccaaatgggaaatcatagttcaagtacttcatcttcctccaccactacattgtctgcagttctgagtgcaaaacttaggaagtgttgcaagtccccttcaccttccctcacttgcctgaggcttgacactgagaattcccacattggtgtgtggcagaagcgagcaggccctcgttctgactcaaactggatcatgatggttgagttggaaaagaagaacaacaagggtccttcttctgaatccgaattgcctgttgttgttgttgatgatgatgccccagagaaggtaaagcctgaggaaagcactggcttagatgaggaacagaaaatggccctacagatgatagaggaacttctgaataggaattga

SEQ ID NO: 15662 - DNA, 1137 bp, Glycine max
  Peptide Sequence Number=SeqID_132440
atgcagatttttccaaccaatgttcgaaacctttggaacgagtgggagctccgtgttatggttctggcaagcctcagcttccacagcatcctcatcttgctggggaacaagaggaagtactgcaccagaaccatcctcagaatcacactatggtttgcatacttgttagcagaatggcttgcaacattctcactaggtgttctttctaacaaagtaggagaaaatgaaggtgattttgtggagccgaaatatgtcattatatctctttgggctccaattcttctccttcaccttggtggctcagataccatcattgcttactcaatggaagacaatgaattgtggagtagacggtttctgagtttttgtgtccaggttctgatggcactctatatctcccaaagagcatggacaaacactgatctcaacattttggcaataccaatattcattgctgggcctaattatgccaaggacatggaaacatacattgcagcctctcatgaggggttcattgttgatgtgcaaggccttaaaacccactcagttggtgatgatcacactcatgcacctgctgaagccaatatcatcccactgccacaaactcatgactcatatggacctgaaatttctttcgagaatgggaatgggaatggcaagaaagtgtttcaggttattgaagttgagcttggatttatgtatgatctcttctacaccaaagcagctgtgacttattctttcatggggagttttctccgtttggtcacactatcttgccatgggaagctgagaggaaactgtcaggaaaatctccacacactatgggaaacagagaaagaaatacttgctgagaagattgtgcagctgaaccagcttcattcactgaaacttagatcagtcaatgaaattggcgatcctaagaaactaatagtgaacagtatgtcaaagctggagaatctctcatccctccaggtcttcgggaaattagaagatgaactacatatgagatgcctcccgcaaaatctcactaatctcaccttgtcaaaatcaaaattgtccgaagatcctatgccagagttgcagagcctactcaaacttaagtcactttgtttctatgaagattcttctcttgattaa

SEQ ID NO: 15663 - DNA, 390 bp, Glycine max
  Peptide Sequence Number=SeqID_132441
atgatgatgcctaaagggcacaaaaggcttgcaatgtgcaatctaaaagccatgaaacaagtgggtcgtatgaattttgcttggaactttaaacatcataaaggaaagttgtgggttaatgttttgagagccaaatatggcagggaccaattgcaactccataatatagaggtcaaagtcattgattctcctatatggaaatccatagccaaagtgtggccaatgcttagatgtggaaagttagagatgggagaattgttagtttgtggtttatatatagaggctcttaagatgaaaagaattacccagcctgaagagggggtcaccaacctagatgagagaaggggtcatgttgagagaagatttacaagtttgtccaacttgtcctaa

SEQ ID NO: 15664 - DNA, 1629 bp, Glycine max
  Peptide Sequence Number=SeqID_132442
atgatcatggaaccaaacccaacaccagatcacagtctggactggtttgaaggttctgtgtcttactttccaccattcttagattatccatacaactctagtgacatccaagagtatcagttgtgggaacaagacatagctagcaactaccaaactgataccaataccagttcccctaatgccaccaacattgttaccatcacaacaccccttgagacttgtgactctaacaacctaccactttctgatttgcccaagaaaagaagtgccactgatgagtcaagtcccaaaccaccacaaaaccacaagcacaagaaaatcaagagcaagcccaggaacaatgaagcagataacggagatgcagaagcgacaacaacaacaacagcaacagttagaaaatctggtgggaacaagaaaggtggagctaaggccaatggaaataactgcaacaataaggatgggaggtgggcagaacagttgttgaacccttgtgctgcagccataactggtggaaatctgaaccgtgtgcaacacctcttgtatgttctccatgagttagcatcaccaactggtgatgctaaccacaggcttgcagcacatggtctcaaagcactgacacaacacttatcttcttctccaacttctacctcttcagggtctataacttttgcgtctgctgagccacggttcttccaaaagacactactcaagttctatgaagttagcccttggttttcctttcctaacaacatagcaaatgcttccattcttcaagttcttggggaagacactgataattcacgcacccttcacatccttgacattggagtctctcatggcatgcaatggccaacgtttcttgaggcgttgagtcgcagagctggtggacctcctccattggttcgcctcaccgtggtcactgcttcttcctccactgaaaatgacaccccattttgtattggtcctcctggtgataacttctcttctagactccttggttttgctcagtcaatgaatgttaatttgcagataaacaagctagataattgcccattgcattcactgaatgctcaaagtgttgacgcctccccggatgaaatctttgttgtgtgtgcacagtttaggttgcatcagttaaatcacaatgccccagatgaaaggagtaagtttctgacagtgttgaggaacatggagcccaaaggggtgatactaagtgacaacaacctggggtgttgttgcaattgttgtggggatttcgccactggattctctcggagggtggagtacttgtggaggtttttggactcaacgagctctgcattcaaaggcagggagagcgaggagaggagagtgatggaaggtgaggctgcgaaggcattgacaaaccagcgcgagacgaatgaagggaaggagaaatggtgtgagagaatgaaagaagcagggtttgtggaggaagtatttggagaagatgcaatagatggaggtagagctttgctgaggaagtatgaaagtaactgggagatgaaagtggaagatgacaatagaagtgttggactatggtggaagggacaaagtgtttctttctgttctttgtggaagctggatgggaatgatcagagctcaacatga

SEQ ID NO: 15665 - DNA, 2140 bp, Glycine max
  Peptide Sequence Number=SeqID_132443
atggcggtttctacgatagccttgtacgcgagtccacccagcggcgtgtgttccacgtcgcaccagatcaactgccacgctggctacgacttcgaattggggtcgcgatcttcgtcgccggcggggtcgacggcgccgccgtcgacctcgcagaagccagtgatgggcgggctctcgtgcctgttttcgtcgccggcgcctccgcggaagcatgcgccgcagctctcgtcgaacttttccggcgaggaggacgagatgaaggagctgagcagttccttctcgtattctccgagcaaattcgctggttcttcgtggaagagggatcagagtcccgtgtcggtgtttcatggtcctgtttcgtgtagcagtagtggtagaagttccacgggttcgacccctattagaagtttcaggggtgggaccagtggtttgtttgatgggtttgtgaggaatgcgttggggtcttcatgtttggactatgacttagatgcgggtgattcttctgctatggttgatgagttgaccttcaatttggaggacaatttcgtggagggtgggtttcactttgagccatatgctaaaaagttgcttcttggggcgcaaatgaggcacaagatcttctgtgaggagtttgttatcaaggccttttgtgaagctgagaaagcacacagagggcagatgcgagcaagtggggatccttacttgcagcattgtttggagactgctgtgttgctggctttgattggtgccaattccactgttgtggcggcggggctcttgcatgactcgctggatgatgcttttctgacttatgattatatagttggggtgtttggcactggtgttgctgatttggttgaaggggtttctaaactgagtcacttaagcaagctggctcgagaaaataatacggctagcaagtcagttgaagcagaccgcttgcatactatgttccttggcatggcagatgcaagagctgtcctcgttaaattggcagatcggttgcataatatgatgacactagatgcattgccaggggccaagcaacagaggtttgcaaaggagactttggagatttttgcacctttggccaatcgcttgggaatttctacttggaaggaacaattagaaaatttgtgttttaagcatctcaacccaagccagcatgaggagctttcatccaagcttgtggaatcgtacgatgatgcaatgattacttctgcaatagagagattagagcaagcacttaaagatgaaggcatttcttataatgtcatttctgggcgacataagagcttgtatagcatttattgcaaaatgttaaagaagaaacttaccatagatgatatccatgacatttatgggctgcgcttgattgttgacaaggaagaagactgttacaaggccttgacagtagttcatcgattgtggtctgaggtgcctggaaagctgaaagattacatatgtcgtcccaagttcaatggatatcaatctctgcatactgtggtgatgggtgaaggcaaggttccccttgaagtacaaattcggaccaaagatatgcatttgcaagcagattttggatttgctgctcattggagatacaaggaagatgattgtcagcattcttcgtttgtgcttcagatggttgagtgggctcgatgggttgtcacctggcagtgtgaagcaatgagtagagattgttcatctgttggatatgctgattcagtcaagcccccatgcaagttcccttcacatgctgaggattgcccatattcttacaagcctgattgtggtcagaatggccctgtgtttgttatcatgattgagaatgataagatgtctgtccaagaattcagtgcaaactcaacagtattggatttgttgaaaagatctgggagagcaagctctaggttgacaacatataggttcccattgaaggaagagttgaggccaaggctgaatcataaacccgttagtgatcccaatagcaagttgaagatgggagatgtgattgaacttacaccagccatacctgacaagtctcttacagaatatagggaagaaatccagcgtatgtatgatcgcgggctaactgtgtcaagcatgggaaccgccgcaagcaccatggctggctcaagaa

SEQ ID NO: 15666 - DNA, 333 bp, Glycine max
  Peptide Sequence Number=SeqID_132444
atggcaatgaggcgggtcgagtatgggtattgtctccacaatcctttatttcgactcttcaacatattttcatacccgtacccgatacttgacgggtttgagtttattgtcccatccccgtacccgtcggattttaagtggcgggacgggttcgggttcgggatcgggacgggtctagtaatcccatacccgtactcgtacccaacttttggttatcggagaaaacccgaacccgaacccgaacccatacctgatcaactcggatattacccgtcaaagtcgggacggattcgggtggatacccacgagtacgggttttcttgccatgtctaa

SEQ ID NO: 15667 - DNA, 417 bp, Glycine max
  Peptide Sequence Number=SeqID_132445
atggaggagagagagccgctaaaattcccgacaaaatataacattcaaataggcatgaggtggctgattcagggtagccagtcaggggattcattgtttatatcatctgactgtttaggcaggcggttgggaccgaggcttcttgggagggctgatgattcaggggtaaataacagtatcgtctttgaaacgccgtatttctacatcgctgctaaggcgagaaacgatgtagaaagcgcatcttactacatcggtgctgacgtagacaccgatgtagaaagcgcaggttactacatcgggcctgacgttaccaccgatgtagaaaacacattttcaaacttgttgatgatgtcattcccgtgttcgaaagccacccttctacatcggtggtttagatggcaccgatgtagaaattag

SEQ ID NO: 15668 - DNA, 162 bp, Glycine max
  Peptide Sequence Number=SeqID_132446
atgaaggaagaagggttggtttggttctacgtagcctttacgtctcgcttggttgggaagcaagagataatgaaaaaggcatgcatgggtcttgtgcacggtgcacgcatcattcggcaaagagaatgcatttataaagaggataaagggtacaagaggtaa

SEQ ID NO: 15669 - DNA, 228 bp, Glycine max
  Peptide Sequence Number=SeqID_132447
atgtgggtgcaagacattggtttgtttgctcaactgacacgcgctcctgagtttggacttccaagaccattcaatcagaaattactcgtgctacacatttgtcacttctttcattcttccttgctacaaggttgtgaaaacaagacaacgattgatacctcaaagccctacactagggcaatgaggggcaccatgcataaacctcaagcaaacctaggggcagattag

SEQ ID NO: 15670 - DNA, 567 bp, Glycine max
  Peptide Sequence Number=SeqID_132448
atgaccggacgtcttcttgtcgggtcattggcttttgaaagccgcatccttcactatttaattgtgcgtattctgcttccacggtcttccaaccttgcccaggtttctgaggaagatctaattatcatgtgggcctttcataccgaccgtcaacttgactgggcacatcttgtaagatatcgcatgcatcaggcattgcgattaaatgcacctttgccgtatccacaacttgtcactctctttttctgccattttcaaattcctcttgattctgaaccttatgttccaatcaagagatcttttttaattggtgctgctgcgattgcttcttttggttaccgcaaagagcgtgatggctcttgggtcaaaaagggcactcaacccgctgatgaagaaggcaacctcccagatgaagataattccactcttcttcgaaggcttatggacaagtttgatggacttcagacttttgttggtgataagtttgatgccatggaattgcaagttgacatgtgtcataccctaatttcgtccggagattattacttgataacatacaataaatga

SEQ ID NO: 15671 - DNA, 792 bp, Glycine max
  Peptide Sequence Number=SeqID_132449
atggagattcatgcatcagggaacaatttcactttaaaagtaggtcccaattggcttcctaattttcagcttttccatttggatgtgagatcatggcagttaggtcccagctttccatcgtggattaagtcacaaaacaaacttgaatatttagacatgtctaacgcagggattattgattctattcccacacagatgtgggaagcacttcctcaggttttgtatttaaacctctctcataatcacatccatggtgagagtgggactacattaaagaatccaatatctatccccgttattgatctaagctcaaatcacttgtgtggtaaattaccctatctttcaagtgatgtgtctcagttagatctttcaagcaattcattctctgaatccatgaatgactttttatgcaatgatcaggacgagccaatgcaattacaatttctgaatcttgcatcaaataatttgtcaggagagatacctgattgctggatgaattggacatttcttgggaatgtaaatttacaaagcaaccattttgttgggaacttaccccaatccatgggttccttggcagagctgcagtctttacaaattcgtaacaacacattctcaggaatatttccatccagtttgaagaagaataaccaattgatatccttggaccttggggaaaataatctttcaggatgtattccaacatgggttggagaaaagctcttaaaagtgaaaatccttcgccttcgatcaacagttttgccggccacattccaaatgaaatatgtcagatga

SEQ ID NO: 15672 - DNA, 926 bp, Glycine max
  Peptide Sequence Number=SeqID_132450
tcgccgtacagcttctgccgcatttcgcgccgttcctgcgcttccagcgagagggtggcggtgggacgggccagcaggcgcgggatgccgatgggttcgccggtttcctcgcaccagccgtattcgccactgtcgatgcgggcgatggactgttgcaccttcttcagcagcttgcgctcgcggtcgcgggtgcgcagctccagggcgtgttcttcctcgatggtggcgcggtcggcgggatccggcacgaattgcgtttcacgcaggtgctcggtggtttcgccggcgttggccaggatgtcctgttcgagttgtttgagccgttccttgaagaacgccagctggcgttcgttcatgtagtcggactcgggcatggccagcaattccttctcgctgggcagatcaatcgccgtatcgctctactgccttcgtcgcaccgcgtcacgtatccaaaaaggggattaccccgccaggcactgctccaagccccgggtgaaaatctcctggggcagcttgcggccgatgaagaccatcttggtggacggcttttcggccgcggtccacggtttgccgggttcggcgcccatcatcatgtgcacaccctggaacaacatgcggcggttgatgcccttcatgtacaggatgcccttgtaacgcaacaggtccgggccatagacctgcaccacgccgcccaggaattcctcgaggcgggcaggatcgaacggcttgttggagcggaacacgaaggcgccgatctcgtcgtcgtgcttggggtggtgatgatgcgcgtgattgcagtgcgccccgcattcgccgtcgtgatcgtggtcatggtcgtgaccgtggtggtcgtggccgtgatcatgatcgtggccgtgcccgtgggcatggctgtgggcggcatcgggatgctcatcggccaggaa

SEQ ID NO: 15673 - DNA, 1218 bp, Glycine max
  Peptide Sequence Number=SeqID_132451
atggatgtcatttgccaagcgaaatctgggatgggaaagactgctgtttttgttctgtcaacacttcagcaagttgatcctgttcctggtcaagttgcagctcttgttctttgccacacaagagaactggcttatcagatttgccatgaatttgagaggttcagcacatatcttcctgatataaaggctgctgttttctatggtggtgtcaacatcaaggttcacaaagaattgctcaagaatgaatgcccacatattgttgttggaacacctgggaggattcttgctctggctagagataaggaccttggtttaaagaatgtgaggcattttatacttgatgagtgtgacaagatgctcgaatcacttggtctctttcttcctcctcctcctctctggaaatttgcttatatgagaagagatgtgcaagagatcttcaaattgactccccacgataagcaagtgatgatgttttcagctacactcagtaaagagatccgacctgtttgcaagaaatttatgcaagatcccatggaaatttatgtcgatgatgaggccaaattgactcttcatggtcttgtccagcactatatcaaattgcaagagacagaaaagaatcgtaaattgaatgatcttctcgatgctctggacttcaaccaagttgttatatttgtcaaaagtgtaagcagagctgctgagttgaacaagttgcttgtggagtgtaacttcccatctatctgcatacattctgcaatgtcacaggaagagagattgaaacgatacaagggcttcaaagaagggaagcaaaggattcttgtggcaacagatttagtaggaagggggattgacatagaacgtgttaatatagttattaactatgacatgcctgattctgctgatacttacttgcacagggtgggaagagctggtagatttggcacgaagggtcttgcaattacttttgtgtcttctactgctgactctgaggttcttaatcaggttagaccctacttccatggagattttaggaatatttcttttgtactgccattgggaaaatggagaaggaatcaaggcacgtattctccaacagtgccttttattaacaagtttctatacgctgatgtcagatgcacaaagttttgtctgatctggaagtatgatgtttttcaatgccaaactgatgacgttttggaactattaggaggcagatcttga

SEQ ID NO: 15674 - DNA, 1095 bp, Glycine max
  Peptide Sequence Number=SeqID_132452
aggggaggtggatatatggagtgttcggagactcatggaatggagaccttgcaattggtggctacaaggccgtcaaacagctctaccattagaaacttatggatatatcagagtggattgctatggggggctcaatcagatgcgaagagatatgtatatgatgtagattactttatacagcatatgaatggctttgtcaaagttgtcaaagagttaccaccagagattgcttcaaaagaaccagttcgagtggactgtagcaaacggaaaggccaatttgattatgttgaaagcgttcttccatctttgttgaaacacaagtacatttcaatcacaccagcaatgtctcaaagaagggacagataccctttgtatgcaaaagctgctctctgtcaagcttgttacaaggcattgcgtctcaccagatccttggaaatgaaagcctctcagcttctagatgcaatacctaaaccctttttgtctcttcatcttcgttttgagccagacatggttgcttacagccagtgcgagtatccagacctttctcctgcttccatgaaagccatagaagcagcacaagtggacagaaaaccatggactggagagttagcccgtgtttggagactacgtgggaaatgtccacttacgcctaatgagacagctttaatacttcaatctctttccatcccaccaaccacaaatatatacctggcagctggagatggtttgatggaaattgaaggtttgacagatacctacaccaacatagttaccaaatcaagtattctcagtagagaagacttcacaagcatgcatggcaatacaaaagctgctttggattattatgtatctattaacagtgattcatatatagccacatattttgggaacatggataagatggttgcagcaatgagagctttcaatggtttatacaagactctatttttgagcagaagaggttttgcacaattaacctcacagggtcttagaggaaagaagttgatgcaagccctatggaagcttcacagagatgattttgccaatggaagaggctctgctctgtccgagtgtttttgcgaattcaagttgtga

SEQ ID NO: 15675 - DNA, 339 bp, Glycine max
  Peptide Sequence Number=SeqID_132453
atggcttgtgcattgcaagcaaccttagcagccaacacctatgccttttcttccaggagattctccttgaagcaccaaaagaacagtaagagaaggttttctttgttcactgttagagctgattctgatgactctgactgcaatgaggaagagtgtgccccggataaggaagctgagaaaatgaggcaaaatatgataaaggtagggaaggtcagtgtggaatggttagctggggagaagacaaaagtagtgggcacattcccacctcgtcgtaagccgggttggactggctatgttgagaaggacactgctgggcagacaaacatatattcagttgag

SEQ ID NO: 15676 - DNA, 267 bp, Glycine max
  Peptide Sequence Number=SeqID_132454
atgcctggttgtcaaataaacacttatatacaactatcaatatcaaccatcaaaacttttccaaaggagcatggaaaggaagggaataagaaagaggctaattcccagagtcagacacagaagctagagaggatgccaacagaagacataaatgctagtgctgaggccttcatcaaaaacttcaggcaccatctgcttcttcagaggcttcaatccatagagaatcacaagcaaatgcttgcaaagggaaaagtagctgataagtga

SEQ ID NO: 15677 - DNA, 429 bp, Glycine max
  Peptide Sequence Number=SeqID_132455
atgaaggctgacatggaggccatgaaagagcaaatgtccacaatgatggaagccatgatgagtatgaaaagaatgatggaggtcaatgcggccacagttgttgcctcaagtaccaccacagaagtggacccaactcacccatttggcttcgatcaagtaaatcatcctgcctcagatatggtagggcagacaattcaaaacaagcattccttcccatcatatggcttgcctcctaactatatggcacctaatgttgcacacactcccaatgagaatgtcgacaactccgtacccatgcccattgagagccaacaacctcaatctgatcatgcacatgtctctcaactcatgggggagatgcatgaagcatctcgagaccacaatctagtcgactccgagctttgcctcgaacacgccactgaggggtag

SEQ ID NO: 15678 - DNA, 684 bp, Glycine max
  Peptide Sequence Number=SeqID_132456
atgaagttctggaatagttcttctaaatcctgtttgtgtcatagtaatgatagtatgatactcacaaaggtcccatttatttccagtgttccatgtagatttggaatttgtcatactccattagaagtgacatcttctcagttaattgcaagtgaggtcttccctctttttatcgtgaaggctcttctctaccctggagctctagcaaaggcaatttgcaagctgaaaaccatccaaagctacagaaatctgctaaacttgtaccagttcaatacaagggcagtctctgctgcatcagatctccaacgcctagaggttctggcaggaagctacttgtctgtgggaggagcaatcacaggtctgataaaaccagggagaatgagcctttttggaatactacttcttatgtggggtctgattagagagtccattatgggaaaatctggttttgctcatgcaaaaggtatccatatctatccagccatgtatattgcactaatctcagcattcttctccattagaaaggatgtccgaaagataatccgtactttcactcgaaagcatgttgtgaaggctaaacgttataaatcgaagacattgtcaagctcattcattgctgttcagaatagcggcttgacaaaattctttaggaagtgcacagtgcagcttattgtgcccttgtag

SEQ ID NO: 15679 - DNA, 231 bp, Glycine max
  Peptide Sequence Number=SeqID_132457
atggctgcagttcccaaagtggcatgtgcaacagttcagctcggattttacaacatgagtgtgaccacttggatggaactctatatgttgataagatggtacccaaaactttttgaaccggggacaacctggacctgcctcttgcccaggggtgccccaaacttggtcctcgctgacccctgttttcacactgtggctgtgtctgataaggcattcaatgcagatttctaa

SEQ ID NO: 15680 - DNA, 273 bp, Glycine max
  Peptide Sequence Number=SeqID_132458
atgggggtagccagaagactcgaaagcaaacaaacacgtcagaatccattgggattccagaagtttgtgttcttcattgcaacagagcatccttatgtgctcactgaaaaattgtattttagttttggtgcagacattaacaatgttgacttcaacgaaaatatgtcttccaagttttggtgcaatgtcaacatcctacatcgtgatgcgtcaacatcctacatcagtggaatggaaaagggtacaggagttgatggttgggactcactttag

SEQ ID NO: 15681 - DNA, 351 bp, Glycine max
  Peptide Sequence Number=SeqID_132459
atggctggtttgcaaagatctgaggtgtctttcaggagacagggttcatcagggcttgtttgggacgacaagttattatcaggggaattgaacaagaacgaagacccaaagggtgctcatggtggtgaccttaaccttaaccttaacgttagaacaacaccacccatccagagaagtcgctccaacggcggctaccgcaccggaaaagtctcgccggcgatcgagcctccctctcccaagctctctgcttgcggcttctgcagcgccttcggaaaaacaggggaaaagggtcgtcgcgcaaagccccgtgcaaagcatcgatcaaggaattttggtctctgtacaaagtaa

SEQ ID NO: 15682 - DNA, 529 bp, Glycine max
  Peptide Sequence Number=SeqID_132460
tccgacgactcagcagcagtgcggaatggagtttctcgtctggtggatctgatctttagggggcaatacataccaaaaggtgctttagtgatctttgatggtctgaacaaggaactctgtgtggggatccatcttgttgttattcgcattgttcaccttggtcggaaatcagggtggttgttctgcgctttctattttaagcaagcagcttcatccttgatgatggcctatggtggtgatgaattcgttcatcctgacaatgcggtaccagtttctctcactcggtccggttaccctcggatcattccgtctcatcataggcgtatgattctgaagaaggatgagaaagcggacatgctgggtacccaatggtcacatggctgcttgtggcctccccgtattcgttacgcctttgatggccctttctaccatcctgcgacgatatgggccgcaatcacaggcaaactaggttgcacgtgtgagggtgctggcaagcgtcgtatattcgcaataggaaactatgtgagag

SEQ ID NO: 15683 - DNA, 1974 bp, Glycine max
  Peptide Sequence Number=SeqID_132461
atgggtgcagcagaagatcttgtgaacagcacaccgggtgcagcagaaagtaaggcaaaccacaccccaggtccttcagaaaatccaataaaggacaacaccagtacttcagaaaatcctgtaaaggacaaagcactaggtgcagaaattcctgaagctggaggtgctgaaaatcctggaagtgaccaaaaaaatgttgaacaaaatcctgcaagtgagcaagtcagtattgcagaaaatatggtaaatgaccaagcaggtgtcacagataatactgcaaaggagcaggtagcaggtagtgcagaggatccgacaaagaaccaagcagcgggtggtgcagaagatcccccaaaggaccaagtggcaggtggtgcagaaaatcctttaaatgacctgatagatcttgcacaaaatcctgatagtgaacaagcaggtagtgaggaaaatctgttaaacaaccaagcaggtggtgtagaaaattctgcaaagaaccatgcagcagctggtgcaggagatcctccaaatgaccaagcagcagatggttcagagaattccgcaaaaaacatatcagcacgtagtgcaggagatcctccacatgaccaaacagcagatggtatagaaaattctttaagcaaccaatcagaagctacagagaaacttgtaaatgatgaacagggtcctgcagaaagttttgtagaagatgaagtacatgttattgaaacgcctgaaaagtgccaaaaatatggtgttgagacccctataagcagcaaagcagaacgcctcccagaagaagcaaaagagatactgaaatcattggcaagtaaatgggaggatgtatttgatgcaaatgcattgcaggtgatccctctcaaaggggcaatgaccaatgaggtattccagataaagtggccaactacgacaggggaattgtcacgaaaggttcttgttagaatgtatggtgagggtgtggacgtgttctttaatagagataatgagatccaaacatttgaattcatgtcaaagaatgggcaaggtcctcgtctactaggacgatttatgaatggccgtgttgaagagtttatccatgcacggacattatcagcatccgatctacgtgatccatctatttctgctcttatagcgaccaaaatgaaggaattccatgatctagatatgcctggtgaaaagaaagtccatctttgggatagattgcgaaattggtttagtgaagccaaacgcttatcgtcacctaaagaatttgaagctttttatttggacacaatcgacaaagaaatctctattttggaaaaggaactatcaggcccacaccaacgaataggattttgccacaatgatttacaatatggtaacataatgcttgatgaagagaccaattctgtgaccatcatagactatgaatatgctagttataatcctgtggcatttgatatagcaaaccacttctgtgagatggctgctaactatcacacagaagagcctcatatccttgactacaataaatatcctgattttgaggagcgtcaaagatttgtgcaggcatatttgagtacctctggtgagcagctgagtaacagtgaagtggagcagctacttcaagaaattgagaagtatacacttgcaaatcatctattctggggcgtttggggaataatttcggtgtctcctatcacagtgcttttggatgttggtataaacaaagcatttgttttcttttgggaagcacaagtgaacactatcgactttgactacaaggagtatgctaaacagaggtttcaagagtactgggcaaggaaaccttatcttttaataaactctgaagcaccttctccttataatgtgcctgagggtacaggagagctagcctcagcattgcccaccaaatcgaagaactctggtatctttaggaagatgaagagagttttgggtctcggtttgttcaagtctaagagctag

SEQ ID NO: 15684 - DNA, 351 bp, Glycine max
  Peptide Sequence Number=SeqID_132462
gatgctactgcgatcaaaaagaaggttgaggacataatgccaatcgctactggccacgagcgcgaggagcttcaggctgagctcgagggaaggaatattcttgaaatagaccatcccgaaggtccattcggcacaaaggaagcacctgctgttgtcaaatcttactatgataaaaggatagtcggatgcccaggaggtgaaggtgggggtgaacaacttgttttgattacagaggatgagcatgatgttgtctggttttggctggagaaagacaagccccatgaatgtccacttgaagtggtaggacctggtggaccacccgatggacatggtgatgatgatcaccattga

SEQ ID NO: 15685 - DNA, 789 bp, Glycine max
  Peptide Sequence Number=SeqID_132463
atgccatctgcaggtagtagaactgctagcagaagcttggagtttgggaagacacatgtggtgaggccaaaaggaaagcaccaagctactatagtttggctgcatggtcttggtgataatggtttgagctcttatcagctgctggaatctcttccacttccaaatataaaatggatttgcccaactgctccttctcgccctgtaaccatacttggtggtttttcttgcactgcatggtttgatatgggagagctttcagaagatggtccagttgattgggagagtttagatgcctcagcatcacatattgccaacttgttgtcaacagagccagctgatgtgaaagtaggaattggaggcttcagtatgggtgctgcagtagctcaatactctgcaacttgttttgccatgggaaggtatggaaatggcatcccttaccctgtcaacttacgagcagttgttggactcagtgggtggcttccaggatcaagccacatgctaatggttgacaacttctgtttgtgtaggagcttaaggaacaagattgaagtgtcacatgaagcaagaaggcgagctgctttgttacctgttttgctgagccatggaatcagtgatgacgtagttctctacaaatacggagagaaatcagctcaatccttaagttcagcagggtttcgatacattacattcaaatcctatgatgggcttggtcattatactgttcctagggagatggatgaggtctccaattggcttagctcaaggctggggctagggggatccacatga

SEQ ID NO: 15686 - DNA, 1542 bp, Glycine max
  Peptide Sequence Number=SeqID_132464
atggtgaaggacaaattaaagaaacatgttctaactgctttcactcctaatgaggattctgtggctattctgtctgccaacgaggtggccaagggaacaagcttattagctctcagcacaatcgatggaagtgttatagctgttgatgtttccactggtgagagaaagttgactaccagccatcctggggggatttgtggactctcatttgcaaacaaaggacgtcttcttcgcattgttggacataatggagtggcatacgaggttaatactgaaacaggagaggttttaaaggaatttaaaatctcaaaaaagtctattacttctctggctttctcaaatgatgaaaaatatttagctattgtcagctctagactgcggattataagctgggaaattgggaaagagattctgaagttccctaatgatttgggaaatgtacagctcatttctatatcgagtgatgccaaaaatttagttacatcagattttgagggtaaacatcttcaagtttggaagtgtgatttaaattcaggaaatgtgggtagaggtcctacacttcccataaggcatcctccattaattttagactgccacagtggttgcaataaagaagatgtagttgttttggcagttactggtagaggttctgcctatatatggaatttgaatgcttcctccgaagatcagatacagccaactaaattgaacacgaagaccaaaatagttgaaacggagaaggaaaatggtgtaagttcaaagaaaaggcatgcttcgattattgcatccagattacaacctgtagaggaagataaacagattaaagctcttgtgacttatggatctgtagatcatccacagtttagtgtcttaaatattagcaattcaggcgagaatatagtattatatgttggagatgagactgattctgttcagcagcatgacagtccttctggcaaagcaataccaatggaaagcaagaaagttaagaaaagacaagcaacatctgatcctgatccaccaacctcaactgacgaggaggatttagatcaacatgaggctgcagaaggagtccttcttgatgacgatttgaatgagccaacaatgggagagaaacttgctagtctaagtttactggatgagaacaaatcaaggagtgaaatagagcaagaatcttctgtcccagcaaagcctccaagtgcagactctgtacatgttttgcttaagcaagcattaaatgctgatgatcgcacccttctgctagattgcttgtatacacaagatgagaagctgattgagtctagagtctccacttttaaatctgccatccaactctcaagttgtttagacacgcttcacataggggctattgacgaggaggaagatgaaggtgaaatggtgccagttatctatgaggataaggatagtagtgatgaagaatctgatgataccatggaaactgacccagatgaacaacaaccagaagaacaatttcatgctgccagatacattgatgcaagtgatgatgatatgtcagattga

SEQ ID NO: 15687 - DNA, 411 bp, Glycine max
  Peptide Sequence Number=SeqID_132465
atggcatcccatgagcagagctacagagctggtgaggccaagggccgaaatcaggagaagaccaaccagatgatgggcaatatggggcagaaggcccaagctgcgaaggacaaggcccagcaggcagcccatgctgcaaaggacaagacccagcaggcggcccactctgtaaacgagaaggcccaagagaagagtggtcaaactaaagaaaaggcctcagagatgggccagttcacaaaggaagcggcccagtctggaaagcagaacactggtgggttcctgcagcagactggagaaaaggtgaaggaaatggcccagggtgctactgaggctgtgaaacaaacctttggtatggcaccacagaatgatgaagacaaagactactacccaacccagcatggcagagaatag

SEQ ID NO: 15688 - DNA, 177 bp, Glycine max
  Peptide Sequence Number=SeqID_132466
atggaggccagatcttgcttgcttggctcattcattcattcttaccattcaatagagattgagataaagctgagccatggcctcaacagttccaattttttgttccagttttttcttgtccctcataaaattcttgactgcaaaattaatatgagacatacacaagatatatactaa

SEQ ID NO: 15689 - DNA, 675 bp, Glycine max
  Peptide Sequence Number=SeqID_132467
ttaatatcatcacctggcgtcgaaagccagcggaacgagctccgacagcggcgtggcggccggcgtcggcagcggcgagggcacaggggagttccggcagaggggacacgtggcactcatcttgagccactcatcgatgcactcagcgtggaagcagtggcggcactccggaacgcaccgtatggtctccttgggaagatactcgctcaggcaaatcgcgcacgggccctggtcgctgggcctggacaggcgtttgctctctccgatcacgatcttgggcccgtagcaggtctcgatggcgggcttctccatgcccaggaccacaacgccaggcccatccgaggcgtcacgaaaactactattgttattattattattattgttgttgatgctgtggttgtgacggtggcgagtgatgatgatgacgttggctttgattcggacgcaggcgtaggaggcgagcatgatggtggagatgaggaccaggatgctcacggcgatggcaatgccgtagccgagtccctcggtggcggtgacggcggagggtggaggagccggcgtgaacatgaaaaagaaaaagagagggtttggttggttaggaatttggagttggattgcgtgatcagaaccgcattccgcgggaaaaaattaaatgcatgtcttaagagactctga

SEQ ID NO: 15690 - DNA, 499 bp, Glycine max
  Peptide Sequence Number=SeqID_132468
atgggtgaagtagaagaggtgcaaaagcagatgaaggccgacatggaggccatgaaagagcaaatggccacaatgatgaaggccatgatgagcatgaagaagataatgaaagccaatgcggttgcagttaccgctaccagtgctgttgctaaggtgaacccgaagcccccatctggccttaaccaaatgaatcatccaacctcagatatggtaggcgaagatttgggaagtatggacgacccttattatgtgcaaattcaaaacaagcacgccttcccgccatatggcttgcctcccaactatacaccacccaatgtggcgtacacttccagtgagaatgtcaataactccactcccatactcattgagagccgacaaccccaaactgatcatgcacatgtctctcaaaccatgagggagacacatgaaattccccaccacaatctagccgacttcgagccttgcctcggatatgccactgaagggcaagcagtcggtg

SEQ ID NO: 15691 - DNA, 1161 bp, Glycine max
  Peptide Sequence Number=SeqID_132469
atgccgtgccctcaccagtgggaagcagccaactgggacacttcccgcttcacatctgagatagcttggcaccggtaccaagacaacattcagctccggaacatccttccggaaaggaatgttgaactgggacccaggatgtttgacgagttcctccaggaactcaggaggcgcagatgggaccaggtgctgactcaccttccggagaagcggatcgacgtggctctggtgaaagagttctattcgaacctttatgatccagaggaccacagtcccagattctgcagggtgcgaggacaggtcgttcgttttgatgctgacaccattaacgacttcctcgacaccccggttatcttggaggacggggaggagtatccagcatacactagatacctcagcactcaccccgatcctgacaccatcgcggccacactgtgcactccaggggggcgctttgtccttaatgctgatggtctcccctggaagctgctgaggaaggacatgatgacacttgctcagacatggagtgtcctttcttattacgatcttgcgcccacttctcacacatctgatgttaatcttgacagggcccgcttgatctacggtttggtgagccgcatggacatggatgtgggcagctttatatcacagcagatcagccagattgtccagtccagtacctcgaggctcgggttcccagcgttgattacagcgctgtgtgacattcagggggtggtttctgataccctgatctttgagtcactcagccctgcgatcaacctagcctatgtgaagaagaactgctggaaccccgccgacccatcgatcactttccctaggcctcgccgcacacgtaccagagcttcagcatcagctcccgaggcccctcttcctacccagtctccgtctcagccatcccagcgaccgcgacatccacctgcttccacctcagcatccatggacatgcatgggcagatgctgagatcccttcacgttggacagcagctcatcatggagaatatgcataggctgtccctacacctgcagatggatcccccgctcaccactccagaggcctatcgtcagcgagtcgcctggccaggagaccagccctccactgacaggggggaagagccttctggagccgctgaggatcctgca

SEQ ID NO: 15692 - DNA, 258 bp, Glycine max
  Peptide Sequence Number=SeqID_132470
atgatctacacaaatggggttggatgcatcatctggcacgacattctgttgcatttttctaactcgaggcgatctgtggtgtctcatgattctgcgagtaaagagtgcccaaggaaaatgggcgaggcatatgcattgaataaagaattgaatggtttggttagtgaagatgatctgaaaaacttgaggaggaaattagatgagagtgaaggacaagactctggagctaaaacatataagcaacagctgattggctga

SEQ ID NO: 15693 - DNA, 1959 bp, Glycine max
  Peptide Sequence Number=SeqID_132471
atggggaagggagggcaatgcttcttcgagaagcttcggaggtgcgttaggacggttttcttcgtggtggcattggtggcgtcgctggcggtgacgtcgcttccggtggtcgtcgcggtggtggacgtgttggtgccgtgcgttttgatcccgaacttcacttgcgtcaagtgttacagcatcaaggagcattttcaccgctacgctttcaagagttccttcacggatattcctctcgtttccgtcataagatcccttatcattctctgtgtttattccgtttgtgatggtcctgctctctcacatggtccttaccttggaactgtgactctgtgctcctttctgtcaattgttctcctttcggtcaaagcatgtgttttcactgtaaattcccatatggaagcggaggcttcggtttccctcaggaagcatagactccatttgaagaagccatggggaatgcctgtcttgtttctttcatcagttgtgtttgcccttggccatagtgtggttgcttacagaaccagctgcagagcacgcagaaagttcttgtttcatcgagttgaccctgaagctgtcctatcttgcaaaaatgttttctctggctatccaaaggtcccacgctctccaactccttctgctgggagaacccccaaaagtgactgtgagatgaggcggaggccttttgggacagctcgtgatgaagaactccttgttagattacttgcaaactctgacagcttattcattacatgccagggacttacacttcattacaagctcaacttgcctggttcaccgccacatacattgtcttcaatgtcctgtattgactccaaatctagttgcagcacttcatcaatggctgcaggattggcaaaatctaacaaacatttgccaagtacatctccaaatatccagccacagctatacagaagctatagcaatcaatttcatggctcgtctctacacattcctctattggatggtcctataaattctattatttctgaagatatccctgtttttcacttagatggtgtttgtgaagatgaaactagtaaattgaattttcaatctctggagcaagatttagagaatattgaccaattaggtattgttttagtacatgggtttggtggaggagtcttctcttggaggcatgtgatgggatgtctagctcggcagagtagttgtacagttgctgcatttgataggcctggttggggattaagctcaaggcctcgccgggaggactgggaggaaaaagagttgcctaatccttataagcttgaaagtcaggttgacctgcttttatcattctgttctgagattggattttcttcagtagtgctaattggtcatgatgatggagggttgcttgccctgatggctgcacaaagaattcaaacatcaatgaattatttcaatgttaatgtgaaggggattgtattgctaaatgttagcttgtcgagggaagtggttccatcctttgcaagaatccttctacatacctcacttggaaagaagcatttggttcgccctctactaagaacagaaatcacccaagtggtgaatcggcgggcttggtatgattctaccaaaatgacagcagaagttttgactctctataaggctccactatctgttgaaggatgggatgaggcacttcatgagattggtaaattgtcttctgaaaccatcctttcggctaaaaatgctgaatcattgttacaagcagtaggagacattccagtgttagtcattgcaggtgctgaagattcccttgtctctttgaaatcttgtcaagctatggccttaaaacttgtcaattctagattggttgccatatctggatgtggccatttaccccatgaagagtgtccgaaggcattgcttgcagctatgtcacccttcatcagtagactcctgtctgcatctgactcgcaaagacaataa

SEQ ID NO: 15694 - DNA, 285 bp, Glycine max
  Peptide Sequence Number=SeqID_132472
atgaaggataatatacaaatgaggattcttcaaggggcagaagtcgtcgccgccacgtttccatggagaagttgttgtcatcatcgtgcgaaacatgtttggcttgcgcacgctagccaccgttctttctgttcctctaccaaaaccctaatcgaggtcacagtcggagcatacacaaacagaagccatccatggacggtgattcctctaggagttccaggcgctaccaatctactcttcgatctcgaccagaatgatgttagtgttttggattcgcggtcataa

SEQ ID NO: 15695 - DNA, 225 bp, Glycine max
  Peptide Sequence Number=SeqID_132473
atgatagtgttccagaatgggtttctagattgcaccaatcctcctatgggcatgattcctgaaagtcacaaggcaatctcaaaaggccccatgctttgtgttgatattgatgaggcagtatatcctagcagagctgttcagtcctcaccatctaagggaactgagtatgaggaaattccgggtgctccaagactttctttctctttcagggtgtgccatgcttga

SEQ ID NO: 15696 - DNA, 1533 bp, Glycine max
  Peptide Sequence Number=SeqID_132474
atggctcaactcaatcaaaacagcaagtttgatccattttctaagattcctgaacttccaggcatgaattactattcttccaaaggttttgttcttttcgaatctaaaaaatcatcttacaacaaactattggaagcattaaaggaagaaagtgtttgcatggttggactagttagaataggaggcttgggaaaaactgctttggcgaaagaggtgggtaaggaagctgaaaagttaaaattgtttgagaagattgtcattgcaacagtctctgaaactccaaatatcagaagcatccaagcacaaatttctgatcaattgggtttgaagttagaagaggaatcagacataggtaaagcacgaagactatcagagagattaagtgaaggcacaacttttctaatcttggatgatgtgggggaaaacctagactttgaatctttaggtattccaatcaatgaaaacaagaagggttgtggagtacttcagatcacttggaagagagaagtgtgcacttctatgcaatgccaatgtactgttgagctcaatctcttaactggtgaagaagcttggactttgttcaaattgtatgcaaaaataactgatgattccacttatgctttgaaaggtgtggcaacaaaaattgtggatgaatgtaaaggattgcctattgcaattgtgacagtgggaagcacgttaagggaaaaaactttaaaagactggaagttagctttgtcaagactacaagattccaaaccactggttattccaaaaggcctaagaagtcctaacgcctttcttcaattaagttatgataatttgaaagatgaattagccaagtcctttttcttgttgtgttccatatttccagaggattatgaaattgatttggaagatttatttcgatttggaaggggactaagaataactgggacttttgaaacaatagaggaagctagggaggagatgcttctggctgttggcatccttatggattcttgtttgttgctacatgcagggaatgaaaaggtgaaaatgcatgacatggttcgtgatgtagctttgtggatagcatctgaaaggggccaagcaattttggcaagcactgcaaaggatctgagagcggtgataaaagatgaaaccataaaagataagagagcaatctccttatgggatttgaaaaatggtcaactttctaatggtaatcatatgaattgtccaacactcaaaattctcttgcttcattcttcaataattggatttgaagtatcaaatgagtttcgtttctgggggccaaaaagatgcacttcatcactgccacaatcaactgagtcattaaaaaatctccacaatttgtgctcaaggagttgtaaattaggcgatatctccattttggaaaacctacaagcacttgagattcttgacttacgatgctcttgttttgatgaattgcctaatggaattgtagaattaaagaaattgaaggttctggatttgtacaactgtaggattaaggaaaataatgcttacgag

SEQ ID NO: 15697 - DNA, 1341 bp, Glycine max
  Peptide Sequence Number=SeqID_132475
atgcccaacacagtgcctactacagcaaccagttcctcctctactagtctgtttgagcttctcaccgaaatgaagaagcaatcctgtccagaatcactcatcttacaagcaaaatctccctcccaattctcctccgaatgctggttcgacgatgcatgcatcttggacatggattacttcgtcaagaccctttctggcatcaaggctaaaggcgttcgtgcagaccttattggcttcatcatcacacactacgcctccaaatggctccctgacctctccgcaggtgacatggccgaaaagggtctcacccaattcgaggaatcgcccgaaagcgtaacagcttcatggatgaagaagagattcttcgtggaaaccttggtgggtgttctgcctcctgagaaggatgcaattccatgcaacttcctccttcggcttctgagaacggccaacatggttggggttgagggtacctacaggcaagagcttgagaagcgtatttcgtggcagttggaccaggcttccttgaaggagttggtgattccatctttcagccacacttgtgggactctattggatgttgagctggtcattaggctggttaagaggtttgtgagtttggatagtgagggagctaagagcgttgcttctttggttaaggtggctaagttggttgattcctacctggctgaggctgctgtggatgccaatttgagcttcaacgacttcgttacacttgctgcagctcttccaagccatgcaagagcaacggatgatggcttgtacagagccattgatacttatctaaaagcacatccaggagtgtcaaagcaagaaaggaagggcctgtgcaggctaatagacagcagaaaactaacagcagaggcctcacttcacgcagcacaaaacgaacggttcccagtgagagcagtgattcaggtgctactctctgagcagagcaagctgaaccggcatgtggattggagtggctcgttggtgagtgtaacaagaagccctggagggttggacttaccaacacggtgtctgtcgaagcgcgaggtgaatgctcaacaactcgagattagaaggctgaaggaagatgtgtacaggctgcaaagccattgcaatgccatgcaggcacagatggagagaatggtggtggaaaagaagaaaggcttcttcaagtggaagaagtttgcatttggcaagagtgagcatgacaaaatggaacaagagcttcaaggaaatggaatgtacacgcctgcggaccttaaaactagattggtcaatgctaaaggtactagtaagaataatactcacaagtggaggaaatccatgtcatga

SEQ ID NO: 15698 - DNA, 644 bp, Glycine max
  Peptide Sequence Number=SeqID_132476
atgaagtttccgttttcagccattgttgctctttggtttgtttgtgaccttgttctggcaaattcacgctaccctgagggaatgtatagttttgataggagctctcatgtaacctataagtatgatcgaatgagtgaagttcagaaacaatgtgcctctgtgttatctgcttcatctgaattgagatatcaatatagtgttactggtatgaaaggagagctttcttttgcgaatggggattggaggcaggatgggggtaagtttcccataatgccatttgatgccaacaaatctcctgggaccttgtctggagaccgtgctccgttgaacttggtttctttttgggtatcggatgttgatcatgaccaccggttgaagaagttgattcctatcaatggtttcatggtgataggaattactcgagacggtaattttgtggacaatgcatatgatgtgaatgctgaatttcagttatggcccagccattctcagctctcaattcccttccaagggatttacactgaatccaagaaaaatggtggggaaagggtgttgtgtttgttagggaacactatgcttccaactcgagaggctgaccctgccaacccgtgggaatggatgaagaaccccagtgatataccgtt

SEQ ID NO: 15699 - DNA, 519 bp, Glycine max
  Peptide Sequence Number=SeqID_132477
cgctgcaattccgcaaattccgttattgcggtttgtaagctgtctggggatttgtttcccgaacgtgaggcttcggctatgcatgtttcggtgagtgtggggcttatgaatttcgtggggtgttggttcggagccatgccttgtacttctggtggtttggcgggacaatacaggttcggaggtaggagtggtgcttcggtggtgttcctcgggattgcaaagttgtttccaattgagattcttggggtgcttttgttgtttgctgggattgagttggctatggctgccaaggatatgcttgtttgtgaggctgtttctctcactggatcaagtggtgcgttaggcttctttgttggcattgtgcttggggtgatgcgtgcaccaggctttttgccaaactacgatgcaatggattgttggcgtgccgttggattgggaaacatccgaacgtggttgaagatacttaggacttcacagtctataattcagtgctttggaatttggatgtactctctttaa

SEQ ID NO: 15700 - DNA, 2559 bp, Glycine max
  Peptide Sequence Number=SeqID_132478
atgcacctctccgaccccaaatccaaaaccctaaccctaatccccaattcaaccctaatcatactggaccgaacccttcttctctccgacgagcttctcctccgaatcctctccaagctccccgattcttcgcagcagcgaaactccaattccttagtctgcaaacgctggctgaacctccagggtcgcctcgtccgaaccttacgcgtcctcgattggagcttcgtcctctcgggtcggttaattaaccgtttcccgaacctcaaccacgtggaccttgttccaggctcgtttacttcttcttctgtcaacacgacaactaccattgtggtgagccacaggctcctttcgatgcacgtggattccgcgtggcgaatcggcgtagaaaaaaacctgttaccggttgaaacagttgacgccgggctcaaatcccttgctagtggatgccctaatttacgcaagctcgaggtggcaggttgcagcgaggttgggatttcaacgattggcgccgagtgtgctaccttgcaggagctggagctgcagaggtgtgacgacgccgttttgggaggtgttgcagggtgtgagaatttgcagattttgaagatagttgggtgtgtgaaggggttttatgagtccgtggtttcggacattgggctaacgattttggcgcaggggtgtaagagattggtgagattggagcttgttggttgcgaggggagttttgacggtgtgaaggcgatcgggcagtgctgtgtgatgctggaggagttggtcattgtggaccacagaatggacgatgggtggctcgccggggtttcgtattgcgagaatttgaagactctgagggttcaatcgtgcaaggtgatcgacgggagccccgggttggaggagcatttggggtgctgtgaggcgctcgagagagtgcatttgcacaagtgccaggtgagggataggaacgccgtgggggcgttgttttcggtgtgtaggaatgccagggagattgttcttcaggactgttgggggctggatgatgccaccctgagtttggcagttgtttgcagaaaccataacaaccccaacagcaacagtgcagtcgataacagacccacattcaccgcgaacacggtgacgaggcacgttttctttaaggagaagaagtacgaggagaacgagagggaagttgttggcagcagcaactgcaacagacaaatgatgcttttgtgtgggtttggctattgggtgcaaggcttcaggtgttttccgtggctggcgctgaactttcacatggctagcaacctcaacttgcacccgtcgacattgcagctcgtgcagaacttggctaacctaccaatggtggctaagccactctatggaatactctcggatgctatctatattaagggtgctcacagaataccttatgttgtcataggagtcttttcttggagtcttctggcgttggtccctgttgcacacaaagtgcttcccaacataattgtgtttgtgcttctcagcaatatgggagcatcaattacagaagtagcacaagatgctcttgtagcagagtatggcaagaagcacaaaattggtagcctacagtcatatgcattcatggcattagctgcaggtggaatcttaggcaacttgattggtggttatctcttactgaaattgcctcccagagccatgtttttcatattttcatccttactgtctcttcaactagcaatttctttctcaacaagggaggagtctttaggcatagcacaactttcaggtcaaaatcttgctaagagatccatctcagaaaatatcaaaaaacaagtctctaatcttgtcatggctatcagtgacaagagcatttctaagccccttatatggattgttggatcaattgccatggtgccaatgctttcaggctctatattttgctatcagacacagtgtctaaatcttgatcctacagtaattggctgttctcgagtgattggccagtttgtgcttctttcaggaaccatgctttataaccgttattggaaaaaaattccactgagaaagctgataggcatggtgcagattctatatgcttcatctctactccttgatttcattttggttaaacaaataaatctcaaatggggaattcccaatgaggtgtttgctctttgctgttctggtttagcagaagtcgtggcacagtttaagctccttcctttctcagttttatttgcaaatttatgtccaaagggctgtgaaggatctctaacagcattccttgcatcagctttgtgtctatcatcaatagctagtgcctttctgggtgttggatttgcctcttgccttggcattacatccagtgattactcgggcttgacgtggggaattcttgtgcagttcattgcggctttaataccattaagatggatccattctttaccaatgtcacaatcggttgagaagcaaaggaaaagaagtatgagcagaagagcacgcagaaacagaagagttggaaaagttgtgtttggttatgttgatgtctacaggcctgagagagaatga

SEQ ID NO: 15701 - DNA, 234 bp, Glycine max
  Peptide Sequence Number=SeqID_132479
atggataagttatcaaaggcggcaatgatgatggcagcaaaggaaacaatggtgatagcggcggtggtgacagcaccacctgattataagcgtcataaaatcctagttctacatatttggaacagtggtcttgttccttcccttgtgcctgagctacctatcttaactggcaagatccctactagtgatcagtcagtcctatatatcggtcactcaatcatacttgatccataa

SEQ ID NO: 15702 - DNA, 2109 bp, Glycine max
  Peptide Sequence Number=SeqID_132480
atggcacagatgatttctgcagatgttatctgtgagcgagcaactagtaagagtaatactggttctgctagggtatcaacggtttttagagcagtttctccatcagagaatcagtatactgcagcaaaaaggtctgggcccagcaacacgtctcttgccgccgaagggatttggaagccttctagtgggcagctttgcatggttggttgccttggacttgttgatgctggaggtagtagctgtaatactcggatctgtatgtatattcctaccactttttccttgaagcaacatagtattattttgggaactttgtctcccattaataacagtagtgccttctttcccctatcatttgagcaacttgtgctaccttacgaactctggaattatttcaagctcactaacccaaattacagttactctaaaattaatttggctggtactgtcctagaaaaaaatgagcccttcagttttacaactgtcattaagaaatcattgctaacatttcccaaacttgaagataatgaggcataccaagatagcctgtctgttctttcagaagatctcacttttcatgtctctggttttcctgaccctgtgcctaatgtcctggccccaaaagtcgatattcaaatggaaattctctccattggtcccttgtttgggcgctatttgtatactaaaaatagttcggaatctgaacaggaaacaccagatcttgccaaggctgctgaatatacagaaaaacagcttcttataaatgtatctgcacagctcagtcttactggaaaaggttatagtaatttttctgtgctttttctggagggtctttatgatccacatgtgggaaagttgtatctaattggttgcagagatgtgcgagcaccatggaaggtcttatatcagagctatgaccttgaggctggaatggactgtttgattcaggtggttgtggcttatcctcctaccacaactcggtggctagtcgatcccagagctacaatttcgatagaaagtcaaaggactgatgacgatgcccttcgattcgatccaataaagctcaaaacatttccaatcatatacaggaaacaacgtgaggatgttctctcacgcagaggtgttgaagggattctccgaatcttgacgctttcatttgccatcgggtgcattttaagccaactgttttatatacaacagaatgtggattctctttcctatatatctcttgtggtgctaggtgttcaagctcttgggtatagcattcctctggtcacaggtgcagaagctctttttaagaaaatggtttctgaatcttatgatgtgtcatctagtgaattggagagcagtgagtggctccatgtcattgattacactgtgaaactgctactgattgtatcattgctagtaactctgcgactttttcaaaaggtatggaagtctcgcatcagattgcaaatgcgtacccctcttgagccacatcgtgtccccagtgataaattgatatttctttgtaccgtcaccatacatgtgatagggtatgtaattgttctaatgattcatggcacaaagaccagccagaaggctcttatagcaaagacttatttggttgatggaagaaattctcattcattgccgggttgggcaacagacctggaagaatatgtaggtcttgttgaagactttttcttgcttcctcaaattattgggaacttagtctggcatatcgattgcaaacctctcagaaaactatattttattggaatcactctggtcagacttcttcctcacatatatgactacattcgagctccagttccaaatccttacttttctgaggactctgaatttgtcaatcctaatttggatttttactcaaaatttggggatattgccattcctgtgactgctattattcttgcaattgtggtctatattcaacaaagatggggctatgagaagctgagtcagtttctgacatttgggcagtataagcttctcccaactttcagataccaaaggttgtcttctagggctggtgaatccgaactagttcctggtatcaatggtgctgctgtaaaagagaatgagcaagttgatgtagaatga

SEQ ID NO: 15703 - DNA, 252 bp, Glycine max
  Peptide Sequence Number=SeqID_132481
atgtcagtgcaagagttcataagaagtcatttggaggccaccatcgccaggcttttgtgccttgtggagtggttgaattgccctcttgacggtgtagagtggttgtatagccagattgaaagtctagagggagtgcttgagaagaagaaccgtcttttagaggccacagccgtattaaaagttgctcacactttttattatgatcttgggttggggtggtgggggacctttgttctcgttgcaagaatttag

SEQ ID NO: 15704 - DNA, 669 bp, Glycine max
  Peptide Sequence Number=SeqID_132482
atggacaaaactgcctccactctatccggccgccacaacctcacggagttgccgccatcaccgcgacttgtccgtagccgaagcggtagcagccccgccgccgctataaccaccccagagagaagttcacataggttaagctctagtcaaagattcaccatcaccagtatccaacgttcaaagtcaacatcaagaacaagaacaaccaacaatgaaagaaacaatattaacctaaatcccactttaacaacatcggtttcgagtaagccaaagaacaatagggttcaagagaagaagagtagagatgatggctttggcaagttcttgcaacgtggtgttagccctgataatattaatgttggagcttcaaagaggtccacatcaaagtcgccttcggcgtgggcgctttcgccgggaaggtggtcacttggctctccaatatggtctcaacccccggcgaaaacaaatggtagtgataacggtaataatgatagtagtgttggtggtggtgttactaaagtcttgaagtacttcaagcaaagaaaagtatcgtcagtgcaagaagaagagtaccatcggtttaggattttgcataatacacttttgcaatggagatttatcaatgctagagctgaggttgccatggctaatgtcaagaatatagccgag

SEQ ID NO: 15705 - DNA, 774 bp, Glycine max
  Peptide Sequence Number=SeqID_132483
atgtccaattccaatcctaacaaccgtaaccgacacgctccgtcgccgccggagcccaagcccatgccgccttcttcttgggccaagaaaaccggcttcaggcccaaactctccggcgagaccaatgtcaccgattccggcccgataaccaccccgcctcccaacgtagatctcgaggccggtcgtgttcggactccggccaccgctaacggcgtcaccaacggcgacaaggctcccgttccggttcctccgccgcctgcggcggcaaagaagcggagagactccgacggcgtgccgaagagttctgttctcagcaccaacggacaggcgccggcggcggagccgccgccgcggaggacggcgaggcacgaggaagtggtagacggtttgccggcggatgacgacgagtttgtgtcgcggcactcgcatatgaagtatgaactcagagattcacctggtttagttcctattggcgtgtacggaattcagcactacttttccatattaggttcgttggttctgattccgcttgtgattgttcctacaatgggaggcactcattgttttaatcttggtggcgaagttgttgatgtgttagtgagtgtaggaggaaacttctatggtggtatcgaccgtgctctttgtctcgggggtgacaactctcttgcatattgcttttggctccaggttgcccttgattcagggcccttcttttgtttatctcgcaccggcgctcgcgataatcaactccccggagtttcaaggattgaatga

SEQ ID NO: 15706 - DNA, 324 bp, Glycine max
  Peptide Sequence Number=SeqID_132484
atgaaatctgaatgggcactgttgagtttgcgtagactcgggcgagttaacgtagactcgcaagtttggccaagtttgcaggcaaggtatgcatgcgtggtggtcgtggcaacagtgcaaagcggaagtgcaagtggccgaatgcgtgtttctttcgcgaccgtgcgagtgtgtggtggtcgtgtcgatggtgaagtgcgtggccgtgacgatgttgaagggagtcagagtcactatacttttctcttctctgttctgttttcacttttcatcctccgtgacatgttttcttctttttcctctttcttttctcttaaaaattag

SEQ ID NO: 15707 - DNA, 309 bp, Glycine max
  Peptide Sequence Number=SeqID_132485
atgttgagaaagataacaatacagaaaagaatcgaattgcgaaaggtcaaacaactggtcaagctttatcaaattttggatggacaactctatcttcttactgaatgggcacaattagagagaagaaatcaagaatccgtagccagattgacaaggaagttgtcagcattatccaccatactgcctttaactcacactgttaaggtaattaaggtagacacggaatccgtctttgaagccctaaatacagccgctaaagtaatggagagcatcgaaccattaatggcgaaataccaaacaaagctttga

SEQ ID NO: 15708 - DNA, 249 bp, Glycine max
  Peptide Sequence Number=SeqID_132486
atgatgataacttcttctaccacaacttcaccttcttcacggaagcctcacaacctcttcctcacgagtcacgctgccatagaacatcctccccgacctccttcctttgcacggaagaacaagaggtgcgacattgtgaggagggtgtcaggggaaggaagtggcacgagacatggaggagctgttgttagaggcggaagatccatcgcaggagcttccatcatagtgggagttgtcgtggcggattga

SEQ ID NO: 15709 - DNA, 621 bp, Glycine max
  Peptide Sequence Number=SeqID_132487
tatcttcgtaagatatctgttcttggacatcgcatatttctaatatatgcggttcctctgggtctggcaattacatgggcatttgctttcatgctgactgaagcaggagtttacagctacaaagggtgtgatgcaaatataccttcctcaaatatggtttcagagcactgcagaaagcatttctcaaggatgaggcactgtcgggttgatacttctcaagcattgaaatcctcttcatggtttaggtttccttatccactacaatggggtactcctgtcttccactggaaaatggctattgtgatgtgtgtggtttccttaatctcatctgtggattcggttggctcataccatgcatcttcattactggtagcatccagaccgccaactcccggagttcttagtcgaggaattggtttggaaggtcttgctagtgtcttggctggtctctggggaactggaactggatctacaactttaactgaaaatgttcacacaattgctgtgactaaaatgggaagccgcagggcagttcaactgggtgcatgctttctgatagtgttgtctcttatagtgactctgaaatttcattttgctggtctgcagtactttggacaatag

SEQ ID NO: 15710 - DNA, 1140 bp, Glycine max
  Peptide Sequence Number=SeqID_132488
atgccttctctctccgaagcctttagaggtcaccccgtgtaccttcatcacaaacactccgacttcaactcacttcaagaactccctgactcttactcttggacacaaccccatgatcaccatctcccaaattacccttccaacaataagaccaagatctttgtccccgtaatcgatttgaaccacccaaatgctccaaacctcataggccatgcatgcaaaacatggggtgtgttccaagtggtgaaccatgacatccccatgagcctcttcagtgacattcagagggctagtcttgcgttattctcccttcccttcaccagaagctcaaagcagctcgctcccccgacggcgtctccggctatggccgcgctcgcatctcctccttcttccccaagctcatgtggtctgagtgcttcacaattctcgattcccctcttgatcttttcctcaaactctggccacaagactatgctaaatactggtactgatattgtcgtggaatatgaagcagccatgaaaaagctagcagcgaaattaatgtgcctcatgttggcttcccttggaattacaaaggaagacactaaatgggctgggccaaaaggagaattcaatggggcttgtgcggccttgcacttgaattcttacccgagttgcccggatccggatcgagccatgggtctggccgcacacaccgactccactctcctcacaatcctacaccaaaacaatgtcaatgggcttcaagttctcaaggaaggagaagggtgggtggcagtgccgccgcttcacggagggctcgtgattaacgttggcgatctgctccacattttgtcaaacgggttgtacccgagtgtgctccatcgggttcgggtgaaccgaacccaacagcggttctcggttgcttatctatatgggcccccagcaaacgtccaaatcagtccacatgtcaagttggtgggcccaacaaggcccgctctttatcgaccagtgacttggaacgagtaccttggcaccaaagcaaacctttttaataaggctctttcagcggttaggctttctgcgtctattaacggtttgtttgatataaacgaggatcagaataacgactttcaagtgggcttcaatctagatatttag

SEQ ID NO: 15711 - DNA, 1791 bp, Glycine max
  Peptide Sequence Number=SeqID_132489
atgttcctgttccagaagggttctcatctccatcgtctccttctgtcaaagaagtactactaccattttccgcttccacgcaatgcggttaccatcgccgattccgtcgaacacccctcagacgccaccatagccaaactagtcctcgaatcagacccacgcaccgtctccgaagccctaaccaagcccacaatccaatggaccccagacctagtaaacaaagtcatgaagcgcctctggaaccacgggcccaaggccctccaattcttcaaacacctagaccgccaccacccttcctacacccactccccctcctccttcgaccacgccgtcgacatcgcggcccgcatgcgcgacttcaactccgcctgggccctcgtgggccgcatgcgctccctccgcctcggcccgtctcccaaaaccctcgccatcctcgccgagcgctacgcctccaacggtaagccccaccgcgccgtccgaactttcctctccatggccgagcacggcatccgccaagatctccactccttcaacaccctcctcgacatcctctgcaaatcgaagcgcgtcgaaaccgcgcacagcctcctcaaaacgctcacatcgaggttcagacccgacaccgttacctataacatacttgcgaacggttattgcttgatcaaacgcacgccgatggcgcttcgggttttgaaggagatggtgcagcgtgggattgagcctacgatggtcacgtataacaccatgctgaaagggtattttaggagtaatcagattaaggaggcttgggagttttatttggagatgaagaagaggaagtgtgagattgatgttgtgacttacaccactgtgattcacgggttcggggtggcgggtgatgttaagaaagcaaaaagggtttttcatgagatggtgaaggagggtgtggttcctaatgttgctacttacaatgctttgattcaggttttgtgtaagaaggatagtgtggagaatgcagtggtggttttcgaggagatggcgagggagggtgtgtgtgtgccgaatgtggttacttacaatgttgttatacgaggtttgtgtcatgttggggacatggagagggcgttggggtttatggagaggatgggggagcatggtttgagggcttgtgttcaaacatataatgttgtgattcggtatttttgtgatgccggggaggttgagaaggctttggaggtgtttgggaagatgggggatgggtcatgcttgcccaatttggacacttataatgttttgattagtgcgatgtttgtcaggaagaaatcggaggatttggtggtggctgggaagttgttgatggacatggttgatagagggttcttgccgcgcaagtttacttttaatagggtgttgaatggacttgttattactggcaatcaggattttgcaaaggagatactgagaatgcagagcagatactcgaagttaaaggaagacaatctacatggttctgaactattgaaagtatattgtctgttcaattggagagcatgtccccattctgtaattttgacgaagtttctgcattctggggaactctctggtgatgaacccaccatttctgaaaatcttgctttaaaggtctcctcattcaggtgttcgaaagagcttatagcagttcttagaagaacaaaatggaatgaaaaaaagataaattatcagaatggccagaacaatgaaacctattttgcctgctacagctttaccacattggggaaatactacatgattggtctgacaatccctggctga

SEQ ID NO: 15712 - DNA, 1287 bp, Glycine max
  Peptide Sequence Number=SeqID_132490
atgcagaccctcaccccaccgtaccccaaccctctcaactatctcacccgggcgcgtcactcggtcattcgggtcgctccgacccgtttcacagtcaaatgcggttacggcttcgaatccgcgagtttctcgcagggactcggcgcgagccgagccgattggcaaagctcgtgcgccatcttagccagtaaggtcgtgtcgcagcgggaagattctcccgccgacggcgacgaccacgacaacaacgtcggcgacgtgaacggccataacgccgccgtaacgaatctaaatatcgtacctgtcaaagccgatggtgaaaacatcaagccgattccgccgaagccactcacgatctccgacctcttgccggcgccgatgcacggctcgcagctgcgcgtggcctaccaaggcgttcccggcgcgtactccgaagctgcggcggggaaagcgtatccgaacggagaggcgattccgtgcgaccagttcgaggctgcgtttcaagcggtggagctctggatcgcggatcgcgcggttttgccggttgaaaactccctcggcggctcaatccaccgcaactacgatctcctcctccgccaccgcctccacatcgtcggcgaggtccagctcccggtgcaccactgcctcctggcgctccccggcgtccgcaaggagttcctcactcgcgtgatctcgcatccgcaggccttagcgcagtgcgagcactcgctcacgaaactcggcctcaccgtgacgcgtgaggccgtcgacgacaccgccggcgctgccgagttcgtcgccgcgaacgacctccgcgacacggcggcaatcgcgagcgcgcgcgcggcggagctctacggcctccagatcctggccgacggaatccaggacgatccgaacaacgtgacgcggttcgtgatgctggcgcgcgaaccgatcattccgcgcacggatcggcccttcaagacgagcatcgtgtttgcgcacgataaaggaacctctgtgctcttcaaagtgctttccgcgtttgcgttcagaaacataagcttaactaagatcgagtccaggccgcaccgtagccgtcctattcgcgttgttgatgatgagagtgagggaaccgccaagcactttgagtatctcttttatattgatttcgaggcttctatggctgaggttagagcacagaacgcactcgctgaggttcaagaattcacctccttcttgcgactcttggggagttaccctatcgatatcacaccctggactccctcttctccgcgccaaaattaa

SEQ ID NO: 15713 - DNA, 195 bp, Glycine max
  Peptide Sequence Number=SeqID_132491
atgatgatggattctacggtcaaagaaaataccagcgataggagattctgtatttcaatggaaatctctaagaaagcaaaagatcattctaatagtggaatacttaagaagatggctgagttggtcatcttagagcttttggtggccattttgcttagtcctcttataatattacatcgtcattcagtaatttaa

SEQ ID NO: 15714 - DNA, 750 bp, Glycine max
  Peptide Sequence Number=SeqID_132492
atgctctgcgtctccgattcatgcgttaagccccttccgctgaagaagaaaaaccctttctctttatttgttcaacatcaatggcttcctcgtgccgcgggctattccaaggcccaaatgtgcttcttcaagattctccgcataatttcatccaccccaccctccaaacaacaacaaccctttccaaccaaaggcgtcggcatcgatttgaatctcagattccgttccgtcacagagaccgaagaatccgaatcttctagaagcgacaacgacaacgcctccgccactgctcaaaccaacagcaacgaagggtttccagagaagagcgttgaagtttcggagaaactggacaacaacaacaacaacaacaccactaacgaagttaacaatcacgcggaaacggcgtcgtttaagggacgcgatggtaattgctttgatttgcttatcgaagcggcgagggtggtgtccgggaaggaggagtctgactcggaggaactcggtggcgagttgaggactcggagggcgagtaaagtgaaacggagggagaagtgggtggttgtggatttatacggcgacgttttaggggagagagaaccggtggtgaggtctaaaagagggaggaaccaggcgttgccgtaccggttcaaagactcggtggtggaaccgttgaaacgcgcaactcgttctcagagaccgtcgtcaaccacacacctcactaaacgacttcttaggtcgtcacccacaacgtaa

SEQ ID NO: 15715 - DNA, 132 bp, Glycine max
  Peptide Sequence Number=SeqID_132493
atgggtcataagcaatgctctaacctttttgtggatgagctgaggcactctgtagaactgacagaggcccgtaaattagagcttggcaactccaagaccctgttggacttcttcgggtccactgggtgtctt

SEQ ID NO: 15716 - DNA, 456 bp, Glycine max
  Peptide Sequence Number=SeqID_132494
atggataatttttgcccttgcttctttgtatccctcttcacttgtgatgtctctgctactagttccacacagttaatgtccaaccaaacacaagacgatttattaaatatatgtgattttgtatattgtgggaaaggaacatgccaactttcttccgctgaattgctcggtttcacatgcgattgtgaatctggttggaagaagcctaacattggttctatcgaattaccgccatgcagttttcctaactgtactgttaatttcaattgtggtaatggatctccggcacccccttcttctccacctacacaagtgtctgaccgcactttcggtggagattgcaatggttttgatcttgggttcagctccgaaactccgccacccccagcaacatctggaactgcctctcctggaactactgcaagtacgtacccttcaaaacattccttaacataa

SEQ ID NO: 15717 - DNA, 708 bp, Glycine max
  Peptide Sequence Number=SeqID_132495
atggttggaggttcattagcagggttgcaagagcatctcaagttagcccgagactacgctctcgaaggcctctacgacacctccatcatcttcttcgacggcgccctcgcccagatcaacaagcacctaagcactgtccaagaccctttaatccgcgcgaaatggatgaacgtaaagaaatcactttcggaggaaacagaagtggtaaagcagctagatgcagagagaagggctttcaaagacaaccccattggcagacgccctgcttcgcctcccatttcggtgaagtcatcatcgtctttcgtttttcagccgttggatgagtaccccacttcatccagcggttctggtcccgttgatgatcctgatgtgtggcggccgcccagcagggacaccaccagccggagaccggcgcggcccggtcaagtgggtgctcggaaatcggcccaagacggggcttgggcgcgtggcgctacaaccagaagtggtgccgctgggcgtggtgctaaggccggtgctaccggtagggttaactccgggactcgagcttcgactaccggaaagaagggtggcgctgcttctggaaaggctagcaagacggatgccgctgctgcagctgtaactgtaagtttcagctttgatgaggcagtctgttggagaaaatttaccgtctcacgttatcttgttggttggagaagttgtttctaa

SEQ ID NO: 15718 - DNA, 114 bp, Glycine max
  Peptide Sequence Number=SeqID_132496
atggcggaggtggcaaaggtagacactgttgatgtcgtcaacatcgatatacgtgacggagaaggcggaagtcacagaaggattaaacctatgtgggaggaagtgagagaatag

SEQ ID NO: 15719 - DNA, 219 bp, Glycine max
  Peptide Sequence Number=SeqID_132497
atgcaaatcgctagcatgaacagcgccacactcaggcacgcgacacgtggctgtgtcgcctctgccactggcgacagcactgatgtcgccacctgcaatggcgttttggccatgcagggtggagtcgctggtcaaaccagcgcttccccacgcgtatcaggtacagcttttgcaggtgaaccagcttttgcagtgcagctgaaaacgccaggtccttag

SEQ ID NO: 15720 - DNA, 1623 bp, Glycine max
  Peptide Sequence Number=SeqID_132498
atgcaaccaattgggtctgtccccatgaatgctggcagctccaccttcttaacccaaatttgtgcttcctccatctctaacactggcttcccctctaagatccggcaggtaatggtatacaagaaaacaactgaagagaaatttccttctatgaagaaatattctgataaggctcctccaaatgataaatttgctaaacatgaagtcaaaatagattatgaacacaagagttctaaagatcctgacaaagttgtcccccctgaccaaagaattaaaggctatccttatgggcctcaaatagttcccatatcctctgctgagtgggaggctgttaaattcaaaccggaaaaaggtgtgaagctcatgggatttactgattcttctaatgtatttagacaccattacatgaaagatgtatatgttttcctacctgaacctggaaatacaagagccatgattgcagtttctgcagtagcaagggctatgaaggaaatgaataaggtggcaatacctgattcattttacttaaatgtacttccttttgctgaggatgtgcgagagtttcaattcccttccttcactaatttcccagcatcgtggcaaccaaatggacaacagctagaggctgcagctaacttaataaaaacgcttgatcttgcaccacatgggcaagaggaagttttgctacctgactttacaccaaatccagtgttagagttaatcagcttatttaaacttcgtaccccattgcccagaggctcttcgctatgcgaaggtatgggggagggatattgtacgcagccttacccttgcatatgcaaagaggctgtttccggattcgaacccatgaccaacaagtcaccaaggcacaactttaccgctgcaccagggcttgccctcaaaaacttcgtaccccattgcccagaggctcttcgctatgcgaagcgcttttatcgttatcttgagctgaaatcaaaggatccagatgtggcagtacctcctcttgatggcacactcaagaaaattacagagcctgatactgacctgcttttgcaaaataaatctgaaatagactcattttgtaggtcttttgagctaaagggaaatcccttgaaaaagtcgaggcgtttattgggaggaaagagatctttttcaaatgatgaagaggttaaaggaaacattactgctcaaccagccaatctcaccggaaatgcatctgttaatgttgggaaaattggggatctgactcccgttcaatattttgaagccttgatttcacgcagagatagtccagattgggttgtaaaagccattaatgaaatgaaaaataaaatatttgacctggtggaggactcccatgaaggggataactatcctaaagcactggaatgtttagttgcacttcgcaagggttgcatccttgagcaggaaccggaacagttcaatgatttccttaaacatctatggaatttctgtcaagagaaaaacctccctagtttctgtgaatatcttgcttctaaggaactcaccttgatctccaaaacagaagctatagacagtgaaaatactgatgacaaagccagaaaaggtttcttggttaaatctgaaccaaaagttgattga

SEQ ID NO: 15721 - DNA, 294 bp, Glycine max
  Peptide Sequence Number=SeqID_132499
atgaaagggaaccgaaccaaacaaaaggcaaaaaataattatgagcagcgaaaattaatatttgtttgccggaatctgttgacagtggaggccttgaagaatgcggacaattctgaacacgttcccatttatgaggacaaagatggtgactggatgcttgttggagatgtcccttgggaaatgtttatggagtcatgcaagaggctgaggattatgaagaggtcagatgccaagggcttcggtttgcaaccaaaaggatctctgaagggattcatagaaagcgcggcaaagtga

SEQ ID NO: 15722 - DNA, 570 bp, Glycine max
  Peptide Sequence Number=SeqID_132500
atgattgaattggggaaaactggatttgttttcaatccttatggagggaagatgagtgaggtttcgtctgatgcgacaccgtttcctcaccgtgctgggaatctgttcaagattcagtactctgtgaattgggatgatccaggagttgaattggaaaagaattttactagtcaggccaaaatgctgtatagttacatgaccccttttgtgtccagtgatccaagaagtgcctttttaaattacagggaccttgatattggtaccaacagttttggaaagaatagctatgaagaaggagctgtttatggggtcaagtacttcaatgacaattttaagaggttggtcaagatcaagactgaggttgatccagaaaacttcttcagaaatgaacagagtattccaattcatccagtttggaatttgggtagttcaagacattgcataacttcggttcctggaccggacactggtgccattaaatctggtgctggaaaattgttacacttaacactttattggtcagtgatggtaaaggtgggatggttgttcattcttgaattattcatatga

SEQ ID NO: 15723 - DNA, 156 bp, Glycine max
  Peptide Sequence Number=SeqID_132501
atggagaacaaaaaaggaagagtcttgaataggacaacaatgggggaagatcttttctgggctattagaggaggtgggggtgctagctttggggtcatcgtttcatggaaaattatgttagttcccgtgcttcaggttgtcacggttcagaaatga

SEQ ID NO: 15724 - DNA, 1914 bp, Glycine max
  Peptide Sequence Number=SeqID_132502
atgagaggtgtatcaaagcacttacaattgttgcgcccaacaagctcgcgttgttgttcatacagtgttaactcgtctctcgtatccccacactatgtgcccccagaaaccgagtcactactcaaccactgttaccgaagggaccttcccagcgccatgcatgtgttggattccatggaaagaagaggagtttgggccgattctatcacctattctgagctcatcaagtgttgcttggctcacggggctgtcagggaaggaaaacgcgttcaccgccacatattctcaaatgggtatcaccctaaaacgtttttgaccaacattctcatcaacatgtatgtcaaattcaacctcttggaagaagcacaggtattgttcgataaaatgcctgaacgaaatgttgtgtcgtggactactatgatatctgcttactctaatgcccagctcaacgacagggccatgaggctcttggctttcatgtttagggatggtgtcatgcctaacatgtttactttctcttcggttctgagagcgtgtgagaggttgtatgatcttaaacagctgcattcttggataatgaaagtggggttggagtctgatgtatttgtgcgcagtgcgcttattgatgtttactcgaaaatgggggagttgttggaagctctaaaggtttttcgtgagatgatgactggagattctgttgtttggaactccattattgctgcttttgctcagcacagtgatggggatgaggctttacatctttacaagagcatgaggagagtgggttttccggctgatcagtcaacactcacgagtgttttgagagcgtgtactagtttgtcattgttggagttagggaggcaagcccatgtccatgtgctaaagtttgatcaagatcttatcctcaacaatgcccttttagatatgtattgtaagtgtggtagtttggaggatgcaaagttcattttcaatcggatggccaagaaggacgtaatctcttggagcaccatgattgctgggttagcccaaaatggttttagtatggaagcactcaatttatttgagtccatgaaagtgcagggtccaaaaccaaatcatattacaattcttggggttctgtttgcttgtagtcatgcagggctagtaaatgaaggttggtactattttcgatctatgaataacttgtatgggatagatcctggaagagaacactatggttgcatgcttgatcttcttggaagagctgaaaagcttgatgacatggttaagttaatacatgaaatgaattgtgagccagatgttgtgacgtggaggacattgcttgatgcatgcagggctcgtcagaatgtggatttagccacgtatgctgctaaggagattctaaagttggatccacaggacacaggagcctatgtgttgttatctaatatttatgcaatttcaaaaaggtggaatgatgttgctgaagttcgaaggactatgaaaaaaaggggcataaggaaagaacctggatgtagctggattgaagtcaataagcagatacatgcttttattttgggagataaatctcatcctcaaatagatgagatcaatagacagttgaaccagtttatttgtcgactagctggtgctggttatgttcctgacacaaattttgtactacaagatcttgaaggggaacagagagaagactctcttcgataccacagtgagaaactggcaattgtttttggtattatgagctttccaaaggagaaaactattaggatatggaagaaccttaagatctgtggagattgtcataaatttgcaaaactcatagcagagttagagcaacggcatattgtaattagagatcctattcggtaccatcattttcaagatggggtttgctcctgtggtgactattggtag

SEQ ID NO: 15725 - DNA, 900 bp, Glycine max
  Peptide Sequence Number=SeqID_132503
atggaaaagtcaagtctttttccatctgggactttcctttttcttcttctggttcttctcaatgtctctgcttcggtggcagctccaacaccagaatcggtgtacacctctttcctcgagtgtctcacaaactacacaaaagcacaagaccaagtttccaacatagtctttgctcaaaccaacgcttctttttcttctgtcctccaagcctacattcgcaatgcccgattcaacaccacttcaaccccaaaacccttgcttgttgtcactccctcggaagatccccatgtccagggtgctgtgatttgcgccaaaagcattgggattcaactcaagataaggagtggtggccatgactatgagggtatctcgtatgtctccgaccaacccttcatcatcctcgacatgttccacttcaggaacatcactgtggatgtggaaaacgaggttgctgtggttcaagcaggtgccacacttggagaggtttattataggatttgggagaagagtaaagttcatggctttcctgcaggggtgtgtcccactgttggtgttgggggacacttgagtggaggagggtatggtaacatgttgagaaaacatgggttatctgttgatcatgttgttgatgctaaaattgttgatgtcaaaggtaggattcttgacaaggaatccatgggggaagatcttttctgggccattagaggaggtggtggagcaagctttggagtcatcttatcatacactgtgaaacttattcctgtgcctgaagttgttactgtttttcggattgcaaagagtttggatcagaatgagagtgccactgagcttgtattgcaatggcagcaggtggcgccgcacaccgatcataggcttttcatgaggctgctgttgcagcca

SEQ ID NO: 15726 - DNA, 165 bp, Glycine max
  Peptide Sequence Number=SeqID_132504
atggatggtttagatgtcagcgaaagagaaaacgaagagatctacttatatagacccctcgtgttgcagctgcattgtacattcccttcacatgcggcactttattcgggaacggattcagatcctctgcagttgtttttgaaattgcatgcatcttcaccttaa

SEQ ID NO: 15727 - DNA, 228 bp, Glycine max
  Peptide Sequence Number=SeqID_132505
atgaattacaaaagaacaccaattgatacccaggtttcacaatccttttctattgcgcaagctaacatcaacataacaatccaatcctcagtgccaccacctgcggcgtcgtgcgatttgatacagaaggagccgtggaagaaggagaataggggagaggaggacgatggtggtggtgtcaaatgcagcaatcgcaaaggcgctagaggagatcccaggatctcctag

SEQ ID NO: 15728 - DNA, 564 bp, Glycine max
  Peptide Sequence Number=SeqID_132506
atgacttggattcaatccgttcttcactatgcaggctattcaatagatgaatccttggaggtcttgcttaggagaaaccaatcatccccttctttcaaagcaaaatctgattatgtgaaggaaccaattccattgcatggcttagaagggctatggaagatgctactcttggagaactcaccactgttgatcctcacaccatatggtgggataatgagtgagatttcagaatcagaaactccttttccacatagaaaagggaacttatatggtatccagtatatggtgaattttgcttcaaatgaagaagcgccaaagcatatagattggataagaagattgtatgcatatatgacaccgtatgtgtcaaagtttccaagacaagcatatttgaactatagagaccttgatttgggagttaatcaagggaaaccgtggtatgaaaaagcaaagtcttggggtttgaaatatttcaattgcaattttgaaaggctggcactagtgaaggccagggttgatcctggaaattttttcagggatgagcagagcattcctccgttgtag

SEQ ID NO: 15729 - DNA, 312 bp, Glycine max
  Peptide Sequence Number=SeqID_132507
atgattgaggaaggttccatgtttcatctacttgacttggagtccaagaaagaagttcaattctcccatcatagacatctcaaattatttctgcatacaactaggaaaattctgataagatggatggcagcggaatggagaaggaagagagagaggagacgccacttcaaggagaagatgagtctagtagaagctcaccaccataggaggccatggataagagcttggaggaagaaggagatgaatgaagggagaggaagagaagagcacgaaattttatgctctaaaagagctctgaaatctgaagtttaa

SEQ ID NO: 15730 - DNA, 294 bp, Glycine max
  Peptide Sequence Number=SeqID_132508
atgatcggttccgtctcggtcgtgcctttgcttctgttgcctctgcgttttctcctgagtatcagcaacctgcccatggtaccgccgttctccaggaaactaacggctcgcagctgttcagccgcttctctaggagataggagatgtaccgctgactgggttcaggacacaaccatcgtccgaaccgtcagctaccaagtcccatgggggcctttggttggaacccataacaaacttaaaaagcacttctgccggtcgacaaatgcgtgctccggttgtagcagtgttgaatga

SEQ ID NO: 15731 - DNA, 351 bp, Glycine max
  Peptide Sequence Number=SeqID_132509
atgggttccaaccaaaggcccccatgggacttggtagctgacggttcggacgatggttgtgtcctgaacccagtcagcgaacggcggtaccatgggcaggttgctgatactcaggagaaaacgcagaggcaacagaagcaaaggcacgaccgagacggaaccgatcataagttccagaactgcccgccacccctcaatgttgatcagctgagattgaaagagccctccatcttggatgaggcggctgaacctgaggttgagttggagatcgacgacctcattcctgatcgacagccgagtagggtgggaaatgttctcgccacagaagccaagtggttcacggctgaacag

SEQ ID NO: 15732 - DNA, 150 bp, Glycine max
  Peptide Sequence Number=SeqID_132510
atggctcgcgtgaggggaccaaagcttttgacgctccgccagccactccgtaaggcactgatcgaaaccccccaggatagattaggcatcgaacaaagcagcgctttccgcttgtcccgggctaggttaaggatgacgacctattggtag

SEQ ID NO: 15733 - DNA, 149 bp, Glycine max
  Peptide Sequence Number=SeqID_132511
atggtgttgggaacatattatggtgacttgaacgtgggaaatgaccaaagttggtctgggtgtaaacaactttggagattgaggttccgctattgggataattataaagacattgaacaaagttttcatgagtatctgctgaagaagat

SEQ ID NO: 15734 - DNA, 1773 bp, Glycine max
  Peptide Sequence Number=SeqID_132512
atgatgttatttgcgcattacaacatcgtttttggaacaccattgttgaactgcattattcaaggacacgatggtaatatttccctgacctccacctttcgtgccttctccgacgccgaggaggatgaagaagacgatgaagaagaagaccaagaccaagacaacgtttctaccgacgaatacgacgacgtttcgggtgaggctttcgacgaggctgacgtgttcgctcggcatggtggattcaagtggcagagagtcgacaagctatgcaacgaagtcagggagttcgacgccgatctcatcgacgttgatgagctcacctccgtctacgatctcatcgacactgatctcatcgacgtcgtttaccagagctgttctatagggcttgcgcttcccgtgtattccacgtttaaagctattgagaacaatgacccatatgagcaacaaagaatggtgataagcttttgtgctggagtgagtgcttccactgctcacacatggacaacactctcagggacaggtgctaatgatgtaagggttatgactcgaaagagtgtggatgaccctggaagacccctggcattgttcttagtgctgccacttctttttggcttcctgttcctcctaaacgagtctttgacttcctccgtgataaaaactctaggaatgagtgacgctagctcaaaaccccttgtcattgtgacaccactggttgtttcccacattcaagccaccataatctgctcccaacgccatggtttacagattcgaacccgaagcggaggccacgattatgagggtctctcctacgttgccaagtttccatttgtactcattgacctcataaaccttcgagaaatcaaagtgaatgtggaaaacaaaactgcatgggttcaagctggtgcaactattggtgaactttactacaagattaacgaaaaaagccccaacacttggattaccagcagtggcggtggctatggatttttgatgcataagtatggtcttgctgctgataatgtaattgatgctcacatagttgacgtgaaaggtaaccttcttgacagaaaatcaatgggtgaggatcggttgtgggccatcagaggaggtgggggagcaagctttggagtcattgtggcttggaatgtaaaactagttccagttccatcaactgtgacagtgttcaatgttccaaggacattgcagcagaatgcaacagagattattcataagtggcagcttgtcgcaaataaacttggcaatggcataatgattagggtaaacttggtaaggagcttcccagagttgggtttggtcagagaagattgtactgaaatgagttggatagattcaattctctatatggctcgatgtacaaatggtcaaccccgtgaagctttgatgaatagaactggatgtggtttgccattcttcaaagcaaaatctgagtatgtgagagatccgattcctgaagttgggttaaaagggttatggctattgttttatgaagatgaggctcaaggtgctattattcagttcactccttatggaggtaagatgtatgagatttcagaatcagaaattccattccctcacagatctggaaacatattccatattaattacttggtagttatatggaaagaggaagggaatgaggcagaacaaaggcacatcaaccggattcgaagaatgtacagttatatggaaacttatgtttcaaagtctcctagggcttcatatttgaattatagagaccttgacactgggtaa

SEQ ID NO: 15735 - DNA, 195 bp, Glycine max
  Peptide Sequence Number=SeqID_132513
atgttgctgtatcctattgcttggttcttgatttcttttttccttttgtttttgaatctgtgcagcaaggaacataatgttgataaagataatcatgaattgaagccacctcagagatctgagcttgcaagtgatgagtttgagcaatggcagaataaaccccgaaggcaagttggattgcaaaaccatcattaa

SEQ ID NO: 15736 - DNA, 1995 bp, Glycine max
  Peptide Sequence Number=SeqID_132514
atggaggattgcaacaacaaaggagaagttcatgtgcatttaactaagcagaagcagtcttcatcaagatcagaagagaaaagcaagggtgatgcacagtgctatggtagcaaccggttactgttgtggctgcttctgattaccctttgggcttatcttggattttatgttcagtcaaggtgggcacatgatgataaggaagaagaattttcaggctttggaagcaggcaaagtgatacaacaaactcttacgttggacagaatcagcatcttgatttgattgccaagaacatttccttatctgtaaatattgaattagttgagaacaaaacagttgatgtggctttggccaagaaagaatacggtgttctatctcaacttaaggctagctcaaagaaaaggaacagaagaaagcgatcaacgcatgctttgcgaggtacgaggaggcgaaaacatatacttgagagcagtgatatagaggagcaagagccagaaattcccctcaggaatgatacctatggattccttgttggtccatttggttcgatagaggatagaattctgcaatggagtcctcagaggcgttatgaaacctgtgataagaagggggaattcgcacgccttgtttggtcaagaaggtttgttttgatatttcatgagctttccatgactggtgctccactttcaatgatggagttggcaactgaactcttgagttgtggagcttctgtttcagctgtggtgcttagcaggaagggtggtttgatgcaagaacttgctaggagacgaatcaaggtgcttgatgacaaggcatatctcagcttcaaaattgcaaacaaggcagatcttgtcattgctggatcagctgtctgtacatcatggattgaacaatacattgaacattttcccgctggtgcaaatcaagttgcttggtggattatggaaaaccgacgagagtactttgatcgggcaaaggatgtgttgcagagagtgaatacattggtttttctgtctgaatcacaatctaggcaatggcaaaaatggtgtgtagaagaaggcataaaactgagctctcagcttgcactcgtcccattgtctgttaatgatgaactagcttttgtagctggcattccctctacacttaaagttccatccttcagtgctgcaaaaatggatgagagaaggaagttgttgcgagattctatccgaagagaaatgggattgaatgataatgatatacttgttatgactctcagtagcatcaaccgtgggaagggtcagctattgcttcttgaatcagcacgctcaatggtagaacatggaccattgcaacaagatgataagaaaataccggagtcatcagatgatggagaatacctatctaccttggctagaagacatcatattagaaatttgttgaaggataacagtgtagccttgaacaatatctcaagcaattttataaacagaacaagggaagtgttgtcccaaaacaatggaacaatggcacaatctctcaaaattctcattggttctgtgggatctaagagtaacaaggtggattatgttaaaggtcttctaagtttcttagcacggcattcaaacttgtcaaagtcagttttgtggacctcagccacaacacgtgttgcctcactttactctgcagcagatgtttatgccataaactctcagggattgggagaaacatttggacgggtgactatagaagccatggcatttggtcttccggtgcttggaacagatgctgggggaacacaagaaattgttgagcataatgtgacaggtcttcttcatcctattggacgtgcagggaatcgtgtccttgcacagaatctccggtttttacttgaaaacaggttggcaagagagcaaatggggatggaaggaagaaaaaaggtgcagaggatgttcttgaagcagcacatgtatgagaaacttgtagaggttcttgtcaagtgcatgagaaggatataa

SEQ ID NO: 15737 - DNA, 1614 bp, Glycine max
  Peptide Sequence Number=SeqID_132515
atggctagcacggttgaagaaaagaacaatgttgagtacgatagtgacccggaagaggcaaaaagaccgttaacaatgcggaggcgtgaagccagcgatgacgaagtaaccgaagccgaagccgaagctgaaggagaagaagtcactgataagatggaagatagtagggtagaggttcgttctgatgacgaaggaggtgttgaagactatgatgatgatgttgaagaagaagaagaagaattagaagaagaggaagaggaggaggaagtggaagttgaagaagaggtgtacgaggaaaagggtgctacaagtggtggggttgaggttgatgagggttcagcggatgtggttaaggaatctcaggatgatgtcagaccccctttggaagattctattgaggaccattcggaggagaaaaaggagaatgaaccatttgcggtgcccacagctggagctttttacatgcacgatgaccgttttagggacaatgctggtgcccgccaaaggcggatacatggggaaaggagtctgtgggagtccaaagacgacagaaaatggggacatgataaatttgaggaaattactttgcacgaaaagcaccatgaagagagggggagaccttataagggtaattatcgtggtcgaggtaaaagtcgaggcacttatcgtggaggatatgttcaaggaaacaggacaggatataatgacagtagcaatcaaaatcaggtacctaagagagttgtgaaagggagaggcccccaaaagtatgaacgtaccaataaaagcaatggtccatcttctgcagtgcaaaataaacattcggagaggacttccacacatgcttccaaggtagaatctggctctgtgcctgttaaaaatcaagtggttgcttcaaatttgaattcagcatccccaccattttacccctcaggctcttccaacaaagatattaatttggcacaaaaaagggaggtgcaaacaggtggcagtagcaggaacattagtcctgttgttgtggatgagggtttcccagttcaacaaaacaatgcacggcttcggggaaacaacgttgttgattccattagcatggcaaagttgtatattgatgaatccatccctctatctgttggaaagcctggatcttctgcagtcagtgcatctcaatctcctcatctcagggcttctgggactgggaggggtgcatcaatcccaatacagatgaattatcagcatgctccctcgcagaataaagtttctccatctcaattccaggttattcagacaagttctgcaccagggaggaattcaacttctgtgcaagctactgccccacagttggggaataggcctgatagtgggtctcaatcttcatctcccctcgaaacatccatgccaataagttcacatgattctggggaagtggatgcagcatcagaatcaggtaaagtcaaaggtgctatggttgggaagggaagggaaggttcccaaggtgcaggaaggggctctttcatttatggtggggcacaggtaatgggcaccacaggaaatgcggctgttagtcatggagatccaaacttcccagccttcttgccaggtttgtaccaacattgctga

SEQ ID NO: 15738 - DNA, 225 bp, Glycine max
  Peptide Sequence Number=SeqID_132516
atgcaaataagctgtacgaagccaggtaggcttaaaaagtcgggttcctatagtaaagatgcccgttataaagttgtgggacagacagaagttgatgttgttgttgagagaatgagaggtgtggattctgttctgaagactaaccaagagaaaggaacaacgtatggttcgcccacaattctctacattcttcacgtcttagagcattttcaagtgtcatgttga

SEQ ID NO: 15739 - DNA, 2199 bp, Glycine max
  Peptide Sequence Number=SeqID_132517
atgttgcaggcatatcttccaaatgacactccaactccactagtaaagtacagaaaagaagaattggaaaatctaagaggagatggaagaggggagcgcaaggaacttgataggatctatgattatgatgtctataatgatttgggcaacccagacgagaatgacgatctagctcgtcctattcttggcgggtctagtaagcatccataccctcgcaggggaagaactggtagaaaaccaacaaagaaagagatgttatacattgtgacttccaactgtaatttcattttgaaagtgtcaccaattctcattgttgttattgatgacacagtgctaatttcacctttatctaatttttcagaccccagatgtgagagaccaaccagcgacacttacatcccgagagacgaaaattttggtcacttgaagtcatcagacttccttacatatgcaataaaatccttaactcaaaacgttttacctcaattcaacactgcatttggtttcaataatgagtttgatagcttcgaggacgtgcgttgtctctttgatggcggagtttatctccctacagatgtactcagcaaaattagccccataccggtgctcaaagaaatcttccgcactgatggtgagcaagccctcaagtttccaccacctcatgtcatcaaagttcgtgagtctgaatggatgactgatgaagaatttggaagagagatgcttgctggtgttaatcctggcatgattcaacgccttcaagagttccctccaaagagcaagctagatcccacagagtttggagatcaaactagtacaataaccaaagaacacttggagatcaaccttggtggactcaccgtagaacaggcactgaaaggtaacaaattgttcatattagatcaccatgatgcattcataccgtttatgaatttgatcaatggcctgcccactgcaaagtcttatgccacaaggaccatccttttcttgcaagacgatggcacattgaagccattagccattgagttaagtttgccacatcctaggggacatgagtttggagccgatagtagagtagtcttgcccccagccgcagtcaacagcgctgaaggcacaatttggttaattgccaaggcttatgttgctgtcaatgacactggctatcaccaactcataagccactggttaaatactcatgccacaattgagccatttgtcatagcaacaaacaggcatcttagtgtgctccaccctattcataagcttctcttgcctcactaccgtgacacaatgaatatcaatgcacttgcacgacaatcgctcatcaacgcagatggcgttatcgagcgatcatttttgcccggcaaatactctctggagatgtcttcggcagtttacaagagttgggttttcactgatcaagcccttcctgcagatcttatcaagagaggaatggcaattgaggatccctgtgccccccacggccttcgccttgtgatagaggactacccttatgctgttgatggactagaaatatgggatgctattcagacatgggttaagaactatgtctccttgtattacccaacagatgatgcaattaagaaagactctgagctccaagcttggtggaaggaagctgttgagacgggtcacggtgacttgaaagacaagccatggtggcctaagttgaacactcctcaagatttggttcacatttgctccattatcatatggatagcttcagctctccatgcagcagtgaattttggacaatacccttatggaggtttgatcctaaaccgtccaactttaaccagaagatttctccctgaaccaggaagcaaagaatatgaggagctttcaaccaattatcaaaaggcttacctgagaacaattacaagaaagattgaggcccttgtggacctttcagtgatagagatattgtcaagacatgcttctgatgagatctaccttgggaagagggacagtgacgattggactgatgaccaaaaggcaattcaagcctttgaaaagtttggaaccaagctgaaggaaattgaggccaaaatcaattcgaggaacaaagattcaagccttagaaaccgtaatggaccggttcagatgccttatactgtgcttcttcctaccagtgaggaaggccttactttcagaggaattcccaacagcatctctatctaa

SEQ ID NO: 15740 - DNA, 2769 bp, Glycine max
  Peptide Sequence Number=SeqID_132518
atgtctgatcaaccacccattaacccttcgaccaagcttgaggacatccttgtagccctcaccacgcaacaattatccttatcacacaaaatcgatgaccttattcaacacatagcccctgtccttcactccgcacctgccatcacttcgtctgttccgcgtccataccctaaccctgcaacatcacacagattaaaattagaagttcctcgtttcgatggcaccgaccccattgggtggatttttaaggtgaatcagtttttcgactacaatggtaccccagagcatgaacgattgcagattgtatcgttttacatggagggcagggccttctcatggtttcagtggatgatcggcaacgcgcaattcacgtcgtggccggcgttcatccaggcactgcaaacccggttcgcaccgtcgcagtacgaggacccaattggtatcctctgcaagctcactcagaaacacacggtgacggcttacctgtcggaatttgaggacgttgctaatcggattgtcggcatcccacctgccttcctcctcgactgtttcatttctggcctcacgccggaaatccaccgtgaagtccaagcccaccaaccactgaccctaacccaagcggctgggctcgcgaaactccaggaagagaagctcctggagtcacgcccttttcccacctcgactagaccacgccctccttcagcccttttcccttccacaccttccaccctccccacccagcctcctccccgtccttcaccttttatgaaacccaccccacccttaaaccctgtcactcctcgccctattcctcccccaccgttcaaacgcctcacctccgaggagattgcgtctcgtcgggaaagaggcctttgttttagctgcgacgagaaataccactgtggccaccgatgtgcctcgcgggtattcctcctcttagctgaagacggcgactccctaaccctacctgattcccctcttataacaaacctagaccctgacccatcacttgacccgacccatgacccggacccgtacccggcccaattaagtttaaattctatggcgggtcaccttgcaccggagacactccgttttatagccaccattgccggcaacgacgtggtgctcctcgtggatggtgggagcacccacaatttcattcagcaacagctagttgatacactgggtcttccctctcggccaacatcacctctgtgtgttatggttggcaacggacagcaattaaagtgccacaccatttgtgaggccattctgatactcattcagacccacgaattccgtgttgatttgtatgttcttcccatctcgggtgcgaacattgtattgggcatgcagtggttgaagtccttggggcctgtcctcacggactataatactttactcatgaaattttttcatggcggtggtctgattacgttgcagggggactttgatgcatccctaacctccctctcctctgttcgccggcaagcccgcaagactgataatgctatctactaccacatcaccatattgcctgaccacaatcccgagacccaagtcatcccttcctctattcaacctcttctcgatcaatttgccattctcttccaaccccctcattccttgcctcccccgcgaaccactgaccaccacatacacctattacccaatatggcccccgtcaatgtcaggccctatcgttacccgcactaccagaaaaaggaaattgaggaccaggttgattcaatgcttcagcaagggcttattcaacccagtaccagtccattctcgtcgccggtactccttatgaagaagaacgatggttcgtggcgcttctgcgttgactaccatgccctgaatgccttgacggtgcgcgaccgcttccctatcccgacaattgacgaactcttggatgagttaggaggcgcaagttatttctcgaagctcgaccttttgcaggggtatcatcagattcagatgcactccgacgacattctgaagaccgcattcagaacccatcacggccattacgagttcaaggttatgccgtttgggctttgtaacgccccatcttcgtttcaggcgaccatgaatcaaatctttcagccataccttcgtcgtttcattattgtcttcttcgacgatatccttatttacagtgcttccatggctgatcattgtcatcacctcgagctcacatttcagcctcaggtcgagtatcttggccatttggtttcaaatgctggtgttgaacctcttcccgccaagattgctgccattcgaaattggcctacaccgcacaccactaaagctcttcgaagcttcctgggcttagcaggcttctatcgccgcttcatacaaggctatgcaaccatagcggcccctctggtcaaggcaacaactacagatccttttcagtggtcgccggaggcacagtctgcttttgaacacttgaagttggcattatcttctacctcggtactggcactgccggacttcacaattacgttcaccgtcgagaccgatgcttcgggtataggcatgggtgccattctctcccaaaaggggcacccaattgcattctttagtaagccattcagtgccaaactgctacgttcttccacttatgtcagagaacttttcgccatcactgttgccatcaaaaaatggcgacaatacttgcttggacatcgatttatcatactgactgatctccgcagccttaaggaactgttaactcaggctgtgcaaaccccagagtag

SEQ ID NO: 15741 - DNA, 231 bp, Glycine max
  Peptide Sequence Number=SeqID_132519
atgattgtgaatgatgtatccgttaaatatttgataacttggtttgtggaggaagaactacttgatgttggtgacctccccgttgacgtaatcagagatggcggtggaagagtcgaaaatgggaaagttgcgtttgcagtcaactttcttttggtagtcttgctctatggtggaggtgactttgaagacggtgacaaagttgtttcagatttgaaagttaaagatcgatga

SEQ ID NO: 15742 - DNA, 222 bp, Glycine max
  Peptide Sequence Number=SeqID_132520
atgtgggtttcgatatctttcttttggactcttcctccttttgcaccaccactatttgatcttgttctgcttgttgcacccctgtcatggcttgctggggaaaccaacacaagcacaaagacagcaattcagaatcaagagttcagctcaagagaggtgcaattagaagttaggcccaagagggcagtaaacagaccctcttacctgaaggattacatctga

SEQ ID NO: 15743 - DNA, 1197 bp, Glycine max
  Peptide Sequence Number=SeqID_132521
atggcaaatgctgcagaagatttctcccaattcgggatttcaaaggaggaaaaggataagcttgttggggaattgattaggtacatgcttttcaaaacccatcaaaattcagggtgccccattaagagagaggaactcactcaacttgttacgaagaactatcatcagcgtaaccttcctacctttgtgatcaatgaggctaaggagaagctttcctttgtatttggctatgaaatgagggagcttcaaagggcccacccttcttccaaagcccagacacggtcctcccaacaaaagcagacaatgtcggggcatggagaggaccagatggctacaagtagctctctcattagccagagctggttcacatactacaatgtgcttgtctcatcattcatggagatgagccaccagtgccaagacctcatgatgcttccccctgccgcaacatgcgtcgctgcattagcccctcctgacgaaacggggcttaggagggactgtgtcatcccttcatctggcaacctcatgaccaccaacagggctgcaaacaggatgcggctcgagattctcgactcggaagtcccatacaggcttgtagagcccatacgaaggcacaactttgatgttagagatagggcactctatatagctgttcaaccaaggggaccagcaactcaggtttatgggtcttcttctcacttatgtgttgcggattcgaaatcatatattctcataagtcaacttcctcctaatgtatatgaaaaatatgttgtggatgttaatactgcgcatctatccggattcacttttgtgataattagtattgtatatcttgctggtggcaaaattccagaagaaaatctatggagccaaatgaggaggatgggtttgggtgaaactgaggcaagtcatccagtccttggaaatgttaagcaagcattggaacttcttgttcagcaaaggtatttacagaaagacaaagttaatggtcctgaaggcaataccgtatattatgagcttgccgagagagctttagatggacccatgaacgacagggttaaggaatatatctctcaggggatggatgagcatcaaaagcaggccaagcatcccaactatgttggtacccatgagcttgattttcttcactccttacctttccctattctttcaacttctttgattgctattaggtga

SEQ ID NO: 15744 - DNA, 402 bp, Glycine max
  Peptide Sequence Number=SeqID_132522
atgaaacacagagaaaaatcaaagagaggaaaaaagaaaccttacaagatgagaaggctagggtttcgtttggccttcgaggatgattacagggtgtttgattttggaccgtcaattcctggcgatgcttgtgcttccctaaagggtcatcgccctattattagattgtggtctgacaccacatctcttcaactacccacattggggttgaacgaggaggttctggaggtgtcctctaatacttccgtctcgatgatgatttcttcagcctctactccagaaaaggattcgtcttccactagcagtggagaatttagcaaattctcgaccttcttgaaccaacttcctaagagggtggtcgataacattgaaaaggttccggatgtgggaacgagattctga

SEQ ID NO: 15745 - DNA, 780 bp, Glycine max
  Peptide Sequence Number=SeqID_132523
atggtggtcctcactttcactgatgagtttactagcaatgtcaagccaagaaggttgttcaaggctttgatccttgatgctcctaacctcattcccaagctgatgccggaagccattaagaatgttcaactggttgaagggaatggaggccctggaagcattcaggagataaccattgctgaacgtgataacatcaaacacttgaagcatagaattgatgcaatagacctagagaaattgacttacagctacgcagtgattgagggggatgcagcactggaaaaagtggattcaatttcacatgagatcaagtttgaggccactgaagagggaggctgcaagaccaagaatgtcagcaagtaccatcccaaagaaggggttgatgttaaaggggaggatttcaaggctgcaagagaggaaggtttggctctgctcaaggtagtggatgcctatcttgtggcaaaccctgaggcctatgctgaaggaaatataaatagcgttcacttcaaacttaacatggaggttctcactttcacagatgagtttactagcactgtccagccaggaaggttgttcaaggctttggtccttgatgctccaaacctcatccccaagctgatgcctgaggccattaagaatattcaactggttgaagggaatggaggccctggaagcattcaggagataaccattgttgaaggccagttaattgggatccaaggtggtgtggggaaattggcatatgagagctcaaaatacccacccaattgcaaaccctga

SEQ ID NO: 15746 - DNA, 573 bp, Glycine max
  Peptide Sequence Number=SeqID_132524
atgaaggtgctggagaaatgtgctattgatgttgaggcttcaaacaagtttaataagaaggaggttatgagattggagtctgctttgggtactactgagaaggaaagagatgccaaaatagaggagaaaatttggattaagcagaaaacatataacgaagtttacaaagctcatgatttcgaattcaatcactacctcctaaaagtactattccattgtgagcggggcactagatggtgggcaaccaactacctccctggcgaaacccaaatggctaatcccggcgaggatgatgttttatcttcttctatcggcaaatcctcttacaatggtgttgatgacacatctcaattgatcaagggatttttcctccctttctctagaccagctttggcttcttcgccttttagtctgagagtgatgactacaatccctttctcttcctttgtcatggtcttgcctatagttgttgtgacgccaataggattgaggcttgtggataaaatcctttgggtgccccatcttgatgaggccctctatcttgtccttcaagacactacactcttcagttga

SEQ ID NO: 15747 - DNA, 378 bp, Glycine max
  Peptide Sequence Number=SeqID_132525
atgggaattgtcaccactgaaagcgagctagtttctgccgtggctcctgcaagactatacaaaaccattgcccttgattatagcaattttttcccaaaagttttaccaaacttagtcaagagtgttgaaatcattgaaggagacggaaggccgggagcaattaagaagttcactattcctgaaggatatgtgaatcaaaaggcagatgtggtcgacgtaaataattacgtgtatgactacacaatagttgaaggcaatgtgctctctgatagagaagataagatgtgtaatgagtacaaattggtggtaaacctgatggaagatgcatcatcaaggtcacacgcaagtactacaccagaggcgatgctcaactcataa

SEQ ID NO: 15748 - DNA, 839 bp, Glycine max
  Peptide Sequence Number=SeqID_132526
atgggagccacaacttttacacatgattattcatcccctgttgctccatcacgcatgttcaaggccttgatcactgactctagaactttgctgccaaagctcttaccacagatcataaaagaggtcaatctgatccaaggagatggggaagctggaagcattgagcaagttaactttgctgaagctttccccttcaagtatgtgaaacacaggattgatgaggttgataaggacaactttgtgtgcaaatacactatgattgaaggagatccattggaggacaagcttgagtctatagcttatgaagttaagtttgaggccactagtgatggaggttgcctttgtaaaatgacaaccaaatataacgtcattgggggttttgaagtcaaagaggaagagataaaggaaggaagggaaagctctcttggagtctgcaagacaaggaagattgccaccatttgcaacattgaaccaattgagtctccatctcaaccagaagaaccatcatctcaaccaacagaaccaaaacctgaagaaaatgatgcacaaaaccatgaagcaacacaacctgtagaaatttcaccaactcaagcagaatcccaagaggagcccccaaaagaaacaccacctgaggcaacaccatcaccaatacatgcagggaataatcaaaaccagcaatcaccaagaaccaaggatgtaggagaggttcatgtgatgcaccacaatccaaccaactttggaaacagatttggttctggccacaactatgctggacattggggagatagatatagataccataatagtccaacatttcttcaagagccaccccaaccaat

SEQ ID NO: 15749 - DNA, 384 bp, Glycine max
  Peptide Sequence Number=SeqID_132527
atggaaacgctgaaggtgaaagaccttgtggatcatctttcgggtggatggaatgtgcctctcatcaataatttgtttgaacctcatgatgctcaagccatcctccaaagtcgtgataaacgctcactgactatgaaagatcgagtgagaatgagtggtgattggaagttgatttgggagttggaagtgcctccgagagtgaagatgaaacatgttgtagatgcacttacccttcaggcagaatcttgccttcaaatggtgatgatgttatttatatttaaccaagtgtgtagtgataagcgaaagagagtagctatgctgctatggtgtctttggcggcagagaaatgaaaaactttgggacaacatagatagatatttctga

SEQ ID NO: 15750 - DNA, 255 bp, Glycine max
  Peptide Sequence Number=SeqID_132528
atgaataaatatccactggacactgtagcatacacagttggcatctgtgcacttcttagaggtagaagaactcaagaggcttgcacattgtatgaccagatgaagaacgatggcatgctgatggtgtacaagcaaaacataaaacatcaggcagaagataatacagagtggaacctaattctggatacatccagttctgaagatctgtcagatgtagctgcttcagttggttggtctcttatgcttgccatgtag

SEQ ID NO: 15751 - DNA, 3963 bp, Glycine max
  Peptide Sequence Number=SeqID_132529
atgtcttacatgcaactgtctcagaagttttacgatgctttcaagctgtgtgggtccccacccattgctcgcaaacttcatgcccaactcatactctccggtttggatgcttcccttttcttactcaacaatctactgcacgtgtactccaactgcggcatggtagacgatgcttttcgcgttttccgcgaggccaaccatgccaatatcttcacttggaacaccatgctccatgccttttttgattcgggtcgaatgagggaagcagagaacttgtttgatgaaatgcccctgatagtgagagactccgtttcatggaccaccatgatatccggctattgtcaaaacggcctccctggtcatagcatcaaaacttttatgtcaatgctccgggactccaatcatgacattcaaaactgtgaccccttttcctatacttgtactatgaaggcttgtggctgccttgcctccactcggttggctcttcagttgcatgcccatgtcatcaagttacatttgggagcccaaacctgcattcagaactcccttgttgatatgtatattaagtgtggagcaatcactttggctgagactattttccttaacattgaaagcccaagtttgttctgttggaacagtatgatttatggatattctcaattatatggaccctatgaagctctccacgtgttcacccgaatgcctgaacgtgaccatgtttcttggaacacgctgatctcagtgttctctcaatacggccatgggatccgctgtcttagtacgtttgtggagatgtgcaatctggggtttaagcccaatttcatgacttatggcagtgtactcagtgcatgtgctagcatttctgatctgaaatggggtgcccatttgcatgctcggattcttcgcatggaacatagcctggatgcgtttttgggaagtggtctcatagacatgtatgccaaatgtggatgcttagcactggcgaggcgtgtgtttaacagtttaggggaacagaatcaagtttcttggacttgcttcatttcaggggttgcacagtttggacttggtgatgatgctttggcactatttaaccaaatgaggcaggcttctgtggtgttggatgaattcacccttgcgacaattcttggggtttgttcaggtcaaaattatgctgcctctggggaactacttcatggatatgcaatcaaaagtgggatggattcctctgttcctgtggggaatgcaatcattacaatgtatgcaaggtgtggtgatactgagaaagctagtcttgcatttagatcaatgccactaagagataccatatcatggacggccatgatcactgcattctctcagaatggagatattgacagggcccgccaatgttttgatatgatgcctgagcgtaatgtcataacttggaactccatgttaagcacatatattcaacatggcttctcggaagaagggatgaagttgtatgttttgatgagaagcaaagcagtcaaaccggattgggtcacttttgcaacatctatccgggcctgcgctgatttggctactataaaacttgggacacaagtcgtatctcatgtgacaaagtttgggcttagttcggatgtttcagttgcaaacagtattgtcaccatgtattcaagatgtggacaaatcaaagaagcacggaaagtttttgactcaatacatgtgaaaaacctgatttcctggaatgccatgatggcagcatttgctcaaaatggtttaggcaataaagcaatcgaaacatatgaggctatgttgaggacagaatgcaaacctgaccatataagctatgttgctgttttatctggttgcagccacatggggcttgtagttgaggggaaacattattttgattccatgactcaagtgtttggcatttctccaacaaatgagcactttgcttgtatggtagatctgcttggccgagcagggttactaaaccaggccaagaatttaatagacggaatgccttttaagccaaatgccactgtttggggtgctctactaggagcatgccgaatccatcacgattcaatactagcagaaactgccgcaaagaagttgatggaattaaatgttgaagattctggaggttatgttcttctagcaaatatatatgcagagtctggggaactagaaaatgttgctgatatgagaaagttaatgaaagtgaaaggaattcgaaagagtccaggttgtagctggatagaggttgataacagggtacatgtgtttactgtagatgaaaccagtcatccacagataaacaaggtatatgtaaaactggaggagatgatgaagaagatagaagatacaggaagatacgttagtatcgtctcttgtgcccataggagtcagaaataccatagtgaaaagcttgcttttgcttttgggttgcttagtttgccaccttggatgcctatacaagtaacgaagaatctccgcgtctgcaatgattgtcacttggtaataaagttgttgtccttggtcacctcaagggaacttatcatgagagatggatttcgatttcatcatttcaaggatgggttttgctcctgtcgagactactgcacctcaacagatcctcaggcacccaaattactagatgacattcttcggcgatactcacagcatgatctatttgctgcttttaactatcttaaagagaaaaaagttttggttgtacatccttgtgtatttggaaaaatacctaatacctattcaagctatgaaattcacttcaaaatcattggtagccacacactcttgggacgtgagtttggaactaactcaatcccaaaagttgggggcactggcaatgaacgttttgaactatcacaacatttcttgcagagtgtttccaagtcaccatttccatttaatactggaaagcaagctgttaaattttctgcatggctggaggaaagaggcaaagacctcacagaagtgggcgctaatcttgctgaagatctacaatgtggggacatttttcatttgcttgctttagtctcatcgggtgaactttcaatttctccattcctaccagataatggtgttggagaggctgaggacttgagaagtgcaaagcgtaaatatgatactaccgagtcttcatatagtgataaagccaaaaagtcaaaatccttctttggagtagaaggtgaaattatttctcgtcgggaaaaaggttttcctggtatcatcatttctgcacaccaaacaacaatttcaagagctgatattttaaatttgttgaaggataatgataactatggccaaacttttgacgaagatttccaattaaacattggccaaagcagtaattattcacttcctgacaatatcttggaaatcactaaatcttctgaccctgtacctctggaagaaaatcatagtgaatcaccctgggaagctatggcaggctatgcacgacatttgttgtcagaatattccaataaaaaacatgcatatgcaatttgtgctgaggtcttcagggttgtttatgctgccatccaaaaggctggtgaccaaggattaagcatgggagaaatttcccgggttataaacttgccaggagcagagacagatgtcttgattgttgatgctcttcaagcatttgagcaagccttaaaggttaatgcttatgatactgtccgtgttgttgatgtcttataccgtcacaagtactttttgacacctatgtctgattttcatctttgtgttgtacaaccttcctcaacaaaaaccatcaagaaaagtgatcatacatgtgagctttatgaattggagatttctaacagaatcataaaagaagataagaaagatattttgagagagagagaacttgggaagcaagaagtgaaaaatgatattaagccgctgaactttgtgttacagtttggtatatataggctagaatag

SEQ ID NO: 15752 - DNA, 288 bp, Glycine max
  Peptide Sequence Number=SeqID_132530
atgaaaatatccacaagggtgctcttcatcattggcacgtcgtctgtggctgcgacacatggtagtggcgccactgccactggcgacacaggtggtattgccacctgtactgacgctttggccatgcaaggtggagtcgctgcttttcaagtggatggcagtagcttttcagctttatggcagtgtcccaatgtggatggcagtagcttttcagtggatggcagtgtcacagttcggtgcatccagcttttggaagaaggcgcaatcacgtttggcgatttaggataa

SEQ ID NO: 15753 - DNA, 516 bp, Glycine max
  Peptide Sequence Number=SeqID_132531
atgttaatgtgtaatgatcaattttcttgtgttggtccgattgagttattatgcaccgttggaagaacaccagatggaataataaacttacttgaacgcactatgccccgtactcatgacgcgatcctgtattacaacgggaaatggaacatgccaccgcagaacaaatttgttggatgcgcgttcatacgaaaaaatcctaagaaatttcaaattccttcaacatgtaccatcgatgaactgaagaatttaataaagcaagttgcacctaaagggattccccctcttggaattcacgaatcacaaacggtaagacgattatttttccaccaaccagctcgctttgagtattcagatacgcttataaaatatgaaataaatgagttgatgaccaacaaagaactgctgaaggtgttagtacaatctaactactggaaaaaatatggaccaatagaaattttagctgtatttactaaatatgttgtgaaaattgaagacgaggtcactgggacgtag

SEQ ID NO: 15754 - DNA, 450 bp, Glycine max
  Peptide Sequence Number=SeqID_132532
atgggtgttgttactcacgaatacgacacccctgccgatgtgcctcctactaggcttttcaaagccatgacactagatttccataatctctttccaaagattgtggatagcatccacggtgttgtattcatagaaggaagtggtggtcctggaaccatcaagaagatgaccatcatagaaggccaagttgatgcaattgatgaggcagcctatgtatataacttcagcataatcgggggcactgccttggctgacacattggagaaggtttcatttgaaagcaaattggtggaaggctcaaatggaggatccattaggaaggtacatgtccaatttttcaccaaaggcaatgctacatttagtgaagaggaggtgaaagctaaccaagccaaggtcgaagggcttgtaaagcttgttgaagggtaccttttggcaaatcctgattactga

SEQ ID NO: 15755 - DNA, 232 bp, Glycine max
  Peptide Sequence Number=SeqID_132533
acaattctgtgcaatcatcaatcctcctcaggctggcattcaagccgttggatcttgtgagaacactgagaggagggtcgttccgggttcaggtgctgaagagttcaagtttgcttccttcatgtctgtgaccctcagctgtgatcatcgtgttatagatggtgcaattggtgccgaatggttaaaagcattcaaaggctatattgaaaatccagagaccatgttgttgtaa

SEQ ID NO: 15756 - DNA, 468 bp, Glycine max
  Peptide Sequence Number=SeqID_132534
atggagcagaagcagcagagcatagaccccttcaaaggcaaaacaaggttacccagttttgctattccagaaagatatgaacttcatttaatacccgatctctctgcatgtactttttctgtcaccgtgcaaattagccttaccatcaatgcaagcaccgagtttcttgtcttaaacgccctggaacttgtcatacaaaacactcactttaccaactctcaagggcagcagcacattccacatgatgttgttgtggataatgatgatgagatactagtcctagtgtttcatgagttttctgggattctcaatgagcacccaagagggttctacaaatgtaatactatcatgaaccatgattattattttggatcaacgctttacatattagttgccaccaataataatccaaatactgttatgtgcttggagaaaaataatcctgtacttccattggccctaaaatag

SEQ ID NO: 15757 - DNA, 381 bp, Glycine max
  Peptide Sequence Number=SeqID_132535
atggaagagaaatggatcgaaacagatcggccagagctcgggaaactgaattttcctttcataggcttcttgctttcctccgcttccttgttcctctgcttcttgaattgtcttgtgtgcttagcacgacactccgctaagtgcacatgtccagctggatcaagtgaccacgctctaagcgcaggatgcgcgcttgctgatgacaactgtgttttccaatcacttatcaacatatgtgaactgattcaatctattggagatgatttaaactcaaatgaaaagaagtatgaggtgaatagtcaagaaaatatatgggtcaaggtcaatgatgatcagagaggtttttatagggtaaactatgaaggcaagcttgcagtttga

SEQ ID NO: 15758 - DNA, 1232 bp, Glycine max
  Peptide Sequence Number=SeqID_132536
atgagaactgagactgaagaagaagaagaaaaggaaataggaattgataatgttgccactgcgccgccgcaatcgccgccgcaacagggaatggaagctgttggaagaaatgtcaagcgagcatatcaagtggaaaccgtcgaggagcataaaaaggaagatttagatgcgcagatttcaccgccgccgccggcgacgagatcaaaaggtgttcgacggaatgtcaagcgaacatatcaagcggaagccgttgagaaacatgaaacaaatgattttcctgtgatggattcacgaccgccgccggtgacaataaccaaaggtgttcgacgaaatgcaaagcgaacatatcagccagaaaccatggagaaacgcgaaacaaacgattttgatgagcagaattcacaaacgctgccgtcacctccgccgccgccggtgacacgaaggagaggagttcgacgaaatgccaagccggaaggaaatgattccgttgtgaagagttcacccccacctccaccacctccgccgccgttgcctgcggaggaggcgaggacagtgtcgggtaagaagaaaagagggagtgctactaaagaatttttgatatctttaagagggaagaagaagaaacaaagacaaagaagcgttgaaaattttgatatcattctaggttctgaatcattattttcacaaccccctccaccaccgccactgccaccacctaaggtttttcagaacttgttttctttgaagaaagggaaacacaaaaaccgtcacattgcttctgtggcaacaacaacaacaagcgtatcaaacaagagggatcatggttcttcctctaggttgcaagataatgtgacgatggctggcaatgagtcaccattaaaccctattcctcctccgccaccactgccgccgttcaagttgccggggtggaagttccgggtgcagggtgactttgttagggtagacagcatgggtagttcacgtagtggatcacctgatgatttggatgaagttagtgtggacacaccgacaactagtactcatgatgaaacaagccaagtcaatagtccttttgccaaagacagtgaagattctgcaagtgtgagtgcaccctcattgttctgtcctagccctgatgttgataccaaggctcacaacttcattgagagcttcagggctggtttgaggatggcgaagatgaactccatgaaggagaggcaggggattgggag

SEQ ID NO: 15759 - DNA, 519 bp, Glycine max
  Peptide Sequence Number=SeqID_132537
atggcttctaggtttcttcttcttgctcttcttggtgcccttgtttgcaccgttattgatgctaggaagcttgggagtgagaagggttcgtttagggatgagaagaacttctttcatcgtccagggtttggaggaggaggtggaggcggttttggcggtggcggaggaggagggttgggtggaggtgcaggaggagggttgggtggtggtgcaggaggagggtttggtgctggtgctggtgccggtgccggtgccggtgccggtggtggagccggaggagggtttggaggaggcggtggtggaggatttggcagcggaggtggagttggtggaggatcagggtttggaggaggagccgggtttggtggtggtgccggtgctggtggcggacttggaggaggtggtggtggagggtttggaggcggcggtggcggtggactcggcggtggtgccggtggaggatttggtggtggagctggagctggagctggagctggagctggtggtggatttccatga

SEQ ID NO: 15760 - DNA, 687 bp, Glycine max
  Peptide Sequence Number=SeqID_132538
tttcttgatgaactgaagcatataaagtggagacctccacatataggaacaaagcaggactggcaagatagaataaacaacatgcgaaaagggagaaaggaagtcgaagtaacagataaagttggcgatgtaagcatggcctctgctccattttatgatgaaaatatgtacatcctcaatgtgaaaaatgatcttgatgccaaggcttcagaagcaattccctcggttgaaggcttaactgctgcgaccaaataccccattcctccatcatctgtcctgaagcagttggctatagctattgagtctggaaggcaaacaaactcgatgaaagattttgtagcttcatcaagaggttcgtcacctgccagagagaaggcaggcttaagtctctcttcagtgaaggctttagtgttgcgtgaaaaggaggacaaactcacctctgagtttagtagtgatgagaaagttgtgtatttgattaattcattgtttgatcaagagggagagttccttaaaaggaactctgatccagaggaaactttcatatcatctttgccaagagatattcatggtgcacctcttgaaagcctagttgttaagctagctgaagtaatcggaaacttcaagacgcttcgagaaatgtctcttttttggtccagggttgttgatgaagtatgtttaactcaataa

SEQ ID NO: 15761 - DNA, 2196 bp, Glycine max
  Peptide Sequence Number=SeqID_132539
atgtccctcatacaatcttcatcactaccgcatgcagtcggaggaggctccatcgccatcgctgtcaatggtggccgccacagccactgtgccatcaaatgggcggtggagcacctccttaagaagaactcctcttgcatccttattcatgttcagaccaagaccatgcatccccatgatgttgatgacgtgcctaaagatggtcgtccaccaactaaagaagaattgcaccaattttttcttccctttcgaggattttgtgccagaaaagggatcacaacaaaggaattggtcttacatgaccttgatgttccaagtgcacttactaattacgttgttgtaaattgtgttagcaccgttgtcgttggtgctgctgcttccccctggaatactcttacaagaatatttaataaagatgatgtggcaactactttagcaaggtctttgccagatacttgcactttatatgttatatcaaaaggaaaagtacaacatatccgaccaacaggtcatcattctcaacatattaaagtcacaccaactagatccataagagacacggtcactctcttgcaaaatactccattagttcatccaaataagaatcttgttgatgcccctacagattctgaagatacacacaggaaaccaatcaaagatgcaaatattgggcgagagtccagcaaactttgggaatctttacgagaaataaaagatttcatgctaattgaagataccaattcaccaagaggtccagcagaatacaacttatcacaaaattcatcagctagaagttctcctggaaacagtgacagcacagggcaacatcttggtccttctttgcttgacaagtcacacggaaaccatgaagttgtaaactcagacaagcctaagaacatcgcttcttcaaaaagcccagtaaacttagacatagaaatgaagaaactgaaactcgaattgaaaaaaacaacagagaaatatggtatggcttgcaaacaagctgttttagcaaaacagaaggcaacagagcttgaaaagtgtaggcaagaaaaggaacgcgatttagaggaagctaagcttgctgaagatactgcattggctttggtagaggtagagaggcaaaaaactaaagtagctatggaatcagtagaaatgtctcaacgcttggcagagctggaaacccaaaagagaaaggatgccgaattaaaagccaagcatgagaaagaagagaggaacaaagcattgcatgaagttgtatgtaatagtattccatatagaagatacaaatttgaagaaattgaagcagcaacaaataaattcgacaatactttgaaaattggtgaaggtggatatggacctgtttttagaggagtcattgatcatactgttgttgccattaaggctgtgagaccagacatagcccatggagagaggcaatttcaacaagaggttattgttttgagcaccataagacatccaagcatggtgctcctcctaggagcatgcccagaatatggatgccttgtgtacgagtacatggaaaatggaagcttagaagatcgtctattcatgaaagacaacactccaccaattccttggaaaacacgtttcaaaattgcattagagattgccaccggccttcttttccttcaccaaacaaagcctgaacctcttgtgcaccgcgacttgaagcctgcaaacatcctcttagacaagaactatgtgagcaaaatcagtgacgtgggtttggcacgacttgttcccccttctgtagccgacaaaactacacaatatcgcttgacaaatgcagctggaacattttgttacattgaccctgagtatcaacaaacggggttgttgggtgtgaaatcagacgtatattcattaggtgtcgtgctgctacaaattattacaggaaaagcgccaatgggtttgtcacacttggttgagaaggctattaaaaatcacactttcagtgaggtgcttgatccaagtgtctcagattggcctgtggaagaagctttgtctttggctaagttggccttgaagtgttgtgagttgagaaaacgtgatagaccaaatcttggtactgttgttttgcctgagctgaatagaatatcaaggatatgggactgtgatgacacgcattatcctagaaattgttatatgattcaagaccatctggatcctaattaa

SEQ ID NO: 15762 - DNA, 294 bp, Glycine max
  Peptide Sequence Number=SeqID_132540
atggacaaagatcaatggacgtatgactatacgatgtcacaagaagttcatatggattatgattatgataataaagaagaatgtggtgtgaatgaaccacatgttgattgttcgaatgcttttaatacgtctcagtgggctcgaacagttacccatgaaaacggatttgttgtagtgattatgaggtctgacacagataccggtagcagaggaagaagttcatttgtcttaattgggtgtgaaaggagtggcttcatgggaaaccagtgcatggaggggaaggttggatggtga

SEQ ID NO: 15763 - DNA, 318 bp, Glycine max
  Peptide Sequence Number=SeqID_132541
atgtcgccgtccagtgaaggtttaatattggtggtacgcatctcgtcgtttgctgttgatttgttagagaaggtgaacagtaaaatggtaaaaactttttccgaaagaagaattgtgaacttccggaagaaaaactgtgaactttcggaagaacttcttccggaaattccttccagaagaagaattgtgaacttccggaagaacttcttccaaaagaagaactgtgaactttcagaagaagttgttccggaatcttcttccggaagttcacaattcttcttccggaagaagttcttccggaatattaattttttttaa

SEQ ID NO: 15764 - DNA, 1764 bp, Glycine max
  Peptide Sequence Number=SeqID_132542
atggctgctaatcttcctgcagtaaacgccgctcaggcggggaaaccgcgtctgcgtaaatcgctcaaactgtggcaagtggtaatgatggggctggcttatctaacccccatgacggtgtttgataccttcggcatcgtttccggtatcagcaatggccacgttccggcctcgtatttgctggcgctggctggagtgctgttcaccgccatcagctacggcaagctggtgcgccagttcccggaagcgggctcggcctacacctatgcgcaaaaatcaattagcccgcacatcggttttatggtcggctggtcctcgctgctcgactatctgttcctgccgatgattaacgtccttttggcgaagatctacctctccgcgctgtttccggaagtgccgccgtgggtgtgggtggtgacctttgtcgccattctgaccgcggcgaatctgaaaagcgttaacctggtggccaacttcaataccctgttcgtgctggtgcagatctccatcatggtggtgtttgtgattctggtggtacaagggctgcataagggcgagggcgttggcaccgtctggtctctgcagccgtttatcagcgagaatgcgcatctgatcccgattattaccggcgcgacgattgtctgcttctcgttcctcggctttgacgccgttaccacgctttctgaggaaaccccgaatgccgcgcgggtgatcccgaaggccatcttccttaccgcgatgtacggcggcattatttttatcgtcgcctcgttctttatgcagctgttcttcccggatatccatcgctttaaagatccggacgccgcgctgccggaaattgcgctgtatgtcggcggcaagctgttccagtcgattttcctgtgcaccacttttgttaataccctggcatcgggcctggcgtcacacgccagcgtgtcgcgcttgctgtacgtgatgggccgcgataacgtcttcccggagcgcattttcggctatgtgcatccgaaatggcgtaccccggcgctgaacgtgattatggtgggcatcgtcgcgctgtcggcgctgttctttgacctggtgaccgcgacggcgcttatcaacttcggcgcgctggtggcctttaccttcgttaatctctcggtatacaaccacttctggcggcgcaaggggtataacaaaacctggaaagatcgcttccactatctgctgttgccaatggtaggcgccctgaccgtgggggtgctgtggctgaaccttgaggcgacctcgctgacgctgggtctggtgtgggccgcgctgggattgctttatctgacctacctgacccgccgtttccgtaaaccgccgccgcagtttgatgcgacgaaagcggagcaggcctgggagtctgccgatgacaatatccccgccggagctgttctcaatcagatcgcgcagttttatcttcgggcgcctaatccgaacgcgcgttggcagaacgaggctgcctggttaccgcatgagcttgcgctgctggataaaaattatcgctcagcggtgtatacggatgtcaccgtgccggaagtggttacgcaactcatgaaaaatagcggctacttcaaagggtataatatcgatttcgacaggctgagttacacctatcctcgaagggaaatgattattcagtggaaagaaacggatctgcagtttattcgtcgactgttggctgaaattggcatctggtttcgttttgagaatcaccataaggttcagacggaaaccgtg

SEQ ID NO: 15765 - DNA, 393 bp, Glycine max
  Peptide Sequence Number=SeqID_132543
atgggtgaagtagacgaggtgcaagaacagataaaggccaacatagaggccctgaaagagcaaatggccacaatgatggaggccatgatgagcatgaagaagataattatggtcaatgcggctgcagatgttgctaccagtgtcgttgctaatgtggacccgactcccccatctggcctcaaccaaataaatcatccaacctcgaatatggtaggccaaggaggcagggagttgggaagtacggacgatccccagtttgtgcaagttcagaacaagcatgccttcctgccatatggcttgcctcccaagtacacaccacctaatgtggtgcacactcccgataagagttgtcataactccactctcatactcgttgagagccaacaaccttaa

SEQ ID NO: 15766 - DNA, 537 bp, Glycine max
  Peptide Sequence Number=SeqID_132544
atggcttataggaaaagaaaggcaccctctacacctacccaagccagatttgatagatccagattcacctcccaagaggcttgggagagatacactgacattgtggtgcctcgtaagcttttaccagaaaggaatgtggtagtctactatacagagtttgatgagttcaaggaggaactcgagagatgccattgggatgaggagttcactgaatttatggacggcaatattgatgttgccattacccctgttgttgtggaagagggggaaacactttgtgcttactctagatttgcactcctgaggcctaatcctcaagacttagctgctaagctctgtatcccagggaggggattcgagcttaatgctgatgggcagcctttgaagattctgaggaagaacatgaccactcttgctcagacttggagcgttctttccttttctaacctcatccacacttcccacacttattatgtcactcttgacagagccaaactcatttatggcatcatcatgaagatggacatgaaatgtggg

SEQ ID NO: 15767 - DNA, 300 bp, Glycine max
  Peptide Sequence Number=SeqID_132545
atgaattgcgttttcgttcatgtgtcctccaccttcgagtttggagccatgcgtagtgattgcttagtgcaattctccattctcaacccttttcggagccccatgaattgcgttttcgttcatgcgtcctccaccttcgagtttggagctatgtttcatgattgtctaagtgcggaccctcaaggaaatcctccattctccacctatttttcggagccccatgaatgtcattgcctagcactgttcatgtgtcctcccttatccagcgcgaagcctctgaaaagagtcgtcatggattaa

SEQ ID NO: 15768 - DNA, 681 bp, Glycine max
  Peptide Sequence Number=SeqID_132546
ataccggcccaccacgggggggctgcgccgttggctggaaacctagaccggtgccagtgcagtgaacggtgcccacggcaggttgcgcagcagcgcatacccgggcagcacccagagccagaacacgggattggccagtacccgcatcagcgggtcgagcacgcgcgggcggatgccggcgatgttcagcagcatcagcagcaggaacggcaggctgatgaccagcagcgggttcatcgccatcgcgccgggcaggtcgaagtggaccagggaatacaggcagcgcgtgctgccacagcccgggcagtacaggccggtcagggcgtagagcgggcagctcggcaacggattgccggcgacatacggattgacgttgcgcaggaccaccgtggcacccacggccaggccggcggaaaccagcagcggtgcccagcgggcgagtcgggaacggatgggaagcgcggacatgcaacaacggatccggcgcaggcgccggatccgtccaggcgtatcagtagccgctgttgctcatcgcgcccatgccgccgagcacaacgaagaacagcacgtacagcacgaccacgacgacccaggcgatggccgaccagatggcccacttcttggccttggcagccgaatcctgggcgccggcgatgtcgccagcggccagcttgccgttga

SEQ ID NO: 15769 - DNA, 5262 bp, Glycine max
  Peptide Sequence Number=SeqID_132547
atgacggagtgcaggcgcacagatggcagtcgtggtgttgctcaacttttatcagggacaggactttcaaaaagggatgctgcagagctaagggagcgatgtttctccttccttctacaaaagctagggtggaatgctcatatttgtatttttaatgtgttggacaagttggaaatgttgcctaaattattcttacaggttgatgaaagtaattcaaacctttcaagaattggaaactatggttggggtgaatttggcaccactatggatgtgtcacatagtgatgatttatttggcattgatgcattctatatcaataaaggtattggcatttgtgaggatggtgggtttgaattcaaggcacctactacttgcaggaatgctctgagagttttgcgggctatgcagcttccaaagcctgttttactggaaggtagcccaggtgttgggaaaactagtttaatcattgccttgggaaaatgttctgggcatagagtggtacgaataaatttttctgagcagactgatatgatggatctgttagggtctgatttacctgttgaaagtgatgagggaatgaagttttcttggtctgatgggatactattgcaggccctgaaggaaggctgttgggttttgctggatgagattaatcttgctccacaatctgttttagaaggtttgaatgctattctggaccacagagctgaggtgtttataccagagttgggtaatacttataaatgcccaccatcatttagagtttttgcttgtcagaatccatcacatcaaggtggtggccgaaaaggccttccaaagtcattccttaatcgatttaccaaggtgtatgttgacgagttagttgaggaagactacctatctatttgtgaatcaaaattttcgactatacctagaactttactctcaaagttaatcatattcaataaaaggatgcatgaagacaccacagtaaatcaaaagtttgccaaagatggcttcccgtgggagttcaatcttcgtgatgtatttcggtcttgtgagataattgaaggtgcaccaaagtactcaggattatactccttctttaacattgtttacattcagagaatgcgtacggtagatgatcgaaaggaagttttacgagttttcaaggaggtatttgaggtgacaccgtttataaatccatatcctcgcattcaactcaattcacatcatttaattgtggggaatgctactattaagaggaatcatgtccaattaactatgtcctcaagcaaacagctcctgatgctgcctgaaattcgtcaaagtttggaagctgctgctcaatgtgttgagcgtcaatggctatgcatcttgactgggccatcatgctctggaaaaacttcattgataagattacttgctaacctaacgggcaatgtgctcaatgaagtaaatctttcatctgcaactgatatatctgaattattaggatcttttgaacagtatgacgccttgcggaatttttccagagttgttgctcaatttgagtgttatgttaatgagtacatcagtttgcaactggagacttcaaatgtagcaattttcagggaaacagatttttatatcagatggatggctttcctttctggattgaaatttgacagcttgtcatctgctacaaattgttttgaaaacctatgttctctcattggacaactaaagttgcagatacaaaagaattctattcctgtatcttactcattccatgaacttgatttggccatgaagacagttttgaagatgaaagcagatgctgtttcaaccaaatttgaatgggttacaggattgttgatcaaggctattcagcaaggggaatggattgtcttggagaatgcaaatctatgtaaccccacggttcttgataggattaactcattggtggaaccttgtggttcaatcacggtcaatgagcgtggaattgttgatggaaacccattggttattcatccacaccctaatttccgcattttcctcacagttaatccccactatggtgaagtttctcgagctatgcgtaataggggagttgaaatctttatgctgcagccatattgggcattagatgataaaagtgggtacaatgacgaggatgttgaattcaaagatgttaggaggtttcttgttttatcgggtattccgattggtcatttggttgattcaatggctagagcccacacttatgctaaaaataaaggttcagaacttaatgatcacattacatatcttgaactctcacattgggttcacctgtttctgcagcttctcaagaatggttgttgtcctatttggagtctaaaaataagttgggagcatatatatctctcctcattgggtgttgagggagaaaatataatcaattttgccaaaactaaatatttatcagtaactaatttggctgggtatgatgatttgacagcgtgtcctttgggtttgcctggaggatggccattgccactcactgtaagggattatgtatattactcaaaagaagcttctatcaaacagaactgcatgtatctggaattcttgggaactcagattgcatctcatcaatatcaagttgctcgtaagaggcactcaacaacttgtttgcagactcctaatgatcatgtgagggtatatttgatggatttgatgactttacatgaacttatgtttcctaaggcttcaaatgtgatgatttcagatgaaagggagtgcaaatttgactcagaattgaccaataagatgctatactttgcagccaattggacaattgaacaagctactgaaagtgattttaagttctatcttctcaggtttaagtggtttagttctcaaatgcagcccttctgccagttctttagtaactttctcatagtgatagaacagatgatcaagcatcctatttgggagtatatttcatgccgtgacaaactagatgttgatttgaagttaatgccattgttgtcacttgatttagtcaatttggccccatcaaataaaaaaattaaatatctttgtaatgctgttagtttctttgatccactaaggttaacttaccagcaacggaatattgagagccagcatagttttgatgacgaagccaatattgagagccagaatagttttgatgaaaaagccagttgcttcattcaacttttgaagtctcttcactttttgcaagatgaaatacttcacaaatttgtcgcttcaactcctaagctaattgaggaccaatcatttgattataaactacagttatactctaaccttattgaggaccatgtttttttttggcgttacttcatatcttcgaagtttatagatatctgtccagaagcagtagatcagatgataatttcttggcattctttggtgaaagatgctcagaagtttacagatatctgtccacaagcagtagatatttttttgatggagagcaaaaaatttgaggagttttctttttcagtaaattcagaaaaatctttactgtggattcatggtggtcacccatttttgccctcttcttctgatttacatgatcgacagcatcagctttataaatttgttgaaacaatttggccaagaaagacaggatcctgctatcaaggaattttgagcagccatcttgctgacgttgttgcatcatttgatcatgatcttcgcttcctggtgacacaagatgtttcaaactcatcatttttaatggcaaaatggagtcatgaggatggtattcatattgtcaagaagttggaggagatgcatcagatagtattgagaaggtttgaacatgaaaaacacaagttgcaattaattaccggatccaaagacctttcagcttttgctgaaaattcacctgcttgctgttcatttacacctgaaatgttgtgtgaaaaatctgtatttgaggcctggcaggatacgtttcttccggttgattataccagtttattctgtgacatggagttattacagaagctcacatcaattcatttggatgatcttgaagggttacaccaagctgtgggacgtctatccaaccttttggactttgctttgaaattttcattgagtttctcatcaaggcctccacaaatgttttttccacaccaaaagatattgtgcaccctgaatacatgggcatccgtggatgcagtaaatttgaaaattgcaagctttattctggagatgtggtttaagtggcatgaatctttgtgggtctatttccctaaatctgtgaagggcgttgcaaggattgatggctctgatgaaattgtagtaccccacatgctcgttgagcctttcagtgcatcaactgtgtttcagatcacgcaatgcatacatgctatcaaggagttttgggtgcaatgtctcaagtgtcgagttaccttgttgaatttgtggcattgttctcatcatggaacacatctgccggattttcttttatctgctgctcgctctcttttccagcagattatttatgcacacagaaaatcttttgatgcagttcaatttgctagaattaaatctattttttgttcttctgagaagaatgtacttacgtatgaagaaagaaagaaaaactttgtcacaattaacaatagccaagcttatcagactcggaccggtcatcaactcggtcagggtattaggtcggggtccgacccagaagaaagcattgatttgctgagctcccttgttgcttcatcaagacaccacaggttgaaaaactcagtgcagaagttcatagttccactgcttagagagatgtatcttcagtctaataccgctgatttcaattatactattggttgtgcatgggcacgcattggagcattacgcattaatctgttgcttagcagtaaggacattgatcctgccatgaagtaccattgcaagtactctcagcttgtggaaacaatatcatcacttgaacttgaaattcaggtacggaaagagtgtagttatcttgctggacagtttttgacacaagaggctgacaaaagaaaagcacaaaggatggaaaagcttcaggcagagtgtcgaaagctacaaagaaagatcgtgtttcgtactgaaccaaggaaatacaagaagttaatcaaagaatgtgagaactttcttaaacaacatgatgctttggaagttttggtgagaagtaggggtactgctgaggaattacgagagtttgctgaccatgcttgcagctggcagatgtggaaccccccaaaataa

SEQ ID NO: 15770 - DNA, 318 bp, Glycine max
  Peptide Sequence Number=SeqID_132548
atgcaccttcttcttcttcttcttgtgttagccgagaaaaagaaaaagagtgttttgtgttgtgttgtgttgttgttgtaccttaacgtgcgcacccccggtgcaggaaatggaggctcacgcgagctccttcgtgtccaaagcgcgaactgcgttccattccgcagccgcgaaagcggagcgtgttctcatggacttcaaaatcgatctaggtgggtaatgattctgataagcaatttcacgacgagtttgggaggcagcggggcgatgaatctgctcggagtgagaaggtttgaagatgcattcatttgcttgtag

SEQ ID NO: 15771 - DNA, 5526 bp, Glycine max
  Peptide Sequence Number=SeqID_132549
atggatgagtatgctgcatattgcgacattattcaaccaattcaagttgctgtgtatgagatgaaatttggattgtcactggtgttgtctagtatctgggaaaaagaatgtttgaatatacttgggcaggaaaacatcaacacggttatggaaatgatatacacgcttatgcgcttccctcgtgctgcttcatgcaagttcatttctgttaagcatgacattgggttggacatgcttccttcataccagctagattcttctactggcttttatttggtggatgcggatttgatggaaaggcttgttactctttcaaataatgttgctgctgataagaaggtatctgtggtgcaatgtagagctgctgctgtctattggaacattcttgttaaaattgcacattttacagctaatgcaaaaataattgatgataaatcttatatgctcatgcacaagatattcgatgagtttgccatgctttggttgaataggaaagattatgcaaagtcaaagagtgatattgatactcaacagtacaagtttaaacctcgagctttcgaaattgagagtgttattgaagatgaattaccacctcttgcaaattcatattcacctgaaacatttttggaatggaaggaattttcttatgatgaaaaatcttctgacaaaatggtaccccctgaggatgaagaatggaagaagctggaagagactatcctcagccatgtggttctcattcacaatcggttatttggatctagtgatctagtccagactcctggaatttttgaagtttctgatgaagatcggttgcattcctttattgactcgtatacattgggtattgatttaatcagaggtgtccactctacacatttgcctggtttagatgctaaactcatgccagagaacttattttatctctgtttagactacagaaagaagtatcttttgtctcacaaatctgctgccagatacaatttttacaaggattcaaatgcttctgagatggtacaaattttgaaagtacttgcacctctccaacagcagattcttccccttctaaatgagtgggaagatcgtaatgatcttcagaaatttttggatataattgagatgctcttgactctcccattggatacccctttagcaaagggttgcagtttttattgcacaaagctgaagttatgcaagaaaatggttcaaagttctccttctcaaatagaactggactcttggccatctttgcttgatgaggtgacagatcagtttgagaataatgcggggaaaatgttaggaagtcccacatcacttgcctcagttcttggatttaagatgaaatctaacatggtatcagagcctatagtccattctgttaaatcgcctattctagtaggctcacctgttctagcaggcatctgtggagaggtgttgggggatattctgcaagaacccgtgtctattttccttagacaagaagttgcacaaagaggagcgaaggcacaatcttttcatggtcatcagcccatttatgatgttctgaacaagggattggttgatggtgcttttgatttgacattgtttagtgaaaacaggttcatgtggtttgacaactgcatcgaggaattagaaagttctttgcagaacttgctgcttaagaaaacatcactattggatgttctacctttgcatcagaaaagtgttgaagaaattcaaagcatatttagaccttatggtgattcccagcggacactttacttgaagggatggagagctgtgtggtatacaattgaaaaaatatatactacagcagttgactatggtaatctttggaaagaggaaaaaaagggtcaagggaagagaagggctttgtctgagcttcttaagcttttagaaaacaatgggttgtctcgacacaagtcagcatatacagcactttctgggaacataccatatttactgctaacaaatagtagattaccatgtgtaacctcgggaattcctgaacttgaaaataagaatagtccagaagaaagtttgcttatggagtggaaaacagccattgattattacttcaagagtgttgtgtctgtcctgcttttgcagcagacatgcctcaatccacataaagatataactcttgaacaggttgacagttctagttctttcctcaatcagctcgttcagatacaacagaagcaactctctgctgccactgcatttgacaagcaattgaaatgctttagagaatgtgtatctactctgggaaaattgttttcattttcctcctccactgataacagtatgaattatatgagctctattatttcacaacagtttgctacttataagtgcatgtggcaacaaaaacaattatttgatactctgtgtgctacgtcacaagaagaattgcttttactaaggatattagaaaatagccatttaaacacttgtcaaagagaaagaccttcagcccggcagatgattgcttccattgaagaatttttttcatccttcagtaaatcaaaggaatcattggattgctatctaattgggaggaccaaggctgtcactgcagtgacttcttcctcgcgtttttgcattgttactcgagaaatggagcacctggtatctgaaaatttcaagaccattagggattttaaggataattttcttgagctacaggaccatgatttggatagaagcaccgttagaaaagttctgattcagcattttcaagaaatagctgacaaggcaaaattaattgaggaagagtttacaacagcaataaagggaaactccaatcaagtagattcatctgaagatataagtgaaagaaactttgtggagcttaatgccagattcaatgaagcccttatgtctacatatcagcaccttgcaactgtattgcagaatttatgtttgtcaagcaatattcctatggttgacgagtccatggaggaagatggaaccctcaatacatctggagatgcaagtgggacaggcatgggagagggtgtcggattaaaggatgtaagtgatcagattgccgatgaagatcagctgcttggaacacgggaacagcaaaatgaaaagcaagatgactctaatgaagtgcctagtagcaataatacagggattgagatggaacaggattttcaggctgatgcaatgagccttagtgaggactctggagaagatgacgatattgatggcgaaaatgaggaacttgagtctgaaatgggacccactggaccagacagtgaagcagtgggtgagaaagtttgtgatgagaatgaagatgaaactctcaatgatacaagagaaaagtatgaatctggaccttcggttaaggatagagatggaggaaatagagagttaagagccaaggatgactatacaactaatgaacctggggatggtaattgtgatgaagatgatgctcgggaagatgatactgtaaccccagatgacgtagaagatggagagaatgctgatgacatgactatggacaaagaagcagcacattcagatcctactgggttgaagcctgatgagctggatcaaactttggatatggatttggacataaatgaagatacagatctcatggaagatggagaattggatgagcaaggtgatttagctgagaatgaaaatgaagggaatcaggttgaagagacttgctctcctgatgaagttatggaagaggcacatactgaagttgatgtgaactctggaaaagatgatcaaggtcaggagcatcaagagaatgcaaacatgaattccacagaatcaaagaaagatgtatctaggccttctgagttgattaatgaacaagtttcccctgctgagttagcatctcagtccaaagttgattggcagacatctggttctgaaaatgtagcagcagagtcaaatgtgtctaatagtcatcatgactttgactctactctgttgggaggattgccttctagctgcatgtctgatatggatattaagatgtccgactcatcaaatagtgggggatttggtgaaaatcaacccaaatctcatcatccgcggatcgagcgttcacttattcaggagaagcatactaatcctcatcgaagtataggtgatgcacttgagtatcagaaagaaagagttaatgtatctggtgatcttccagaagataacagtgagaaccagggtgagatggaagatgaaaatgctgatgagtatggctatgtttctgaatttgaaaaggggacaactcaggctatggggcctgcaacactggagcaggttgatagaaacattgattgtgataagcttgataaagaatgtcttgctggagaagatgcaaaattgcagtttgagaaggaaaaatctgaaataaattctataagtaattcttcattgatccctccccaaaatgaaaaaagggagaaagtgaatacttcaaccgtggagaagtcacgagaagatggacctgtgaatcctcttgccagtatggatattgatctagaaaatcatttggaagatttggtttctttcaggaattcatacttcagtgagagcaatgataatataagccagccttttctgcatgacgaagacttgggtaaatgccaagaaccttatgatgtacctgatcatgtgaaagataatgctactgctctctggagaagatttgagcttagcacaacaaaattgtctcatgaattgactgagcaactgcgccttgtaatggagcccactgtggccagcaagcttcaaggggattatagaactggcaaaaggataaatatgaaaaaggtaattccttacatagcaagtgattatagtaaagatagaatatggctgaggcggaccagacccaacaaacgtgattaccaagttgttatagctgttgatgattcacatagtatgtcagagaatggctgtggtgatgttgctattgaagctttggttacagtatgtcgtgctgtttcacaattggaaatgggcagcttggctgttgctagttttggaacgaaaggaaacatcaagttattgcacgactttgacaagccctttactggagagtctggagtcaaggagcagatgatctccaatttgacattcaagcaagaaaatactattgcggatgagccagttgttgacctattgaagtacttaactaacaagctcgatactgcagttgcaaaagcacgacttccgtctggacataaccccctacaacagctagttttaataattgcagatggtcggtttgtggaaaagaagaaattaaagcagtgtgttagagatgtgtcaactggtaatcgaatggttgctttcttgcttcttgataattctcaggagtcaattatggatctcaaggaagtgtctgttgagggtggacagacgaaaattttcaagtacatggattcctttcccttcccctactacattgttctgaggaacattgaagcactgcctaggactcttgcaaacttattgagacagtggatggagcttatgcagcattcaactggttga

SEQ ID NO: 15772 - DNA, 3450 bp, Glycine max
  Peptide Sequence Number=SeqID_132550
atgattccatcactggataatagggacttgcaagagataatcaaagtgaggcatccgaatttggagcttcatgttggcaaactcatagaaacctttgaaagggttaactctatttccatggttcaagcgggttttcacatgggaagttctgcttctgtttattgtccctgcaggttctcattaagggatctccttaaatggtgcaaaaggattgctggtttaggtttttgctttgatggtaccttatcagaaaaccaatgttttagtgtgtatacagaggctgttgacatatttgcgtccttttcatcttcaattaaaaatcgtttgtcagtaatgaaagagatagcagggttgtggaaagtacctgtttctgcagctgagaccttgtatccccgtgacaaaccgataattcaggattctttcacagatttaagaataggccgagtttccctccagtacactaaaccgtcgttgcaacatcataaaagaccttttgttgagatacgcagttctctgcatgttttggagcgcattgcttgctctgtcaagtataatgagcctgtactcttggttggagaaactggtactgggaagactacaattgttcaaaatttggctttaatgcttgatcaaaagcttactgttttgaacctgagtcagcaaagtgatgttggtgacttactagggggttttaagcctatggatgctcagtctgtgtgtgtgtccctttataacgagtttctgactctctttaccaagacattttctgtagagttgttgctaatggcttcaatctatgctgctgttcagaataatcaaggcttgatcacttctatgcataaagttttagaagattatcgacaaaagttgttaattgataagaatggggaagctctattgaaaagattgcgaatagaagttggaaagtcagttaagcttatacaacctggatcttccaaaaagcgtaaaaggccattagaagaacaattaatccaagagtgggagagattttgtataaaactgcgtagtgtctgtcaaagtaatcgctcttcagcgatgatgttttcttttgtagaaggaagttttgtaactgctcttaaaaatggtgattgggttttgcttgatgaggtgaatttggctcctcctgaaaccttgcaaagaattattggtgttctagaaggggaacatggtgtgctgtgtttagctgaaagaggtgatatggattatatacatcgccatccaaatttccgtatatttgcttgcatgaatccagctacagatgcagggaagcgggatttgcccttttctttgaggagtagatttactgagtattttgttgatgatgttttggatgatgaggatttaagtctgtttattagtcagttcattagtagtggctatatggatcaacagttggtgaataaaattgtgcgtttctataaagaagcgaaaaaggaatctgaagagagattgcaggatggtgctaaccagaaacctcaatacagtttaaggtctctttatcgtgctctagagtatacacggaaggcagagagaaaatttggatttcaaaaggcattatatgatgggtttaatatgttttttgtttcgttgttggatggacctagtgctgaaataatgaggcaaaaaatatcatctcttttgttaaaagggcctccagatgtagattttatccactacttagatacctccaaatgtgatggatatacagggaattatgttctaactaaatccgtacaggagcatcttgggaatttggcacgttctgttctaatgagatatcctgtcctcttacaaggtcccacttctagtgggaaaactagccttgttcgataccttgctgcaataactggtcatgattttgtaagaatcaataatcatgaacacactgatttgcaagagtatctaggttcttatataactgacaccagtggaaagcttgtttttaatgaaggcgttttggttaaagctgtaagaaatggttactggattgtgctggacgagcttaatttggctccatctgatgtgctggaagcattgaaccgattacttgatgacaacagagagctttatgttcctgaactgcaagaaagaattaaagcagacccaaactttatgctttttgctactcaaaatccacctacactttatggtggccgcaaaatgctgtcccgggcatttcgtaatcgttttgtagagattcatgttggtgaaattccagatagtgagctcagtgaaatattggccgagagatgtaaaatctactttggtcatgccaaaagaatggttgaagtcatgaaggatcttcggttgcacagacagagtagcagagtctttgctggtaaacatggatttatgacacctcgggacttgtttcgttgggctgatcgtttccagagatttggcaactcttatgaagatttggccaaagatggctattatcttttggcagaaaggctacggaatgaggatgaaaagtccattgttcaaaaagttctggaaaatcatcttccggttaaactaaacataaaaattttatatgatcagatactatttagaggtcactcttcttccaatttgaatgttggtttaggaggtggttcaaagagtctagaaagtgtactcttgaccaaaagtatgcagaggttatatttccttgttgaacgctgctataatttacgtgagccggtactgcttgtgggggaaacaggtggagggaagactacttctgtttcttctgacataaatcatgcttcttcgactcttgatctgctgaatggtatgataaggaattgtaaagaaggtcacgtatgtagtttggatgtcagcagagaagatattaatgctcttgagcaaataaatttggacctcaatggtttgcatcaaaagtggcagagcatatttatgtggcaggatggtcctcttataaaagctatgagagatggtgacctctttcttgtggatgaaatatctttggctgatgatagtgtacttgagagattgaatagtgtgctggagccagaaaggatgctatctttggctgagaaaggtgggtctgatcttgagaaggttactgcacattcaaatttttttgttatggcaacaatgaaccctggtggcgattatggtaagaaggagttatctccagcactacgcaatcgcttcacggaaatatgggttccccctgttaatgatcaagatgagcttcaaggcattgctatgaaaagaatttccatgtttaagtttgctgggaacttagaccccacatatcaaaaaacacttgttaatgccatgataagtttttttgaggcttttcttagccttaagagaaatggcctagcaaactgcaagtatggagaagctaaaaaaaatagaagtttaataatgaagggaaaaaacaaaaaaatcgagcttctccaaaagatgatttaa

SEQ ID NO: 15773 - DNA, 219 bp, Glycine max
  Peptide Sequence Number=SeqID_132551
atggaaggaagagaaggcttcagttctggggttacagtgataggggcagaagctccatcagcctatcatatggcaccaaggagtgaagctctaagtcaggttcctcctcctgttcctgaagcaacagctggagctattggtgtctcacctgtgagtgtgggattggatggaacagccactaagaagaaatctgattctattttagcaagggagtgttga

SEQ ID NO: 15774 - DNA, 186 bp, Glycine max
  Peptide Sequence Number=SeqID_132552
atgttggaaagatgtcaatgctatgataaggcaaaggacattgagaagctgatgtttgcattaaaatttataggaggcattggacatttctggacccaggcaatggcaagcgaaaccgtctggaccacaaaagaaagaaggggacaaagacaaatcccttccttattccaaccgaaaagggtgtaa

SEQ ID NO: 15775 - DNA, 681 bp, Glycine max
  Peptide Sequence Number=SeqID_132553
atggcatcagctctaccaaatgtaggtttccatgcccgcacttcatctagtagaatgaacaaattttccaatgtcaaattgctaccattgacaagcaaaaggaatagaactttctgcagcaatgtaaaggctatggcaggaggtgaaacgagtttgcagaagtcaaagcagcaagtgcaaccaaagatgaaggtgccacaagcttcacctaaagtgctgttgaaccagtttccagtagcaaggactgtgcagcaaatgatggacacaatggagaggatggtggaggatcccttggtttatggtagcacttcacctttgatagttgtgggagacgatgaatacagtaaggggaagattccttgggcaataaaggaaggccagaaagattacaaaatgagattcaacatgccaggaatgaacaagaatgatgtcaaggtatgggtagaacagaacatgctggtggtgaaggcagagaaggcactccaggagaaccatgaaggtcaagcagacggcaacgaagactggcctgccaatagctatggtagatataaccacaggatagccctcccagaaaatattgagtttgataaaattaaggcacaggtcaaagatgggattctttatgtaacaattcccaaagccagcacttcttcaaaagtaattggcatagatgtacagtaa

SEQ ID NO: 15776 - DNA, 876 bp, Glycine max
  Peptide Sequence Number=SeqID_132554
atgtcggagaaggatgttgtgtcttggagtgctatgatatcgggttatgctcaacatgaatgtttcttggaggctttggcattgttccaagaaatgcagcttcaaagagttagaccagacgagactgctttaaacagtcacttaacatgtttgcgtcactactttaatcccatgatccacaaacacaaaatagaggctaatattaagcattatggatgcatggttgatcttttaggatgtgcaggtttgcttaaagaagcagaggaactgattaagagtatgccaatggcacctgatgttgccacttggggtgctttgctcggggcttgtagaaaccaccatgacaatgaaatgggggagatgttgggaaggaaactcattcagcttcagcctggccatgatggttttcataggggagttatggcacaacatcgggtggtaaagacacctggttgtagcatgattgaagcaaatgggtcagttcatgaattcttggctggagataagacacaccaagaaataaatgatattaagcacatgttagatgtagtggctgcaaaattaaagattgagagctatgtactaactacaagtgaggtttcactagacatagatgaagaagagaaggaaactgcacttttcaggcacagtgagaaacttgcagttgcctttggacttatcactatttctctgccaactccaatcagagttacgaagaatttgcgcatatgtaatgattgccacactgttgtaaagttaatctccaaagcatttgatcgtgaaattgtgcaaattgtacgggctattaaagtgagtgactatcctatgcttcaggaagctgcaccaaattttcacaatgttctggactggaactaa

SEQ ID NO: 15777 - DNA, 1053 bp, Glycine max
  Peptide Sequence Number=SeqID_132555
atggtgttggcgtatgctgctacgctttcttccactctgtcgtttcaaaagtctgttcctttgaattctcaacgttcaggaacatcatttggttcctctttcctattcagcagagagaatggttcagttgttccgtctcttgttgtgtgtcatgctaagaagaaactcagttttatggagcaaattctggattacattgaagggggtcccaaattaaggaagtggtatggtgcacctgatatccttgaaaaagatggtactgccatagaagatgatgaggatgattatccagaagatgaagtgagggatgcagtgctggtaacagatggagatagtgagacgggtcagatggtgatattgtcattgattgtgaaaaaagctcgagtaaagacattggtgaaggataaaagggttgcacttgaagcctttggaagttatgttgagttctgtctattttttagtcttattattgatcacatgatgcttgttgcaaagtcaatggcaggagatacaagtgacaaacgattcctcaagaaagccctgagaggagttcgcacaatcatatgcccaaatgagggttttctttctagcgttggtagccttcaaggggtacaacatgtaatcgtcttatctcagttgtcagtttatggtggtaaaagtggctttcaatccatgatgaaaagcaatgcaaagaaactggccgagcaagatgaatcagtattgaagacatcaggaattccttacaccataattaggaccggtgcattactagatgcacctggtgggaagcgaggctttacctttgatgagggttgtgcagctagaggaagtattagcaaagaagatgctgcctttgtttgtgtagcagctttggattgtgtcccacaaactggattcatatttgaggtggccaatggggataacaaagtttcagattggaaagaatgtttggccacattgatggaggaaacaaaatgtatacccaatgaggaaggaaagccttgtgcttttccttaccttaaagtgatcaaaattgttgctttcaggctgtaa

SEQ ID NO: 15778 - DNA, 507 bp, Glycine max
  Peptide Sequence Number=SeqID_132556
atggctaacaacgggagtccaaagcatgagaagatgcaaaagaacctatgcacacagctagctgttgcagtgagaagcattcaatggagctatggtattttctggtcaccttcaaccactgaagaaagggtattggaatggagggaaggctactacaatggagacattaaaacaagaaagacagtgcaagccacggaattggaaataaaggctgataaaataggcctgcagaggagtgagcaactgaaggaactgtacaagtttcttcttgcaggtgaagctgatcatccacaaactaaaaggccttctgttgcattagctccagaggacctctcagatttggagtggtattacttggtttgcatgtcctttgttttcaatcacaaccaaagtttgcctggaagagcactagaaattggtgacacagtctggttatgcaatgctcaacatgcggatagtaaagttttctctcgttctttgctagcaaaggttagattttgcccataa

SEQ ID NO: 15779 - DNA, 1440 bp, Glycine max
  Peptide Sequence Number=SeqID_132557
accgtggtgtgttttccctatcagaaaggcgttattgagataggcacaactgaactggttgctgaggatcctagtctcattcaacatgtcaaggcttgcttcttagaaatctcaaagcctacatgctctgataaatcttcctctatccttgataagccacatgatgacaaatatccaacatgcaccaagggtgaccaaagggtgttagatacaatggctttagagaacccatgttctcttgaagaaaaaatcaaatttgatcatgaacccatcaatgaattacaagatgataacaatgaaggttctaatggttgtgagcaccatttccctatggatggatccatgattgaaggtatcaatggtgtgccatctcaagtgcattttgtgaatgatgatgccttggtcattggtgctcctgattcccttagttcttgtgattgtatgtctgaagcttctgagaatcaaggcaaggattccaagaatgtaggccaaactcaacttatggaacttcaagattgccataaaccaaagagaagctccttggatgtgggagctgatgaggacttgtgctacataagaacactttgtgctattttggggaactcatcaacttttaagccaaacccttatgctggtaactcaaattgcaaatctagttttgcaaaatggaagaaagggagagtttctgaaaggaagaggccaaaattgcaccaaagcatgttaaagaagactttgtttaaggtcccctttatgcacagaagttactcttctctcaagtcacaaaaagggaatgacagaatggagtggactagtaaattggaaaatgatgatcatggtttaatagggaaagcattctctgataagaaaagagaaattaaaaactttcaagttgtcaaatcaatggttccatcttctataagtgaggtggagaagatttcaattcttggggacacaattaagtacttgaaaaagcttgagacaagagtggaagagctagaatcatacatggaagttacaggtcctgaagcaagaaagaggagtaaatgccctgatgttctagagcagatgtcagataactatggcaccagaaagatttgcatgggaatgaagccttggatgaacaagaggaaggcttgtggtattgatgagatagacacagagctagaaagaattacttctgaagaagcaaaagctttggatgtgaaagtcaatgtgaaggatcaggaggttctgattgagatgaaatgtccttacaggaaatacatactgtatgatatcatggataccattaacaacctacatttagatgctcagacagttgaatcttcaacaagtgatggtgttctcacattgacacttaaatctaagtttcgaggagcagcaacagcaccaatgaggatgatcaaagaagcgctgtggaaagtatctggaaatatttga

SEQ ID NO: 15780 - DNA, 960 bp, Glycine max
  Peptide Sequence Number=SeqID_132558
atgtctatgtctgaatatgttgttgagcttcctattttggacatttctcagccattacagccatcttctctaacctctctctctaaagcctgcaaagattggggatttttccacataatcaatcatggaatctccaaagatctttgcagccagatccactacttatccaaataccttttcagcctcccttctgaggctaaacttaaacttggccctttctcctctataaagtcttacacccctcacttcattgcttctccattctttgagagcctcagaattaatggaccaaacttctatgcttctgctaagagttctgaagacatcctctttgacaaacagacttccaaattcagtgagacactgcaagaatattgtagtaagatggttgatttgtcagagaggattctaaagcttgtattgatgagcttagaggatggatttgagaagctgttctatgattctgaattcaacaagtgccatggttacttgaggataaacaactattctgctccagaaagttttgaggaccaagttgaggggcttggaatgcacactgacatgagttgtatcactatcttatatcaagatgaaataggagggcttcaagtgagatcacatgaaggaaagtggatagacataagcccttctgagggtaccctagtggtgaacataggggacatgatgcaagcttggagcaatgataaattaaggtcttctgaacatagagttgttttgaagcagtctgtgagcaggttctccttggctttcttttggtgctttgaggatgagaaggtggtgttggcacctgatgaagttgttggagatggaaacaagaggctgtacaatccatttgtgtgctcagaatacttgaaattcagagagaacaatcaaagaggaaggtttgaaaaagtggggtacacagttaaggattttgctgggattaagtctaatctgtaa

SEQ ID NO: 15781 - DNA, 171 bp, Glycine max
  Peptide Sequence Number=SeqID_132559
atggagggttgcattaattttttcaatttttgtgctgatcttgaagtgttcttcaacaagaacaaccttgtcatcttgaagttcaagccccttcctctaagagcaaatcttactcgttcttccagcatttttggacctgccgtcgaggctgcactctaccgtcaagggtag

SEQ ID NO: 15782 - DNA, 2793 bp, Glycine max
  Peptide Sequence Number=SeqID_132560
atgtggacactaaggagtttacgcggccttgatctttcccaatgtagtgaactaagtggagagattcctaattccatagcaaacttgtccaacctgtcatatcttgatttaagtgtctgcaatttttctggccatattcctccagagattggaaagttgaacaagttggagaatctacgtatttcacggaataagcttttcggttccattcctccagaaattggaatgttgacaaatcttaaggatattgatttggcaaggaacgttctctctggtactctccctgaaacaataggtaacatgagtaatttgaatctgcttcgtctttccaataactcttatttatctgggccaattccatcctccatatggaacatgactaacttgacattgctctaccttgataaaaacaacctttctggatcaatccctgcttccatagaaaatttggccaatttagagcaacttacagttgctaacaaccacctttctggatccattccttccaccattggaaatttgacaaagctcatcaagttgtatttaggcatgaacaatctttctggatcaattcctccctccataggaaatttgatccatctggatgcccttagtctccaagtaaacaatctctccggaacaattcctgccacatttggaaatttgaaaatgctcatcgttttggaattgtccaccaacaaacttaatggcagcattccacaaggcttaactaacattaccaactggtactccttgttactacatgagaatgacttcacaggccatttaccacctcaagtttgctctgctggggcactagtgtactttagtgcttttggcaaccgtttcacgggttccgtgccaaaaagcttaaagaattgctctagtattcaaagaataaggctggaaggaaaccaattggaaggagatatagcacaagattttggtgtatatccaaatttggaatacattgatttgagcgacaacaagttttacggccaaatttcgccaaactggggtaagtgccctaagcttgagaccttgaagatatctggtaataatatttctggtggtataccaatagaacttgttgaggcaaccaacctaggcaagcttcacctttcttctaaccacttgaatgggaagcttccaaaggaattaggcaatatgaaatccttaattgaactccagcttagcaacaaccatctttctggaaccattccaaagaaaattggatcactgcaaaagcttgaagatttggatcttggagataaccagttgagtggaacaattccaatagaagtcgtggaattacccaagttacggaatttgaatttgagcaataataaaataaatggaagtgttccctttgagtttcgccaacctcttgaatctcttgatctaagtgggaatttgttgagtggaacaataccaagacagcttggagaggtgatgggactgaaattgttgaatctgtctcgcaataatctttctggaggtattccatcaagttttgatgacatgtcttgtttgatttctgtcaacatatcatacaaccagttggaagggccacttccaaataataaagcctttcttaaggctccaattgaatcattgaaaaataacaaaggcttgtgtggcaacgtcactggcttgatgctttgcccaaccatcaacagcaacaaaaaaaggcacaagggcattctactggcattatgtattatcttgggtgctcttgttctggtattatgtggagtgggagtttcaatgtatattcttttttggaaagaaagcaagaaagaaacccatgctaaagaaaaacatcaatcagaaaaagctctgtctgaagaagtgttttccatatggagtcatgatggcaaaattatgtttgaaaacatcattgaagctactgatagcttcaatgacaagtatcttattggagttggagggcaaggaaatgtttacaaggctgagttgtcttcagatcaggtttatgcggtgaagaaacttcatgtggaaaccgatggagagaggcataattttaaagcatttgaaaatgaaattcaagccttgaccgaaatcaggcaccgtaacattataaagctatatggattttgctcacattcacggttctcatttttggtctacaagttcttggaagggggtagcttggatcaagtactaagcaatgacacaaaagcagttgcatttgactgggaaaagagggtgaatactgttaaaggtgtggccaatgctttatcttatatgcatcatgattgctcacctccaataattcatcgtgatatttctagcaagaatgttcttttggattcacaatatgaagcccttgtctctgattttgggacagctaagattctcaagcctgattctcacacttggaccacgtttgctggcacgtttgggtatgcagctccagagcttgcccagactatggaagtaactgagaaatgtgatgtatttagttttggagtgctttctcttgaaatcatcacggggaagcatccaggagatctcatttcttcattgttttcttcgtcttcatcagcaacaatgacttttaatttgctactaattgatgtgttagaccaaagactacctcaacctctaaaatcagttgtcggggatgtcattttggttgcaagcttggcattttcttgcataagtgaaaatccaagttctcgcccaaccatggatcaggtgtctaaaaagctgatggggaaatcacctttagcagaacagttccctgcgattagacttggacaactcttctag

SEQ ID NO: 15783 - DNA, 3093 bp, Glycine max
  Peptide Sequence Number=SeqID_132561
atgacaagcaatgctcaatttacatcgtggccggcatttctacaggccttgcaaacaaggtttgcaccatctcaatatgatgacccaacatgcacattgtttaagctaacacagaagggaacaatagcggaatacctgtcgaagtttgaggacttggcgaacaggatcatcaggttgccgccccccttcctcttggcttgtttcatctctggcttgtccgcggagattcgtcgcgaggtacaagcacaccagcccctcatgctggttcaggcggccagcctggcccgtctccaagaggagaagctctcggaccttcgtccgccttctcaacctcgtcccccaccacttcctcatttgcaagtgcgttccccaccgttacctctactattaccgtcacctactcgaaatcagtcaccctttgtgcgttgcttgacactggacgagctcacctctgtccgccttctcaacctcatcttcggccaccgtgtcacggtgctcattgacgggggaagtacccataattttgtccaacctcagattgtcgcccaattgggcttacctagccgaaagatcgagacacctcagcgtgtaatggttggcaacagccaatacttggaatgcaccagcctttgtgaagtcgtccctgtcgacattcaggatcactcttttaccctccatttatacattcttcctatttctggcgccaatgttgtctttgatacatcgtacttccatattacaatgttatctgaacctgttccaagtccctccacccctgcaccaccaccagaagttcaacacctcctcaataaattcaagcttctcttcaggcaacctcagccgttacccccggagaggacgacggaccaccatattcatcttcttcctcatgcattaatagtgaatgttcgtccctatcgttaccttcactatcaaaagcaagagatagaagctcaggtggattctatgttgcagcaagggatcattcaacctaacacgagcccattctcgtcgccggtgttgctcgttcgtaagtcagatggcacgtggcgggggcgcccaatgtttttcgaagctcgatctgttgcaagggtaccatcaaatcagaatgagtttaaggctaccatgaacatgctcttccagtcgtatctccgacaatttattatcgtcttctttgacgatatcttgatatacagctcctccttcgaggctcacttgcaacatctagaaacagcttttcaaggggtggagccgatagctttgaagtttgccgccattcaacaatggcctctgccacgctctatcaaggcctcactactctcgaatccttccagtgacccccaagctcagatagcttttgaaaacctcaaactcgcactgtctacggcccctgttttagccttaccagacttcactgtgcccttcaccatcgagactgacgcgtcgggagtagggatgagtgcggttctttctcaaaaggggcatccgatcgccttcttcagcaagacgtttccccccaaactcttgggtgccttagcgtatgttcgtgacttatgtgccatcactaccaccgttaagaagtggaggcaatacttgcttggccaccattttgtcatcatcactgatcataagagcttaaaggaactgttgactcaggatattcccatgatccctgtattgcttgctgggtatcacacaaccccgacagggggtcacgccggcattactaagaccctagcacacataacagagaatttccattggacaggtctacacgaagatgttaaaagatttgtggctaattatgtggattgtcaagtcactaaatatgaagctcaaaaaatggcagggttattatgccccttgccggtgccttgccgtccatgggaggatttgccattagacttcatcgttgggcttccaccatatcaaggcaatactaccattttggtcgttgtggatcgctttttcaagggaattcacttgggcctccttcccactgctcatacggcacacatgactgcgtctttatttgtcaacatcgtcgtcaaactccatgggatccccagaagctttgtctccgatagagaccccctgttcatcagtcgtttttggcaggaactctttcgtgcaagtgggaccttgctccgtatgagctcttcttatcacccacaaagtgatgggcagacagaagttctgaatcgcgtcgtggaacagtacttgagggcctttgttcaccgccgaccaagcttatggggcaaacttctgccatgggtcgagtggtctcataacacatcttggaatgctggcactggggcaacgccgtatgaagtcaccttcgatgaaactttccaaagtatcaggaacaagctcctgaaggcacaagcaaaaatgaagaaacaagctgatgagaaacggagggaggtgcaatataagattggtgattgggttctcttgaaattgcgtcctcgtcgacagacgaccgctaaaggatcgaaggcattatctggcaagctggcccaacgggtgaagatacaccttgtgtttcaactctctaagatgaaaccattcaaaggagcaccagatagcatggcaggggtcgagttgcccactgattgtctcaatgatcaaccactggtgtatcccttagccattctggactaccgcaaagcttcaccagaggatccttgggaggtgctaatccagtggaatggactttctcctgatgatacttcatgggagagctggacacacttatgcgaaaattaccaccttgaggacaaggtggttttgcaagcgccaacggatgatacgaatatgcaagttacagaggaggcaacagataagaaggatgagggtagccaacttctagaagatccttggcttgatcatggtctgctagcaagggacaacttgagcaattatgtctggttcctcgaaactgtggtggcagcagaggccaaagaaaccattttggaaaagcaaacaacttggggtgaagggatttttgggcttcaagaatacaatcagaggttgcagattcttgcaagtgaatggtgtattgtggtgaggacatgcaagaattggagctag

SEQ ID NO: 15784 - DNA, 1236 bp, Glycine max
  Peptide Sequence Number=SeqID_132562
atgcgtgcttatctcctccacttggttggttgcactcttatcgctaacaagagtgcaacacatgttgatgtagtgcatctagaggcttttcgagacctgggtgagagtgggaggttttcttggggagttgcggcgctggtgcatatgcatgaccagttaaatgaagtttctcagaccactacacgacagattgttgggtacattactttattacagtgttggatatatgagcatttttctagtgttcatgacagcgtcattgacgatgcatacgatgagacatccccacgtcttagatgggatgctattgtgatcacacatcgaccagataaggtcgcacgacagttcgggtatcagcagattacatgcagtggattgcaacttacaaagtgtgttggtctcttaccgatcctgcaagttgcaagttgttatggggctgatgtgttagctgctattgaccaagccatagatgatggtgttgatgtcatcaatgtttcttttggtgtcagctacgttgtcactgctgaaggaatattcacagatgaaatttccattggggcattccatgcaatttctaaaaacatacttttagttgcctctgcaggaaatgatggaccaacgcctggaactgttgccaatgtggctccttgcgtcttcacaattgctgctagcacattagacagagatttcagcagcaatttaaccattaataatcagctaattgaggatgcgtttgataaaacactagcagatgcttttgcttacggttcaggacatgttcgacccgatctagcgatagatcctgggcttgtttacgatctaagcctcactgattacttgaacttcttatgtgcttccggatacgaccaacaactcatttccgccctcaatttcaacaggacattcatttgttcaggttctcacagcgtaaatgacttgaactacccttcaatcacattgccaaatcttcgcttaaagcccgtggccattgctcgcacagtcacaaatgttgggccaccaagcacatacactgtaagtacccgctcgccaaatggatatagcattgccgttgtgccaccttccttgactttcacgaaaattggtgaaaggaagacattcaaagtcattgtgcaagcaagcagtgcagctacgcggagaaagtatgaattcggggattttcgttggacagacggaaagcatatagtaaggagttctattacagttaagcgcagatga

SEQ ID NO: 15785 - DNA, 171 bp, Glycine max
  Peptide Sequence Number=SeqID_132563
atggaagaaagaacgagagcaccaaattgttacggctatcccctactagcagaccatgatcaagccaaggatcttctagaagttggctaccctcatccttcctcacacgtagtcgttgagctaggattgtttggtcgacatttgtacaagctaacctttggtcgactttaa

SEQ ID NO: 15786 - DNA, 897 bp, Glycine max
  Peptide Sequence Number=SeqID_132564
atggcaaccctggatcactcaaagttatctcagtcaagtactggtgtggatttatgtcgctctggttctaattatcatgctaagcagttagcatctgaactccctgcccagagttgctcattttcagatggaaaaagcaggattcagcagaactcagttaataacctacatggagtcaatgataatactgttgaagaaaattggatacaaaccgaggatgtccaactgtcaaaatctgaggatttacagtcatcacttaagttgaagaaagatggctccgatgaaggggggttatctactaatgtggcctcctgtgccccttctactcatattttatcaacgactcctgaagaaactgggtcagttggggaaacaaggtctgtaatttcacatggaagactaggtagttttacatcaatgggttcagattatgtggcagcaacctctggtcctggtctatcaccaagttcttcagttggttcaatgtcttcggaaaaatcaactctgaatcccaatgccaaggagttcaggctcaaccctaatgcaaagagttttgttccatctcaatcacatgctaggccccgctccccagtgtctgatggttctttctatttcccgactaccgtacccaccgtaccaaatatgccagccatgcccatgggtattggagttggaactacttttgtgggtccacaacctgtcatatataatccacaagcggcacaaatgccatcccaaccatattttcatccaaatggaccacagtatggacaacttggtcatcctaggcaagttttatacgtgccaagttacctccctgcatttgatctggacttgaacaaacttagctacattgtatatttccaggagatgccatataagggacgggattattga

SEQ ID NO: 15787 - DNA, 612 bp, Glycine max
  Peptide Sequence Number=SeqID_132565
atggaaagcgagaaagcgtttgagtttctcggatgcgttcctctcctgcagaggcttccgagctcgtctctgaggaagatagctcaacttgtggatgtcaaacattgtgagcccggagagtatgttgttcgcgagggtgaacccggagatggtgtgtacttcatattggatggagaggctgaggttcttggatctgttagtgccaatgatgaaaatcgaccagagttccaattgaaacaatatgactactttggttatggtttgtcaaacacagttcaccaggcagatgttgttgctttgtctaagctgacatgcttagtgcttcctcatgagcactcaacactgctgcagccaaagtctatctggagagcagaaaattctctcgagacatgctcacctgtggagaatatattgcatttggagccgctcgaggtagatatcttccaaggaattacccttccagatgctccaagatttggaaaggtgtttggggggcagatgattggacaggctctggctgcagcttcaaaatctgttggctctcttaaggttgttcatagtttgcatgcctattttattcttgcgggggatttaaacagtaagcatgcttaa

SEQ ID NO: 15788 - DNA, 702 bp, Glycine max
  Peptide Sequence Number=SeqID_132566
atggggttagtggggcaagggctgtgggtgaggatgaatttgcaacaagttggacagcctaaatcatctaatggatatggttgttggaaatctgaaaaagaaggggcaactaagtctgataataagatcccgtctggaaagtcaaatgccagcagcagattagcaagtgtagtgactggcaataaaggtggtagttatgggagtccttcacatgatcgattagtatatttaaaaacatgccttattgggcagcatgtggaagtccaggtgaaaaatggatctatatactctggaatatttcatgcaacaaattctggcaaagattttggaatcattttgaaaatggctcacttaacaaaggatgctgctttgcaaggaaaagaatctggtgtagaatttgtcagtaaagctccttttaagactttaattatacctgccaacgaccttgtacaagttattgcaaaggatgttgctgtttctagagatggcctacctagtgaatctcactatgatatgcatcaggagatcatggttgattcagtaatatctcaatcctgtcatgtcgagacagggagagaattacagcgatgggtacctgatgaagatgatccacaatgccctgaactggaaaatatctttgatggcccttggaataggtggttttatacttctcttgttattcctaaaatttttctttcatga

SEQ ID NO: 15789 - DNA, 384 bp, Glycine max
  Peptide Sequence Number=SeqID_132567
atgaacatttcttttccagtgccaattacataccaagttcaccgtctccgagatggaaagagctttgcttcaaggaaagtggatggaattcaaaaaggaaatgtcatattcactctgatggcttcatttcaaaaagaagaatcagggatggtccaccaagaagtagctataccatctgtccctactccagataaggcaagatacaagcttatgtctgttatgattttttgcttctgccaatggaagagcttcgggagagacgtcttactgaccctcgtttaccaatggaaacccatatccttcccatctatccatccttgtttcaaatttgaacctggaatctccaagttggggtgcctggtccttaatcatcgaaatgtctga

SEQ ID NO: 15790 - DNA, 1901 bp, Glycine max
  Peptide Sequence Number=SeqID_132568
atgtctttgcttcgacggagaaaagggtcggaaccggaaaagggtccgagcccgagttcggagccaaaggttttaagcgaagacgagacagaagatgataagaataataagaagaataagaagaagagagatgagatgatgccttcttcgattcctcagtatgtgaccgaggccttcactgggcccatgccggacccaccgggcctcaaactcaagaaggaaggactcaaggtgaagcaccctgtggtttttgtgcccgggattgtcactggggggcttgaactgtgggagggtcacctgtgtgctgaggggttgttcaggaaacgcttatggggtggtaatgggttcagatcctggaaacagcctctccttaggcaggaacctcatgcattggactgccattcttgttgctttggtgtgaccataggcactgctgaattctttgagatgccacttctcacttaccctgagttaccttcatgctgggtggatcacatgtcactggacaatgaaacaggattggatccaccagggataagagttaggcctgtctctggacttgtagctgctgattactttgctgcaggatactttgtatgggcagtgctaattgctaacttggcacgcattggttatgaagaaaaaactatgtacatggctgcatatgattggagaatagcatttcagaacactgagtgggttgaagcaccagctccaactggtggtggaggaggaccagattggtgctccacatatataaaggcagttgtaaacattggtggaccatttttaggtgttcccaaggctatagcagggcttttctcagctgaggcccgggatattgctgttgctaggacaatagctccaggatttttagataacgatctgtttcgcattcaaacattgcaacatgtaatgaagatgacccgtacttgggactcaacaatgtcaatgataccaagaggaggagatactatatggggtggtcttgattggtcaccagaagaaggctatcaccctagccagagaaagcacagcaataacaatactcagttgaaagaccacgaaacaaatcaaacaaattttgtcaactatggaagaatgatatcatttggcagagatgtggctgaggcacactcccctgagattcagatgactgacttccggggtgctatcaagggtcgcagtattgcaaataccacttgtcgtgatgtgtggactgaataccatgaaatgggatttgaaggagtgagagcagttgctgaacataaagtttacacagctggctcagtcgttgacctccttcaatttgttgctccaaagatgatggctcgtggtagtgctcatttctcttatggaattgctgacaatttggatgaccctaaatataatcactacaagtattggtcaaaccccttggaaacaaaattaccaaatgctcctgatatggaaatcttctctatgtatggagttggcttacctactgaaagatcttatatttacaagttaactccctttgccgagtgttacattccttttgaaattgacaccacacaagatggtggtagcgatgaagatagctgtctgcaaggtggagtctacactgttgatggggatgagactgtgccggttctaagttcaggcttcatgtgtgctaaaggttggcgcggaaaaacaagattcaacccatccggtatccgcacctacgttagagaatatgatcattctcctccagccaaccttctagagggaaggggcacacaaagtggtgctcacgttgacatcatgggaaattttgcattgattgaggatgttataagagtggctgctggagccaaaggagaagatctaggaggtgataaagtgtattctgatatcttcaagtggtctgagaaaatcaa

SEQ ID NO: 15791 - DNA, 651 bp, Glycine max
  Peptide Sequence Number=SeqID_132569
atggagcatatagataaaggaaaagaatcatcaaatagtgacaatgaagtagaagccacaaattctccaattatttgtggccttccagatgatatttttcttatgtgcctggcaagaattcctagaaaatatcattctgtcctgaagcgtgtctctaagagatggaggaacttcatttgctgtgaagagtgtgagtttctagattctactgatgaggtttattcatatgatgcttcctcaaactgttgcgctcaagcttcttccttgtcaactgctaggttagtatctttatttctattctttttggaagctaattcagggggaggaggttcaaattcaagctatcattcttgggagacttttgaccctttgacaaattgttggacatctcagacagatcctaaaattgttaatgaaattaaagattcagtcattcttgacgggaagatatacatccgatgtagcagatatcctgtaactcctcatgtatttgctgttgtatatgaaccatcaagtggcacatgggagtatgcagataaagacattgtttcaggatggactggtcctgcagttgctgttgatggtaccctttatgtcttggatcaaatgtggttgttgatgttggtgatttggggaatgaggatcaaatga

SEQ ID NO: 15792 - DNA, 720 bp, Glycine max
  Peptide Sequence Number=SeqID_132570
atgggttttgaagctttgggaagtaagctattcttattgggtggttgtagtgggtttctagattttactgatgaggcttattcatatgatgcttcctcaaactgttgggctgtagctgcttccttgtcaaatgctaggtgctacttgacttgtgaagttttggatgaaaaactatatgctattgggggattagtttcaaattcaagtaatcattcttgggatacttttgaccctttgacaaattgctggacattccatatagatcctaatattggttctgatattaaagattcagtggttcttgatgggaagatatatgtccgatgtgccagacatccggatgtaactcgtcgtgtttttgttgttgtatatgaaccatcaagtggcacgtggcagtatgcagatgctgacatggtttcaggatggacaggtcctgcagttgttgtcgatggtaccctttatgtcttggataagagtttgggaactagtttaatgatgtggcataaagaccaagttggaaagctttcaccatggcttactagaccaagctgtcagcttgttgcagttggtaaaagcatttttattgttggaataaatcttagcactgtggttgtcgatgttggtgatttgggaaatgaaggtcaggtgatgatgggttcttctatacctggattattatctgatttcaatgtaattagttgtaaatgcttgtcaatctga

SEQ ID NO: 15793 - DNA, 678 bp, Glycine max
  Peptide Sequence Number=SeqID_132571
atgggttttgaagctttgggaaataagctattcttattgggtggttgtagtgagtttctagattctactgacgaggtttattcatatgatgcctcctcaaaatgttgggctcaagctacttccttgtcaactgctagtcttaattttagcccctactgcactgtagagatcactattttcttctacataagatttcagacagatcctaaaattgtttctgaaattaaacattcagtggttcttgatcggaatatatacgtccgatgtaccagcaaatatcctgtaactcctcatgtatctgctgttgtatataagccatctagtgggacatggcagtatgcagatgatgacatggtttcaggatggagaggtcctgtagttgttgttgatggtaccctttatgtcttggatcagagtttgggaagaactaggttaatgatgtcgcttaaagagagacgcgagtggatacccgttggaaggctattaccttcgaatgctagaccaccctttcaacttgttgcagttggtaaaagcatttttattgttgggagagtgcttagcactgtggttgttgatgttggtgatttggggaatgaggatcaaatgattgtgggttctgctctacccggattattatttgatgtcaatgtgataagtgttaaatgtttgtcaatctga

SEQ ID NO: 15794 - DNA, 171 bp, Glycine max
  Peptide Sequence Number=SeqID_132572
atgcaaaccgccagtcccattggtggccagtctcattggcgatttcgtcatgcaaggagactagccagtcaaactggtgagttgcaggctaaggcgcaggctcagcttttcaggctttcagttggtcaccttttcaggtggcaagggcgggtaaaggctaaaggggactag

SEQ ID NO: 15795 - DNA, 231 bp, Glycine max
  Peptide Sequence Number=SeqID_132573
atgaaagaacacaaaggaaaaagagatgaagctctcgttctcgccacaagggatggcgatatcctcgaagcccaagtcaaaggctgcagctcccagctccctgcacctgcacccctgcccctgcgcgcttgtgaatgctgccttcaagtcgccagtcaaactagcgggttgacaaccattagctgtctgccagtgatagtggcgacatgccacatgtcacaaccacaatga

SEQ ID NO: 15796 - DNA, 1116 bp, Glycine max
  Peptide Sequence Number=SeqID_132574
atgtcatatggtggggttgttcggtgtctgaatgatccatttcatgaggtgaagagaaggagagaccgaaagaaggagacccagaatgtcgggaacaagggtcagccttcagctgactcacgaaggtcatctgagaataatagtggtcaaggaatgaagtttaacgccccttctgaacgcaatgttcgaagaacaaactattctcgaaatactttacctggcatcagcaaagagtttcgtgttgttagagacaacagagtaaatcatatatataaagaagtaaagcctcttacacagcagcactcaacatccgccactgagcagttaaatgtaaacacacctgataagggctcatcaacttccaccaatcataggtcatctggttctaggaattcatctctggcatcaaatggtccttctgattcacatgctaggtacttgaaagatgctgtgccaaatatcattgacagaaaaattgcatctgaggataaggataagcaaggcatgatttcaaatgcagcaggtcgggtgcaaccaattaaacctaacaatgcccatcaaaattctgcctcagtggcatcaaccagttctgctgttggggtgtattcctcttcaacagatccagttcatgtgccctctcctgattctagatcatcgggtgttgttggagccattaggcgtgaagttggggttgttggtgttcggcgacagtcttcagacaacaaagcaaaacaatcatttgctcctagtatctcttatgttgtgggaaaagatggtacatccgcggattcttttcaatcagttggtgctgtctcaaagactgaacaatttagtcaaactaatgtaactgaaccttcattatctggtatgccagttagcagaccatctctgaacaaccagtataataataggccacatcaacaacttgtgggacatcaaagagtttcccagcaaaataaagaatggaagcctaaatcaagccagaagccaaacagtaatagtcctggagtaataggaaccccgaaaaaggctgctgttgctgctgcttcgcctccagcagaaaattctggagatatagaatcaaataccacagagcttcaagataaactttcccaa

SEQ ID NO: 15797 - DNA, 1293 bp, Glycine max
  Peptide Sequence Number=SeqID_132575
atggacaagtgggacaataaaccctcaagaaaacagcaccacagagaaaacccttctttctcttccactctacttgacgttatctaccgttccatcgacgaagatccaacggatgagaaggaagaagcccaactcatcttctacagagaaaccatgaggaatcagaaacagagcaattgtttcagagaagaaaaacctgaagctgagaaacacaactctcgcagggccaggaaggtggagaattggatggagaagaaagccaacgagaaggttgtaatggggagaaactcattgacggaatttgaacgaagaacgcgaagcaattcaatttcaaacacactctccatgtattcaagctcaacctcttctgagtcaagctctgttggaggcttctcttcttcagagtcagagtccttctatggagtgcaaaggccaaagccaattaaaaccagtgtttctgataaaaccaaaaccaaaacaaccttcgatgcttcacttcacagtcacaacttcaggagccactcttcccaaagccaaaagccaaagcatgagaacggttctggcaaaaccaagtccaaagccttgaaaatcctctatggtgagttgaagaaagcaaagcaaccaatttctccaggtgcaaaacttgctagcttcctcaactctctcttcacttcaagtggaaatgccaagaaagcaaaggtttcaacaacaacaacaacaacaactacgtctacttatcgtcccgtcctgatcccggttgcgacagatcgtactgctgatactaaatcagcagcacaacaacaacaacaacctggttccacttgttcatcagcatcttctttttcaaggtcttgtttgagcaaaaccccttcttcaagatcaggtgcaaaaaggtcagtgaggttttgcccagtgagtgtcatagtggatgaagattgtaggccttgtggtcacaaaaatcttcatgaaggtgaagagagcaatggaaagaacagaagtgaggaacttaggctgcatgtcatgcaggagagtcgcagggtggaggagttagcaagagacttgttgaagaattatcagaaaaagagtgaagtggagtttgatgatgtcatgcattatgaagatgaagaagaagaagaagatgatgatgatgtggctagttgttcaagttctgatctttttgagttggataatctatcagcaattgggattgaaaggtatagggaagagttgcctgtgtatgaaactacccatttcaataccaatagagccattgccaatggcttcattctgtaa

SEQ ID NO: 15798 - DNA, 1125 bp, Glycine max
  Peptide Sequence Number=SeqID_132576
atgaagaaccaaacaaacaagagagacatgcctttgaactggctggagattgactggaaaacttgctggagactcatgggtcagtgccagaaaatgaagaaccgacctctgggcgtcaagaaacttgctggaaagtcagtaaatgtgaaaattcagacactgtcacctaatgattgggcatatgatcctccagctggttatgacattccttatttcagacccacaattgatgaaacagtacgagggcagggtttgtcatctcctcaggaggctttgatctcccatgcaaccaataatcctcctgcttccacaattgccatggtgcaacaacagcaacctcctgtgccgcagatgtatccacaagttcatgtttcacactttgctaatcttatgccatatcgtcagtttctgtccccagtctatgttccacctatggccatgcctggatattcaagtaatcctccctatcctcacccaacaaatggcagcagttacttgttaatgcctggaggtggttcacatcttaatgccaacaacctcaaatatggagttcaacagttcaagcctgttcctgctggaagtcctacagggtttggaaattttgctaatccaactggatatgcaatgattactcctggtgtggttgggggtgcaacggctttagaggattcatctcgagtcaagtacaaagataatctttatgtcccaaatcctcagcttattttgctggaggtcagtattatgtccggaaggtgccaaaaggttctaacttctaaccatgctgagacatcagaaatctggttacagaatccaagggaccttcctggcatgcaatctactccatactataacatgccagggcaaacacctcatgcagcttacatgccatcacacacaggtcatgcttcctttaatgcagctgcagctcagtcttctcacatgcagttccccggcatgtaccacactcctccacagccagcagccatggctagtcctcaccatttaggaccaccagccattggcaacaacgtcggagttggggtggctgcagctgctcctggggcacaggttggcgcatatcagcagccccagttgggccacatcaattggacaacaaatttctga

SEQ ID NO: 15799 - DNA, 894 bp, Glycine max
  Peptide Sequence Number=SeqID_132577
gtttgaagacgatggaattgaggagccagaccaagccttaagggagaaaagaaagaaagatgcaaaagcactcttcatcatccaacaagctcttgatgatgaggtgtttccacgcattgcagcagcttctacagcaaaagaagcatggcatattctcaaccaagaatatgtcagagacaagaaagtggtcaatgtaagattacaatctcttataagagaatttgagtcattccagatgaaggaaaaggagaacatgcaagaatgtttgtcaaggatatctagcacagttcaacaaataagaaccttgggtgaagagatcaaggaaagccaggttatgagtaaggtgctaagaagcctcacaaagaaatatgatcatgtggtggtagcaattgaggaatcaaaggatatggaaacatatacctttgatgaattgaaaggctctcttcattcacatgaagaaagaatatgcaaaggtagaggctccagagggagaggtcgtggaagagggcagagtaatgaggaaaaggatcaatcttctcaaaattaccagggatcattcaaatgctactactgcaagaagcctggacacaaagaggctagttgctggaagaaagaggaggatgaacagaaaggacgtgatcaaaaatccaactttgtggagcaagaagaaaaattgttcttggcacaacatacatcaaacaatgatgctgaaggtggagtgtggtatgtagacagtgggtgctcaaaccacatttcaagtgccaagccaatattcaggaccttggatgaaacagcaaagaccaaagtgagactaggagatggaaagcagcttgaagtagaaaggaagaggcacgattgcaatcacaaccgagcaaggcaacaccaagctcttat

SEQ ID NO: 15800 - DNA, 1113 bp, Glycine max
  Peptide Sequence Number=SeqID_132578
atgttagaatatgctggatcagagcatggacaaggtgacacagatcttgattgctacttctctcattcctcttcaccaggcagtgaagattttgagaatgcttcttcctttgatagctctatgcataaacatagtggtgttagcaagaaaactagtttaatccaaaagttgaagaaatggggcaaaagcaaagatgattcaagtgctctttcatcagcagccagatatctttcaggtgtctctcctagcaggatgagtatgagtaatagaccaagggattccctggaatccttgatgcaaaggaatgctggtgattctgtaaccatcactacctctggacagaaggatcaggaacctactgattctcctgaaactctagctcttcctaacataagaagagtttcatctagcgactccttaaattctgttgcagcttcatttcaattgatgtctaatacagttgttgcatatctggatgaaaaatatcctgcatataaagaccgccacaaattggccttacagagggagaaacaaattaaggaaaaggctgagaaagcaagagcggagaagtttggtgacaattcaaatttgaatatgaccaaggctgaaagagagaggacaacatctttgctaccaaaactcacccaattaaaggaaaaggcatatgtttctggtagtccaaatgatcatcctgacaatgttaagaatgttgataatcaaaccattagcaagatgaagctagcccacattgagaaaaggccacctagggtgcctcagccacctcctaaaccatctgatggtgctcctgttagtgcaaattcaaacccttcaaatggagtatcatgtgctccacctcagcctccgcctccacccccaccagaaccaccaggtggatcacttcccactcccctgggaaacctatcaagaggagagttagctggtgataaagttcaccgtgctccagagctagttgaattttatcaaacattgatgaaactggaggcaaagaaggatacttcattaatatcatcaacaacttatccatttgatgctaggagcaacatgattggggagattgagaatagatcatcattcctcttagctgtacattaa

SEQ ID NO: 15801 - DNA, 486 bp, Glycine max
  Peptide Sequence Number=SeqID_132579
atggatgcaccttcgtctcaggatactcttgcaccacaacatccattgcccactctagttgcttctaaggcaacaggcgcaatggcccaagtgccaaaaaaggtagcaccaaagaagcaacaaccttcatccactacaaaatgcctaagggcacttaatgagactaagagtgacgaagatgggttggtgtttagaaaaaagaaagttgcaccacctttggatgagaccactgcgcctcaaatgaataaggttaaaccaactccacaggttccaccttcccccctccccatcactcaaagaattaagcgtccaatgggcaaaactgaggttattcacttcaagaacaagaagaaaactgagtccactactggcatggacaatgagattcaacaccaagcacctctatcccccatccaccttgatcgcttccaacatcaaggacaacctaccatcgaaacccaagctcactgtttaagacaccacaag

SEQ ID NO: 15802 - DNA, 316 bp, Glycine max
  Peptide Sequence Number=SeqID_132580
atgtctttcccgatgctcttgtccttcatcacttcacttgacgagaatatggggcaagtcaaagggagtgccctccataaaatgggagttcccaatttgatcttcaagtttgatgaacttggtgcctctacgctcacaatcagtagcttgagcgatgaactcatagatgagttcaggcacccccaccttggggtcctcaaagaaatggtagatgcctcacaacatgaggtgtgccttgataacatatccaacattctccaacgattcaatgtcaaagaagtgttcggtgtgaactttgggttctttatccttcaag

SEQ ID NO: 15803 - DNA, 258 bp, Glycine max
  Peptide Sequence Number=SeqID_132581
atgtctcctcaaatttcagccagcccgcaacaattagaccttgcaccgtacgcttcaggcccctacaatgctcaatggaatgccccggggcttctccatgacaagcacacgttgcgttcgagtcgtattctcggagaaatagaggttgacgaaccttggttggggttacggctaccattgaattatcaagtagatatgggagtgatcgaggccgtacccgaatcgaataaacatgaaaatgcagtaactaagaagtga

SEQ ID NO: 15804 - DNA, 471 bp, Glycine max
  Peptide Sequence Number=SeqID_132582
atggaggagcatctgcgcgctcagtgcgtcatcagctcgcttagcgaggagtttgtctcttcccgcctaagcgcgcccagctcgctcaacggattttcaataactcgcgctaagcgagccttcaaggacagaaagccctttttaaggctgaagttggaaaaatcaattattcgtctgagagagcgtggattggaacgtgctgccttgcgatggaaggctaagcatctttgttgggaaattctgctgaaacttgatgctaagttcaacgagacatttgagaacgaggtgatttggtttatttggacttggagattgaagctacttggagatgaaacaacgcagaaaggcggagaaaaatcttgcaagaaagggcaggaatctcatactggtgcatctgaagctcacaggatggctgaagatcagcctcgcagagtcacccttgaggactattctagttctactgtgccgtaa

SEQ ID NO: 15805 - DNA, 675 bp, Glycine max
  Peptide Sequence Number=SeqID_132583
atgctgggtgcacaagcaatagagctggtaagaaagattaccagtaccgctcgagatgattgcgaacccaaattaaatgacccagatctggcccctttgtcacgggccccagcagaatcactagcagaatgggctggactgagaggtccactagcagaatggccccatatactgatccttcgagagtggaggaacctacgccatgagaatttcaaatgcctcgacgtactcatcgatagtggttgtttggtggaggagctaaagttgagaaaaaggattacccatttggtggttgccgtaacgctcgagcagcacgcatttgaaagaggcccaatagtcgcaccaggagaatcggaacaacacaacaaagtgtcctacatctctgtgcacatagcagtcactaattgggagagttcattgacgctggttgagaccaggactcttgaggaagtggaagaagttttacattattcatctcaaacaaagacttctttgactcgaataatgttggacaatatggttgtacctctaccaaatggggatgtggacatatctatgctaaaagaagctgtgcagttgataaatgggagatatgagactgaggcatcaggcaatgtcacactagatactgtacataaaattgggcaaagcggagtgacctacatttctaggtaa

SEQ ID NO: 15806 - DNA, 1902 bp, Glycine max
  Peptide Sequence Number=SeqID_132584
atgcctcaggacttgcagcatgtgctggatcagcatgcctctgtcttcactgctagaaaggggctgccacctcaacgagcccatgacaactctattaatctgcttccgatgaactcaacttgtgagtgtaagttctctttcggcttgccttccattgactatttagggcatgtaatatctgcccagggagtggcgatggatcccgataaggtgaaggcagagttggactggccggttccagtaaatgccaaggaggttcgtggtttcctcggcctaactggttactatcatcaatttatcaaagactatgcttctggccagggatttggagcggtattgatgcaggactgccaacctattgcctatttcagcaaggccctatctgcgggaactttgtccaaatctgtgtatgagaaggagatcatggccttggctttgtccattcaacactgcatctccttcaacaacgtctcaccaccacagatcagcaatgctgagaataaggctgattataccttatcctgtcagtttccttccactgagttcaacaccatctccattagtccttattgggtggatttccctgctgtcaggaacaaagtgcaaaatgaccctggcttggtcaagttgagctcccaattgcaatctgattctgattctctgcaacactatactctgcgcgacggtttactttttaacaaagatcgtttgatgttgcctaagacctcctctttaatccctactttgatggccgaatttcacgacacgggaatgaaagctactataatggagtacatccaccaatgtgacgtttgtcaacgtaaaaagtaccaggccttgtctccaacagggctgttgcaacatattcctatcccagaaatcgtatgggatgatatctctttggattttatcaccagcttgccacattctcagggatatgacgtaattctggtggtgatcgaccgcttgtccaagtatgcacattttttatccctcaagcacccctacacagcgtgttcagtagcagaggtattcatcaaagaggtcgtcaagttacacggttttcccaagtctattatcagcgaccacgatcctttgttccttagcaaattttggagtgaactgtttcaccttcaaggaactgtgctaaggatgagtactacttaccattcccaaaccgacagtcaaacggatgtgaattttgatacaatacttcatcccattctgcaatgggcaagttccccctttgagattgtctatagtcggaatccactttctgtgcttcgttatctgattggggaaacccaagttgattcaatcgcatcagtgttgattgatcgcgacaaagccttacgtcagttgaagttccatctgcaccgtgctcagcaaacgatgaagaagtatgcggatgctcatcatcgtcatgtcacttatgaagttggcgagtattcatcaaagaggtcgtcaagtgctttcccatgtcagggaggtggcgtacaagttgcactcaaatgctctgcgaagagtggttcttctgttaccattttgcctcccagattggcagtggataatcctaaaacccctagacctgaggatattttagccattggcgaaggcaagcacctgagaaattctgtcgaagagtggcttatcctctggaagtctcaacctgtggtagaagcaacatgggagaacacagcaccaatcaaagacagatttcccaatttctgccttgaggacaaggcagttgttttagagggtggtattgataggaaattagcttctaaatgggataggctctttaaggtgaggaatatttctgttataattgggattgtgggtttggcggtggggtatgatggatttggaataaaaagtggagctcagagaacctttctctga

SEQ ID NO: 15807 - DNA, 360 bp, Glycine max
  Peptide Sequence Number=SeqID_132585
atggcttcttacaatgatgtttgtaaatgtaatgaaacatatcaatgtcacaaatatgaaaataagttgacatttcgtgctttcccacaggcaatggcaaatgcagcataccctgcatatatgttggagactagaaaaactgctccaggtcttcgtttagtggataagtgggcggtattaattggtggaggtcagaaccataggatgggtttgtttgatatggtgatgataaaagataatcatatatcagcagctggaggtgttgctgatgctcttaaagctgttgacctgtatctggagcaaaataatcttcaaatggaggttgaggtgcaacaagatgataggaacagattttactga

SEQ ID NO: 15808 - DNA, 573 bp, Glycine max
  Peptide Sequence Number=SeqID_132586
atgtctgcaactgaagtcacaagctctaggatatcatacgagtcctttgcaataaagcctcctgagcacccaacttatgatttgaagggcattatcaagctagcacttgaagaagatgctggggatcgaggtgatgtaacatgcttggccaccattccatttgacatggaagtggaagcttattttttggcaaaggaggatggcatcattgctggaatagctcttgcagagatgatatttcatgaggttgatccttctctgaaggtggagtggagtaaaaatgatggagattttgtccataaagggctacagtttggaagagttcgtggacgggctcataacattgttgtagctgaaagagttgtgctaaactttatgcagaggatgagtggcattgcaactttaactaaggttcttgcacagttgcactatgctaaatgtatagcatggcactatgctacatgtatagcagctgactttaaacataatagtccagaactatcttgggacgagacaaggttttcacttgttggagatgagttcttttcagtctgggataataaacacaaatga

SEQ ID NO: 15809 - DNA, 404 bp, Glycine max
  Peptide Sequence Number=SeqID_132587
cacaacctcaggaaatcactgaccgaaggacgaagtcgttgagaggaaaggagatcgcgttggtgaaggtgcagtggggaaccgatgagggtgattctacatgggagttagaggataggatgagagaattgtacccaatactttcaaaaactggccccgacggacgcagagaaacgcgagaaactggaaccagagaaatggcacgcaacccgaggcaggattttagcgtttctaagctctctctctccctcttcctcacgttgctttttccttctcctccattctccattgaagctccacacaaagcttcaacctttggtgctcatttctgctccaaatcgcgaaaggagagcattttcggagtcgtgaagtgcgtggctacgagtgggacttcgaaaattcag

SEQ ID NO: 15810 - DNA, 216 bp, Glycine max
  Peptide Sequence Number=SeqID_132588
atggatgtgtattttacaattaaaatattgatgttcccgactaatgctaatgtagttgtctggcctattatgcaacgaacaaaacaagataacaacatttttctcaggcaaaatgacgaccattttcctcataaaggtacaggaacgggagcatttggatctttaacctcctccacacccacctttacttggccaggcaacaaaggagtgttatga

SEQ ID NO: 15811 - DNA, 234 bp, Glycine max
  Peptide Sequence Number=SeqID_132589
atggcacaccttaggtttgtcatactttttggtaggaataatcaacatgaaaatacagaaaaaggggttcccatgaaccctaagagaataaaggtcattcctgagtggccagctccaccaagtgtgttgaggaaaaaagcccaacgtttcaagaacctcggggatttgaggtcaaatccttttcaagggaggagaggaatgatgcaatcctaccccgcaaaggacattggatag

SEQ ID NO: 15812 - DNA, 453 bp, Glycine max
  Peptide Sequence Number=SeqID_132590
atggcaccccacctaacgtccccaaggtctcctgacccccgcgacatatctcaaggtaccactctgtggtcaacaaacaaaagtaggaagactgactcttccacgctttcttacatcaagcttattggattatgggcacttgtcatatgtggcactaggtggcgatcgagcgatggcgcaaatcaactatcccacttccacaagccaggcataagcacaccatccccagttgcccacctttacattgagctcacgcactcctacatagcccttatcctcgtccctctcaacaccgggtccccatcaacccctccaagctttcacaatattcaaagaattcaattccatttatcatggaactaccctaaaccaagaaaaatagagtggaggcagaaaactctgcacaaaactcatccaaattccacagtttttcctactcacctgccccaataa

SEQ ID NO: 15813 - DNA, 658 bp, Glycine max
  Peptide Sequence Number=SeqID_132591
ttttgagcgcctaagcccggtcattaacttggcctacatcaggaagaactattggaaccctgaggatctaatagtttctatccgaggggctaggagggcgagggcaaggccagctaagctttcttctacttctacagctcctactccagcacccacttcagcagccccttctgtcccagctcagatagattctcaacactttgaagccatgcttcagaacattcatcaggaacagatcattctattacagagtttacaggtggtggcgcctccaggatctattccttcagtggagcagttcactaagatggtagcctggcccgggacccaaccttctcttcacagggaagatggaggtcccacagcccagccaattattatagaagaagaggcagaggagacacaggtgagacaagtagttgctgccacacctgagcgatcccttgaggctacttcagacccttctacacagggggaggacataccctcacctcaacccgcagtagacccctccactcctcttctagagatgtcagaggacccgactacatcattcctggctatggacacttctcctccagctactctagtattgcatctgacggataaggaggatgttcagacacaagacacccaggaccagtcacaggaattctga

SEQ ID NO: 15814 - DNA, 282 bp, Glycine max
  Peptide Sequence Number=SeqID_132592
ggaaaaagttgcatgctagttgctggggatgtttacaaacctgctgctattgaccagcttgctattttgggaaaacatgtggatgtgcctgtctatacagcaggtactgatgttaaaccttcagaaattgccaaacaaggtttagaagaggcaaaaaagaagaaaattgatgttgttattgttgatactactgaagtgttgctagttgtggatgcaatgacaaggcaagaagttgttggatcgagtggcctcagaataattaagaagggggggttgaattaa

SEQ ID NO: 15815 - DNA, 204 bp, Glycine max
  Peptide Sequence Number=SeqID_132593
atgagatgggacagaaaagcaaggttgtgtgacagaaaggtggaccgtacgatagaacaggatgattgggatcgaacggtggaggagagttgtgggacagacaaggaatctccggacaacacggcagcagatcaggggatcccggtggtggggcccactggagaggaggaggtgacgtggctaacaagttacaactacaactag

SEQ ID NO: 15816 - DNA, 294 bp, Glycine max
  Peptide Sequence Number=SeqID_132594
atggagagcaatttgaaaaccaaacgaggtcaaatcatgagcgaggttgagagtggcgatccacgagagcaaatcgagggcgaggcttacctcgaagttgttggtggaggagagggagatgatggtgttctaaacgacggcgtttcggtgcggcggtggggtttggaagaagagttggtgggcgaaggggagggagagtcgggtgccggagagccggaggaaggcagaggagacgaagaggttgtggaggaaggaggacatggcggcatgggtgtggagggaggaagcttctag

SEQ ID NO: 15817 - DNA, 210 bp, Glycine max
  Peptide Sequence Number=SeqID_132595
atggtaaccgatcctcttgtgcatgtggagggagatgatggtgttctaaacgacggcgtttcggtgcggcggtggggtttggaagaagagttggtgggcgaaggggagggagagtcgggtgccggagagccggaggaaggcagaggagacgaagaggttgtggaggaaggaggacatggcggcatgggtgtggagggaggaagcttctag

SEQ ID NO: 15818 - DNA, 336 bp, Glycine max
  Peptide Sequence Number=SeqID_132596
atgccaattcctcttgcttcacctgttcctattggggggcgtcaagctgtagtcgagataaagagaaccactacccgagttggcagtggcattaatggtactggaagacctaggatcccatctggtaggggtgggttacgaaatgactctttcaggggtcgtgggaattatgttgggggtcggggatacggtcgaaatgattatgtaagccgtggcgggttttctggcgctgaagaggaagaattaaatggaaactgggtgaataaccaagagcaagaactgttaaatactgtattgttaaaggatgaagataatgtggtaaaatggtgtttataa

SEQ ID NO: 15819 - DNA, 1203 bp, Glycine max
  Peptide Sequence Number=SeqID_132597
atggccttgcaaacagctactcctccaacaactcccagtgcccaagttgttggtaatgcatttgttgagcagtattaccatattcttcaccattcaccaggttcggtctatcggttttaccaggactctagtgtgataagccgtcctgattccagtggtgtgatgacatcagttacaaccatgaaaggcattaatgagaagattctttcactaaatttcaaggaatttaaagcagagataaagactgcagatgctcaaaaatcatacaaggaaggagtgactgtgttggtgactggatgcttgactggcaaggataacttgagaagaaaatttgcacagtcattctttcttgctccacaagacaatggctattttgttctgaatgatgtttttaggtatgtagaagaccatgaaccatcagaactgcctccagttactggagatggtgattcagctgctgttacagtaacaccagaactaggcaagattataattcaaaaaattgtatcttctctttcaaaatttattcaggagctgcattcatgctgttctcctttctttacagaacccagtcatgttgctgattcttgtgcaccagagcccacaaattctcatgtgaacaaaggtcaaactgttgctgagaatgcttatgagctatctaataatcatgagagacagatacctgttgagaatgaaggcaatgtagaatcacattttcagtcaaatggtaatgatgattctcaggccacagaactggcttcatcagctcaagacgatgctccaaagaagtcttatgcatcaattgtgaaagtccaaaaagggagttcagttccaactaaagtctatgtgcctactaatacactaaagtctgggcctaacaaaactgagagcaaggtagttgagtcagtagaatctactgaagtgcctgaagcagctttggaaagtgttagcaaccctgaaagtagtgatgctcatgaggaagttgagggtcactccatatacattcgaaatttgcctttaaatgtgacggttgctcagttggaactggagtttaagaaatttgggcccatcaagccaggaggcatccaagtcagaaataataagcagcagggatactgttttggctttgttgagttcctatctctaaattccatgaatagtgcaattcagatggtaatgatttggcataagaattatatatag

SEQ ID NO: 15820 - DNA, 234 bp, Glycine max
  Peptide Sequence Number=SeqID_132598
atggaagacattctgatgcaacaacctgaaggttttgcggtggaaggaagggaaaatttcaaggtaggggatggttcccacatctatctactactctatatggatgacatgctcatagcatctcaaaatttgttggcaattctaaagttgccgtccctactcaatagtgaatttgagataaaggacatgggagctactggaaagattctgggcatggagatcaagaataattga

SEQ ID NO: 15821 - DNA, 300 bp, Glycine max
  Peptide Sequence Number=SeqID_132599
atggtggcgtgccacggcttcagtggcgtcgagcatggagctagtatcgctcttggtccggtgaagctcaggcatgggagttgcgacgacggaggggtgggtgcggcgaacttggagggcggtgaagcgcatgccgagcagagtgcggttgttgtggaagggtttgaaatcacgttcaattccaataactggaacggcaatgaaagtgaaagagacatagagagggaagagaaagagacggagagagcgaagagagaagagaaagaggcgcggagagagggaagaagcgctgcccaatga

SEQ ID NO: 15822 - DNA, 429 bp, Glycine max
  Peptide Sequence Number=SeqID_132600
atgggtctcttaaggggtgtacctatatgcccacaagacctctacaagttgttcgacccatcttttcttggcttcatccagccatttattcagctccctcaaaatcaccttgttagctacctcggcttgccctatagctatgggaaaggttatgagaatgtccattccccaaatggaaaaaggccaaggggagaccattggatagagattttcagtcggctgatgtatcaaatttccatgtttttggcattagaaacacttctttacaaaattcaagcagtccatcttgagggttggccaatagtagtcggccctcagaactccagtggccatggtccattctttggaatgcaagccacatacacccttatgcagttcctagaggacatagttagcttggtctcgatcaaggcacttaagctgaggtag

SEQ ID NO: 15823 - DNA, 444 bp, Glycine max
  Peptide Sequence Number=SeqID_132601
atggtcaacacaatcaagattgagaaattcacaaggaacatagctttaacctttggtgcatcaagatgcgagccttgttgcaagaaaatgacatctaggatcctctcttcggctaatcgtcaaagattaataagtcagtgcttgagttacaagaggaaataccttgcctttcccaatgatggaactctcgaaggccccaatagtcaaaatggacatagtccaacacggtctatgttgtgtgcacaagctttgggaacttcgtctgatgatgcttcctataaatgcaatgctcacaaaactgaagaggttctaccttgtgatttccatgtaagcctcgcttgcttagaatatccagacctttttcactcatgtggcccagacacagatgccatagagaattatcagactagccattggacacatgacttctggattgtgaaatag

SEQ ID NO: 15824 - DNA, 195 bp, Glycine max
  Peptide Sequence Number=SeqID_132602
atgtgcacatgtggggagggcgcagaggtcgaatcagaagaggaactggaggaggacgtgatagcgaaaaacgtcggcgaggacaatcgcggaaaggtgatcgttggccgcgagataggtgttggggatgacgagaatggagagggaggagcggtacaagagatccgcagcgagggacatgagggaggtgaatag

SEQ ID NO: 15825 - DNA, 888 bp, Glycine max
  Peptide Sequence Number=SeqID_132603
atgggtgtgctccgcatacttaacgtagctccaatgcagcagcatccgaacaagaatgattactcgggccaacgccaacatgaatgctttcagctaggctcggcgaaaccagatcgttgcaggaaagcgaaaacacaagaagcagagccatcgggagcatcaaagggcttaagagaccactcccgacaccgagaaggcacttcccgtgagaaaaggctcaagcagtcgatgcttgggttccaacctactaccgccaccaccttggaaaatatggcaaccctaaccaaccaaagcttcttcaataataacttttggtcaaatcgtcttattcagtcgaaaattatttcggagcacggttgccaagtcttaagcaaaggtgacaatgcggccaattgggccaacttttgggtcttcctttctagggtgccgataattgctcaacaccttcaagggtcatccaacatcaaagccttgaaggagcagctattgaaggccaaggattcattgaactcgacacttcaagccaacatgaagctagccggtgacaataagatcctggaggaacgagtgcttcctttgttaaatgatgccaagaggttggagacgcgtgccttaaatgtcgaggccttgttgatgccaacaaggagacgaaggaggctaatgttgaaaaggaaaggatttagcaaaaggcctttgatgatgtctataatgcacatgaggttgcatatgtgtgacatctcggacctaagtgtgttcgacatcaacaaggatgtgcatgaagtactgattgatgacatctcggaagatgatattgccctttcaccccacaagccaacgaccctagtcgaggaaccacatgtcaaggagatcaaggatggagaattttga

SEQ ID NO: 15826 - DNA, 510 bp, Glycine max
  Peptide Sequence Number=SeqID_132604
atgtctggcccatacgatgccattgtcggaactcttaacgtaagacgggcattgcccgcccatttgcgaagattaaggaactggttaaaagggaagagaaaaaaaagtgttgaaattgtggaaaacgatggagactcatttgcgaagagagtgagaagagagaatgtggaaaacgtacctgggaagggtgtgattgcgaagatgctgagagatagcacagcacaggtgctagccgactttgccaatgaattccatcccgcaccaccacaattcgaacaagaatggtgggcgatgcatgtggacaactcctccaaccggcatgggggtggagttggggtgatcctggaaggacccaacggcgtggtcatggcccaatcattacattttggcttcaatgccacatgcaatcaagccgagtatgaagccatcctcgttggtctaaggcttgccaaagaagttggggctcaaagagttcaatgccgaagccactccaagatcatcgtcgagtag

SEQ ID NO: 15827 - DNA, 270 bp, Glycine max
  Peptide Sequence Number=SeqID_132605
atgtgttacttgaacaacaggagtgacaatgcgatgtacagacgtgccacgagtgttagtgtaatgtgtacttttcgagtctacctagctgtgctgcttaggaatgtgtcccacaaacttgattctgatctagaaagcagtaagaagcggaattgggacactgatgttttggtattaacattggaagaggaagcaattacagttgcccatgcattggcaaatagatggacaggcagggaaggaaggaacaaccatgttattaatttgtga

SEQ ID NO: 15828 - DNA, 1176 bp, Glycine max
  Peptide Sequence Number=SeqID_132606
atgttgatggtgctgataagttatatagagactgctgaaagcactgagtcgacagaaggctctcaaagagcagtacctaatcacaaaagaaatgtcctcactgttctaaagtggtacttgctatacttaatctgggatacttataagttagttttgcagggtcagaatgatgatatcttaggtaaggaattgtcaacggattcttcacagcatgtttgctctgctttggctttagtgataatgggaatgcctccagtgttaggaaagacatcattcagtgctttgggtcattctgtatattttgctgtttcacatatgaatctcctgattgtggtgcattggccattggacataaaacacgataatgatgccttttctatgtttcatgcagcatctatgcttaactggagtttgatacctttgcttgatttgatggcatttcttttcattcagtacactgcttctagaaagggatttcgtgtccatcatcaatctttgatatcatggtctgtgctaatgttatcctctctgaccctactctcacatgctgtatttcatattgttttggtcattgagggggatcagtggagtactgttgatgctcagtgggatcagctgattggatttataagagtgcagtcatggaagactttgctgagagagtactttttggatggttttggacttgaggagggtggcatcagagcatcatctgtttactcctcttctcatgaaattgaggaacacgataatgagcagccattggatggattgcaagatagagtcaatcttctgaaaagattatcaggtgatataaatgaggaggtggataggcataaccacatgctggatcgaatggggaatgatatggatgcatcaagaggggtcctttcgggcactatggacaaatttaaaatgtgcatgcgttatctagcacacaatggattctttgagatagtaagaatccatgacaacatagaagaaaaggaagcatatgctctcactgttgtatcagagcttcacccagaacataacaagtcattcaatgagacaatggctagtgattctcagatgatgaacttggtgttgagagattgcaattgggtcttggaaggactagagtccattgtggatgttggtggtggaactggaatcacagtcaagattacctgttag

SEQ ID NO: 15829 - DNA, 363 bp, Glycine max
  Peptide Sequence Number=SeqID_132607
atgagtgattttggagaagttattattgatatgggtgattcaataaagtgccacttgggtgacaaattgttgattggcactaggcatgacaatagggtccgaacctgcgagacttgccctagactcacttcgattttgacaaggaaaatccaagttgaccgaggtcggggtcggattcgggattttataagcatgtcagggcggggcgggacgggggaaacccaacttcattggggcggagatggagtaaatctacactcctattgggttttgggggcggggacagggaaaatggggaattggggacgagggtgggataagcaaaactcggcctcgacccgtcccgttgccatgcctatttga

SEQ ID NO: 15830 - DNA, 846 bp, Glycine max
  Peptide Sequence Number=SeqID_132608
atgaatttgcatgagatagaacacatgtacttcccttttccggcaatcatagactttttgctcaatgttgatcattctaaaaggatgtgtgagtttctttctagttggacacctaacatctttgttgttgctgtggtggacagtagcaacttcaccttgaagactactttgaaggaaaatgagattctgatatcaaaacagctcttggcagatcttttaggggtacttgctgatggcaaaaggcaatatgatgagtggtttgacatcatgggcctcaaaaagagcatgatcatgaggaagttcttcgaagaaaagaatgatgagttcaaatccaaatccctgacttctttttggaggattgtgcattggattagcatgcactctgtgttgcctagagctggcacataccaagaaataaatgaccatgaattgctagtcatttatttcctatggaagaagatccctcttagcttgtcaagtctgatcatcaaccatatgatcatggccacaaagcctatcaagtcaacctccagtgtgcctaatgggatgttgatgactctggtgttcaaacattttggagtgcccttagaggatgaagctcaggatgaagaaatgttgacttgggggggagagaaaaatgttgcaactttgaagttgaacccccagccttggatgaagaaaacttgcacatgttctaataaggaaccctcaccgcctctctttgatttgatcaaaagtggggaaagattgaagaaagtcacttctgagggtactcataactctaaagaagaggtgtttgaagaccattctgagaaagttcagaatgaggaggaaaaagaagaataa

SEQ ID NO: 15831 - DNA, 860 bp, Glycine max
  Peptide Sequence Number=SeqID_132609
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcaaaactggatgtaatgtattctgggttgacggaaatgaatattcaaaatcgttgaccaattgcatgaaaacaagaatcccaatcccaatcagaattgaaattgggcacattaaagtcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15832 - DNA, 477 bp, Glycine max
  Peptide Sequence Number=SeqID_132610
atggcggaaccatcaaagaagcgcaaaggttcttcgagtagaagccaacgacattccgaggttcaggatactccaattccttcctccatttcctcctcctcattgttctcatcggaagaacaatgtatacagtacataaacctcttctcctttcgttctatcattgaccctaagttcatagatatggatttcttttctgatgagagtttcgaatgcattcaagcatttaaaaactcaaatctcattccctttatgtctctaaaattgcctgtgtattctgaattgataaaagctttttattctaatcttgaaattcaagaaagtaccttgatttcagaagtttatgggataaagatggtcattgaccaatccctcatctatgatttgacccaattgactaatgacggtgtaccatttgaaggtgcactggacgatgattggaagtttgatttttctgtgcatgatgcctgccgattg

SEQ ID NO: 15833 - DNA, 225 bp, Glycine max
  Peptide Sequence Number=SeqID_132611
atggaagaagtgtacaataactataaaaatgaagtagggcctatgcttgaaattccagaggatctgtaccatttgattaagaatgcagtttcaattagaaaccatcttgagaggaacaagaaggaaaaggactccaagttcaggttgattcttgttgacagcagaatccaccgacttgctcgctactacaacaagactaaggagctcccacaagtatggaagtag

SEQ ID NO: 15834 - DNA, 384 bp, Glycine max
  Peptide Sequence Number=SeqID_132612
atggctatttatagaaaaaaccatttggggcaggggcagcttgcccaagcaagctcgttgcttcatcttgaaggtatcagctcgcccttgcttaaggctaaagaaagaaagaccacacaccagagaatcaagaagattctaagaagtcagcctaaaatctggagaccaaaggtcactaccataaaagaaaccaaaaacctgaaaattttggcaatggatgaacttattggctcactaaagaatatcgattatgagatttttgtggaagatgaagaagaattggcctttctcatcaaagagattcaaagcttgctcaaaaagagaaaaaggctaagaagtgatggaagcttgcttgtgaagcttttatggaggctggatctttga

SEQ ID NO: 15835 - DNA, 366 bp, Glycine max
  Peptide Sequence Number=SeqID_132613
atgtcgtctgccgttgccgtcttcgggtgtaagtggtggtgcctgcgggttggcaagataagaatctcaggttgctcaggaacaaccaccagcgaatctgcatgctctgcacaaaacttggatgtcagacttggtcatgtgacaacaaaacccaaacaggaagctcccatggtgatctctacaaagccctccaatactactctcgctctgagtggatcacccatcacactcccgtcaacattaatcgtgatgctaccaggattcggacgttgccacaccacctgtctcacaactagactggctcaacaaagaaaaagctctagcatgaatggagttatggagatggcatcagaagccaagtgctaa

SEQ ID NO: 15836 - DNA, 723 bp, Glycine max
  Peptide Sequence Number=SeqID_132614
atggagtattacgatgagagtatcttaatggctttagtggtggtcgtaggcaaaccagtcaaggttgatatcaaaaccattaatgtgtctcatggaaagtttgcacacatctgcgtggaaattgaccaaaaccaaccagtagtgggtagagtttggtttagaaacacatggttcaatgtggagtatgaggggatgcaccttatctgcaatagagcgacccaagcgaaggaggggggatctggtgtaaaccctagcaaccacaacattatgagggctcgacccgactcatctaaaggtagtaatggcaactttggtcaactagttatactaactcatgaggctaacatgaacatcacaaaggctatagacaaccacaagggcacagaaaggcagcttgagggaggacgtcatgatggtggtggactcaacttttggtctagcgtaagaagggcttcgaacatttatgtcttttgtcatggaacgttatgggctttgccaacaagcggagtcatggccatgaaaagaagcaagattcatggtctccgtcgaccttctagagagtggtatattgataaccaaattcttcatgaagaggcaattaaatatttcaaaaccctcttctgctcaagagaaagcataagcagtaaggaattgaggtttgtgccagatgcttttgttatgggtcattttgatgctaggataatcgagactttcctcgtctga

SEQ ID NO: 15837 - DNA, 579 bp, Glycine max
  Peptide Sequence Number=SeqID_132615
atgatgggagagctaaagttctttctaggacttcaaatcattcaaaaagatgatgtcatattcattcatcaagagaaatatacaaaggactttttaaagaggttcagaatggataacgccaaatcaatggttacccctatgcatccatccactgtcattgaaaaggataagaaagataatgatacttttgaaaagcagtacacatataaagggaaaggcaaggcaatagaggtgtcttctaggtctgattctgaaacaaccataactctcacacctccttgctccaagggagttgcgataaggtcatccaagagaaagagctctatgaaaaaggagaagactgggaagaagagaagaagattagaatatgaggttgttgctttgttcaaagacaaaaaaatggaagagaagtttgatggaagcttcgtcaacaaaaaggtggtgaatggaagacacaatgatttgatggagatcaaagagtgtggttgggacattgtgtgttttttgaaaaagaagtggacaaggtttttgatgcacatgaactgtagaagcaagcttcatgatgatgaatcaagttga

SEQ ID NO: 15838 - DNA, 513 bp, Glycine max
  Peptide Sequence Number=SeqID_132616
atggaagtggaagggtcatcgaagaagacaatagtgatgcagcagaaggagatagcggaggctagggttccactgtcgtatagggaccagtgtgcccacttgctcatccctcgcaataggtgcagatttaatgttgcattttggcatacattccgtggaacaggtgctgacccatttggtgcacctaccaaatactggccatgggaagatgtgagagctaattttgagttcattagcaaactcagtgtggacttttggtgctttcacgacaaggatatagcctatgaaggaaaaactcttgtgataagggaagagagaatgcaaacacaattttatactggttcggccacttccaatgcctacatccagtactcaagcaacccacttgagatttccactatctttgtaaaatccattacaaagtctgaaccacacagggacaacctatcccttgtgttcaggaatcctttacaacaagagactcacagtctcttaaccaatctcattgaataa

SEQ ID NO: 15839 - DNA, 519 bp, Glycine max
  Peptide Sequence Number=SeqID_132617
atgaccaagccaaagagttttggtggtctaggtattcgaatgacaaggaaccaaaacacaacccttctgggtaaacgtgtttgggatttgattcacctagccaaccagttatgggtctcgattctaacctcaaagtatttgagggagggaaatctatttatggctaaaggaagaaagggttctatctcttggaattcaatctctaaagtgttggaggttctagaggatggcttccggatcaaattaggtgatggaaacatgtggttttggttcgatgcctgggtggtgaaggagttgttagccaagagggtttcttgggtggatatccatgacattcatctcaaggtcaaagaagtgtgggtatcaccggagtggacttttgagggtttgtatacggctctaccatgggtattggggtgcaggaaggtttccctaggtgtgagaccatgcctaaagcattggagcattgcttgttttcatgtattcactcttgggcactgtggttggcttgcggtgtaa

SEQ ID NO: 15840 - DNA, 606 bp, Glycine max
  Peptide Sequence Number=SeqID_132618
atgattgatttgaaagaattgtccttggtcagtggaaaagctgcatggatggcttacctgaatgctgcctttatcatgcaggatatctactgtttggatgccgatggtgctctttttgatgctgcattactttctgccgttgcttccttatctcattcactggctaaggaggctacttttgggaagctcttggtcatctttatgaaaactattggattttttagtagaaacaaaggacactttgtccgcagattgatgtatatgggtttgccggtgcaaattcctgttgttgccatgaatgatgatggcaaaatagtactcgtgtctgaagaagatggacaaaagcgagaacaggagccagtcaataaggagaagaggaagcttacattaagaagcattccattctcattaacttgcatacttcacaagaattacatattggctgatcctactgcagaagaagaatccattatggaaacccatgtaacagtagttttggatacatccggtcaactaatatctctttacaagcctggtgggccagttcttgcctacacttctgctatccaggttagtttgcacattgcaatggaactaacgaggtga

SEQ ID NO: 15841 - DNA, 1188 bp, Glycine max
  Peptide Sequence Number=SeqID_132619
atggcacatgttcctgataagattaagtcgatagatggatcaagggaaactcttaagctttctgtaaggatcactgatctttggttcattgggatccctgaaaagtctgaacaagccgaaatggttattgttgattctgatggagatgaaatccatgttgtttgcaaacaagatcagttaaagtcttggaaggctgatttgatggaaaatttgacttatgtgatgcataattttaaagttatgaaaaatgatgatactgatatactgatacatttattgttgtttgcttctgatagtaggcaggtgctatcctgcacactctggaaaaattgcttacaatttttatcttacttgaatgaggttgaagatgaaaggctcatcgttattcttttgacacatgccaggatcaaggaaggcctgggatcatatccgccgtcagtcaataattctttgaaggcgtctaaactaatgatcaacgagcttgtgttggaaattcaagaattcaaagagaggcttttagatttagggattgaggtcagatcaattttgatgcctattggacaagggagttcacaggtttcaaggtatagcgttgaagtgatggttaatcacaagggcgaatacaccaaatttttgctctgggaccgtgaatgtgtagagttaattggtcaatcagcggatgaagtcaacaggcttaaaatagtagatggcgatgttgatttaaatgtctcttctcaagcactagataggttattgggttgtttccttgcattcaaagtcaaggtacaaccaaggttcaggaatattgttgttcttaaatattcagatgaatcagacttgatcaatgttgtgctggatatgcttcccgatactgaggtggtcttttgtcaaccatgttgcaagatcgagagttcaatacttgactcgaccgaccctacagagcttgaatttcaatttgtgtttgttaccatggatgatgatcgttcaatgcttgactcgactgaccctacagagcttgaatctcaatttgtgtctgttaccgccgatcatgaccctcttctcaggattccattaacaccaactaagcgcatatcctctgatgaattggacgatgaacccaaaaaatttgagatttcacctgcgcaagtttcctcaaataaattacgcaagcattgtcaggctgaatga

SEQ ID NO: 15842 - DNA, 435 bp, Glycine max
  Peptide Sequence Number=SeqID_132620
atggtgattatagtcggaatcaccaatttggatgccagaaaagttctgatagacggaggcagcatgaccgatatacttttcctatttactttccaaagggtgcaagtccacacccacgatgttgtaaagctcgaaaccacctttggaataggcaaactatcaagaacattacttgttcaatatgtcctcattgacactgactcttcctacaatgtcctgactggaagaacgtcattgaatgctcttagttcgattgtctcaactccacatcttgcgatgaagttccccaatctgaaaggcgacatcatcactattagatcaaatcaaatggaagcccgcgaatgttatgctagaagcctacttgtcaaaccaaacacaacacctagagtagtagacatcaacaatgttggaggagccgactcaagagaaaaatga

SEQ ID NO: 15843 - DNA, 261 bp, Glycine max
  Peptide Sequence Number=SeqID_132621
atggcgtcattgtggatgcgcaatgacctaagtcgagaatggattggggacggagagtatggtggagtcgatggtgataggggtgatggagggtgcggtacctacaaaagggacctggtgatcaagtcaattgtgcccaaggccatacatagaactcgtcgggacaatggtagcatggttagtcgagctcttgatgtttggcctacggttcgaaccacgaggccctatcaagaggaaatgcctaacggacttcctagttga

SEQ ID NO: 15844 - DNA, 600 bp, Glycine max
  Peptide Sequence Number=SeqID_132622
atgccttccaagattattttgatgatgccaaagactcaattcaagaatcaagagccaagcaagtttcaagaatcaaagagtcgttcaatcaaagcaagtttcaagtatcaaagagtcgttcaatcaagattcaagactaaccgcctgagatatcttttgtttacccttacaaagattcaagggactaaccgcctaagaattctttgtcttaacacattggagggtacatcctttgtggtacaactaaagcgtacatctacttgggttgtaatattgagaacaagagagggtacatctcttgtggatcagttcaagtggagtgtacatccacttggttgttcaaagagaacaaaggaggcctccaatagcaaaggtagaggagtagtaattactcttgagggaccagataacatctccatcgagcaatccgtgaagtataactggaaacccatacacaaccaagctgagtacatagccctcatcacaggcttaaatttagcaattgaagtcggcataaagaaattgaaatgccaaagcaactccaaacttgtcactgagcaagggaatgaagtctttcaagccaaagaagagaaaatgtag

SEQ ID NO: 15845 - DNA, 447 bp, Glycine max
  Peptide Sequence Number=SeqID_132623
atgactgttgaagtggctgttggaaacgaagtgtttggaccaagggacacaagggtcgttcctacttccttcattccttccttccttcttgctttctttgattggcctctattttgttactccctgtctagtgtcgatatgccctttggtcctctgtttttattatctaaccatctacgtcttcttcttctactatggggaatgggtctcccatccgtgggtcttaacattaactcgtcgcccttaaagggtcttagcattaactcttcgcccttaaaggaacttaacattaactcgtcgcccttaaagggttttagcattaactcgtcgcccttaaagggacttagcattaactcgtcgcccttaaagggtcttagcattaactcgtcgcccgtaaagggacttagtattaattcatcgcccttaaagggtcttatagtcgtgtga

SEQ ID NO: 15846 - DNA, 381 bp, Glycine max
  Peptide Sequence Number=SeqID_132624
ggaaataattttcctcagcaatttcgagagagagaagtgccaagaaggctgaaccctttcttcttcactcctccccctatttatagcaaaataggggaggagcttgccacccagctcgcccaggagagcaaggttgctttctccagaagcaacagccttctggaggaaggatctgaaggcccaactttcgaagaagttacggaaactcacgaattgcgcaaaaacacttcttttcgatttccgccacattacgaaatttcacagatcgcgcaagcctgcttccttttgatttctgacacgtctcgggacttcatttattgtgcaacaaaggacgccaagtatctcaaagaggctaaccaaaggttgcatgtcatcaagtaa

SEQ ID NO: 15847 - DNA, 375 bp, Glycine max
  Peptide Sequence Number=SeqID_132625
atgaatggttgccccaagattaagggaatctcctcatcttcttcaatttccatgatcacaaagtccaccagaaaagtgaagtggtggactttgaccaagacatcttcaaccaccctgtacggtcttgtgatggagcggtttgccagctggagtgtcatcctcgtagggtcaatcttctggttcccgattcttgggcatatggaaaagggcatcaaattgatgcttgcccctaagtcaataagagctttccctacaaatgcattcccaatagagtatgggatgatcacgcttcccggatttttgaacttgggtggtagctattggatcactgcactgcaattgccttctaccacaatggtttctgtcataccctaa

SEQ ID NO: 15848 - DNA, 894 bp, Glycine max
  Peptide Sequence Number=SeqID_132626
atgaaagaagaagtgaggaaggaagtcctcaagttacttgaggctgcactcatctaccctattctgatagtgcttgggatgtgcatcgactaccaaaagctcaatgaggccataaggaaagaccattttcctttgtcattcatagatcagatgttggggcggctagcaagacaatctttctactacttcttggatgggtactcaagggtgccatttgggttatgtaatgcaccaaccactttccagagaggcatgctgaccatctttgctaacatggtaaagaagtacatagaggccttcatagacgatttctcagtttttggaccctcctttgactgttgcttgactaatttagagcttgtgctgcaaagatgtgttgaagcaaatctagtactaaatttagagaagtgtcacttcatggttcaagaagggatagtacaacccgaggcattgaggttcattaagggcttgtctaaaatagccaaaccattgagcaacttgtttaacaaagatgcaatcttcaagcttgatgaagaatgcttggaagagtttgagttgatgtgtgatgccaacgactatgctgtgggtgcaaatctaggacatcgacgagacaagatattccatgccatatactatgtcaacaaggtcctgaataacgcacaattgaattatgcgactactgaaaaggaaatattggtcaacgtctatgccttagagaagtttcaatgctatctgcccaaagcatactgtggcactatcaaaactcaccttatggaggccattatggtggagataggacaactatcagaatacttcaggctagatttttctggccttccattttcaaggatgctcatgaccatgtacttcactgtgatcaatgctagtgaatag

SEQ ID NO: 15849 - DNA, 381 bp, Glycine max
  Peptide Sequence Number=SeqID_132627
atggctagtgattctcaaatgagtaacttggcattgagagattgcaagttggtgtttgaaggactagaatccattgtggatgttggtggtggaactggaaccactgccaagattatctgtgaagcatttcctaacttgaaatgcattgtgtttgaccgtccacaagttgtggagaacttgtcaggaagcctcaatttgacatatgtaggtggggacatgttcaaatctattcccaaggttgatgcagttctgcttaagtggattctacataattggattgataaagatcgcataaagatattaaagaattgtaaagaagctatttcaaatgagggtggcaaaagaggaaaagtgattatcatagatgttgtgatcatataa

SEQ ID NO: 15850 - DNA, 1236 bp, Glycine max
  Peptide Sequence Number=SeqID_132628
atgggttctcacaacatcaaaatccagtaccactcaagggtttcccctccctcagcaacacaaacatcactctctcttactttcttcgatcttttctggctcaggttccaccccgtggaacgcatcttcttctacaccctccctacaccccaatcaaacccatccattttctattccaaaatcgttccaaagctcaaaacctctctctctcacaccctccaacactttccccctctcgccggcaacgtcgtttggcctaatgattccccaaaccccatcgttcaatacactccaggcaactccgtttcatttgtggtagcagaatccgaagctgatttcaaccacgattcatcggattctcatgcctctattgtctctcttcaaatcactctgttccccaacagaggattcagcataggaatcagcacccaccattccgttcttgatggtaaatcttcaactcttttcatcaaagcttggtcttctttatgccaaaccaacgatgatgagtcttcagagtcatcatcaccatctttggcaccaaagttggttcctttctttaacagatcagtcatcagaaccccaagggagttgggacttaacttcccaaccaattggaccgaggccttaaccaaattgttccctactggaaacagcgacgggagatgcttgaagctactacctttccctccaagactcgaggatgaggttcgagccaggttcgtgctcacaggagcagatttggagaagttaaggaaaggtgtcttgtccaaatgggacatcgttgaaagaggaacagaatcagaggcacctaggttgtcgtcctttgttctcacatgtgcttatgcggtagtttgcattgctaaggccattcatggagttgaaaaggagaaagagaagtttgcttttgcattcacggtggattgcagggccaggttggagcctccaatccctgagaactatttcggcaactgtgtgtggggtaatttggtggatgctgacccactagacttcataaaggaagaagcttttggtattgttgcaaagagtattcatagtaaaataaaagagatgttagataaggggatttttcatggggcggatagttcgttttctaaatacgagtctatggcaaaggagaaagttgaagtctttgcaattgctgggtctaatcgatttggagtttatggaactgattttggttgggggaagcctgcaaaggtcgagataacatcg

SEQ ID NO: 15851 - DNA, 543 bp, Glycine max
  Peptide Sequence Number=SeqID_132629
atgaattcgggtcgtatttgtgggcctttaaaaaccgctgggacccaagttggttaccgagggaaagcgttcttcaatttcagagttcgggcttcatttcagactcagagtaacactacagtacagagtacaaacatcaaacaccttctctgcacgcaaaaaccagaatcgaagatgcagagatttaaagctctgctacctcaacaaactaggtcctcacttcgcactttctgttctcaccgtcgagctttctccgctcaaccaaattactcagagcaccacgacgacgattctcaggaacagattttggtcgaaggaagagcgaaatcgcgagcagccattctcaacaggccgtcttcgctgaactcgctcaatgcttcaatggttgctcggttgaagaggctgtatgattcctgggaagagaactctgatattggctttgttctgatgaagggtagtggcagagctttctgttctggtgcagatgttgttaggttgtatcaatcactcaatgaagtttcaatccttcaagtggttacataa

SEQ ID NO: 15852 - DNA, 141 bp, Glycine max
  Peptide Sequence Number=SeqID_132630
atgggtgaaaaccctagatcgtggcctgagaggttgttgcaacagcataacaacctcattagtcagccacatgacgctaaggttggtcatctagagaacatccgtgctcatggtccagggctaactaggatggaggattga

SEQ ID NO: 15853 - DNA, 804 bp, Glycine max
  Peptide Sequence Number=SeqID_132631
atgaatcaaggaactgagggagagccagagaggaacggcgagaaacgtccaggaggaaagttgttgattgtgagatgtgaaagagctgagattctgagaacagaaagcattagacccttgtttcgctatttcaagtggcaggaaacatgcaagagggcccttagttgcgacgggcattgttcacccgtgaataaggcacgccctaaggcaaaaggaggtggttgcagtgtaacgctcgccagagatgtgtcgtgtggtgtgcatgaacttcccttgccagaaaagggccatgtgtggggtcactgcggcggcccaatagtgagcgcgggtactgttcacccacaaagaaagttgcacacagatgtgtttgtgcgaggaacgttggtgaacgtcgttgtggaagtggattctgaaggaggattggtagaggctatgaaacacaacaaaacaaggccaaacaaccagccaaacgagggtgttgagaggggtccaccagaagtaggaaatggtagcagaggggttgcccgaggatggtctcaccggaaacgacgccacacaccgatgtgtgaagagcacatgagttacccgcactggagagaggaggcgcgtgtgagcacatgcagaggagttgcaggtcgtgactctggttcaaaggcatgtacagtagctgctgctggagcgatgtccggcgtggaggtcattggtagaagaaagaatgatagaagaaaggcagcaggcaaaagggctcacctaggacaatgggtcctcagtaacggacggtttttccttattccctcaacctag

SEQ ID NO: 15854 - DNA, 546 bp, Glycine max
  Peptide Sequence Number=SeqID_132632
atggcacaaatgaaatcttctatttttgaaaataagagggttgccattttggatggcataacaatgggatgtggatctggaatttctctgccagggatgtttcgtgtggtaactgataaaactattttttctcacccagaaactcaaataggtttccacccagatgcaggagcttcttatattttgtctcgtctacctggctacttaggggaatacttggccctcacaggagataagcttaatggtgttgaaatgattgcctgccgccttgctactcattattcactaaatgcaaggcttgctttgcttgaagaacgtcttggtaaactaatcacagatgaaccttctgttgtggaggcatcccttgcacagtatggtgatcttgtttatccagataggagcagtgtccttcacaggattgatacaattgatagatgtttcagtcaagaaactgtggaggaaattattgaagctttggtgagcattgtattaaatatgttcatgatcattgataagtctggactccggaaggagctgaattattaa

SEQ ID NO: 15855 - DNA, 228 bp, Glycine max
  Peptide Sequence Number=SeqID_132633
atgtctcatggtcacggtagctctggtggtgttaaccaggctccacgtccagctccttggcacatagggctgtggattttgtattcggtcctcgaagtatatattcaacacgaaacagtaattaataggtctcctgttgctgccattgcacctatggctaatagtctagacggtgatacatgcaatgctcccacaaaggcttttcggatccttttaggcatgttttga

SEQ ID NO: 15856 - DNA, 711 bp, Glycine max
  Peptide Sequence Number=SeqID_132634
atggtttgggatctgcaaccttcagaagatgcaagtagaggctcatctaagttgtctcgttcagacgttgaaaagctgaagcaaagtgtggtgtccaagaagaaaaagaacacaaaccttcacttatcaagttttgtgttatctattgcctatgcatgggtttgcagggtgagagctgaggaaattaaaaacaaaagcgttgctttggctctaactgttgattgtaggtggcgtttggagccacctcttcctgcaacatactttgggaactgtgttggattcagacttccaattgctgaaacgagagagttgttgggggaagaaggactagttgtggctgtggaagcagtgagtgatacattggaaactctgaaggatggagcagtgagtggagcagaaaattggtcatcatggttgcttgatggtatgggagctgaagctgatgtgaagaaaattggtgttgctgggtcaccgaggtttgaggtatatagtagtgactttggctggggaagaccaaagaaggtagagatggtgtctattgaaaaaactgcagtgtttgggctttcagatagcagaaatggggatggaattgagataggttttgcttctctttttgtcaatggccttgaatctcgagtctctctcagtttgcttggtagggaacttactgttcaaccgcagaatattccatatgaacattttgtttggtga

SEQ ID NO: 15857 - DNA, 715 bp, Glycine max
  Peptide Sequence Number=SeqID_132635
gctcgcgttaaacgtccccaaggagatgaacactccgcttacaggatcaacaagcacacccaagaagagtcgtaaccccaacagaccagaaacaccatggacaacaacaacacctctcacacacattgatacgaaggtcttccctacgtccctcaagggagttgcattgacgtggtatgaaggacttcctccccggtctattgatagttttgacacccttgacgatcgcatcgtgaaccttaatcccgaggtggtgctgcattctatgttgttggccctacgacctagaaaatttgcttacagtttgtgcaagaagcctccaagcagcatagatgagttacggaccgacacacacaagttggacaagcaacatagactggacaagcatcaaccccttcaaaggggaccaaggtatggatgttatacacctttgacggaaagtcgggtcaccgtcctcgaggttcccatacaattacccccaggcaagattgagaaacttatacaagcgggttacctaacccagttcgtgaaaagacccagtagcaaccaggctgaaggacgacttggaggtcacaatgaggaccatcgcaggggaagtgatagaggacaagacagaaggggaaacaaaacagaagatagagggagacctaggcatcaccaacaaagacgtgagcaccaaccccaacaagagcaggaaaatgaacctgctcaatag

SEQ ID NO: 15858 - DNA, 900 bp, Glycine max
  Peptide Sequence Number=SeqID_132636
atgatgatgattcgatttccattggtggttcttgtgttgatgatttgtgccatgagatgcagaatggccaaagcagcagaacaaagtcctgattctgggaatgtgtacacgctagcttctgtgagagaggatttggttaggcaagaggataccatcatttatggtctcattgagagagccaagttccctagcaattctcacacctatgatgaaaagtatgctcaaatccagggtttttgtggctcattggtggaatttgttgttaagaatacagaggccattcaagctaaggctggaagatacaaaaaccctgaagaaaacgccttcttcccagaaaatttaccaccatcaattgtgccatcttactccttcaaacagtttttgcatcctggtgctgcttcaattaacataaacaagtccatctggaaaatgtatttcaaagagttacttccattgcttgctacttcgggtgatgatggcaactatgcgcaaactgcagctaatgacctttcattattgcagaagctacaaagagtagcttctgcctctattgctgccttggacgtgaaaacatccatctctagaaggattcactatggaaagtttgtagctgaggtgaaattcagggatgctcctcaagactacgagcctttaattcgagctaaggataaagaaggattgatgaaattgttgacatttacaagcgttgaagagacggtgaggaagagagttgaaaagaaggctgtggtgtttgggcaggaagtgaatcttaacagtgatgacaatgacaatgaaaaccgtaaatttgatccatcagtggcttctagcttgtacaaaaattgggtgatacctctcaccaaggaggttcaggttgagtacctcttgcgccgtctagactga

SEQ ID NO: 15859 - DNA, 1566 bp, Glycine max
  Peptide Sequence Number=SeqID_132637
atggctgacttctcttgttccacatccactatgggccgcattgaagcagccatcgcagaacacatcgttgcccaagacgccacaatcatcaaactagacggaattaaacccaccatcagcgaggctcctcaatcgaacaccaaagacggagatgcagagttcaaatcgagctctgtttgcttagacaaaaaggtgcaaagcttcatggaagagtcgctaaactcggtatatagtcaagggagggttacggaaaatcaaaccatggaggcggaagttcatagtgaagattgttcaaaattcacactgggaagcgatgagaaaccagatgctaatgttgtttcattcaaagtcataaggaagaaccccttttgggtgcacaacagagaagcacttcggctcttcaacaagttcaacaaaggtctgaggcatttccttggtattgacacattttaccctggaggctacttaagggacgctggtaagtggactgttcagcaagctgctgaattatcaattgttgctcccactattgaagtatcattggatggaaggttcctaagtgggttgaaggaggaaagagttgaagttgcaaaggttcttcatgcaaccaaaatctgcagttatgcacatggaatgaatttgatccgtgcaaagagtattgaaaagggttgggatttgaagttgggtatgtctactagtcttgcttattttgacatcatcctacttgcatcaaactataatgatgcaattttctatgttgagaccatgaatcttgatggagagacaaatctgaagcagaaacaagcactcgaagcaacttcaaaattgcaagactcgaactttcaaaatttcagggctgtcatcaaatgtgaagacccaaatgctggggttgcttatggacgaggagttactgaagttaagagagctctatctaggaaacatgaatcacatccaggccaagagttgaaaaagattagtgaattaaagtcatccattaaaggttttaactttatggaagaaagggtagtgaatggaaattggatcaaagaacccaatgtcaatgtaatccagaacttcctaccattgctggttgtatgccatactgcaatgcctaaagttgatgaagaaactagtaaggtttcatatgaaactgaatcaccagatgaggcagcttttgtgattgtagccaaggagtttggatttgaattttatgaaaggacacatacaactatttcactacgtgaattagacaccatatcagaccagaaaatcaacaagtcttacaaacttttgaatatattagattttactagtgcaagaaagcagatgtctgtaattgtgaaagatgtggaggggaaactattactacttagcaaaggggctgacagtgtaatggccttaatacttgcatatcgtgaacttaatgatgaagagtacgataaatttaataaagagtttacagaggccaagaacttagtaagtgaagaccaggagcagattgttgaggggataatacaaaatattgagaaggacttaactcttcttggtgctcctttggcagattga

SEQ ID NO: 15860 - DNA, 354 bp, Glycine max
  Peptide Sequence Number=SeqID_132638
atgggtcaaatttgtgttgctcctagacagtgtacaacagactacatgaagtggttttacatgatatctcatccctttatgagtccgacacaacctagggatcctcctacacatccacccgtggtgcacgatgatacatttattgaaccagatcctcctcagcagccagtcaccgcagcggctatgccagaaccacctacacctgctattgaggctagtcatgcaataacagaaaggttggaacgcttgatcaacatgagggtagttactgctggaactgaagcatgcactgtgaccgaggagtgcctgaggattgttgcagttgtgactgcacaagggaatgcatatgtttga

SEQ ID NO: 15861 - DNA, 2922 bp, Glycine max
  Peptide Sequence Number=SeqID_132639
atgtctggaaaggctttgaaatccttgaaggatgaaaacccagatttgcagaagcaaattgggtgcatcactggattttttcagctctttgaccgccaccgtttcctcacaggccaacgctctgccacctacgttcagcacaggcctacttcaggtggaagcagtaatgaaatcaaagagctcaatggtacaaagcaggaagctaaggcaaagaatctgaagactgctagagaaaagcaacaattctccacagaatcatccataacttctttttcttcatcatcttgttcatctagcatgtcatcccatgagtttaacaaaacaattcagatacaatcaccgtcaagaaatcgaatcagaattccagaaaacacaaattcaaaagcagcaaagaagcaacctgataccccgcaccagcaatccctccatttccatcatattgtcaacgactcaatgcataaagaaactcaaggattgtctgtgaaaattggggctaaagaggaaaagaagggtcagactaatgccttgaaacacattgattccccccggcctttgcagtcacacaaatatgtgaatgcaggagttacagttgccagtgaacctttacatactattgcaaagtctaagaaaaaaccttgggactcaccacggctctcttatgatgaaacattcaaatctgccacaaagcacaaggaacttccaagactttctttggacagcagagaagggtccaatagaggtttcaatgaaggaaacaagtctcacaaccagttgaagggttcaccgagagggtacgggagaaactccagcacaatgattaaccatctgcaagaacaagaaacttccaaaaggtcttccagtgttgtagctaagttgatgggacttgaagccctccctgagtgtacacaaacttgtgggagtccaatgggaacttctagttgttcttccaaaaagaatgagctcttggcaagatctagtacaagtgatgaaaagcaacaccaaagattcagcttgcctcagtctagaagggctgattcaatcgcaaatgtgacaccatgttcacggtttgcactagaaccaactccatggaggcaacctgatgaaagccaaagctctccattacaagcttccaagggaagtgaatctgatataaaagcctcaaagtcctctctcactgtgtacggggaaattgagaaaagggtggcagaacttgagttcaaaaagtctggaaaggatctcagagcccttaaacagattcttgaagcaatgcagagacataaggattcagtagacatttctagagaccatgcttcaaattctccatctgacaataggaattgtactaatctcaatgaaagctcgaaatctcagagcccaagagtacgacaaaaagatccggcatctgtcacggttgagatgtcaaattcaacccgggttagtaaattgccaatcgtcatcatgaaaccttcaaaagttactaggaaaccaaataatccttcctctacagaaatatcaattcatgctaaatctggtcccagcaagtgttcccctagtaatcccacaaatggaagattggttgacaggcaaactactataggtatcagttcgacaacaaaaaatatcaaggatccttttggacaacaagttctttcatctgataaaaacaacatgagaacttcaaagttgatgcaatccttgaaagtttctcaagacaacactggagaatgcaccaccaactctggttatacaaccgtgactggcagccccagactacaaaagaagtttggtttggagaggtgttcgcaaccaaccagtccatcatcagattccagaattaacagaagagggcatgataggcaacctgtggaattgtcttctccaagtacaacaccaagacataagttctccactttgcagcaaagaaatgaacgtttcactgaaatcagctgtcacttgagggattttaagcatcatgttaacatcatttcggattttgacaacaaaagcagctcggccagtcatagtgacattgaagtcattcgcattgatcaatctagaaagatcattagctcctccatccagctgagtggcatgaaccaaaacaatgcatttgaagagttgaggaaggcggagacaatgattactgcagaacaaccaagccctgtgtctgttcttgatgctgcattctatagggatgacccaccatctccagtgaaaaagaaatcagacatctcaaaaaatttaggtgaagctctaagcactgatgaggatagtgaagagagctcagtggatctacttcaagaaattgagtggattgatgagaaactcatcaatttcaataacactagggatcctgaccataagtatatagcagaaatactgttagcatcaggtctgctcagtggccacagctatagccagatattccattcgccgggtcatttggttgatccaaagttgttctttgcacttgaacaaatgaagacaaagatgcattttaacattaaagacagtgccaagaagattcgtaggattattaaccctgagaaaatgcaaaggaaactcatatttgatgttgtcaatgacattttagttcaaaagctgatattggataattcttctgcattgtggtgccaaccaaatgagttagcaggcacaacactaaaagggaagcagcttttggatgagctatgcacagaaattgatcagttgcaacctcaaaataggaatttcagtttagttcatgaggatgagaatttgaagcatcaccatgcaatttggactaattgctgcaatgagatgccaaatattgtgttggatattgaacgtttgatctttaaagatttgataactgaggttgtgagaggtgaagtagcaaaccattctggtagacattgcaggcaactggtgttttacaattag

SEQ ID NO: 15862 - DNA, 155 bp, Glycine max
  Peptide Sequence Number=SeqID_132640
agaaagtcatagcaaaaattgaagataatcaaacctcaggaggacaaaatggtttgctagtccagcaacaactatttcccttcccactcaaccttcatgcagctatggagttctggatgacgccacttccaaagagggaagataagtcgggatag

SEQ ID NO: 15863 - DNA, 201 bp, Glycine max
  Peptide Sequence Number=SeqID_132641
atggagcatgacacattccttgcaacttggttggcagagtttgatttctctcccaatggcttgagattctcaaatttgcaaccacagcctaggttgatcaaccatgaaaaacctatgctatgtaggtggcacaagcttaatcccttcaaaattgagggtaggagatttgccctggactcagctagggactactttccttag

SEQ ID NO: 15864 - DNA, 837 bp, Glycine max
  Peptide Sequence Number=SeqID_132642
atgatcagcaagcttattccaaacttaagagagttgaggctagttggttgttctctttcagatacaaatattcaatctctgttttattcaccttccaacttttccactgctcttaccatccttgatctttcttcaaataagctcacatcctcaacatttcaactgttgtcaaactttagccttaatcttcaggagctttatcttggtcataataacattgttttgtcatctcctctctgcccaaactttccttctcttgtgatccttgacctttcctataataatatgacatcatcagtctttcaaggtggtttcaacttcagttcaaaacttcaaaatcttgatttgcaaaattgtagtcttacggatggaagttttcttatgtcatcttctttcattatgcgttcttcatcttctcttgtatcccttgatctctcctcaaatctgttgaaatcatcaactatattttactggctctttaactctaccaccaatcttcataaccttgaccttggttataacatgttagaaggtcccattccagatggatttgggaaagtaatgaactctcttgaagttctttacctatccgataacaaactgcaaggcgagattccatctttctttggtaacatgtgcgcattgcagagtttagacctctcaaataacaagttgaacggtgaattttctagcttcttccgaaattcatcatggtgcaacagagacatatttaagagtttgtacttatcttgtaaccggttgactggcatgttacctaaaagcattggattgctatctgagttggagtatcttaacttggctgggaattctttggag

SEQ ID NO: 15865 - DNA, 258 bp, Glycine max
  Peptide Sequence Number=SeqID_132643
atggggtgttctcctctacgtcgtctcatcctctacgcaaatagagggtcattctctccatcgtcatcttcatgtcgtcttctccttcgtggtagtgctaagctcatcttctccttatgtgcttatgctctcctctgcaatgatagattaatgacagcaaaatggaaatggaagaatgatgattggagatgccacttcaaggagaagatgattaaagaagaagctcaccaccataggaagccatggataagggcttga

SEQ ID NO: 15866 - DNA, 165 bp, Glycine max
  Peptide Sequence Number=SeqID_132644
atggtttctccccctccaaagtactgtaaagcagatgcaatcataggaaggaaagcaatgttcaagagacctttttatcttgagtttctgaacttctgctttgagaaatttgaagtggctgtatggtcttcaagaaccttccaagggtacggtgtgcttggttag

SEQ ID NO: 15867 - DNA, 573 bp, Glycine max
  Peptide Sequence Number=SeqID_132645
atggatgtcaaatcagcatttcttgatggaagcttggatgagcatgtttttgttgatcaacctcctgactatattaaacttggaaatgaacataaagtgtataaattgaaaaaggcaatctatggactaaaacaagctccaagagcttgggatgggttgtttttcaagaagggtgaaaagtcagagttgattgggtttaccgatagtgactttgcgggagatcaagatgataggaaaagcacttcagcttatgtttttatgtttggtacaggagttgtctcatggtcatccagaaagcaacctatagttaccttatcaaccatcgaagctgaatttgctgctggatcagcttgtgcttatctcaacaatgatggagcaattgtcttgaagtactgcaaaagtgagaaagctgcttggtgtttgcaccttggacacgttggagaagcacagctagtgtttgattgccactttctttggattgaccgcgaatcaagccaagctcaaggtcaagagcatacgtggagttgtgttgctgctggagatgaagcaaagcaagtgaagaggaaagtttag

SEQ ID NO: 15868 - DNA, 3541 bp, Glycine max
  Peptide Sequence Number=SeqID_132646
atggcattgttccgcaagttcttctataagaagcccccagatgggcttcttgaaatcactgaaagggtttatggtacgctttctgctggctcattttctgtaaacacattggttctggtggaactgaagagtgttggctttcttctcagtgcaaatatttcatcatccttatgcatattgtcttggtggggggttgtggtattctttgattactgctttaccacggatgttatggaagaagatgaatatagagtgtatataggaggaataattgggcaacttcgtggtcacttccccgatgcttcatttatggtgttcaacatgcgggagggagatagccaaagccagatttcaaacattttgtgtgactatgatatgactgtgatagactatcctcaacagtatgaaggttgcccattacttaccatggagatgatccaccatttcttgagatcaggggagcagaaaacactagacatgatatacaagcaagctccttgggaacttttgcagttgatgtcaccgttgaatcctttaccttcacaattgaggtatcttcagtacatatcaagaagaaatgttggttcagaatggcctcctcttgatagggcacttactttggactgtgtaattataagactcattcctaatatgggtggagagggtggctgccgtcctatatttaggatgtatggacaggacccttttattcctgcagatcgaactcccaaagttctcttttcaactccaaaaaggagcaaacttgtccgctattacaagcaggtggctgattgtgaactagttaagattgacatccattgtcatgttcaagcattcataagatcaaatattttgatgcttaaccgtgatgagcttgacatattatggaatgctaaagactactttcctaaaaactttagagtggaggttcttttctcagatatggaagcttcgtcttctgttatttcaattgatctgcctcatgttgaggaaaaagaaggcctacctgttgaagcatttgctaaggtcaaggaaattttcagcaatgtggactggctagattcaaaggcagaggtagcaagtgtgctccaacagatcacagcatcaaatatccttcttgaaagattggacagtggggtttctgcttcaacaagtggcttgcgaaaggagtcatctggaaaatttaaacttgattcggagaaacacagtgattcaaagaatctgacttcaacagttcaggagaaactttctatgtcctccatgggatcatcagtggatgttcctatggataataagacagaaccattacaatcaaaggcattgccaggaaataacattgagagtcttgaatgtttaggtcaggggaaccaacctattgcctcatttgggctctcaacagattcagattctaccgaaaaggcacacaatgattcaaagaatctgacttcaacagttcaggagaaagtttccacctcccccttgggatcatcagtggatgttcctacggaaaataagacagaaccattacaatcaaaggcattgtcaggaaataactttgagagttttgagtgtttgggtcaggggaaccaacctattccctcatttgggccctcaacagattcagattcttttaaaaaggaggttgaatcattagaaacaaaacaatcattggaaaatgataccaagtttactgcatgtatggctcacgagaatcaatctatccccttaattgagacatcaatggatgcaaatttaataaaaaaggagagtggatcattagaatccaaggagaaggatattgagtcattagcatcaaagaatcttttggaaaatgacaccatgtgtcctacatctgtagcccaggggaaacaatctgttcccttaattgaaccatccactgattcagattcattggaaaagaagactggtttgttagggtcaaaggagaaagcaattgaatcactaaactcagaggcattgttggaaaatggtagcagattaaaatttgagccaaagccacttccagaaattgatacaagaagtcctacttctgaagttgaagggaaacgttctatgtcctcatctgaatcttctagtaatgctcctatggaaaagtacaaagatcctctagaattaaaggcatcgccagaagataacatcaagactcttgcatccatgagtcaggggaaacaacttattccctcatttggactctcaacagattgtagttttactgaaataccaattgtatcattagaatcaaaggcattggtggaaaacaatgccaaggttcctacatctatggctcatggggagcagtctatgcccttaattgaaccatcaaaagatgaaaattcaatgaaacagaagatgggatcattagagtcaaaggaaaaggatactgaatcattagaatcaaagtcattgttggaagatgataccaactgtcctccatctattgctcagggtaagcaatcttttcccttaattcaaccatcgactgatgaaaattcaacgaaaaagatgggacaattagaacaaatggtattgcctgaaaatgatgtcaagagtgtcaaatccacagttcagaggaaacaatatgatcccttacttgagccgcccattgatgcaaacctaattagaaaaaagattgaacctcaagaattgcaggttgcacttcagcttcccactcaatctaaaataatttcaccatgggtgcgtccagctgttcgatctgcttcagcttcttattttaactccttgcaaggttcacctgtagctatctcaaggtatcatagtgcaccatcagctcttggaataacatctgtgttgcaggatcatgcaccaatggatatcaaagaagtcactcatgcagtgacagtatctcctctgccttctactttgcctccttctgactccaaggtgcaaaattctttagagcctagttctaccattgttcctccaacatcatcaccaccattgcttccatctttaccattaaaaacttcagttgatgctcttactgccatggaaaagacttttggatcctttgctcctgcagctgtcactgctcttccaccaccaccaccaccacctcctcctcctcagagcgagcatacttcaaaattgatgcaatctaatgttacacagtaccctgaaaatacaatgctagatgaaggtaagaaatcattggttagtcctcctccatccctttcaatgcctgctcctccaaccacatctctttcttctccatcatctgccacaaagagctcatccttatctcatcctccacccccttcccttcctggaacatcactttccactgccaaagatgcatttaaaggtcctcctccaccaccgcctccacctacccctccaccttcaaccaatcaggcttcgtcatccttgatacctcctcctcctcctccactgcctgggtttccttattcagcctctcaccctctttcttcttcatcgagtatgagcaagtctgttgctacacctggccctcctcccccacctccacctcctagtcattctg

SEQ ID NO: 15869 - DNA, 189 bp, Glycine max
  Peptide Sequence Number=SeqID_132647
atgcaaggaagcttatgggctgagacacagaaactagatgaattttgtagggctccagagtttgacatgtcagaacttgagagtttgttctctgcagctgcaccaaattctaatgatggaaaaggaggaaaattgaatcgccgctcctcgcaaaaagttgacaaattaatacctgtccagcctaattag

SEQ ID NO: 15870 - DNA, 495 bp, Glycine max
  Peptide Sequence Number=SeqID_132648
atgcctccaatcacagagaaacatgccaatttatacatgtattctctcgtgccaatcgttgtctttcagtgtgctgtgcttgcattggatgattcagtattggatgttgatcaagttgagaacctcataaaattctctccaaccaaagaagagatggaaacgctgaagccgtactttgtgtgcagaactataatggggataaggacaacttgggaaagtgtgaacagctcggctacgccagaaacgggtactgccatcacgatgctgatacagtggtggcacaaagagaggcagggaggagtagaaactagaggaacgcctcagatggttgatgacgtcaaaaaactagagagacaactggattctttgatcatcggaggactgaaactacatgcgaatctcccgaaacatgtaagggagtggaagtcgacagagtataccaacaacgatcatcagcacaggaagggactactcaaggagaacctagctaactga

SEQ ID NO: 15871 - DNA, 1023 bp, Glycine max
  Peptide Sequence Number=SeqID_132649
catcaaaaagctctcctagtggctcggtttgaagaggaagaagtgagagctgctgtgtgggaatatggcagtgcaaagtgtcttgggctagatggactcaatttcaagtttatcaaggaattccgggatgtcatcaaaccagatttgctctgttttcttgatgaattctatgtcaatggcatctttctgaaagggagcaatgcatcattcatggctttgatccctaaggtccctgacccccagaatctcaatgaatatagacctatttcattaataggctgtatgtataaaattgtggctaagttattatctggcaggttgaagaaggtgcgactagctattatagatgaacaccaaatcgctttcatagagagtagacatttgctacacagcatggtaattgcaaataaagtggttgaagaagaaaaaagatgcaacacaacctgccttgtgttcaaagttaactatgaaaaggcatatgatttagtatcttgggattttttgctatatctgatgagggggatgggtttctgcaataaatggatatcatgggttgatggttgcctgaaatcagctttcatttccatactggttaatgggagtccattagcagagttcatccctcaaagaggacttagacaaggggatccactagccccattcctattcaacattgtagcaaagggcctaactggcctgatgagagaagcgcaagagaaaaacctgtttgagggatttaaagtaggcacaaacaacgtagacatcagtacactacaatatgcagatgatacggtgttctttgggtcaacatcgatggcaaatgtcagagcaatcaaggtgatgctaaggagttttgagttggtcttggggctaaagataaattttgataaaagcagttttggggcgatcgggatgtctgagcaagggatgcatagtgcttccacttatttaaattgcccttttcctatttgggtatccccattagggcaaatccaaggtgtagtgagttatgggaacctatag

SEQ ID NO: 15872 - DNA, 318 bp, Glycine max
  Peptide Sequence Number=SeqID_132650
atgactttggttaggattgtttttatcgcggtcgttcttactttgataacttccaatgcggttggattcactagtacaccaaagacgtcgggtcctaatcaatgtcatgataatgctgattgctcaataaagttaccttactgtaagggaatagccttttgtcgtaatggagtttgcgcgtgttacgaagagaaagcaagcataacacaacaatgtcaaaatgataaagattgcattcatttaatttgtgctccgccatgtgaagtttcctattgtgacacaaaaacttccaaatgcaaatgcaagtgtaagaactag

SEQ ID NO: 15873 - DNA, 981 bp, Glycine max
  Peptide Sequence Number=SeqID_132651
atgtatgatctacaccccatactattattagttcaagaggcaattgtgcagacatgtgttaaagcattattggaggcaattgtgcagacatgtgctatagtcttgaatgatggaaaggcatgtaaaggagttgagcaaaaaattggtatgctgataatacttccatgttatctttgccggttatggggcgaaaatggtgtgaatgtcgatgatctcgagacaaatcatgttgtccttgttcatggaggtggcttcggggcatggtgttggtacaaatccatagcacttctagaagaaagtggttataaagtaactgccatagatttaactggctcgggtgtgagttcatttgatgcaaacagcattacaagtctgtcgcaatatgtgaagccacttaccaacttccttgaaaaacttttggaaggcgaaaaggtgatcttggttggacatgattttggaggggtatgtatatcatatgcaatggagatgtttcctcttaagatttccaaggctgtctttattgctgcagcaatgctgactaatggacaaagcactcttgatattatttctcaacaggcaggttcaaatgatcttatgcgacaagcccagacttttgtatatgctaatgggaatgatcatcctcccacttcttttgatctggacaagtcattgtcgagggatttgttattcaaccaaagtcccaccaaagatattgcactggcatgtgtctcaatgaggtctgtaccatttgcaccagttttagagaaggtttccctttcagacctgaaatatggatctgtaaggcgattttatatagaaactcttgaagacaatgccatacccatttcactccaggaaaacatgataaatgcaagccccccagaaaaggttttccgtttgaagggggctgatcattctccttttttttcaaagcctcaagctctgcataagttattagtagaagtctcaaagatcctttga

SEQ ID NO: 15874 - DNA, 1302 bp, Glycine max
  Peptide Sequence Number=SeqID_132652
atggaaactagaaaagagtcaattaataagccagtttcttctaattctatgtctattgatgaaaatgaggacaaatcaagtcatgaagagatgttatctcaatttgttgagcctagtggtagtagtaaaaggcctaggtctttaaggtctaagaagtgtgagaaaagtaaagggcctgatatcggtcaaatgatgttagacatgcaaggaaaattgaaagctaaaaaaatagatgaagcggtcgtgcgtgaattgattgttgatttaatggttaagcatgatttgcctttgagatttgttgagtttaaggagatgtggcatacaagttcatctcagagacagtatccaacagtgatagaagagctgtgctatcaattttcacttgctgatattaagaaatcaaccaaaaactttgatgaagaccaactaattggaactggagatatgtgtattgtatataaaggttctctccaacataatggtgttactgaggatacagttgtaatcgggcgaatacatgggagcgctgagaaagagcttaagcaattcaagaatgaaattgagctgctttgccagcttcggcatcctaatttgatcactctattaggattttgtgaccacaaagacgagaagattcttgtatatgagtacatccccaatggatctctccatgatcgcctatactgtagtgatgtgaaaaaggaaccactaacatggaagcagagactaaagatctgcataggagcagcacgtggactacacttccttcacacaggtgtcaagcgaaccatctttcatcgtgacgtaacaccttataaaattcttttgggtagcaacatggtggccaaacttgcagacttccggctttccttaacaggaccgcattatgcatcaaagccaaaaccaaagacaatttcaaaagatggctttataggtacatatggttatgtggctcctgagatttccgaaaacaatacaataacagaaaaatgtgatgtttattcctttggggtagtgctactggaactggtatgcaaagacaagctaaaagatgttgagaagcggcagaagcaccctgttgaggagaatattgatccgaatatcaaaggaaagattgcaccagagtgttgggaagtatttatggatatcacagaaagatgcttgaagtttgatccgaatgagcgaccagcaataggtgaagtggaggtgcaacttgagcttgctctgtcactgcaggaagaagcagatataataaatactggcgatgattataccctattatcgatgatcattatgaattaa

SEQ ID NO: 15875 - DNA, 408 bp, Glycine max
  Peptide Sequence Number=SeqID_132653
atggcgacgccaaagacaaggccggagaacacaacagggaacacctttgatgagaagtccagcaccaatactggtcgggacaacaacaaaatcgcttgcgccacaacttgtttcgtcggcagagggggcacctttgacaacaactccggcgctgatattggtcgcaacgatattggagtgagtggtgttgtcaactgcttctctggagacatcaacgacatggtttctgtgcggtattgcaccatcggtgttgttatcgttgcggagtccatagagttgtctattgatggtaacttctcagaggggaaagatgaggaaggttggctggttaccgagatatgtagtttcaagagaatgacatcaagtttggagaccatggaggctagggtcacggcagagtggagttga

SEQ ID NO: 15876 - DNA, 363 bp, Glycine max
  Peptide Sequence Number=SeqID_132654
gtggcaccagactacatggactggtttttttggattttgcacccgttcgtcacgccgatcgaggagactgctgagccgagacatccgcctccctctcatgatgaggagttcgtcgagccacctatccccgaggtttcagttgcgtccgatctccctacgcattcaatggttgattgtgaaggatgtcaagggatggttgaggatttaggagtgattgctgaggatttggagcgggtcatcaaccttaggatggtcactgaaggcactgacttatatgacatcatgactcgttgtctgaggagagctagaggtgacgctgctgatggaagtcttaggccgcgacagagacgccgcatagattag

SEQ ID NO: 15877 - DNA, 360 bp, Glycine max
  Peptide Sequence Number=SeqID_132655
atggaaaaatctgacaagatgaatttcaaagagaagaaagaaaagaaaggatatatcacttgggaagataatgtcttaaattattcaagtgattcagagaagaaaatcataagtttgggtatcatgatgaaagactatgaaaatggagaagagcaaagtcgatacattgatagcaatttctccaaacacatggcatgcatcaaagtttattcatatttctccccaagaaaagtgaatatgcgatttatggagacaacaaacaaaggccacttgatcaacaacctcaacaattggaagttggaagtagaagttattggaagttggaagtggaagttagtggaagttggaaattggaaatga

SEQ ID NO: 15878 - DNA, 120 bp, Glycine max
  Peptide Sequence Number=SeqID_132656
atggcgactctttgcaaatccagaagaaaggtatcaaagggcaataattgtcaattttgtgaaattaagacattttcaaaaggattgcctaaaatagattccttacaatccaaaccataa

SEQ ID NO: 15879 - DNA, 2007 bp, Glycine max
  Peptide Sequence Number=SeqID_132657
atggttgaggcagttgtgtcctttgcagttgaaaggcttcacaacctaccgacggaagaggccagattgttaactggggtgagtgacaaagccaaaagcatgcaaaatgaactgaagaggatgcaatgcttcctaagagatgctgagagaaagaaggataaaaatgatactataaagaattatatttcagaggtgggaaaactagcctatgatgcagaggatgtgattgaaatatatgctattaaggttgcattaggcataagtgttggaactaaaaatccactcgccaaaactaaacatcttcacaaagcatctgaggtgcaaagacaattgagaaggtcttattctcacatagttgaagagttcattgttggcttagataaggacacagacaaagtgcttatttctcctaccaaagaggaaagggatgggattacgaagatgaaagatgatgaactggcaaggaagttgtttaaagttcagcaagataaaaaatgtttgatcatcctggatgacatatggagcaatgaggcatgggacattctaagtcctgcttttccatcacaaaatacaagttgggcattgtttaagaaaaaagcttttccaagacaagataatcctgaatccacggtttctgatgagtttataagattaggcagagaaatggttgcaaagtgtgctggtctgcctttgactatcattgttcttggagggcttttggctacaaaggagagagttagtgactgggatacaataggaggagagactgagattccaagaactaaactaattcagttatgggtagcagaaggtgttgtttctcttcaatatgagactaaatgggacgaggcaatggaggatgttgctgaatgctacctgggtaacttaatcagccgctgcatggttcaagttggtcagatggggtctactgatgcaagacgaattgatgaagttcgtaggcttgctgtcttcttggatcaacatgctgatcaattgattccacaggacaagcaattcaaattatttcaagttctagatcttgagggaattaagggggtgaagggacagtcattgcctaaagaagtgggaaatcttttatggttgaagtttctgagtctaaaaaggactcgcatacagatactcccatcttccttgggcaatttggataatttgcaattcctaaatttgcaaactgtcaataaagtaaccgtggaaattccaaatgtaatatgtaagttgaaacggttgaggcatctatatcttccaaattggtgtgggaatgctactaacaacctgcaactggaaaatctggccaatttacagacaatagtaaattttcttgcctgcaaatgtgatgtaaaagatctattgaagttgaaaaaactcagaaagctagtactgaaggacccaagacattttcaaaagtttagtgaaagtttcagtccccctaataaaaggttggattgccttttatccttgtctttaaggactgacatgctttccttccctgaaaatgttgtagatgttgaaaaattggtgctaggctgtccttcccttcgaaaattgcaggtcgaagggtggatggaaaggctgccagcagcctcactgtttcctccacagctttcaaagttgactctatggggatgtagacttgtgcaagacccattgttaacattagagaagcttcttaacttgaagtttctaaatgggtgggatatgtttgtcggaaagaaaatggcatgctcaccaaatggttttcctcaactaaaggttctagtacttcgtggcttacctaatttagatcagtggactatagaggaccaagccatgcctaatctttaccgattgagtatatccgattgcaacaatttaaagacagttcctgatggactaaaatttatcactagtcttcgggagctggaaatcagatggatgcctaaatcattcaagaccaggcttggaactgctggagaggattaccacaaagtccaacatgtgccatcgatt

SEQ ID NO: 15880 - DNA, 546 bp, Glycine max
  Peptide Sequence Number=SeqID_132658
atggaacgagatcaagttcaacatcaaccaatgcaaaaggaaattggaggaaatcttccgccttgccaacattgtacaaagaaaggacatcctccattcaaatgctggaaaagacctgatgctatgtacaatgagtgtaatcaaataaggcatgaagttgttatttgcaaaaacaagaatcaaccacacaacgaagctacaaaggctgctgatctggaagagaagtacctatttgttgttacatgtttctctagtattgaatcaagtcaaaattggcttattgacaatgattgtactagccacatgacaaataataaggatttattcaaggaactgaggaatataagcacattgaaggttcgagttggagatgacaagttcatcatagtgaatggaaagagaactgtagcaatctcaactaacagagatacaaaactcatttctaatgtgttaagattggactttccagcctccaagacaaggaaaagtgttgttgaacgtgccttagatgctgtcaagacagttttgatttttaatttgaattaa

SEQ ID NO: 15881 - DNA, 672 bp, Glycine max
  Peptide Sequence Number=SeqID_132659
atggatggacttcttagtagtcctcttgggtctattatgggacatgttacaactggtgttgctatcattacctaccgctggaaaatcaaccttgtcctcaaggttgaagagggacttcaaaccatggcttcacacagaggcaccaaaaatggatcattgcaagagaagaaaggactgcaaaccatgaatcctaccaccgggatcaaaaatgaaaatgttcttctcagtatagctaatggtcttcttgtcgagcccttaaacaatggcagccgtgtaacaaccacattccttatggtggatcctagatacacctctatgatcttcttcaacttcatgagaatggttgagtgtgtagcggcctggttcatcgcaacgccaatcggttgttcaatgtcagggaaaggcacgtcgggaccatcttctttgtctgccattggcgtgtggggcttactattggtgggtaggtggacggaggaggaagttcctatgttttggtgttccagcgttgccattggcactacaaaatccatggaagggattaagctcgatgtacataaggagaaggtgtgtgctgaaacgaaaaggatgggtccaacaaaggtggttgctgatggatggctgtgtggaaaggatgcaacggaaagaggtggactgacaggtgctgtggtctag

SEQ ID NO: 15882 - DNA, 1914 bp, Glycine max
  Peptide Sequence Number=SeqID_132660
atgccaaattcgaagaacaaccgtaacggacagggcgagcctcaccgccgggggaagttaacgaaaaaatcatcgtccttctacggtcactcatcaccggctgccatgtccggcgatccaatcctgcgaccgaagacggtgccggatcttttgtcggagaggcatcgtgcggcagcgacgccgctggtggaagttgtgccaaaacagccgccgaagttgttgttgaaggttacttccatgggaagcttgggaccggtgcaggttgtgatgacgccggaatcgacggtcggagatttagtggcggcggcggtgcggcaatacgtgaaggaaggtcgccgaccaattttgccgtccaacgacccttcccacttcgaccttcattattctcagttcagcttagaaagtttggatagggaggagaagctgagggatattggatctagaaacttctttatgtgtccgaggaagtgtggcggcggcggcggcgacggtagaggaacgacgccgtttgcttcatgttcaagagaggccgacaaaacgaccaagggtggcgcgtttggaaagggttcattacttggaatatattcaatttggaaggagttggagtaccttcacaacggttttgaagtgaaattggggaattggatgctggatttctggaatgatatctgggtgaatcgaacacctatagcattggaggtagcttggatcgacattcatgatgtagggattcaagtgaaggatatgtggtttgagcggggaggaaaggcagattgtggggattatcatgtgggtaaatgtgcggacgcgttggctatggaaggagcgctttcagattttcaggatcaagtgttgcatgttcctccagatgacttgattgcccttttgcatgctgatgcaattcgcatgatttttttggagagtgttgaggttaaggttgggcagactgtgacggttgacccaatggatcctgtggattcatacatacacatttctcaggttgcgctcggagaggcgaaaaaggacaaacctaatgaacctgtggttctgtacttgaaagttggtgaacagaagattgttttgggaaccctttctagggatggcatccctcacctatcattggatttggttctggactccgattctgagctttcccacacttcaaaaagtgccaatagtagtgaagaggacgaggaacttgcattggagggacaagataatggaaaacctgaattaaaagctgaaggtgcgaaggttaccaaaccttctaaatctattcccaagattggtgcaccagcaaaagctgctgatcctaagaaagacgaggatgatgattccgatgatgaatcggatgatgatcttgctggtgaagatgaatctggaagttccgatgagatggatgatgatagcaatagtgaagaggagagtgatggagatgatgaagagacccctgctaagaaggtggatcagggcaagaagagacccaatgaatctgcagcaaaaactcctatttctgccaagaaagctaaaactgctactcctgaaaagactggttttgggttaaagtgtggtgctcattggtgtaaatcttcccgatgtttactcccctcgaataccccaacaactggtattagagtcgatggttcgactgtcttcctggcggcattactcccgctcgagggagagactatcatgtggaagagactcacacttgagggggagatggttggattacaaaaaagtgtacatgtagctactcctcatccttcgaaaaagggtgggaaaactcccaacagtacaaaaggccagactcccaattctgctggacaactatcttgtgcaagttgtaaaaagtctttcaccaacgaagctggtctgcaacaacataagaaggctaagcatggtggtcagtga

SEQ ID NO: 15883 - DNA, 396 bp, Glycine max
  Peptide Sequence Number=SeqID_132661
atgcttaatcacttcttcttcccattctccttcctcgtcttcctcctctccttctccctcaccttcttcttttcactcacacatgtacatgcaatcgttgttgtggaactgacgcaccgacttggtggggacgtagaggatgttgtagtacaagtcatcaaaaagggaccaacagaaagaagaatcatcagattaaggtggtggttgtggtggaggagggatgttggaaggaaaatcatcgatgttgatgatgatgctggtgtcagggatgaggtcatgtttgaggccgaaatcatagatgtcaaagaggaggccgacgtgacagaggttggggcagcagacagagagtttatggaaggagagagggaggttgggttggcggcgatggagaggtaa

SEQ ID NO: 15884 - DNA, 705 bp, Glycine max
  Peptide Sequence Number=SeqID_132662
atggtggatggacctaaagaatgtatctcaacatccacaacaggggcagctgttgaatggtccgatatcatggaaggttgggatgtatcaaaggaggccccggatgaagagttcaaggaattatggaagcttaaagttccatctaaagtggttgtgtttgcttggaggttactcaaggataggctaccaaccagagacaatttgaggaggaaaaaaattgagttgcaggattatttgtgtcctttttgcagaataatggaggagagtgcaagtcatctgttctttcactgcagcaaaatacttccgctttggtgggaatcgttgtcttgggtgaatctcgtgggtgtcttcccacaccacccaagacaacattctatccaacacatgcatcaaacacatgaaggattgatggtgactagatggaaatggtggtggttagcattgacatggtctatttggaagcacaaaaatagcatagttttctccaacaacactctcaatgcaaataaaatgatggatgaggcagtgtttttactatggacttggctgagacatttagagaagggttttgcatctcactataatagtgatcttcaaatcttagagaaggatttcagtgtagttgaggataggaatctatgccacatacttgtattattctcattatgtggtttactttctggatatgatcaaccaattgcttga

SEQ ID NO: 15885 - DNA, 684 bp, Glycine max
  Peptide Sequence Number=SeqID_132663
atgtcaatgtgccaaaataattctctaccattcaacaaatatgcatttttgacaacgcacaacgcttatgccattagtggggacacattgaaagaaatcgaagcttttctatcagcaaatccaacagaaattgtcacaattatcttggaagattatgttcatgccccaaatggtttgacaaaggtcttcactgatgccggtctgatgaagtattggtttcctttgataagggtgccaagaaatggtcaagattggccctctaatggggatgggggtaggaaagcaggaagctgtccaaatagggcagaatcatctccccttaacgacaaaagcaaatccttggtgttggtaaactattttcgatcaactccaattaaaccaatcacatgtgaagatagttcaggagaacttattaacatgatacacacttgttatggtgatgctggtaaccgaggagtgaaggagaaggatcgttcggtagacactctcaatggaaagctattgtgtggatgtgatgatgttcatagatcctgggatcaacatcatcagcttgctctcaatcataggaaaaatcgtagtaacaagaccgaccatctggaaataattcaggcattagattgttgtcaattttcagctgttaaaatcacttttgcttggcatgagcttgttggcaaggattgctaa

SEQ ID NO: 15886 - DNA, 216 bp, Glycine max
  Peptide Sequence Number=SeqID_132664
atgggtccacctaaagaaatttcgaccatcatttaccacaatggtcacattgcagacaacctagttcgtggatcggtgtatatatttgcgaacccaatatttatttatgttacgcatacaccgagaagatgcactagcgacatcttgggaatattcgtgcgaataagccaagtgcagatgaatgcatggttgttaaaatcgcgctttaactcatga

SEQ ID NO: 15887 - DNA, 1182 bp, Glycine max
  Peptide Sequence Number=SeqID_132665
gatttgaaagcagagttgcagaaccaccctgcctatcaggaactctggcgaactatcgagaccaattcctccactcattcggcctttgtgcttaccccggacttcatcctacagcaaaatcgtatttggctcccacaagggtgtagttttatccctttaatcatggctgaattccactctatgctgacaggaggacatatggggatttccaagacctcggctgaattccactttgtgaccacttgtcttcaatgccagcaaattaaatatgaccaccgcaaaagtccaggcttattgtgtcctctgccggtaccatcacgaccatgggaggacttgtcgcttgatttcattggcggcctcccggctatccgaggtcacacagttattctagtggtggttgaccgcttctcaaagggagtccatttgggtaagctctggcccaattacaccgcgcaagaattattcaaactttccagcacaaaacttcgtatgacctctacataccacccccaatcagacgaacaaactgaggttctcaatctcgtcatcgagaagtatcttcgatcatttgtgcatcagcaaccagcttcgtggggaaaattcctcatttgggtagaatggtcttataacacgtctatttattcagcaacagggcttactccatttgagattacttttgggaagaaaccccccaccatccctcattatctcaccggcacttccaccattgatgttgttgatgattttatgatgcatcatgatgtagccttcgtcagcttcaagaagaaattactaaaagctcaacaaaccatgaagaagtttgcagacaacaacaggcgcaaaaggattgggctagttgcatatcgcctcaagctccctccagactcaaagatacacctagtttttcattgtgcgctccttaagccatttcaccactcctctgacacagacacaggtgcagttgacttaccgccgcagtcaaaggacaatgatctgctaattacacctcttgtgattctcaacacgaagtgggccacaactgacataggccctgaattgcaagttctagttcagtggcagggattgccacttgaggacacatcatgggagccttggaccgaactgaaagaaacctatcaccttgaggacaaggtgcttcttgatgtgcaagggatgttatga

SEQ ID NO: 15888 - DNA, 684 bp, Glycine max
  Peptide Sequence Number=SeqID_132666
atggaaggagtagcacctattgtggaggaaaaggcagaacttgtcgttgaaattgatggctcgttgggggattctgacagtctcaaagagtctggctcaaagaaaagggttaggtctgagtcatgtgctgcttctggctccaaggcatgtcgggagaagttgagaagggataggcttaatgacaagtacaccttttactccaaattccaactatctcccttgaggcacgtacctaatatgatagacgtgattaggtttgttgaattgggcgccattttggagcctggaaggcctgccaaaacagacaaggctgctatcctgattgatgctgtccgaatggtgacccagttacggggtgaagcccagaagttgaaagacactaatcagggtcttcaagaaaagattaaagagttaaaggctgagaagaacgaacttcgcgatgagaaacagaggctcaaggcagagaaggagaaactggagcagcagctgaaatctttgaatgcacagcctagtttcatgcctccccctgctgcaatgcctgctgcatttgcggcacaaggccaagcccatggcaacaagttggtaccttttattagttatcccggagttgcaatgtggcaattcatgccacctgctgcagtggatacctcacaggatcatgttctccgtccaccagttgcctaa

SEQ ID NO: 15889 - DNA, 1602 bp, Glycine max
  Peptide Sequence Number=SeqID_132667
atgttgctgcagatatcgccgagtttgaggcatgtcaccgtgcttccgggaaaagggttgaaggagtttatcaaagtgaaggttgcatcaaggaagctttcttatcggatgctcttttattcactcttgttcttcactttccttcttaggtttgtgtttgttttgacagcagtggataacattgatggagcaaacaagtgctcttccataggttgtctgggaaaaaaattgaggccaaagattttgggaagaagtcttgaatcaaatgttccagaagtgatatacggaatattagatcaaccccttggcaaagaggaattagagggaaggtctgatattcctcagacattagaagagttcatgacccaattgaaggaaggtggttatgatgccaagacatttgcaattaaactaagagaaatggtaacgcttatggaacaaagaaccagagaagccatagttcaagaatatttatatcgccatgtcgcctcaagtggcataccgaaacagcttcactgccttgccttaaggctggccaacgagcacaccaacaacgcagccgcgcgccttcaactaccctctgcagaacttgtccctgccttggttgacaacaactattttcactttgtcctggcctcagacaacgttcttgcagcctctgtggttgcaacatcgcttgttcgcagcagtttgcgacctcagagggttgttctgcacataattacagatagaaagacatactatcccatgcaggcttggttctccttgcaccctttgtcacctgccataattgaggtcaaggcattgcaccactttgattggtttacaaagggaaaagtgcctgtgctggaagcaatggaaaaggatcaaaatgttcgatcacagtttagagggggatcatcagctattgtagcaaatactactgagaagccaaaagtaattgctgcaaagctgcaagcacttagtcctaagtataactcagtaatgaatcacattcggatacatcttccagagttgttctcaagtcttaacaaggtggtcttccttgatgatgacattgtggtacaaactgatctttcacctctgtgggacattgacttgaatggaaaagtcaatggagcagtaaaaacatgcagtggagaagataagtttgtgatgtcaaagaggttgaaaagctatttaaacttctcccaccctttaatatcccaaaattttgatcccaatgaatgtgcttgggcttatggtatgaacatttttgaccttgatgcttggaggaagaccaatataagctctacataccattactgggtagagcagaatataaaatcagacctcagtttgtggcagctaggaacattaccccccggattaatagcattccatggtcatgtccacactattgatcctttctggcacatgttgggattgggatatcaggaaaatacaagttttgctgatgctgagactgctggtgtaatccatttcaatggcagggcaaaaccatggctagaaatagcttttccccatctaaggccattgtggaccaagtacattgacttttcagattacttcataaagagctgtcacattagggcattgtaa

SEQ ID NO: 15890 - DNA, 2718 bp, Glycine max
  Peptide Sequence Number=SeqID_132668
atgggtaagaatgatggcaagaaacaacagcaccttcttcttggaggtgttgctgctggtggtagtggtggcagaaccaacatcaatggctttattccctcctttcacactctctctggttacctgaaaattgtttcatcgggtgcttccactgttgctcggtctgctgctgcctcttttgcgtcatcaattttggataaggatgatgatgctgaccgtgatcgggttatttgggctgggtttgacacattagagggcggccatggagaagtcatgcggcaagtacttcttctaggctattggtctggtttccaggtttgggatgttgatgattcaaataatgtccgtgacctagtttccagacaggatggtcctgtttcttttatgcaaatggtaccaactccaattgtatcaaagaaaccagaggacaagtttgcagacaagcgtccattgttggtagtttgtacggatggtttgttggctggaggagacaaaacacaagatgggttgggtgccacttgcaatgggggcactttaaaccgtcatgcccaagtgaatggaaactatctgccaactactgttcaattttattctatgaggtcccgaacaaatgttcatgtactaaagtttagatcagttgtttattctgtaagatgcagttctcgaatagtaactgtttctcaagctactcagatacactgtctttctgccacaactttagaaagagagtatactttacttaccaatcctattgtcactcattgtctcggttctggaggcattggctttggaccacttgcagtgggtcctagatggctggcctatagtggaagcccagatgcaacagccacttctgggcatgtcagcccacagcatttgacaccttctgcaagctttcctggtttttcttcaaatgggagtttggtcgcacactatgccaaagagtctagcaagcatcttgctgctgggattgtgacacttggagatatggggtataaaaaacttgccagatactgctcggaacttcgctcagatagcagcggttctatacatttggtaaattctagcccaaaaggaaatggaatcgttaatggccattcaacagatgcggataacattgggatggtcattgtcagagatatagtcagtaaaaatgtcatttcccaattccgggcccacaagagtcctatttcagctttatgctttgatcctagtgggaccatattgctgactgcttctgttcagggacacaacattaatgtttttaagataatccctggatatgagagagtgtcagcatctgatgctgacccttcttatgttcatctctacaggctgcaacgtggcttgacaaatgcagttattcaagatatcagttttagtgctgatagcaggtggattatgataagttcctcaaggggcactagccatctatttgctataaatcctcaaggaggacctgtaagtattctgtcatgtgacaatagtttaacagaaaaaaatggtggattggatatcattaataatcaagcagttcgttggcctcatagttcagccttagaaatttgtaaaccacagagcctctgtgctgctggtcctccaatcacactttctgtcgtaagcagaattaggaatggatctaatggttggagaagcacggtaaccggagctgctgcagctgcaacaaataggatgagttccctttctggggctattgcttcatctttccgtaactttaaagacagcagtaccttgtatgttaatgggaactattccaaggaaaagcatcatctgttggtcttttcacccaccagttctatgatacaatatgctctgcagacaattaacagtcaagactcaggtgttgtttctggagtaacacctgcttatgaatctgccccactgaccgatgcaagagtagttgttgagcctatcaagaaatggaatataagcctggcatatagttggagagagggagaagatactattgacatatatggagagaatggagtttcagacagcaataaattatattcagaggaagtgaagaaggataatatcattagccctaaaatgaagaatgtaactgtgaaatggaatccctgttctgagaaagagcatcagttttatatttcagaagctgaactgcaaatgcatcaagctaagacgccattgtggggaaagactgggatatattttcattcagtgggtaaagaggctactttgatgatggatgaagaagctgctctcgaaggggaatttgagatcgaaaagattccaactcgtgtgatacaagctaggtcaaaagacttggttccaatttttgactatattcagacctcaaaatttcaacaaataaggactcttgttaataacaagttaaatgaacaacttctgcatcaaagttcctttgaaaagggaaggatttcacccaggggcattttgggttttcctgattgcataaataattctggtgaaacgattgctgagtttaaaagtgggattgaaggaaatgagcggggtgatagtttgattccagcagaaacaaaggctttcgtaaataacaataacacccttaaaccaaatacttggccagagattgtaaataatagaagagagaacttaaacatggatgttcatcaaatgtttgtaaatagtgacagaaaaggcctgaaactggagaatcactgcaaggaaaaaggagatgaatttgaatga

SEQ ID NO: 15891 - DNA, 354 bp, Glycine max
  Peptide Sequence Number=SeqID_132669
atgggcatccctcacttctttcttattccatacccaacactaggacatcgaatctcttgtttccttgacccaattgagctcttcgttgatggcgttgatgccaacgaggtcatacttgtcacagaggctgaagatctcaaagttgagttgggtggccttggcaagattgagtttttcggggtcagcggtggccatgagatcgccaagcttcttggagaggtggagggcgcagatggagtgttggaggagctcgatggtgcggtggaggttgaagagctgggtgtttttggtggcaatagagtagtgaaggttggagaactcggagcggaggtgacgaacggaggactagagtga

SEQ ID NO: 15892 - DNA, 336 bp, Glycine max
  Peptide Sequence Number=SeqID_132670
atggtggacctagttaccatcctaaatggtaggggtgcacatataaagaagggggattggattggaatcagaaaactgcacggccaaaggggaaaccaccaaggagggtggcgtgccacccccgacactattagtgcagggcacgacaatacgagaccaccacatggacggcaacagcgtgacggcgatggaggtttttgcggttgtgcaaacaaaaagagagagaaaagaaacaaaaaaaacgaaggtgatagggtccttaatgccaccagcgaagggcccaaaggcgcgaagctaccaccggataatggcaaatggtggcagcagcatggatag

SEQ ID NO: 15893 - DNA, 902 bp, Glycine max
  Peptide Sequence Number=SeqID_132671
atggcagaagaccgtccacaaaggatgatgttagaggactactctagctctgctacaccttggtacttcaccaacatagccagaccggacgggaatagtctacgggcatgggaagaggtggtggagaatttcctgaagaagtactttccagagttcaagaccgttgaaggaaagcacttgatcgcttccatgggttacttcagaaaactcccacacatgggttcagcaagccagtccagctcaacatcttcattgatgacttgtgaccacattccaagaagctcctcaatgccgccgccgatggaccaactagcaaagcaaatggctgaaagacccactggaacctttgtggccaacactaagaagaatcctaaggaggaatgtaaggaaattgtcactcgaagccagaagaaaaaggatgctgaagttggcagagtattacaggataagagcataaaggaaggagatgatacaaagagggaagaagaggatgatgggaaagagaaggatgccgaggtgttaatccctaagaccaagagtcagtttgcttgggaggctagaaaagagataacaccagccttactaaaggaagccctgtaccttctggtgccatcaaagaaggataaagagcgctacttcaagcggttcctcgacatattccagaagttagagattcttatcccttttggagaggccctacaacagatgccactgtacataaagttcttaaaagacctcctcacaaaaaagggaaagtatatcagcaacgaaactgtcgcaacgtgcccttcgcgggcgagcgagggcgaggctcatgggtgcgctttccaaaggaggaaagatgcgcggagtcgccaccaacgtttatttgtgggaaacgtcgggaaaaccgaaggaaaccg

SEQ ID NO: 15894 - DNA, 177 bp, Glycine max
  Peptide Sequence Number=SeqID_132672
atggaaatattatctgggagcattccatgggtgactatgatgattttgcataaaaagtcaaccttgctacaaaagatggactgggtacaaatggaccattgtcgtgcagcaacatcgttgccttcgttcaaggagaaacaaccagagagtcataataattgtgtcagacgcgattga

SEQ ID NO: 15895 - DNA, 270 bp, Glycine max
  Peptide Sequence Number=SeqID_132673
atgatgacaagtgtttcaagaaggatgccattttttgctgctgcgaaaggcgatgaaacacgtgtagatggaggcgttggctatgtatccgagttgctggtacaacatgttgcggcagaatggagaaggaagagagagaggagatgccacttcaaggagaagatgagtctagaagaagcttaccactataggaggccatggataagagcttggaggaagaaggagatgaatgaagagagaggaagagaagaactaaaatacaagggctga

SEQ ID NO: 15896 - DNA, 691 bp, Glycine max
  Peptide Sequence Number=SeqID_132674
atgtgggtgtcgaggaagcggtttccggcagatttcaggcgggaggagaaagagaagagcgatttcaggcaagaggagaaagagaagagcaagtgcaagatattgtttgatgaagaagagcttaaaatgatcctaggttttaatagagttgaagactatttaggttctttgtggcaatacgatttatatggagattatgttgggaagctaaaaatcaataacgaagatgaatatttcatcactcgtgagtactgccctagcaacattgccattgaggaagctcaaatccggaatggtggtgtgatggtggaactgttgaagcacagatttagagaaagcctagatctgttggagagaggtgatgatggccccttttcaacccacaaaaaccttagcaccgaggaactctgcaccgtcggaagagccggtgtcagaattgataatgtggttctggtcgctgccactgagcaccgaggagctcattataccattaacaccacattgttttcttatgtcaatatttttcttatcttaattgctttgtctttggaacttggaacatatttctacaagggtataatgtatgaagttgttggatttggatgtggtattataggccaaggcattgcaaatttgatcatgactgcgaataagtatggtttcttgtctagagttcgttttgcattgatag

SEQ ID NO: 15897 - DNA, 402 bp, Glycine max
  Peptide Sequence Number=SeqID_132675
atgccactgttctgcttacgacatcggtttttgtacaaccatcgtaaaacctgcgtcgtagaagaccatttttgtagtagtgaaagttgcaccattaattccaagaacaaaatgaaatacaagtctaaagatgaagtaatgctcaaaagtcaaaatagaagaaggagtagagtaaagagggtggaagcacgggcaggggggagagaaaacaacatcataccccgaaggccagcactcttcacaagtggtggcacaggtatgtcttcttctgatatctttatgctcctggtattcagcaaggacaaaatcatcatactattagatgatccaggagctttaacagtgtcgtataagggaagggggcaaggtggtatgaaaagggaacgatacttgtgtctataa

SEQ ID NO: 15898 - DNA, 351 bp, Glycine max
  Peptide Sequence Number=SeqID_132676
atgtcagcttctcctctggattcaactgcacagaccggacagtcaagtgggggtgggggtgattggcaagaacaagtgtatcaacatattaaatctatgaaagaaagttacttgccagagttgaatgaaatgtaccaaaagattgctacccaacttcaacagcacaattcccttccaacacaaccaaagttagatcaacttgaaaagatgaatgtatttaaaatgctggaacgtattatagcattccttcaggtttctaagagcaacatctcacccaatttcaaggagaaactaggttcatatgagaaccatattataaacttcataaatagagaaactaggttcatatga

SEQ ID NO: 15899 - DNA, 723 bp, Glycine max
  Peptide Sequence Number=SeqID_132677
atgagaatgagtgaagacgttaaacagagaaataggtggccgccacggctattcacgtttcgagggttgcaggccgtgagccagggattgcgtgatgccaatgggtcacttagcaaacaaaatgtagaacgaataatacttcctcaactcaatgcaaaaactaaattccctaaaacttatagtcattatttgagtcggatgaagtggtttcgaaaccagtataacatgatgtcaacccttatgcgcaacaactctggctttggatgggacccaattggaaaaactttcactgctcatgaggattcccacctaagtcacagcaaacttcgaggaaaaagtatggttgattatgagtatttgaagatcgttgttgggggtggagtttctagcgggaataattctatatcagtcgatccagatgatactgatgcaacaacttttgagccagaaaatagaactgttgggatagaagaattttcatataatcctaatagtgatacattcataacaccaaataactatgaaccagcatatcagcctccatcaccaaaccaaccaagtccaccatcccacccccctttagattcagaggttcccatagaaaaacaaaactgtcacaagcgaaggagatccgagtatggagggagttcaagcgctgttgggatcaacaatcaaggcaacgttctggaaatctttctgttggcattgggactattgctgtga

SEQ ID NO: 15900 - DNA, 198 bp, Glycine max
  Peptide Sequence Number=SeqID_132678
atgcaagggagtttgggttcttgcggtggtgacagaagaaggatgatgtggcgacggttagggattatcagtggcagtgatggtgttaaaaaagatgatggaggtgttgaggaggacaacgatggtgtttgtggcgatgatgaggggtttgctggtgtcggaagtgtcgttggctatgacaaagatgatgacatgtaa

SEQ ID NO: 15901 - DNA, 1638 bp, Glycine max
  Peptide Sequence Number=SeqID_132679
atggcggcaagagaagttgacaaggtaggagaagacgaagcaagccacgacaatgtgtggagtgcgggatctgatgtggtaggacaaagacgaagttgtgacaaagatggatttgcaatggtgaagatctggagaggagagtgctacacattgaaggaagaaagaagtatgtgcattgtacgcagcgccatttctgcttatcctattcgagcttccactccaatggctacctctccacttcccattcctctcaatgttaccaacactcatcatgccattgccaacccctttgtgccagaggattgtgattttcactggtttgtgagagtgcaaaagaattgttcagttgaattgctggtggtgaaagcagtggattccttgcattcagagttcagggctgtggataatttggttgtgtgcaataccaaccgtgtccttaaagctttccagaatgctcgagttggatcccatcactttggtggttgcactggttatggtcatgatgaggctgggggccgtggagctcttgaccaggcttttgccaaaatttttggggcagagtcagctattgttcgtcacagaagttataatattctcatctgtcaacagttcttctcaggcactcatgctatcacctgtgctttatttgctctcctgaggacaggggatgagcttttggcagttgctggtgctccctatgacacgctagaggaagtattagggaaaagggaatctggtggactgggttccctccaagattttggggtgaagtaccgagaagttccacttgctgaggatggtggacttgactggaatgcactcatgagtgctgtaaaacccaaaacaaaatgcgcactcattcagcggtcatgtggttattcatggcgtcggagtttgagtgtcaatgagataggcagggcaataaaaataatcaagaagcaaaagcccagctgctcagttatggtggacaattgctatggagaatttgttgaaagcatcgagcctcccatggtgggtgcagatttgatcgcgggcagtttgatcaagaatccaggtggaacgattgctccgtgtggtggatacattgctgggaagaaaaaatgtgttgaagcagctgcagcccgtctttctgcaccaggacttggtgtggattgtggttcaacccctggtgatatcatgcgagcctttttccagggtttatttctttcatctcaaatggttggagaagcaatcaaggtacaagtctgcaagataattcatttttataggagagattgtgcttttgttgcttctatcttgcattttggcctgattgctgaagttttggcatctaaaggctataaagtgcagcctctcccccgcatcccccgttctgatacagttcaggccatccagcttggaagccatgagcgtctccttgctttctgtgaggctgttcagagaagctctccagtaggttcgtataccaaaccagttgcaggtgccactccaggatatgcatcagaggtgatctttgctgatggaaccttcattgatgggagtacaagtgagctttcatgtgatggaccacttagagagccatttactgtattttgccagggtggcacccattggactcaatggggactagtcctatga

SEQ ID NO: 15902 - DNA, 210 bp, Glycine max
  Peptide Sequence Number=SeqID_132680
atgtcttggcaggaggaactagagagaaatcaaaaggcatcaggttccaagtctgatggatgtgcaagacaggttgcttcctatgagtttaccactttaacttgcatcccaggtgtcatcacatatcgtggagctaaaatccagatattctgcttgtgggttgataagcctgggatgcctaaagctgaatttagttgtacctttttctga

SEQ ID NO: 15903 - DNA, 689 bp, Glycine max
  Peptide Sequence Number=SeqID_132681
gcgataagaagtcggcgattaactttgacgttgataccactaagccggagccagtagaaggcggcgacaaggctaacttcgaaggcgtcttcgcggataaaaccggcactgaaatcccagtgcggccggacaccaacgatgacacgctgatcttcaaaggtaagggctcagaagacggtactatcgtgatgatttggggcgacgaagcgcgtacccagctgatcggttctaccgtggtagaaaacggcgagtggcgctatgagtcagacaaactggcagaaggcgaatatgcctttaacgtcacggttcgcgatgcagccggcaacgaactggtcatcgaccataccgttaagaccaacgtcgacgtcaccccgccgccgccgccagaaatcaactcgatcttcgctgcgggtgctacggatgtagaagggctgatgagcatgtcgctgaacgacatcatgacgcagggtcaggattcactgtttatcgacaacggcaagtcacagctggtagtgaacgctaaacagggcgaggcgctgacgctggaagacatcctgccagccggtgaagatgccagctcctggcagcaggcgaccggtaccgtcaccgtcggtggcaacgagtacaacgtctacagcaacggtgatgcggaactgctggtgcagaacctgcacaacgaacagcactga

SEQ ID NO: 15904 - DNA, 171 bp, Glycine max
  Peptide Sequence Number=SeqID_132682
atgatagtcaaatttcacgacaatccaacggtgaacgtgttcgagatcgtagtttttctgagacagatgaagagtattgcagtgactgcaaaagcaagctacactccattagtgtatgatcacagtgctggggatacaatctgctccgaatgtggcttcattctcgagtag

SEQ ID NO: 15905 - DNA, 423 bp, Glycine max
  Peptide Sequence Number=SeqID_132683
atgatctctgaccatggatggcaagtgttgtccaagagtgatgatgttgccaactgggctaatttttgggcctttcttactacggcttcgagcgtggcccaaattttcctggagtcttctaatgttgatgccataaaggatcagttgttgaaggctggggaatctctgaactcaattcttcaagctaacaccaagttggcgggggacaacaagaatttggaggatcgaatgcatgcactgacaatcgaggctaaggggttgaagatgcgtgttgttaatgttgaagccttgggagttatgctaattgatgacatattggaggacatagtccccacgccagagaagccgacgaccccggcaaaggactttcatgctgaaggtgttagagcaaaggatgaagaccaagtatggcctacagattga

SEQ ID NO: 15906 - DNA, 606 bp, Glycine max
  Peptide Sequence Number=SeqID_132684
atggaccaagttgcaaaagcttgtaaagtgtggaaagagacattgaagaaggtatacaaagatcttcattcccttgcgttggttcagattccgggctgcactcttgttacacacccctcctcgtatgacaataacaatagtgatatggtaaaaacttgtaagaatcaacagggaatcaagaatgccaacagggatgccaagagaaaactgaagagagattgcgatcttgtagccgtgctcttgaccatggaacaaatggctaataacttaggcttggtttggagcataaaaaatcatgccaaggaactatacaagaaagcagaaggtagtagggtatttaggggacggagaagacattcaagggcctctatggtggcatgcttgtacttggcatgtcaagaagaggaatttccaaggattgtaaaggaaatgcaaagtgtttctggaggagccaaagagaagaataagcatattaacaaggtcataggagtgttcaaaaagcattttcaggtgggcaggaattatggcaagacacaagccttggacttaggtgaacgcttatgcaccaatctcttggccttgacaaccatgtcatcaaagctatga

SEQ ID NO: 15907 - DNA, 237 bp, Glycine max
  Peptide Sequence Number=SeqID_132685
atgacgcaacttggcattcacaaaaattactcacactttattaaaacaccaccaagcaagtcagaggcccagcatggagtgcacagaacgtttggaaccgagtctgggcgacccaactcgatccgcaatttggcaatagggttggaaaaccctaggttcctaactcccaaaatggcgcgacaaaagggggaaccaccacgaagggtggtccccgcctccccgacaccactggtgtag

SEQ ID NO: 15908 - DNA, 693 bp, Glycine max
  Peptide Sequence Number=SeqID_132686
atggtttcgggtgaaggtttgtcaggggagtcggttggtaacgggtccaaggttcgtgggtatgacgatgaggtgttggagctacaccttggcttaagaagaactctagagaagtatttacttatgcctattatgcttcccaaatacacatgggctgatggtgagataggtacatacttcttcagatacaaccacgagccagacttgctcaaccttgagttggttgtcgataagaacaataaaggaaccaaagtattgtccggtccttctcggtactgtccgatcggatgctactcctcctatggagtttgtgtttataaactgagaatgaatgaacaaggattccttttacacgtcgattacagggaagaattgttctctgattcagtgggaaatcctatgtttcctttctattggcaacaatgccctcgccaatatgataagtacccaaaggagcttctgagcgtcgtcgaacagttagttatgtttcttttcgggtgtgtgccaactccttgctctcaaccgaacatcgagcctcatgattcacttgttgatgcggtgcctcctcccagcaaagatcccaaaaggaaacacaagcacaagatgaagagccaccgcaaacaccaaagtggtttaggggaaccttctgggcatcaggatgataactcccgagataaaagattcaagcaatag

SEQ ID NO: 15909 - DNA, 2448 bp, Glycine max
  Peptide Sequence Number=SeqID_132687
atgggagctgctctgttgcctgatgcagcatttggaatatttccacgatttttcaatgttcccaggcatcctttgatctgtagaacaacttctgctacatcagttagaaagagaaattttttctttggtgacaaaaggatctccaaatcatcactcattgttttgtcgcacttgaatgattcagatgacaaactcacagatgtagttgttgatcaagatgatgttataggaatagaagatgaattagtggtaaccaaaaaagctctttcggaggcacaacatagacaagagattattgagaaagagagggatcaattactagaagaacttgctcgttctgaggctaaaaaacaggaatacatcactaccattttacatgacaaggaagtagctatatcagaacttgaggctgccaaaactctatttcagaaaaagctggaggactcagtggaagagaagttcaatttggaatcaaagcttgtccttgccaaacaagatgctgttgatctcgctgtgcaggttgaaaaattagcagaggttgctttccagcaggcaacttctcatatactagaagatgctcaactcagaatttcatctgctgaaaccacagctgctgaagcagctcatctgattgaaaaccaaattaaagatgcaattgagggtacaatatcgtccatagtggaaaaatcaaatcatgctatagaaagggctctagttgtggcagagaaagcagaggaacttgcaaagaagtccacggaaacatttatagatggtacatccccatttactgaaatagctgctgttgaggcagaaaatatcaagttacagggaataataattgatatagaatctgagttgatgatggcaagaagtcaggctgataaactgaagttagaattggagaacaccagacagcagctacaggcatttgaacaaagagctaatgatgcagagaaagctttgcttgatttccaggagtcaagcagggaaaacattctccagagggaggaggagatgaagtcaatgttggagaaagtgaagaaagatgtggcagataggacaaaggctatttccaaggcttttaaggctgatttgaagaacatcaaggctactgttgaagctgccaaagaagtggtccattgtaaagattatgcctacctaagaagatgtgaagcactgcagagatcattaaagtcatcagaagatgctgtgaagatgtggagacagagagctgaaatggctgaatcattgctattgaaggaaaggctacaagatgaaggggatgcagattctatctatgttgttaatgggggacggattgaccttttgacagatgttgattctcaaaaatggaaactactgagtgatggtcctcgtagagagatacctcaatggatggcaagaaggattaatgctgtctctcccaaatttccacctaaaaagattgatgtagctgaagcattgacatcaaaattcagatccttggagttgcctacagtggatgaagtatggtccattgctcgagaaaagccaaaggaaggggatgctttaattgagcatgtttatgaaagagaaacgattgagaaaaagcggaaagcattggagcgtgctcttcatcggaagactatacagtggcagagagctcctgaacaaacaaaactagagccaggaacaggaacaggacgtgagattgtgtttcaaggttttaactgggagagctggagaaggcgctggtatctggaattagcagctaaaacagctgacttatctaattgtggggtgacagcagtgtggttgccaccaccaacagaatctgttgctcctcaaggatatatgccttctgatctttacaacttgaattcatcctatggttctgtggaagagcttaaatactgtatagaggaaatgcattctcaagatctgctggccttgggagatgttgtacttaaccatcgatgtgcacagaaacagagtttaagagcggagtttcagagtccaaatggtgtttggaacatttttggtggcaagcttgcatggggacctgaagccattgtatgtgatgatccaaattttcaggggcgcgggaatccttcaagtggtgatatcttccatgctgcacccaatgttgatcattctcaggactttgtaaggaaagatatcaaggagtggttgaactggctgcgcaatgatataggttttgatggatggcgtcttgactttgttagaggtttctctggtacatatgtaaaagaatatattgaagcatcaactcctgtatttgccattggagaatattgggacagcttgggctatgaacatggaagtttgtgttacaaccaagatgctcatcggcaacggataattaattggatcaatgcaactggtggtacttcatctgcatttgatatgacgacaaagatccagaagcttgctattgtgaaaatataa

SEQ ID NO: 15910 - DNA, 174 bp, Glycine max
  Peptide Sequence Number=SeqID_132688
atgacagtgacttctcatatctattctctctacggcaacacaatcgtcattgttgttgattgctgctactgcttgcttcgtggaggcttgactaggctaagacatggaggtccaacgacagggcaatgggttggtggtggagatgacggtccaagggatagagggataatttag

SEQ ID NO: 15911 - DNA, 249 bp, Glycine max
  Peptide Sequence Number=SeqID_132689
atggctttgtgttcagtttttctcaatcttcatcttctgctttttgtttctagttaccttagccaggagatactggcagagcaagaagctgatagagtgcatggattacctgcgcagcctccggtgaagttcaacaatatggtggttatatcactgccaatgaaactcaaggaacaacattgttctattggtttttcgaggccactcacaaaccagaacaaaaactcgttctcttatggctcaatggag

SEQ ID NO: 15912 - DNA, 303 bp, Glycine max
  Peptide Sequence Number=SeqID_132690
atggctaaggaggaggatacctccacaaaccagattcatgagccatcttctacacttgtacctgatgatgccacaccatctgcaccagcacctgagagagcatcatccatagaagatgggttcaaagaaaatttgtcccaaatttggctgacacagaggctaagttttgaagtgcaaaaagtagcagttgggctaagcgagcatccaccgctaagtgcagcttcaacatgcttagcgcgacagaagaatttggcagggcatcaatatcaaggccacgcgctaagcgcgagatcagtttgctaa

SEQ ID NO: 15913 - DNA, 456 bp, Glycine max
  Peptide Sequence Number=SeqID_132691
atgcccagggcacagaattccacagcacaccacagtgcctatttcgggaaaagagctctggaggcaacaagaggagcaacttttgcagagatacctaggttttgtaagcttattattgttaggaacttgattgaagcaggatcgaagcttagtcttacaagagggatctgcggattaagttttggttcagaggatgagctcactcctcttgagccctcttcagttgttgcagatacatctatggctcaggaggaggtatcttcaccagattccatgatagagccatcccctgctcctatatctgaggacattatgccatcagtaccagccatggagccagagcagcccattaaaatgaagatcagccacaggatgagtaggatgtttaaattttgttttgttttaatttccacaaatcatggacaatttagtttgcattatgtttcagttatttaa

SEQ ID NO: 15914 - DNA, 177 bp, Glycine max
  Peptide Sequence Number=SeqID_132692
atgtgtgaaatgatcccaggttatgtgatcaagatagtccctacatccaaagtccacccaatgaaggagttgaacatctcaagattaagattccaagtcattctaacaacagtgatggcttcttggtatggagcaagagtagggatgagcactactactcagttaaacgatggttaa

SEQ ID NO: 15915 - DNA, 576 bp, Glycine max
  Peptide Sequence Number=SeqID_132693
atgtatggagttggtggcattatacacaatgttgcttacgcagatgatgtagcaaggtgtcccgtttcccactgcagagattcagtatgcagggacgcgagtagcacattcattgcatggcccagacatctagtgaagcctataactgatgattcaaatcataatgcgcgtttgccagttggacgtcttggtgaggctgaggttgcagcggaacctgatccgttgggcgaattgatgaagacattgttttacgtgtacaagagtccagtggaagtgccgtgggaggcgacacaatttggacttcctgatgttggggcaaaatttttcatcacacatgctgatctagcggaaataatatcaggtgacaagtgtttgaacatatctatcctgcagctgtgtaccatttttatgaataactgtggtagaagcaaagttgatcagtcactgtatggtttgttggagcctcaatctatacacaatgctaaggacagacgtgaacaatgccaagaatacattcaaacatgggtcaaggaatcacaaaggcagttgtacttaggggcttacttgcatcagtaa

SEQ ID NO: 15916 - DNA, 168 bp, Glycine max
  Peptide Sequence Number=SeqID_132694
atgtcaaacgcatcgaagatcaagaagctagatccaaccagcaaaagagttagcaccattgcagggaccggaaaagctggttccaaagatggaacaaccgtaaaagctcaggatggattgtctaccaagtcgaacactcgtgcacaactatccctattcatattatga

SEQ ID NO: 15917 - DNA, 393 bp, Glycine max
  Peptide Sequence Number=SeqID_132695
atggtagctaagagagaggctgactccgcattgtttgcagagatcaatccatggcagaaagagaatcttgctataacaagttcacctttgtggtggttactgaccttgatgggaattttatcgtataaattgggagcaatggggaggaagggccttgcttataatgaaaagaaaaatatactttatgttgcaaacactgaaaacaatgttttaagggaaattgattttgttaatgagaaagttaggactcttgctggaaataggaccaagggctctgattatgttggaggtggaaaaggagactctcagatttgggagcacaatttattggatgcaactacaagagtatttagtggtgatggctatgaaagaaatttaaatggatcaaggtag

SEQ ID NO: 15918 - DNA, 237 bp, Glycine max
  Peptide Sequence Number=SeqID_132696
atggttacccctgggacagctacaactttaaatttacaggcattggcagaggagatcaaggcaagatatgataaagctgctgtcaaagttgttgacctgattcttacacttctacaatttggaggatatacactagtgcaaaattcagttgatctgtatcgaagctttgggtttgatacacagccagtcctcattgggctcatcatatttcaggcttccagggcattagacatttag

SEQ ID NO: 15919 - DNA, 150 bp, Glycine max
  Peptide Sequence Number=SeqID_132697
atgcggactagacatggcaagaaaatctgtacccgtgggtacccatccgaatttgtttcgattttgacgggtaatacccaaattgactggatatgggttcgggactgtgtggaggatactcgatatccaacgggtacagagatgggataa

SEQ ID NO: 15920 - DNA, 372 bp, Glycine max
  Peptide Sequence Number=SeqID_132698
atgcagctaaaggcaatagaggaaggaaggagttggtgcttaataaaggggactaggtttggctccatcttaggaaggatatatttcctactaagagaaagtcaaaacttagccccagaggtgttggccctttttaggtcttggagaggatcaacaacaatgcttataggtgtagctaattctattgatgaggcgtctacaaatttgaggacaaatcctcttcaagaggaaggggatgatgcaatcctcccaaggaggggacgcatcaccagagtcatggctaggagactccaagaagactgggccagagatgcaggagaagactttagggttctcatgagccttagggtagattttgggcccatgggctaa

SEQ ID NO: 15921 - DNA, 528 bp, Glycine max
  Peptide Sequence Number=SeqID_132699
atgcataacagcaagttagctgtgaagaaaggagtctggaggaatgatctgttgtcaattggtattctatcaataatcttcatgtgccttaacattgcggaccttgcagttgcatcactggtctgcaaaatgtggaacaaagcttgtcatgacccgtctctttggtgcaaaattgatctgtccaaacttaacagctcattctttttgaacatactgaataatcagccaggagcttacaagcgtacaagtggaaaaattactcaactcttaaagtatgttctaagtctgagtaatggaaatacatattgcttagtatttaactacaatgtttacttgacggatgagcagttcatcatagctattgaaaggaccccaaatctgaaacaactagttttaccaaggacatgtgacttttcaagagaagcagagcatatggcaatgaagtcaaggtgggccttgagtccattaccattacatctgacatattttttgcaatttgcgaattctgcaggaacatcattcggatga

SEQ ID NO: 15922 - DNA, 264 bp, Glycine max
  Peptide Sequence Number=SeqID_132700
atggagaagaagaaggggggtgcagcaaggaagagggggggtgagagcagaaatcagaaaagaagaagaagaagagaaggaagaaaatgggccagagatgagtccaacgggccaaagaggggagaaccggaccggtggtggtctgagggaggctgtgttggtggtttgtggtggcttggctattccggcactctgactgattggtactgtactgactctctgacacgcacagtaattaatgctttatttaaaggacagaattag

SEQ ID NO: 15923 - DNA, 399 bp, Glycine max
  Peptide Sequence Number=SeqID_132701
atggctttgacaaagaatatcacattgaagagtttggatggcgaggcatttgaggtggaggaggcagtggcggtgaagtcacagatgatcaagcacatgatcgaggacaactgtgctgacaacagagttcctctccccaatgctactaacaagattctggcagaggttatcaagtattgcaagaagcatgttgatgccaattgcattgatgagaagcccagtgaggatgaacttaaggcttgggaagctgatttcgtcaagggttacatgttgttgaggcttggaggtttgggcttgtattcgattattgttattgatgaccccccattgcagttactttttgtgcatttatgtctcaaggaaatttcaatggggagttttcatcagaaagcgcactga

SEQ ID NO: 15924 - DNA, 294 bp, Glycine max
  Peptide Sequence Number=SeqID_132702
atggcaaaatttgttggaaaggaagctttccactcaagagtaggtgcatctggaaagtcacagggaacatgtgctagagtcaccattgttcaggttctttttcttgtgtgttgtaaggagaacaacaaccatcatgcacaaaaggatctttgtcgtgctaagtttaagttccctagtcatcaaaagatcatagttagctggtgtcagaccctaatttcatttggggacaatcatttgcaaacatttggattcttgctagccgaattgagctgcttaacactacttgtctcgtaa

SEQ ID NO: 15925 - DNA, 513 bp, Glycine max
  Peptide Sequence Number=SeqID_132703
atggcatttgcacaacgacgagaactggaagatgaagtgagaaaagaactagaattggagagaacatttagaatctcgatgcaaagatcagatgggatcacatttcgagaaccaatttcagtgtcttttaatcacagtatgggtccattgaataatattaccatgtctggagggctaccattccatttactgtcacaagcttctaagcaaattaacaaggataaagtgattatactaaataagccagatgatcattgtggtgaaaagcgcaaagcaatgacacttgcaattgatgacaatgagagtctacagaagaaatccaagaaggagtggagttgcgagttgtgtcaaatttctgcaacaagtttgaaaggcttgaatgatattcaagggaaaaaacataaggctaacaaagaatccactagaactcaaaaaatagggctggattcaagaccagaaagtgaaacacttcatccttgtttaacacccccacacatgcaaactggaatctaa

SEQ ID NO: 15926 - DNA, 207 bp, Glycine max
  Peptide Sequence Number=SeqID_132704
atgagcatatattatgctataaggaaagacgaattacctgttatcactaatgaaagtagtccagctgatgttgcgctatatgagcggtgggagcgatccaaccggctcagcatgatgttcattaagatcaaaatcttggttgagatatgtggttttgttgaccaacatgaaaaggtccgagacttgcttaaggccattgatgactag

SEQ ID NO: 15927 - DNA, 582 bp, Glycine max
  Peptide Sequence Number=SeqID_132705
atggctttgacaaagaatatcacattgaagagtttggatgttgaggcatttgaggtggaggaggcagtggcagtgaagtcgcagatgatcaagcacatgatcgaggacaactatgttgacaacaaagttcctctccccaatgctactaacaagattctggcagaagttatcaagtattgcaagaagcatgttgatgccaattgcactgatgagaagcctagtgaggatgaacttaaggcttgggaagctgatttcgtcaaggagtatgaacaagatttttattgtgcttgtggaactgcaaggatccttgcttggttaccttgcctaaaagttacatctcgtagactccttctcctacatgaggagttacactattggaataagtctattgttgcttatgggttcatgcttcaagaacattctggaatcagaggtgcatctagaaagtcacagggaacatgtgctagagtcaccattggtcaggttctttttcttatgtgttgtaaggagaacaacaatcatcatgcacaaaaggctctttgtggtgctaagtttaagttccctagtcgtcagaagatcata

SEQ ID NO: 15928 - DNA, 213 bp, Glycine max
  Peptide Sequence Number=SeqID_132706
atgtgtgaaatgatcccaggttatgtgatcaagatagtccctacatccaaagtccacccaatgaaggtgttgaacatctcaagattaagattccaagtcattctaacaacagtgaaggccgcttggtatggagcaagagtagggatgagcactactactcagttaaatcagctaagatatttccagcctttgtgtccaatggagaaatgttag

SEQ ID NO: 15929 - DNA, 225 bp, Glycine max
  Peptide Sequence Number=SeqID_132707
atggaagaaaaactgctcaattggaagtcgtatctggacattgctaatttgtttgtgtacttgaatgaatatgttctagaagaaaggaacaagggtccagcatcttcaagtgtcgtgtcattcgatccccgtggagtgttggtgttgccgcttgcaccacagacagaaggtaccctgcttcacttcttcttggaaatggctcatcacttcttcttggagttgtga

SEQ ID NO: 15930 - DNA, 231 bp, Glycine max
  Peptide Sequence Number=SeqID_132708
atgcaggaacaagttgattttctccacatccttcgtgtaggaaatgttgtggctgattggttggcctgtttcgggacttgtaaccctggcactaaggttgatacgatcagagacatgcaggaacaagttaattttctccacatccttcgtgtaggaaatgttgtgactgattggtgggcctgtttcgggacttgtaactctggcactgaggtcttctttgaggacttctaa

SEQ ID NO: 15931 - DNA, 231 bp, Glycine max
  Peptide Sequence Number=SeqID_132709
atgacgccacttccagtgaaggaagataagtctgggcagacgccactttcagtgaaggaagataagtcaggctttcttaaggagtggaaagcacctaaggacctttctattgacaacatcatagttgatattgcagagggagcttctattgagctcataagaatgtacaaagaagactatgctaagctaaggagtgctttgagtctatctcaaaaagcctggatgctatag

SEQ ID NO: 15932 - DNA, 567 bp, Glycine max
  Peptide Sequence Number=SeqID_132710
atgacacatgttgaattgtttcggaagttcggggaatacgaaatggacttcacaagaatgactgaagatgaagctataggtaaaaagaatagaggcttatcattgaagactagcattacatcaagtgatgaaagtgcggatgacaatgcagatgggtcagatactgaaagtctgaacttgcttgtgagaaggttcaacaaattcctcaagaaaaagaataactatgaaaatagaacctttcatcctagaagaatatcaagaaagatgaactatcttcctccaacggattcacttgcttcaagtgcggaaagacaaaacatattaagcgaaaatagtgaagaggaacaaacaattttgtgcttgatggcaaacaatgaagctgagagtgaggtgtgcttagcaacggataaacaactatggtatcttgatagcaattgctcaaggcgatgtgaaccttacggggcggaatgtttaatacaggctacagagatttggatgccacttccagtgaaggaagataagtctgggcagacgccacttccggtgaaggaagataagtcagggtag

SEQ ID NO: 15933 - DNA, 297 bp, Glycine max
  Peptide Sequence Number=SeqID_132711
atgcaacatctgatgaagcttcttgaagactcttggtcggtggtccgcaaccatctgcttaaagaacttgccaaattctcagaagactatatcaagctctttggtggcatggagagatttgaggaattaaggatgtcactacttgttgatgggttaaccaaggtgactacggataagtggatagatataacgaacatgggatatgtcattgcatcaaggctaagtcgtggccaaatccatatattagcagaatgcagcatacaagagcttcgtgatgttcaagagagactatgttga

SEQ ID NO: 15934 - DNA, 674 bp, Glycine max
  Peptide Sequence Number=SeqID_132712
atgtacaaagataattggacccaaccttggcccatgggctcagaaatctaccctaaggttcacgagaaccctagggccttcttcagcagctctagcctaatcctcttggagcctcttgctcatggctctagtgagtggtcccttcctagggaggatcgcatcacttctgttgtcatcagtcgttatgttcactcatgcatactcccgccatgtaattacttatgccttgctttctttttcttcaccgtcaaagtcataatgaagcgtgaaagtctgcaccgctttcttagttgcatgcattgggtaccatgggagttgaagtattggtcgtcaaaatttccattcttgcgaacatggggtcagaccaagcaccatcttttaagaaaaaggttctatcatgtcaaagtcaagaatctagaagtagccagcttgcgaaaattggggcagcgaatgggtcaagtgcaacgtcaggcttttggcaaagtatatgggaagatctgggatctggcgatgatagaagtgtccattgaagccatcgcatctctcactcaatactatgaccagtcactcaaatgcttcacttttaggaactttcagttagcaccaaccatagaggaattcgaagggatcttaggatgccccataggaggaaggaagccatacctcttttttgg

SEQ ID NO: 15935 - DNA, 932 bp, Glycine max
  Peptide Sequence Number=SeqID_132713
atggcgaatcaagaggagtgggtcccgttgatggacgtattagcattactaatcttaggggtcgtcctctgtccaaacatggatggtatggtggacctagccgcaattgatactttccttgcataccaccatagcaaggaaagtccggtggtagctgtcttggcagatttatttgacacatttgaccgaaggtgcgagaagagtagcgcacggatcatctgttgcttgcccgctctctgtgtttggttggtttcgcacctgttcctgcaagacactaggcatccatgtccgctccaaagccatcgctcgtgtgctgaaaagagaagaatagattgggaccaacttttggctggtgtaggaggtagaacaatcaattggttcccccgatggaaggaaggaaaggagggagtccttttctcatgtaaagggtacccaaacattccgctaataggaacgaggggttgtattaactacaatcccgcgctcgctataagacaactagggtaccccatgaggggagcaccgatggaagaaagcatgtctcctttccttgtaagggatttcggcacgcaaaatttcaaggctatacaaagaatccataaggcatgggaaaccccgttaaggaaagatcaagaacttaggggcattcgtaacggcatcattggtggttatcatgaatggctgaaagttcatatacgaggtttagattggctcgccaagttaaaagtcgtcagcgaagacagtttcgaagcaccggaagaagacgaagaagtccaagctctcaaaaatgagttaggaaaggcgaaacttgccaaggagaagttcaagttagccgctacacacatccagaaggaatgtgccggattacgggaagagaatgcaactaccgcaaaagcccttgaacaagagaccaagagggctcacaaggaaga

SEQ ID NO: 15936 - DNA, 228 bp, Glycine max
  Peptide Sequence Number=SeqID_132714
atggtcgaagaatttgtgaatggctttgttcatcaaaacggcatcgctgtcataacccacaatccccccaaaggcgattccggctccatgtaccgcaacacattcacctcagtattttccgctatggccgaagaatttgtgaatgactttgttcatcaaaacggcatcgctgtcataaaccacaatccccccaaaggcaatttcggctccatgcccgcaagttgctga

SEQ ID NO: 15937 - DNA, 423 bp, Glycine max
  Peptide Sequence Number=SeqID_132715
atgtgcaagtttgagtttttccgtgacatcgtccacggcgaggccgtgacacacgcgcttctgcaccaagcaactctgggccacgtcccagtttcgctggtcggtgacgtagtgctgcagccagggcgagaaatcccctactccataccccaccgacggccccgcccgatccggcgcgttgtttctggtgacgaagagcgctacaatggtgaacggcgagaaggcgaggatgacgaagaacgtggcgaggaggtagaggtagagggcggcgttgacgcggcacagcacgccgacgaggccgagggtggagatgacgaatatgaagaggccgccgaagaggagcgggtactggagcaccttctggcagtcgccgtggacgcggatgtaggcggagtcgcccatggcggcgatactcaggagtaa

SEQ ID NO: 15938 - DNA, 234 bp, Glycine max
  Peptide Sequence Number=SeqID_132716
atggggtttgagggtggtaacggaaatgtagttactgagggtcttggctgggaatatacatggggtgacacgcatcatgctactcaacacgaaacaagccagtcggtaagatcagaagtcgaacatatgactagttcgattaaatcattgtatcatatctattttcaaattgatgctaacgtcattgaactagatgtcatcatatcggaggaggggaaaataaagttgttgtga

SEQ ID NO: 15939 - DNA, 165 bp, Glycine max
  Peptide Sequence Number=SeqID_132717
atggtgtggaactgtagctatgtagcttatgtggaagggagggatgaggtagacaaaggaacttctaatacacaggtattttggtcaagaatgtcaaacttgagcttaaatccattacatttagatggtattgatgctttaaaaagatccaggacttcttcatga

SEQ ID NO: 15940 - DNA, 270 bp, Glycine max
  Peptide Sequence Number=SeqID_132718
atggagaagacaaaattgtttcaagcaccgacagaaccggaagcaccctttgtttcaaaggatgtacccaccactagaactgatccacaagagatgtaccctctcttgttctcagtcaaacccaaggagaagggagacacaaaagaattcagacggttagtcctttgttcttttggaaaagggagaagagagacacaaaaagaattcaggcggttagtccttggcgaattctttttggcaaagggagaagggaatgaaaaggatgaatag

SEQ ID NO: 15941 - DNA, 255 bp, Glycine max
  Peptide Sequence Number=SeqID_132719
atgagaaagcgcatgtatggcttcaatggtcaaattactgtggaggttggagtactccaaccgattgttcctgatggcgtagcagcccaagacatagatgatggtgacgagcacgagcacgcatgcattgaatatggtgagatgtctccactggcttctgatgttggccagcactcctcctttgcacgaatcgcagttgaaacacagtttgtcttgtctgttgctccatgtcctgcaatcagtgtcgttcgctaa

SEQ ID NO: 15942 - DNA, 2365 bp, Glycine max
  Peptide Sequence Number=SeqID_132720
tcttcaaatcacagaagcaaagggttattatccgtatcaacccgccattgaaacgggtttgatgcttttgggtgaagtgagtggtgcaactttggatcctactattacacacatggcttattacaaatcgctgagttccatcactgtgtcggatattgaatcccatggaattgcaagagaagacgctgccactctccaccagggtctcgcagaaatcattgaaactcacagcaatggcacccccgccacgtggcagcacgtcagcaacagcatcctcaaccctgaacttcccttctcctttcatcagatgctgtactatggttgctacaaggattacggtcccgacccacccgcttggatacccaaccgggaaagtgctgctttgactaatgtttggcagttgctagagaggaagggtgaagagtttctgggttcggcatataaggatcctattacaagctttgatgatttccagaaattttcagtctcaaaccctgagatatattggaaatgtgtgtgggatgaaatgagcatatcattttccaaaccacctgaatgcatcttacgtgatagcccctcaggggaaagcccattatcacacccgagtggtcaatggcttcctggagcatctattaatccagcacagaattgcttaaatgtaaatggcaaaagaagtttgaatgatacagtaataatatggcgtgatgaacaacatgatgatctccctcgacaaaggatgacactcgaggaattgcgtgaagaagtttggtcaatgagagcaggaataaggatgcagcaaatggtacagaaggataagagctacataaaactgtggaggatactgtttggggggtgggtggaacagaatgaacacttggaaactgcttattggagagggttagttgcatatgctctccaatctctgggtctggagaaaggatctgcaattgcaattgatatgccaatgaatgtcaagtctgtggttatctacctagctatcgttcttgcaagttatgttgttgtatcaattgctgatagttttgcagctagtgaaatatcaaccaggcttaaaatatcaaaagcaaaagtaatatttactcaggatcttattatgcgtggtgacaaaagtatccccctttacagtagagttgtggatgcacagtcacctatggctgtagttatccctgccaaaggatctgaatttagcatgaaactgcgtaatggtgacctctcttggcatgattttttggagaaagtcaataatctcaaaggcaaggaattcatagctactgaacaaccaatagagacattcacaaacattctcttttcttctggaacaacaggtgatccaaaggcaattccatggaccaatattactcctctaaaagctgctgcagatgcatggtgccacatggacgttcgtaaaggtgatgtagtgtgctggcccactaatcttggatggatgatggggccgtggctagtatatgcatccttgctaaatggagcttcaatggctctgtatattggatcccctcttgggtctggctttgccaagtttgtacaggatgctaaagtaacaatgcttggtgttattccaagtattgtacggagttggagaagtacaaattccacatctggctatgattggtcttctatccgttgctttggctccactggtgaagcatctaatgtggatgaatacctttggctgatggggagagctctctacaagcctatcattgaatattgtggtggtacagaaattgggggtggatttgtttgcggatcactactacaggctcagtcattagctgcttttagcacaccagctatgtgctgcagtttgtttattcttgatgatgaaggccttcctattccacaaaatgttccaggaataggtgagttggctcttggtccgctcatgcttggggcttcaaatacactgcttaacgctgatcattacggtgtctatttcaaaggaatgcctctcttgaatggaaaggtattacggaggcatggagatgtatttgagcgtactgctaaaggatactatcatgcccatggtcgttcggatgatacgatgaaccttgggggaatcaaggtgagttcagttgagattgaacgcatatgcaatggagtagatagcagcattctggaaacagctgcaataggggtaccaccttctggtggtgggcctgagttgttgactatagctgttgtattcaaggattcaaatagcacaaatcaagatttacaccaattgaggatgtcttttaattcagctctccaaaagaaactaaatccactgttcagggtttctcaagtagtcacactgccatctcttccaaggacggcatccaacaag

SEQ ID NO: 15943 - DNA, 498 bp, Glycine max
  Peptide Sequence Number=SeqID_132721
atggcccagcacgactcctcgacgctcgactttcttgcccaaatcactgctttatgtaaagcccagggagtccactccgattccttgacccatgagagattaagtcctgctattaatttggcatatattaagaaaaattgctggaacctagatgacctctcagttactttcagagggccacgcaaggccaaggggaagaggtctgaggctcccccatcttctgaggttcctccttcctcagctccagcacctattccatctatcccatctacacccacatatggggcagtttattatcatgcagagccttcaggacttgggcttgccatccatcatgagcttggaggagaagtggcctggctaggagaccagccctcttcttctagagggggtgaggcctccacaacccaggagcctattcttgaggagacaacagcagcggcagcagcaacagaggaggagaatgatgcaattctaccccgcaagggcattgggtag

SEQ ID NO: 15944 - DNA, 342 bp, Glycine max
  Peptide Sequence Number=SeqID_132722
atgatcatagagacgcgattaaagaagaacgaacagagatgccggaaacagatgccgctaatactagcaaatcgcgtgcaaccagagatcgagaccaaaggagtgcgaagaatggagaaatcgcacaaaacagaaatcgcgatcaaagaggtaacagaatcgaaatctaagaacagaattcaaactggatcgaaatcgcgatcaaagcgacgcaacgatcgaagaaacacagttttccagatcggaaatccaaacagaatcgaaaaatcatggattcacttgaatcacacaaacaaccaaacaaaacacaagaaggatgtgcttgcagaagcgaaaaaatag

SEQ ID NO: 15945 - DNA, 580 bp, Glycine max
  Peptide Sequence Number=SeqID_132723
tccggcgttcaatgcaggacgaagcatatggttgcctggttggttaaacgctgttaatgagaatagtaattctctattcttaacaatagggcctggagacttcttggttcatcatgctattgctcttggtttacatacaactacattgatcttagtaaagggtgctttggatgcgcgtggttctaagttaatgccagataaaaaagattttggttatagttttccttgcgatggcccgggacgaggcggtacttgcgatatttcggcttgggacgcattttatttggcagttttctggatgttaaatatccattggggtggagattatctatggttgaactcttcgcaacttatcaacggatataacccttttggtatgaatagtttatcagtctgggcagggatgttctggtttggacatcttgtttgggatactggatttatgttcttaatttcctggcgcggatattggcaggaattgattgaaactttagcatgggctcatgaacgcacacctttggctaatttgattcgacggagagataaaccagtggctctttccattgtgcaagcaagattg

SEQ ID NO: 15946 - DNA, 611 bp, Glycine max
  Peptide Sequence Number=SeqID_132724
tgcacaaatcatctgctgtttacccacctttgtgtatggttggtttcgcacctattccaacaagacataaggcatccatgtccgctccgaagccatcgctcgaaggaaaggagggagttctcttctcatgtgggaactacccaaacatcccgttgataggaacaaggggttgcattaactacaatcccgcacttgctataagacagtttgggtaccccatgaggggagcaccggcggaagagagcctctctcctttccttgcgagagatttcggtgcgcagagtttcaagattatacaaagagtccataaggcgtgggaaagcccattaaggaaagataaagaacttaggggcattcgtaatggcatcatcggtagttatcatgaatggctgaaagttcatacgcgagggttagattggctctccaagttaaagattatcaacgaagagaacttcgaagctctggaagaggatgaagaagtccgagctctaaaaacagaactaggaaaagcaagacttgccaaagaaaaattcaagttggtcgctactgacgtttggaaggagtgtgccgagttacgagaaagaaaatgcagctaccgcaagagtccttga

SEQ ID NO: 15947 - DNA, 336 bp, Glycine max
  Peptide Sequence Number=SeqID_132725
atgttagggtaccatcaaggtggctcacaaaacactcaagtcccaaaactcacaaaacaactcttcaatcccggacttggtacaaaactcgtgcagcctccatgtttttatagcaatataacagatttatatgtccagtattttcgggcaagatgtcctggacatcgtatccgacatcgtggatcctacaacttcaatgcttttagcaactccagtattttcgggcaggatgtcctggacattgtatccgacatcgtggatcctgcagcttcaatgcttttagcaattccactattttcaggcaggatgtcctggacattgtatccgacatcgtga

SEQ ID NO: 15948 - DNA, 291 bp, Glycine max
  Peptide Sequence Number=SeqID_132726
atgcctcacaatcagattgacccgcgaacttgtttattcatctacccgttcgggagggaggggatgaccacggcgccccgtgcgcccggcctcctcgtcctcgcgacaaacacaaaccccggcgcttcgtgcgccaaggaactcaaatctgttaagtgcgactcccgggggcccggagacggtaatcccgtgaaccatcgagtctttgaacgcaagttgcgcccgaagccattaggccgagggcacgcctgcctgggtgtcacacatcgtttccccaacgcaaacatgtaa

SEQ ID NO: 15949 - DNA, 657 bp, Glycine max
  Peptide Sequence Number=SeqID_132727
atgaaaaaattgattgccgtgtgcggcgtattcgcggcgctgctgctgaccggctgtgcccagaataagaaaccgtatgactacagcgccttccgtgccagtaagccggcgtcaattctggtgctgcctgccgataaccgtgcgccggatatcaacgcgtcgcacagcttcacctcgctggtgacccagccgctggcggaagcgggttactacgtgttcccggtggcggtggtggaagagaccttccagcaaaacggcctgagcaacgggcatgaaattcaggcggtgagcacgaagcgcttgcatgacatcttcaacgcagacagcgcactgtacatttcgattaccgattacggcagcagctatctggtggttgattcggtgaccacggtctcggccactgcccgtctggtcgatctgcgcagcggtaaagagctgtggcagggcatggccaccgccaatgattctgagaacagcaacaacagcaacggcggcatcattggcatgcgggtgtcggcggcgatcaaacagatcgacaacaacgcgggggacaaagcgcacaccaatgctggtgtcatcagcccacgtctgttagcgcagaacgagcagggtggtctgctggccggtccgcgctacaaagcgccggttacgcgttaa

SEQ ID NO: 15950 - DNA, 1368 bp, Glycine max
  Peptide Sequence Number=SeqID_132728
gcattgcagcagcaacagcagcagctggaacagcagctggctgcccatcaacttagcctgcctgcagcgcccgagcgcgccggctggctgcaaacgctgcagcagcgctggcagcagtggcaggaaagtgagcggttacttgctgagctacagccgcagctggcgaaaagcgaaacggaaggaagcagcctgcagcacgctctggcgcgtgaacagcagcaggtcgccagcctgcagcaagcccttaaccacctgcaacagcagcagcaggcccagcagcagcagcgccagcagctgtttggcgaccggcgcgtggcggacgcgcgtcagcagcagcacgccacgctgcaacagcatgaccaggcgctggcgcaacagctgcagcgctggcagcaggcgcaaagcgaactgcacggcctgaaaggtcagtatgaacagattgtcagccagcagcagacgctggcgcagcgcgcagcggacgccgaaagcgccttccggcaggcattgctgctcagtgatttcgctgacgaaagcgccctgcgcgccgcgctgctggcggaagatgaggtgcagacgctgcgccagcggctgcaaacgctggagcagcagcatcagcagcacaccgcgctgcatgccagactggcgcagcggctgagcgatcacctgcagcagcgcccggccgcgctcagcgatgccgatgctggctccatcgccatccggctggagcagctgcgcgtggcgctgcgtgacaacgcacgccagcagggtgaagcgcagcagcagctgcacagcgatacccggcagcgtcagcagcagcaaacgctgctggtgcagatcgccgctgacgaagcggaactggcacagctaagccgcctcaacgatctgatcgggtcggccaaaggcgacaagttccgccgctttgctcagggcttaaccctcgatcatctggtgtggctggcaaaccgccagctcgatcgcctgcacggccgctatttattgcagcgccgcgtcagcgatgagctggagctggaagtggtggatacctggcaggccgatgccacgcgcgacacgcgtacgctgtccggcggcgagagcttcctcgtcagcctcgcgctggcgctggcgctgtccgatttggtcagccataaaacgcgcattgaatcgctgtttctcgacgaaggcttcggcacgctggatgccgaaacgctggacaccgcgctcgatgcgctggatgcgctcaacgccagcgggaaaaccatcggtgtgatcagtcatgtggaagcgatgaaagagcgcatcccggtgcagatccgggtgcgtaaaatgaacgggctcggctacagtaaactggagctaccgggcgagtga

SEQ ID NO: 15951 - DNA, 1142 bp, Glycine max
  Peptide Sequence Number=SeqID_132729
tcgtcgcgcgctatcgatgcgcctcaggttcgcgccgcaagccagccggcttatcagggcgtgcgcagcccaatcgcggtgggacagtttgataaccgttcgtcatacatgaatgggattttctccgacggcgttgatcgtctgggcaaccaatccaaaaccattctgatcacgcatctgcagcagaccaatcgcttcaacgtgctggatcgcagcaacctgaaagagctgcagcaggaagccgacttcaaacacagccagcagaacatcaagggcgctaactacatcatcaccggtgacatcaccgagttcgggcgcaaagaagtgggcgaccagcagctgtggggcatcctcggccgcggtaaaagccagatcgcttacgccaaagtgaacctgaatgtggtggatgtgaccacttcagaagtggtgtacagcgtgcagggcgcgggtgaataccagctgtcagcgcgtgaggtgatcggctttggcggcaccgccagctatgactctaccctgaacggcaaagtgatggatctggcgatccgtgaagcggtcgaccacctggtggatggcatcaataatggcgcatggcgcccgccgatctactactggggtgattaccagcagcaggtctacagctattaccagaaagacagcgatccgcagaagcagattgatgcgctgaatctggatatcgaaaaggccaaagcggtgaacaagccggtagcaccgggtctgcacgcccagctgggcctgctgtacgccaaaaacggcaatacggataaagctttcagccagttcgcccttgagaagcagctgtttccggaatcggcccccgtattcgcggcgctgctgctgaccggctgtgcccagaataagaaaccgtatgactacagcgccttccgtgccagtaagccggcgtctattttggtgctgcctgccgataaccgtgcgccggatatcaacgcgtcgcatagcttcacctcgctggtgacccagccgctggcggaagcgggttactacgtgttcccggtggcggtggtggaagagaccttccagcaaaacggcctgagcaacgggcatgaaattcaggcggtgagcacgaagcgcttgcatgacatcttcaacgcagacagcgcact

SEQ ID NO: 15952 - DNA, 1278 bp, Glycine max
  Peptide Sequence Number=SeqID_132730
gatgcgccgcatctcgatccggccgatcacggcattatcgcagcggcggtagagcgcgccgggcaggcgctggcggaatttggtaaagagcgcgatcgctacggcctgatccacgccgatctgcgtctgaccaatctgctgctgcacaaaggcgagacccgggtgatcgacttcgacgactgcggcatgggctggtatctgcacgatctggcggccgcgatcagcttcgtcgagcaccatccgcgtgcggcggagtgggtggataactggatcctcggctatgaacgcgtggcgcacatcagcgatgctgagatggcgctggtgccgacgctactgatccagcgtcgtattcagatgacggcgtggatgggcacgcacgccgataccgagatggcgctcagcctcaagccgcactgggccagccattcggtgcggctgtgccgtcgctatcttgagagcagtcagctgccgcgcgccagtcgtcacaggcgcgctgacaggcacgcggatcgccaccgggagcgcgccagcggcggccaggcggtgcattgccttgcaccgcgcgccgtcgggggacgctgcgcgtttgccacacccgccagcaaccgtggcgttctggccgcggcggcgaccggtctgagcgccttcattacggataaaggcggcgatgtcgatcgcatctttggcatcggcggtatcgattccgaactgctggccagcccgacactgagcctcgggctggtgaactattgccgcgtgatggaagaagcggcgcgccactccggctttgataacttcgtcattagggttaattggctacatcggactgtgctcgccgacgctggagcaggcgctgcacaatgtggtgaacgcgtttccctggcaccagcacgatacgctgacgcggctggtggacaagggcgactgctggcggctcgattatcaggtgcgccacggggcgatcctggcacgccgtcaggatgcggagctgacgctcggcatgttcctcaacctgattcgccacgtggcgggcaaaaactgggcaccgcgcgagcgcgccatgccggagcaggatgcgatgctgctgatggtgatgcaggatgccattcgccgcctcaacagcagcgccagcgtgcagagcgtggtcgaacaggcgcgttcgcaggtcagcctgacgctcattcagggcgaaccggtactggaggagatcgccggcaaaatggggttgtcgagctggtcgctgcagcgacgcttgcgcgaagagggcatcagctttag

SEQ ID NO: 15953 - DNA, 1011 bp, Glycine max
  Peptide Sequence Number=SeqID_132731
atgaagaataataaccaccagcagcaagaacggtccctcgctgctcaatcacagatgttcagtttcttcttctctcatgttcttgtatttgcctcagggttgctcattggaatcaccctcatcactttctctttcaaaaacttgtccctcaactttcaattccaccaactcttccttccatcactgtctcctcattctgatcccattctcatctctgcgttaaataatcaaacaaaagtcaccatccattccatcttgaggccaaccaaagcggctatgcatgacatgacagaggaagagttgctgtggagagcttctatggttcctatgattaaggaacttccttacaatcacaccccaaaggttgcattcatgtttttgacaaaagggtctgtccttttggctccactgtgggagagattcttcaaaggaaatgaagccttctattccatctatgtccattcacttccttctttcaatgacactgtgcctcaaacttctgtgtttcatggccgcagaataccaagcaaggaggtaagatggggtgacttcaacattgtaggggcagagagacgtctactagccaatgcactgcttgatttctctaatcaacattttgttcttctctcagaatcatgcattcctttgttcaatttctcaaccatctataactatcttatgaactcaaccaagacctttgtggaagcctatgacatgccaggtgcagtggggcgaggcaggtacagccccagaatgaggccactagttaacctttctcaatggaaaaaggggtcacaatggtttcaaatagaccgtgcccttgccattgacatagtttctgaccaacaatacttccccttgttcaacaagtattgcaagaatagatgttatggtgatgagcactacttgccaacgtttgctaaggcatggcagaacatgtctctacaatgggaagaccaccaatatttgccacctgtttgcaagaaaattcatgccgcaggctttagatag

SEQ ID NO: 15954 - DNA, 1959 bp, Glycine max
  Peptide Sequence Number=SeqID_132732
atggctgcagacttcgccattaaaatccctacaagctttccatcaacgatgaacactcgttcctccttgtttgcatccatactcacacttgctttcttcttcttaacaagtttgccacaatcctactctcaattacaaaaccacacgtactctatttgcagccaaatatcattcagttgtggaactctgagaaacatatcctatcctttctggggagggaaccgacctcagttttgtggccgcaatgggttcaagctaacgtgcatgcacaatgaaaacacctcggttcaagttggttcccaaagattcaacgtactaaacattaaccaaacggcttccaccttgagaatggtgagaacggaccttgtctatgatcgctgctcttccaatttcaccaacacttctctgagtgtcagtcccttcacttttctcccctccgttcagaatgtcattgtattctacgaatgcccttctgggattaattcagttgtgggaaacacttttacgtgccagaatgatactagtaaacatgttttctatgtggtcaatggaactcagctgaaccagttcccagaccttcacaagtactgtggggttagtcttcaggtgcaagtttcccagggtgttgtttgggaaagtggacttggggtgctggagaaagggtttgatgtgcggtacgatgcagagttgagttctcagtgcactgcatgcagggattctggaggaacatgtggaaccaatgagaatgattcgcctcagttctcttgttattgctccgccggagctcatgcttcagtctgctctactcacaaaagtttcgttgctactggatttgcactacctctaatagctgtcatcatatgccgtaacaaagctaggatttggaaatttatgttaatacaagttggtaagataaaaaggaatgatcgagttatagaagccttccttgaaagccaaggttctatgggtctaaaaagatacagtttctctgatgtcaagaaaatgactgactccttgaaaattaaacttggagaaggtggttatggttctgtatacaaaggaaaattactgaatggctgctcagtggcagtgaagatactgaacgagtcaaaagagaatggcgaagagtttatcaatgaggttgctagcataagcaaaacatcccatgtcaacattgtctctctccttggattttgtctagatggaagcagaaaagctctcatctatgagttcatgttcaatggttcacttgaaaagtacattcacaagaaagcatcagctgaaagcaaaactactaccccatccttgagcttggagagattgcaccagattgcaataggcatagctcaaggacttgagtacttgcacaaaggatgcaacactcggattctgcatttcgacattaaaccacataacatccttttggacgaagtttatcgccccaagatatcggattttggacttgctaagctcagcacaagagatgaaagcatcatttcaatgtcaaatgctagagggacagtagggtacgtggctcccgaagtgttcagtaaaagttttggaggtgtttcacacaagtctgatgtttacagctatggaatgatgctgctagaaatggttggagggcagaagaacatggacattgaagctagtcgttcaagtgagatatatttcccacaattggttatttataagaagcttgagcagggcaatgatttgggacttgatggtgggatattgtccggtgaggaaaatgagatagcaaagagaatgactatggtgggtttgtggtgcattcagacaattccttctcatagacctaccataagtagagtcattgacatgttggaaggtagtgtggattccttggaaatgccaccaaaaccatttctgtcttctcctccaagatcatcaacagatttttccactgcaatatccaaatcacttgacggtgtctaa

SEQ ID NO: 15955 - DNA, 1899 bp, Glycine max
  Peptide Sequence Number=SeqID_132733
atgttcaaatttgcatttttttttgccttttttctttttttcactactaatactacctccggaagccacaacaacacatcatcctgtcctactaacagctgcaaaaatggacctaagatcagttacccattttggttttcccaaggttcccttcctgatcaatattgcggttaccaagaacttgggcttttttgtgatgacaatggcaacgctattttttctccacccccaggtaaatactattacgtaaaagacatagactatgcaaaccatatacttaagctcgttgattttgacactgcaaacataacttgtccaagggcacttcacagctttcccttgggcaacctaccactctctcactcccctttgaactcaaacctcaacttttactacaactgcactcactacccttcttctggtgtgcctcctatcgagtgtctaagttctggggcaaaccggtcttttgtgtttctgatggggaacgagaccgaaggtttcgactgtcaggaaaaagttgtggtggcagtgttgaaggatcagatcacaagtcatgatgatggcggcttgatcaacgagtttgctggggccatgaatgaaggcttcttgcttgattggcaaacaactacgaattgcgccgagtgcgaggctagtaatggaacttgtggttacagtaacaccaggaaggagacgctgtgcttttgcaaggatggcaccacaaaaagcaatacatgtcaagggggagggggaagcagaaccggtttgtcaaggttaattataggtttaataataggtggaggaattggtgcactgctgatatgcatcctagtttacagttttagacgaaaattatcaccaattgtgtcagaaatccggaaggtcaaaaagattcatcaagacattgaggccctcataagaagtaatggacctcttcccataaaaagatattcatattcagagataaagaaaatgaccaattcttttcaatccaaactgggacaaggtggctatggtcaagtatataaaggaaatctaagcaacaactctcctgtggcagtgaaggtactgaatgcttccaaagggaacggggaagaatttatgaacgaagttataagcatcagtagaacgtcccatgtaaatattgttaatctccttggtttttgtcttgaaggccagaagaaagcacttgtctacgattacatgcccaatggatcccttgaaaagtttatacacaacaagaatttggaaaccaatccacctttgagttgggaaagattacaccacattgctgaagggatagctaaaggactggagtacttgcatagagggtgcaacactcggatattacattttgacataaaaccaagcaacatccttttggacaaaaagttctgtcccaaaatctctgattttgggatggctaagctctgctcaaatacacaaagtatcatatctatgtatggtgctagagggacagttgggtatatagctccagaagtgtggaacagaaactttggaggggtgtcatataagtctgatgtctatagttatggaatgatgattttggaaatggtcggaggaaggcaaagtatcagtattgaagcaagtcattcaagtgagacatattttcctgattggatatacaagcatgttgagttgggaagcaatttagcatgggatgaaggtatgaccacagatgaaaatgaaatttgtaagaaaatgattattgtgggattgtggtgcatacaaacaatcccatctgacaggcctgctatgagtaaggtggttgaaatgttagaaggaagcatagatcagttgcaaattccaccaaagccattcatatttagtcctaccaaaacccaagtggatatttgcaccactactagtagctctgattga

SEQ ID NO: 15956 - DNA, 801 bp, Glycine max
  Peptide Sequence Number=SeqID_132734
atgggggaggctacgaaaggaattactaaagcaatgggtcaaatgaataggtggaccgcggatgaatttgccttctgtacagaggatgatgcaagagtaatgggagatgccattgatgatgctttggaaggtggtgaagaggaggaagagacagaagagcttgtgaatcagtttcttgatgagattggaattgacatcaactctgagcttgtgaatgcacctgccacaacctctgtcagcgcaccagcagcaaagaacagggttgctcaagctgaatcaaccgcaaatgaagacagtggaatatatgatgatctacaggctagtgcggcacagtggacagccagaatgagagccaagccacttatcaatgcaagaggtgtggaagatgtgcctgcaagtgtgaagcttccttacactttcctcttcttcaaaacttgtcaagcagataacacattcagtctgggatcgcgtgtgattggtattaatgcaccatccgagcatggtgagagtgaaaaatgtgaaagaaattaccagtgttccagttatgagaagccaaggatagagtttcattcctcttatggaatggatttttcagaagcattagcagaaatgccgtgtcttgatatggttgacgataacaatgagcaagcacaacaacaaccatttcggtctcaacaatgctggagcacacaaaaagacaacttgaatctttgggcgttgaaagggcttctgtataaattggtggcgtctaacgaatgtttagaaggaaagattgcttattatatgccaatgaattcatga

SEQ ID NO: 15957 - DNA, 2798 bp, Glycine max
  Peptide Sequence Number=SeqID_132735
caaagatagacaataataattcttcaaatccagtgacatgttttacttgtcgtcccaatgatacccctcagataaagtacgatgtctttgttagctttagcggcgctgacatacgacaagatttccttagccatttggttgagggtttttatcgaaggcaaattcatgcgtttgtagattacaagattctcaaaggggatcaactatctgaagcacttcttgatgcaattgaaggatcattaatttcattgattatattttcagaaaactatgcttcttcgcattggtgtttgtttgaacttgtgaaaattgttgagtgtagaaaaaaagatgggcagattttactacctatcttctacaaagtggatccttcaaatgtacgatatcaaaaggggacttatggagatgccttcgctaaacacgaagtaagacataatttgaccactatgcagacctggagatctgctttgaatgaatctgctaatctatcaggatttcattcatcaacttttcgggatgaagctgagcttgttaaagagatagttaaatgtgtgtcgttgaggttgaatcatgtgcaccaagttaactccaaagggcttgttggagttggtaaacgaattgcacatgtagaatcattgctacaattagaagcaacagatgttcgtgttattgggatctggggtatgggaggtattggtgaagaagatttgaaaattgacacacctaatggattgcctcaatatgttgagagaaggcttcgtcgtataaaagttcttatcattcttgatgatgtcaatgattctgaacaactggaaattttagctggaacacgtgattggtttggattaggtagcagaatcatcataacaactagagataagcaggtacttgctaaagagtctgctaatatatacgaggttgagacattaaactttgatgaatccttacggcttttcaatttgaatgcctttaaagaagttcatcttgaaagagagtaccatgagctttcaaagaaagtggtgaattatgcacaaggcattccattagttcttaaagttttgggtcaccttcttcatggaaaagagaaagaaatttgggaaagccaacttgaaaggcttaagaaagtgcaaagcaaaaaggttcatgatattatcaaattgagctacaatgatcttgatcaggatgaaaagaagatatttttggatattgcatgttttttcgatggactgaatctgaaagtaaacaaaataaaaattttattgaaagatcatgattattcagtggctgcgggattagaaaggttgaaggataaagctcttattagtgtttctcaagaaaatattgtaaccatgcacaacatcatacaagaaacagcttggcagattgctcgccaagaatccattgaagatcctagaagccaaagtcgactattggatcctgatgacgtttatctagtactaaaatataacaagggtaacgaggctatcagaagcatagtcatcaacttgtcgggaatcaagcaattgcaattaaaccctcaagatcttgtgaatatgaggatccttatactccattcatccacacaactaaaggagctgcctgacctatcaaaggccacaaatcttaaagtaatggatctccgattttgtgtagggttaactagtgtacatccatcagttttctctctcaaaaagcttgagaaattgtatctaggtggttgcttttcccttagaagcctccgaagcaatatccatttggactctcttcgttatctctccctctatggctgcatgtcactgaagtatttctcagtgacctcaaagaatatggtaaggttgaatttagaactcactagtatcaaacaattgccttcatctattggacttcaaagcaagcttgaaaagctacgtctagcatacacttacattgagaacttaccaacaagtatcaagcatcttacaaagctgcgacatctagatgtaagacattgcagggagcttcgaactctaccggagcttcccccgtcacttgaaacactagatgctcgtggatgtgtatcattggagactgtaatgttcccttctactgctggagaacaactgaaggaaaataagaaaagggttgctttctggaactgcttgaaattggatgaacattctctcaaggctattgagctgaatgcacaaattaacatgatgaaatttgcacaccaacatttgtccacatttggtgatgcccatcaaggtacctatgtgtacccgggaagcaaagttccagaatggttggtgcataagacaatacagcgtgattacgtgactattgatctctcttttgttcttgctccacactcctctgatcacttgggcttcatttttggcttcgttgttccggaagtccctaatgagggtttggttttggaatttaagataagcactggaggagaaggtgaaggtagcaatatcaatgtgtacttagacagaccacgtcatggtattaaatcggatcatgtgtatctaatgtatgaccaagcatgttctcgctacctaaatagtcgtgccaaacatcatccaaggttgaagattaaggttacagtagcatcgcgaacgcacacatccaagtatgtaccattgcagttaagagggtttggagtcagcacaatcaacactacacaatacctcagttttgttcgtaaagtagaattgggtgatgagcttctacctggaatcagggaagatgcagaagctggaactctgcctgctaatgttgttgcgggaatggaaggattctacaatatataa

SEQ ID NO: 15958 - DNA, 1947 bp, Glycine max
  Peptide Sequence Number=SeqID_132736
atggaaactgtggttggaattgaggacaatgatgatggaaagtttgaagacagtggggttgatagaagcagttcagctttgtcttcaccgaagcaaattgccaacccaattgtatacaagcttgttcgggttgaaggtgatgggaggttagtgcctgcaacagatgatgaagtaatggaggtgggggattttcttgagtatgaaaacagtgaaatgcatgttgttgcaaacactggacagagtttggaatgcatatcaattgaaagatcatcttctgggaagcttcgattggagtgtaaggaaggcactgcagaggcagatttgggggaactgaatgcaaaattacagattttgcaaaaggtcaaagaggagaaacaacgcatatcatgtggatcacctgctcattctcatgtaaatatagacagccagtgttcagctgataaatttccagtcatagatgggaaggttcaatctgaaactccctgccaggaaattccttctatagcatcaagtttaaattatactcatagtaatcaatctgggagtattgatcagtgttccagaccttcagaaggagtaatagagagtggatcatctgcttctgctgtctattccaatttaaagcctgatctttcaatgtcagatggagaaatatgcttggacaagctatcaatcagagaactgcatgaactgtttaaggtaacatttggtcgggaaaccactgttaaagacaaacagtggctgaaaaggaggattgccatgagtttaactaattcgtgtgatgtttcagctacaactttcattattaaaaataacaaaatagttagaaaatttgaagaagaaagttctggaaatatgaatgctggatctttaatctcttcgggaaatatgactgaagaagaagatgtcaactttaaggattcatctgctgtaaatgcttgtggaattgaagataaccaagttgtttctgaaacaagaccagaaattggattggaagatgagaattatcagacaggacaaagagctgcaaaaagaattcggagacctacaaagagatatattgaagagctctctgaaaatgaatctagagagcacaatccgaggttgtcaatttctaataaaccaatgggacttggacatgtttctccaactttgaatgtcaggcctgctagaaatgctttttcagaggtgagaacatatggcaccaggttagactctctcggaggttctgatgtccaaattccttgtgtgtctcgggttcggagaagtcgtccaagaaaagatattgcatctcttatgaaattccatccaactagcatgggtgaggctgaaaaactgagtaataagctccttgagcatagttctgatgctggtagtgagtttccagacaaagttttgaagtcaagaatgccttcaaagtttcatcaaccatcctcttctgaacctgtgaaagagcagtgtccagtaataggcccggttgagctacggcaggaattgaggccaaaaagggcagatccatccagccatacctcagatgacaataatatagttactgttcctactgcaaaaggagggatgaggaggaagcatcatcgtgcatggactcttgttgaggtgattaaattggtggaaggtgtgtcacggtgtggagcagggaggtggtccgaaatcaaacggctctcctttgcatcatactcatatcgtacctctgttgatcttaaggacaagtggaggaacttgctcaaagctagctttgcactgacacctgcacctgcagatgaggggataaatttgcggaagcatggtacggctcccattcctgagaaaattttgctgcgtgtaagagagcttgctgagatgaattctcaagtgcctccaaattatagctcaagccagttagcatctggtggagggagtgtgcatggagatagatcggggtacttgtaa

SEQ ID NO: 15959 - DNA, 2454 bp, Glycine max
  Peptide Sequence Number=SeqID_132737
atgagtgaactagcctctcattctcatgagaggccttacaagagaaggaaatacaaagtggtagaagaagaaatggttcttccacttgcaagaaagcactttagctttagaaggcaatgtgagcttttgtatcaaagcttatgcatgatgcctctgaaattgattgagcgtgtcctgccatggttggtaggatctttaactcaagatgaagcgaagatgtttcagagaaatatgcagttggcaggtgcatcaggttgttgtcctgctcaaagactttcagatattgaagaaaacattggttggccatcctgtgcttgtgcatctgcattatctaatagtcatgtattagctgaatcaggtgggaacaatagaccagtcaagagaaacatatcggagttgcacaaaaatgaagatctacctgaaacttcagaggctgaagatattcagaaacaatgttgtagtgcacggccttgttgtgtgccaggtttaggagtaagtagtaacaatttagggctgagttctctttctacagccaagtccttacggtccttgtctttcagctcttctgccccatctcttaattccagtcttttcatatgggaaacagagagcagctcatgcaatgttggatctacacaaagaccaattgataccatatttaaattccataaagctatacgcaaagacttggagtatctagatgttgaatctggaaagctgagtgatggtgatgagacaattcttcggcaatttaatggaagatttcgtcttttgtggggtttgtatagagctcatagtaatgctgaagatgagatagtatttccagctttagaatccaaagaggcacttcataatgtgagtcattcgtacatgctggaccataagcaggaagaacaattgtttgaggatatttcctgtgttctttcagagttttctgtccttcatgaagccttgcagatgacccatatgtcagacaatttaactgagagtaattttggaacctctgatgctaataatagtgatgatatcaaaaaatataatgaacttgctactaagcttcaggggatgtgcaaatccataagagtcaccctggatcagcatcttttcagagaagaatgcgaactgtggccattgtttgggagacatttcactgtagaggaacaagacaagatagtgggtcggataattggaacaacaggtgctgaagttctccaatcaatgttaccatgggtaacgtctgcacttactcaggatgaacaaaacaaaatgatggatacatggaagcaggcaactaagaacactatgttcaatgaatggcttagtgaatgctggaaagagagtccagtgtctacagcacagacagaaacatcagatcatatcacttctcagagaggtgctgaatatcaagaaagcttggaccacaatgatcagatgttcaagccaggttggaaagacatatttcggatgaatcagaatgaacttgagtcagagatccgcaaggtatatcgagactcaactcttgatccaaggagaaaagcatatcttgtgcagaatctaatgacaagtcgatggatagctgcccagcagaaatcacctaaagctttatctgaaggatcatctaacagtgtagaaatagaaggactctcaccatcatttcgggacccagggaaacatgtatttgggtgtgagcactataagagaaattgcaagcttcgggctgcatgttgtggcaagttatttacttgcagattttgtcatgacaatgtccgcgatcactctatggatagaaaagcaacatcagaaatgatgtgtatgcgctgcctgaatatacagccaatagggcccctatgcataacaccttcatgtaatgggttttcaatggcaaagtactattgcaatatatgcaaattttttgatgatgaaaggaatgtatatcattgcccattttgcaatttatgccgtgttggacaagggcttggtattgattattttcattgcatgaagtgcaattgttgcctggggattaaatcatcatctcataagtgcctggagaaaggtttagaaatgaactgcccaatttgttgtgatgacctgttcacttcaagtgccacagtcagagctctaccttgtggccactatatgcattctgcttgcttccaggcatacacgtgtagtcactacacatgtccaatctgcagcaagtcattgggagatatggcggtttactttggtatgcttgatgccctattggctgctgaggaacttcctgaagagtacaaggaccggacatactctgccatgactgtgatcggaagggcacttcacgcttccactggttgtaccacaaatgtggattttgtggctcttacaatacccgggttatcaaatgtgagacgtcaaattccagctgctcttagtgtgcttcttttgtcgggaggtagacagagttggtaa

SEQ ID NO: 15960 - DNA, 649 bp, Glycine max
  Peptide Sequence Number=SeqID_132738
ttccccctcgtttctctttttcccatgatgtcgtctctgagctacaaaagcaacaagatgttccacgcaaagacacaatgcttcttgagtcaaatcatgactttgagttcagcactagcagaagaagccttgagtttgaatcatcttctgcagatgagcttttctccaatggggtgatcgttcccattcagatgcagaaaaagagaaacactactaggaaacacaccctttatggagaagctccatatatgagacttcctccacttccttctagtgttgacaaaataaagaaagagagcactagagaagttctacatgataagaaaacttactccacctctttctggggtttcagtagaagcaaaagtctcagttgtgatacaaagaaaagtttgatgtgttattcacctcctttgtcaaggagcaattcagctggttcagtgccacagccaaagagagtgagttcaaccgggcatcaagctaagccactatcatcttcaagctcttctaccttaaatttgtatcctatacaaaggtctcattcaagtaagagttatggaggatcttatgccaatggtctttggattagtcctgttttgaacctaccaactccttgcatttctaaaggaagtggtactagtctcttcgg

SEQ ID NO: 15961 - DNA, 364 bp, Glycine max
  Peptide Sequence Number=SeqID_132739
acacccagtggacccggaggagcccaacaaggccctagggtttccagctctggtcacgggcctctgtcagtcctatagggtgcccgtcccccccagcaagggatcgcgcccacaagacactcagtggaccctgagaagtccaacaagcaaggtcatcaggccccttactaaccgagctttcatcaagaagtactgtgcccccaggcaggcgcagggcgagacaccacaacagcctggggatggccggcagcgggcaacagacgcaccgccgacacctccaaaagcccctcaactcatctacaaaagctggagcattgcctacgaaccgtggtcgaccagcaggcggccaagtccaaagccaaag

SEQ ID NO: 15962 - DNA, 429 bp, Glycine max
  Peptide Sequence Number=SeqID_132740
atgaattttgcagcgagaaagcctgtagaattcaccccaattccagtatcctatgctgacttgctcccatatctacttgataattcaatggtagccataaccctagtcaaggttcatcaacctccatttctcccagaatacgactcgaacgcaacgtgtgcttgtcacggagaagccccggggcattccattgagcattgtagggctctgaagcgtaaggtgcaagttacaatgttaaatgaaatggataaagttgatatctttgtccctcatcctctcataaacgcatctttgcttattcaactttcaccggaatgtgggtgcaagccattggtctgtttgctcaagcgacctgtgctcttgagtttggacttccaagaccgttcaatcagagattactcgtcttgcgcgttggtggggctgccgtaa

SEQ ID NO: 15963 - DNA, 186 bp, Glycine max
  Peptide Sequence Number=SeqID_132741
atgacgggtctagtcatcatcctaagtggtagggacaacctgacccaacccgtgatatgcaacagggttggaaaccctaattgcctcacccaagaaatggcccggtcaaggaggaaccaccacggagggtggcgtgccgcccctagcaccactagtgcagggcccaacaatacgacactcttatag

SEQ ID NO: 15964 - DNA, 231 bp, Glycine max
  Peptide Sequence Number=SeqID_132742
atggaggctgacgacgacggcagcacggcaataataatgcatagatggaggtggaagaagttgcgttgcggcagaagcatatacggaatgcgcgagggagatgagagggagaagcttgctgatgtctttctggcctctagtcctcaatctattattagcaattttttctttctagggcttagacccctttcaaaaaaatgcatcaaatgctcctttgatttagaactataa

SEQ ID NO: 15965 - DNA, 258 bp, Glycine max
  Peptide Sequence Number=SeqID_132743
atgagtgaggtgtctgattatgtttgcgaatttgactggccggagtctggagatgcatgtcgattttgggctttgtttgtccatggtgacgcattggactttcaagtcagcatgttgattttcaatatatcccgcggcaacttggaggaaaaacaagaaagggaagggggaaaggaaaacgggaacgagagagataaaaatataaggaaaaaagaggaatcaagaccttattctggaaggtggctcatgaagctctga

SEQ ID NO: 15966 - DNA, 597 bp, Glycine max
  Peptide Sequence Number=SeqID_132744
gcaggagtgttgatctctcacaagaggaaagcggggagaaagaagtttcgggagacgcgtcacccggtgtacagaggggttcggcagaggaacggtaacaggtgggtgtgtgaagttcgtgaaccgaacaagaagtcaaggatatggctcgggacataccctacgccagaaatggcagctagggcacatgacgtggctgtcctagcacttaagggcacctctgcactgttcaatttccctgattcggtttctcttcttccggttgcaaagtcatcttctgctgctgatgtaagagttgctgcttcaaaagtttcaacgattttttgcccttcttattcctcagtaacattatctagttcttcaccatctaattcccgggtcaaggctaagccttgtttgattgatgattttgttaagactgagaataacgttgatgaggccaaatcagtgttttttgatgaagaggcgttctataatatgccacttttgttagatagtatggcagagggtcttctcattactccaccgtctatgaagagagtatttgattgggaccaggttgactgtgaaatagatctcactctctggacagattaa

SEQ ID NO: 15967 - DNA, 555 bp, Glycine max
  Peptide Sequence Number=SeqID_132745
atgaggccaattatcactcaaacttgtctatggatggtgacaccaatgaccccattcatgtgccacacgacaatggcacgagacaattttcactatgggatggaaagaagttgcacaatattggtgggtctaaaggcagcaatgcaaggagtgtcatggggttctgacaatgaacagaagatcaagaccagtaggctggtagtaacaagctttggctcacgggtaagctggctagctatgggggaattcaagcactttgtaattgttaagttcaaggaaggtgtggccgttgacgagctcacaaaagggatggaaaagttggtcacggagattggtgctgtcaagtcctttgaatggggacaagacattgaaagcctagatgtgttgagacaaggtttcactcatgcattcttgatgacattcaacaagaaagaagactttgttgcatttcagagccacccaaatcatgtcgagttctcgacaaagttttcggcagctattgagaatattgtgctactggatttcccatctactcttgtgaaggccccagcatga

SEQ ID NO: 15968 - DNA, 228 bp, Glycine max
  Peptide Sequence Number=SeqID_132746
atggccggacacgattggccattggattttttgtttcctacttacaggtacatagggacggatgcaagtggggatagggtcacgaccgaccgatcgttgccccttcccggcgctaaacaagcagagaacgtcgctgcaaggcagcccagttcaagtgggcaaacgctaacccataaggaaggaggagacatggttaatgttcccctaaaagaaaaaagtacaggttag

SEQ ID NO: 15969 - DNA, 270 bp, Glycine max
  Peptide Sequence Number=SeqID_132747
atgtggttcgccagtaggcggccaaccaccacggacaggtgcagttgcatgagtgcctctaccgattcagcctcagccagtagggtcagggttccaccccttttatatgccctaccccagagcagttcggagctgcggtcgcatggcttggagactgccccgatgctcagacaggggcaggacctgcaggggcccccggagccgaggatgaagcccaagaagatgaagacatggctgacctattcgacttctagggaggaggcggattga

SEQ ID NO: 15970 - DNA, 318 bp, Glycine max
  Peptide Sequence Number=SeqID_132748
atgctgacatctccagaaagggtgcagacgaccacattggtctttgcttgtcaatcagacttcgggtctccaaatgacgaggtgcagataaccgtaaggcgtcttcgcatgctaccggattcacgggtcacgatagcaggatgggtgagtgactcttctttgttgggagaccccattgttccttcttccgagggcaaggatggaaattctcatcccgggtcaaggtttatggtgagttgggattttggctcaaggcttgtagaatggtcagacatgatatatgttagggcattggtttggctagcagttcatggataa

SEQ ID NO: 15971 - DNA, 411 bp, Glycine max
  Peptide Sequence Number=SeqID_132749
atggactacctcacccctaccttaggggaaaccaataccatcctacttctcgccctacttgaaggagtcacatttgatttcaagcatgggtttctacatatgctagagaacaacctgtttagtggtgttgcctatgaagatcctatgcagcacctgagcaagttcatcaagttaaccaacatggtgagaaagaattatgtagcggtaaagtacattagactatatgcttttcccttctctctcaatgagaaggcgtgggactggctgtgttcactacctaagaatggcatcaccacatggaatcagtgcaaaagtgccttcttaaggaagtatttctctcctattaagatagatcagtacatcaaggacaatggaaactttgttcagaggaagcaaaagagtctgccttaa

SEQ ID NO: 15972 - DNA, 288 bp, Glycine max
  Peptide Sequence Number=SeqID_132750
atggctccgaagaagctctccacaaagaggtccagaaaggacacctctggggaaggctccagtgctgcccaggattttgatagtcaccgattttggagcgccgagcaccaacagcatttcgaggccatcaaaggatggtcgttcctcagggagaggcgggtccagctgaggaatgatgaacacactgacttccaggaggaggtagctcggaggcgatggactcagcttgtatcacctgtggctaagttcgatcccaaaattgtcatggaattctacgccaacgcctga

SEQ ID NO: 15973 - DNA, 1011 bp, Glycine max
  Peptide Sequence Number=SeqID_132751
cagcaagcctttcgcaaagcctacggtaagatctgggacttggctatgatagaagtctctacaaaggcgatcgcttccctcatccagtattatgaccaacccctgagatgtttcaccttcgaagatttccagctagtgccgactgtagaagagttcgaaggaattcttggatgccctctggaagggaggaagccttatctcttttccggattctacccctccataaagtgtctagaagaaagagcaagggacttggcaagtcaaaacaagtggcctcctttcattgatattctagcgctgttaatcttcggagtggtcctctttccaaacgtggatggtttggtggacctagtagcaattgacgctttccttgcctttcaccacaataaggaaagcccggtcgttgccgtcttggctgacatatacaacacattcaaccagagggaggccaattgggaccaactcttgccaagcatagaaggggtgtcagtcaactggttccctcgctggggttgtatcaactataatcccatccttgccataagacagcttggctacctcacgaggggagagccgttggtggagagcctcacacctttcgtcacacggggtttcagtgacccaacgcaagggtgcttcaaggagtccacaaggcgtgggagagcctacacacgaggtctagattggctcccgaatttgagagccgctaaagaggaaggggttgaagccccggaggaaagcgaagagcaactgagcgagactgaagcaaacatgttagccatcatcggcaagtacaaagaagaactggatttggcaacggcccatgagcataaggtggcggatgagtacgcccaagtgtacgcggaaaaggaggcaaggggaaggtccagatcttccccgattactagcaaaggccaaggcgatggcagacgtgtacttagcccccgaggaaatccatgggctcctcagctattgccaacatatgatagacttgatggcccatataattag

SEQ ID NO: 15974 - DNA, 1656 bp, Glycine max
  Peptide Sequence Number=SeqID_132752
atgaaagtatatcgacctgatgtggctcgagttggggttgattctcagacacgtgctgcccaagcagtttctgttgagcgtagaactgagcagcttcttgtcaagagtcgggaagaaattatgggatggatgcaccaattaaagaatcgtgaggcacaattggttcagcagttacatggtcttcatagggaactaaatgctactgctgctgctgttcgttcccaaggatctgttggtgttgatcctgaccttctcatggccagagatcagaacagagatgctttgctacagcaccttgccgctgtggttgaaaacagggacaaggttttggttgagatgtctcgccttgcccttttggaaagtaggttccgtcctggtagtggttttaatttggaagaggcccgtgctagtttggaggccagttttgcaaatgaagcagaggtagttttcactacagtttctagtagtgggcgcaagttgttttctcgtctttcccatggttttgatatggtggtcattgatgaggctgcccaagccagtgaggtggcaattctgccccccctctctcttggtgcagcacgatgtgttcttgttggagatcctcagcagcttcctgctacagttataagcaaggctgctggaacattgatgtacagtaggagtctttttgaaaggttccaacaagcaggatgcccaacaatgttgttgtctgtgcagtatagaatgcacccccaaattcgagatttcccttctaggtacttctatcagggacgccttactgatagtgaaagtgtggctaaattgcctgatgagccatactataaggaccctttacttagaccttatatattctatgacatcagacatgggcgcgagtctcacagaggtggatcagtgtcttatcaaaacatacatgaagcacaattttgtctccgattgtatgagcatgttcagaaaacagtgaagtctttgggtgttggaaagattactgttggcataattactccttataagctgcagttgaaatgcctccagcgtgagtttgacgaagtcttaaattcagaagaaggcaaggatctatatatcaatacagtagatgccttccaaggtcaagaacgggatgtcattataatgtcttgtgtgcgtgcatccagtcatggtgttggctttgttgctgatatacgacgaatgaatgttgcccttacgcgtgcacgaagggccctttgggtcatgggaaatgcaaatgctctgctgcaatctgaagattgggctgcgttgattaacgatgcaaaatctcgaaattgctatatggacatggactctcttcctaaggactttcttgtatctaaggcaccttcttacacatcattgcctggtaagccttcctcaaatatgaggggcatgagatcaggtggaccaagatatagatcaatggacatgcatatggagtcaaggttgggaccaccatcagaagaagatgagaatatgggtgctccagttagctccagaaatgggaaccttcgtcaatcgcggtattcaatggagaattccttagatgattttgagcatgggggtgacaaatcaagagatgcatggcagtatggaatacagaagaagcagaactcatctggatccatgggaaagagagacgtataa

SEQ ID NO: 15975 - DNA, 99 bp, Glycine max
  Peptide Sequence Number=SeqID_132753
atggttgcaggtgtgaatagttgtggaggtggaggagtagcaagaaccatatggtggctacgggtgagagaagaaaacgatgacaataaagagaaataa

SEQ ID NO: 15976 - DNA, 264 bp, Glycine max
  Peptide Sequence Number=SeqID_132754
atggggaaagacagtggacctgcaagtaggcttgagcaccaaaaacaacctgaaaccaaaactaacactgagaactcccaaagccaatattcaagcaatcatccaatgctcgtccacaccaatccaccaagcaaaagaactcctcctttcaacaatcagatgacaaggaggccaatgaaacagagcacaacacaatcacacaaaacagtcctgaacttccataattccaaagctcaaatcagaacactgaaacccaaccagtga

SEQ ID NO: 15977 - DNA, 2283 bp, Glycine max
  Peptide Sequence Number=SeqID_132755
atgggttctcgaggaaggccattatttgatctcaatgagccacctgccgaggataatgatgagagggaaggtattgtctgcttccagccccaaaaggcacacccatcaacaaatccgcacgcgtctgacttatttgcaacatcatctgctgcccaaggaatagtaaataataatgctttttcacatgcctcatctgtctctggatttcaaccttttgtccggcctaaatccactggtgttcctgaattggatgctgaatccaagagagcaggagatcaggatgcaaaggtttcctctaaagatgaagatgtgaatgttatggattcacggatattaagttcggccaatgctcaatttacagagagggaagaaggggaatggtctgatgaggagggtggctttgctaatgcaaatggaggtaataatgctaatgcaaatggaggcaataatgctattgcaaatggaggtagtagtttgccacgacaaagtcaagcttcagaagagccagcaacttctggaatggtggatgggtgtgttgcagtggcttctgacagtaagtctagaaatattaagagttctgatagtataaatgatgaaaagagtagccatgcttctataggtctagaatcaaattctagtgaacagaaaagcaatagtattccaaattcagaaagcaatataaaaagtgaagcttctgttgatgcacaggaggaaccccctttaatccccaagccaaaagaagtgaaaggtattgaagcaagtcatgcacttaggtgtgcaaataatcctgtgaagaggaagattgaccaacgtaaagaggaaatgttgggaaagaaacgtaatagacagactatgtttcttaacttggaagatgtcaagcaagcaggtcctattaaaacctcaacccctagaaggcagactttctcatcacctgtcataagtcgtataaaagaagtccgcactgttcctgcacaagttgagcgtgttgggatagctaaggatcaaaggctcaccgacacatcttctggtgaaggtggcaactatgctgaagcacaagagcctaaatctgattgcaatggtgatacatctggaccaccagttagatccaggaggctaaacagtgagacagaacctcctacagaggccaatttaccaccacccattccaagacagggttcatggaaacaactgtcagattcaaggcagcagaagaatgtactccattctaataggaagtcaggactgagtggtcaaagctccaatgatgtcaaattgggaaacaagaaacatctttctatcaagaagcaggctcctgtcagcagccagccccaggacacttctgttgaacgccttatacgggaggtgaccagtgaaaagttttggcatcacccagaggagactgagctacagtgtgttcctggacgatttgaatcagtggaagagtatgttagagtatttgagcctttgctttttgaagaatgccgtgctcaactttacagtacctgggaagaatcaacagaaacagtttcaagggatactcatattatggtgcgagtgaaggcaaatgagtcaagagaaagaggttggtatgatgtgaaggttcttccagtacatgagtttaagtggtcatttaaggagggtgatgttgcaatcctttcatcccctaggcctggatcagttagatccaagcagaatagttcatctttagctcaggatgatggggaatcagaagtcactgggcgtgtggttggtactgttaggcgtcacatacctattgatacccgtgatcctcccggtgcaattttacattactatgttggagactcttatgatcccagcaggcaagtttttgttcaaactttcccattaaagggctcttttaatgattgtgttgaaatggttgatgatgatcatatcattagaaaacttcaagctggaagcatctggtatctcacagtgcttggttctcttgctaccacacagagggagtatattgccctacatgcatttcgtcgcttaaatttgcagatgcaaactgcaatccttcagcctagtcctgaacacttccctaaatacgaacaacagaccccagccatgcctgaatgcttcacacagaactttgttgagtatctgcataggaccttcaatgaaccccagttggcagcaatccagtgggcagctatgcatacagcagctggtactagtagtggaacgacaaagaggcaggaaccttggccttttacccttgttcaaggacctccgggaacaggaaaaacacatacg

SEQ ID NO: 15978 - DNA, 414 bp, Glycine max
  Peptide Sequence Number=SeqID_132756
atggtagaagaacagcgccgcaaaaagtcagaagagcgcaacgcaacgcaacgcgaagaatgggaggttggaggcggaagcagatcatgttatgactcgtcgcaaagatcttccaactctttcatggatgagttaaatgtggtgccagaaagcagggaggccattggtggcggcctgtataagttgcatcataccctgcctcttaatgtttctgagtacattttacaagctctgaagccaaggctcaaacacaattcctgcatgtatactcccccaagacaactaaggagtaaggagggaagagaggaaagctttgtgcctcggattaggaggagacatctctatagcttggagttgaagctcatgatcatgatcttacaacctcctattgatttgattggaacagatctctaa

SEQ ID NO: 15979 - DNA, 909 bp, Glycine max
  Peptide Sequence Number=SeqID_132757
atgaaacatgaaagtgacgggaacttcattcaggttccttcactgtcttctccggtaacagatcctgatcctgatccaatagtgattgtcattgatttgagaacgttctatgcgtcagaggtgctagtggcacttgaatacctccacatgatggggatagtgtaccgtgatctgaagccggagaacgtgttagttcgatcagacggccacatcatgctcactgattttgacctctcgttaaaatgtgatgattccacatcaacgccccagatcatcttggatcagaaaaacaccccacacaaggacccccgcgtggatccctcgcagtctcagttcacctcgtcttcctgcatactacccagctgtatagtccccgccgtgtcgtgtttccacccaaaacgcaagcgcaagaagaagcaggcccaacataatgggcctgagtttgtggccgagcccattgatgttcgctccatgtccttcgttgggacccacgagtacctggctccggaaatcgtgtccggggagggccacggtagtgccgtggactggtggactttgggcatattcatatttgaattgttctatggtgtcacgccctttaggggaatggacaacgagctaaccctagcaaacattgtggctcgagccttggagttccctaaggaaccctccgtgccacccacggcaaaggacctcatctctcagctattggttaaggacccttcgaggaggctaggctcaacaatgggtgcttcctctatcaagcaccacccctttttccaaggtgttaattgggcattgctaaggtgtactcctccaccctttgtgcccccacattatattaaagaagctgtatcatctcatcatgaaattgaaacttgtccgcagactcccattgattattattga

SEQ ID NO: 15980 - DNA, 540 bp, Glycine max
  Peptide Sequence Number=SeqID_132758
atgggtttgggtaaccgtccttgtattcaatgtaacttatttaaaaagcctaagcgtcgcatccagtactcaagcgcgctcctcttagggttttctcaattccaaatcttccttcctctgcaaccaagcatcacaggagcttgtgagaggattccagtagttgttgcaagagttgaaagccaaggcggttgtgaaggccaggtagttctcgtaggagttgtggcggttcttgtggagccacggctatgcttcgcgtgcgctttcgtcttcctttgctctgaacgtcgccggtgttggattcaaaacgacattggccatgctttcgtcttcctcaactctggcgcacacaaagtgcttcgtgatctgaacttttcaacaacagatccagtggcattgatgcttggaatgagcttaaagaatgttgtatttgaatttttatttattgtgaaggcatacaatttgtctagagaccacaaacctgatcttgagattaagaaggaaagaatcttaaaaggtggtggttttattcacgcaagctga

SEQ ID NO: 15981 - DNA, 651 bp, Glycine max
  Peptide Sequence Number=SeqID_132759
atgatgatacctgacggcgggttcagggaagcgtttgtggggctggcgttggcggaggatgtggaggtcgccgccggggcagaactcggtgaggaggcagagccatttggcggcgtcgatggtggcgtagagggtggggaggaaggggtggtcgagggattcgaggatttccctctcggtcttggctcttccttccttgctgcggctggccagctccttcttgtccatcaccttggcggcgaacatcacggagagggacccgtcgttgagttcggcgaggtagacggagctgatgtcgccggagccgagacggcgggagaagcggaggtcggaggggaggatgcggcggctgggggactccgatcggatccggtggatggcggcccagcgtgggtcggaggagggagcgtggggcttgctgttggcggggaggtgggcggaggaggaggcggtgagagtggtggtttcggagccgaagctggtgctccgcttgatgtccgcggtggcggtggaggcgaagctaagactctggaggtcgggttagagatgaggaaagtgaaacaaacggggttcccactctcactcattcctctgattcctatcgggccaaatggaactgccacgttcgctttcgcccttttagatatataa

SEQ ID NO: 15982 - DNA, 780 bp, Glycine max
  Peptide Sequence Number=SeqID_132760
atggagcccctcttggttactaacctgcggaagctgctcatgctctgcgtcgattgcagggtgccgctcgaaacggtggagcttcttgggcctgagttgggtctgccctccgattttaaggattgtttggttcccaagtacccgcagtttttcgcggttaggcggttccgtggaagggattcgcttgccttggaggattgggattccactttggcgctcactgctagagagtctaggttggcacaggaaggagttgtgaacctgaaggcagatggaaataggaggaaggtgaagatttcaagagatgggaactatcttggtccatttgcattcaaaatgaattttcctgcgggttttcggccaaatgttggttaccttgagcagcttgagaggtggcagaagttggagtttccttctccttatttgaatgcgaggaggttcgatgctgctgatccgaaagctcgaaaacgggctgtggcagtgattcatgagcttctcagcttgaccatggagaagaggatgacatctttacagctggatgcatttcatgcagagtgtcttttgccatctaatttacttctttgcttgataaagcaccaaggtatattttacctcaccaataaaggtgtaaggagtactgtcttcctcaaagatgcttatcttggttccaacttgatagataagtgtcctttgttgcaattttatgataaatttatggcactctgtggtagaggaaatattgatctgtgtgacaacaattctttaacaatggttgtttag

SEQ ID NO: 15983 - DNA, 1767 bp, Glycine max
  Peptide Sequence Number=SeqID_132761
ccaccaccaccatcgcctattctccgcctccacgcgcttcaactctacttcgagagactcgcggcggcgaaggagcggctcaaactctgttcgaccagcggcggatggggccgaatcgatcgagacgacgccgtcgaggccatgctccgctacgccgacgccggtctaaccaccttcgatatggccgatcactgtacgttctcttcttactcgcaattgcttctgctgacgtggagttttccgattggcctgttattcctcctccctccgttactgcctgataacagaagcattgccgtcaagaatggcaatgattcattggtcatatgtcgggttgtgaatgggatgtggcagacgagtggtgggtggggcagaattgatagggatgatgctgttgatgctatgcttaaatatgctgatgctggcctcaccacttttgatttggctgatatatatggacctgctgaagatctatatgggattttcattgatcgagttcgtcgagagcgtcctccagaattattggaacaggtcagaggtctcactaagtgggtgcctccgccagttaagatgactagtagctacgtaagagacagcataaatgtttcaaggaagagaatggatgtggaatccttggacatgcttcagttccattggtgggattattcgaatccaggctacctggatgcactaaaacacctaacagatttgaaagaagaaggtaaaatcaagactgtggctctgacaaattttgatacagagagattacaaattattcttgaaaacgagattcctgttgtaagcaatcaggtgcaacattcacttgttgatatgcgtccccaacagagaatggcagagctttgtcagcatacaggagtcaaactgataacgtatggaacagtaatgggtggtctgttgtcggagaagttccttgacaccaacatatctattccttttgctggtcctgcaataaacaccccctccctccaaaagtacaaaaggatggtagatgcttggggaggatggagtttgttccagggactgcttcggactcttaaacaagtagcttctaaacatggcgtttcgatcgcaactgttggagtgaagtatatactagatcagcctgcagtagcaggatcaatggttggtgtcagactaggcttggctgaacatattcaagataccaatgctatcttttcgcttgttcttgatgaagacgacatgaacagcataagagaagccacagcgaaaggaaaggatctgcttaaagtgattggtgattgtggagatgagtacaggcgggacaaaggaaaagtgttcgagcccaattttgtgtcagttgaagaattttattggaacaacgaggatatcatcgtcgttgatagcagtgcttcccatggcattaacattcatcaaataagtgagagtggtgaagtacctagcagcaacgacaacgagggtatcaacggggcgaacaacataagagaggtaaatcgcggggagagagttattggagccgttgaaataggtgcaagggagaggaacgatgaggttttggctcacatcagggttggaaatggagttagcctcgcagagctggttggaggagacgaggccgacgtagacggtgtcggcgatggaggagggcgtcagagggctgcgtcttgtagaagagcttcaaggggagaatgtggtgctccacgtcgggtaagagatatcgatgacgttcacagtgagaagcgcaatgggatcgatttggaagagtga

SEQ ID NO: 15984 - DNA, 459 bp, Glycine max
  Peptide Sequence Number=SeqID_132762
atggatgaaaccccaagagctgaaaaccctagttatatattatgtctctccactcctgcgcctctcgtctcgctctgcacaaaccctaacaccaaaaccagaagcgaaatcgcaatcgcaatccagcgagtcgtcgctgcatacttgctcgcagtgttgggagggaatccttccccttctgccgatgacatcaaacacatcctcggcgcagttggagctgaggctgagaatgagttgattgagttgctcttgactgaagtcaagggaaaagacttcaatgagctaattgctagtggaagtgaaaagatgtctgcagtgtctggtggcggtgcagcggttgccgttgctgctgcaccagctggaggtgctgctgcacctgctgccgaagcaaaggaagaaaagaaagtagaagagaaggaggagtctgatgatgatatgggtttcagtttgttcgactaa

SEQ ID NO: 15985 - DNA, 1933 bp, Glycine max
  Peptide Sequence Number=SeqID_132763
tcttattcagttcaaagtgttgctgcgtttgaagatgacggaggaacacgagaatggcgccaacgcaagcgaggaggaacaggtcataggcccgggcccggcccctcgtgcccggcccaagcgaccccttcagttcgagcacgcctacctcgacgccttaccctctgccaacatgtacgagaaaagttatatgcaccgtgatgtggttacgcatgtcgctgtttcagctgccgaatttttcatcactggaagtgccgatggtcatttgaagttttggaagaaaaggcctattggtattgagtttgccaagcacttcagatctcatcttggtccaattgaaggtctagctgttagtattgatggtctgctttgctgtacaatatcaaatgaccgctctgtgaaaatatatgacgtagtcaactttgacatgatggtcatgattcgcttgccatatgttcctggtgctgttgaatgggtttacaaacaaggggatgtcaaagctaggctagccattagtgataggaactcatcttttgtgcacatatatgatgcaagggctggtacaaatgatcctatcatctccaaagagatacatatgggtcctattaaagttatgaagtacaatcctgtatgtgattctgtactttcggcagatgcaaaggggataattgaatactggagccctgctacacttcaattcccagagaatgtggtcgattttaaattgaaaagtgacactaacctctttgaaattgcaaaatgcaagacttctgtttcggctattgaggttagtccagatggtaagcaattttccattacatcacctgatcggagaatacgtgtgttttggttcagtacaggtaaactaaggcgagtttatgatgaatccctggaggttgctcaagatctccaaagaagtgatgctccattataccggttggaagccattgattttggtcgaagaatggctgtcgagaaggaaatagagaagacagaaagtgcactacttccaaatgcagtttttgacgaaagttccaattttcttatatatgcaaccttgcttgggattaaagtggagaataatgataggttcttaagaatagctttatatcaaggggatcgaaatagtaaaaaagtaagaaagatcccttcagcagctgcaaatgctaatgagagcaaggagcctttgacagatcccactctcctgtgttgtgccttcaaaaagcacaggatatatttattcagtcgaagagagccagaggagcctgaagatgcaactaaaggaagagatgtgttcaatgaaaagccacctgctgatgaacttttggcagtatcggatattggaaagtcagttacaacatcacttcctgacaatgtggccataagtaactacgtcttatggtctggtccagggttagacttagaccttcctcaaccctctcatgatgatcctggtttactagaacaggatattctacacaccactatgggtgatattcacatgaaattatacccagaggaatgtccaaaaactgtggagaatttcactactcactgccgaaatggctactatgacaatcttatttttcatagggtcatcaaaggcttcatgatacaaacaggagatcctttaggagatggcactggtgggcagtctatttgggggagagaatttgaggatgaatttcataaaagtttgaggcatgataggcctttcacagtatcaatggcaaatgcgggccaaaatacaaatggttctcagttctttataaccacagtggctactccatggttggacaacaagcacactgtatttggtagagttgccaagggaatggatgttgtacaggctatagaaaaagtgaagacagacaggacagataagccacatcaagatgttaaaattctaaacgtaactgtaccaaagtcttga

SEQ ID NO: 15986 - DNA, 1731 bp, Glycine max
  Peptide Sequence Number=SeqID_132764
atgagtaactggttggggttctctctgactccacacttgaggattgatgaagaatttgagagagagaaccaagagcgtggagcaggaggaggaggagggtaccatcatccttctccttcttctcaccctcacttgtctgttatgcctcttcgctctgatggctctctctgtgttgctgactcctttagccactctgctgcatctcaagaatggagatatgatagtgcaataggtggagggaattccaacgagaaaggtccaaagcttgaggactttttgggtggctactcaaactcccccactaaggtcttttgccaagacactcagcatgaccaaaaccaaagccagaacaatgtttccaaaatcaatgttaatgtagcaccaagcttttgcaccaatgcagagattgaaactggggagagcctcgctaacccttatccccaccaatctttccatgcatataatgataactcacatgcccttatccccaccaatggcatgtacaagtcctggttggcacaaactcagttttcttctgatggaaaaccttcaactgaagctaatgggtgcaatttccaatctctgtccctctctatgagccccggtatgcaaaatggggtgggtgcaatttcctctgttcaagtgagtgaggatagtaggaaacgggtcatggcaaaatctcatgctagagaaccagtccctcgcaaatctattgacacttttgggcagagaacatctcaataccgtggtgttacaaggcatagatggactgggagatatgaggcccatttgtgggacaatagttgcagaaaggaagggcaaacaaggaaaggaaggcaaggtggttatgataaggaagaaaaagcagcaaaggcttatgacttagctgcaatcaagtattggggtccaacaactcacataaatttccctttaagcacttatgagaaggaacttgaagagatgaagcacatgaccaggcaagaatttgtcgccaatttaagaaggaagagcagcggattttcaagaggggcatctgtgtatagaggtgtgacaagacaccatcaacatggaaggtggcaggcccgaataggaagggttgcaggaaacaaggacttgtatcttggtacatttagcacacaagaagaagctgctgaagcatatgatatagcagcaatcaagttcaggggaacaagtgctgtgaccaactttgacataagtaggtatgatgtgaagagaatctgctcaagctccactctcattgcaggagatcttgcaaaacggtctcctaaagaatcaccagctctggttcctgccgaggacttcaattcgtgtggttcatcgatgccgccggcatctcagccccctcctttggctataactgatggtgaacattctgatgagttgtccaacatgatgtggaatgccaacagcgatgtgcatgcacagaatgagaatggtgctaacatcaacaacaatgtcactgaatcatcatcacaacaggtttcaccaagcagcaacaaggatgctttgaaccctcaaagccccaagtgttctgtggggctacccaatgagtttggagtcagtggagcagattatggacatgggtacttcacccttgatggaccaaaatatgatgatgggaacaatgaaaacgaccacatgagcaccaacaggcttggaaatttgggattggttaatcaagttcccatgtttgctttgtggaacgaatga

SEQ ID NO: 15987 - DNA, 189 bp, Glycine max
  Peptide Sequence Number=SeqID_132765
atgcagatagcaggaactgataaatttgctaaagtgatagactttcttcgccgacagctccacagggagacattgtttgtatatgtcaatagtgccttttcaccaaaccctgatgaattggtcattgatttgtttaatttgaggaaaaattttagctttatgcctgactgtatgtgcttgggacaatag

SEQ ID NO: 15988 - DNA, 303 bp, Glycine max
  Peptide Sequence Number=SeqID_132766
atgaggatctcagtaacctcgagtgactcagacgcgccgataccgttgagcgggagaagagggagggcgatgaccatgaaggacacgagggcagagagcaccacggggtccagcctcgcctcggaagcatcaaggacaaagatggcgacgacaaagtatgcaggcggcatgaggggaaggcactttgcgactaggttggagcgaagggtggcggcggtggcgatgcagtggcacgacgtagttggtgtagcagtctatgagagttggcctagcggtgcggtagcgctgcggaattggcgctga

SEQ ID NO: 15989 - DNA, 861 bp, Glycine max
  Peptide Sequence Number=SeqID_132767
atgagaagaagtccttgttgttctaaggaagggttgaacaaaggagcatggacagctctggaggataaaattttgacagaatacattaacattcatggcgaaggaaaatggagacacttgcccaaaagagcaggtcttaagagatgtggaaaaagttgcaggctaagatggttgaattatctaagacctgacattaaaagaggcaacataactaatgatgaagaggcgcttataatcaggcttcacagtcttctcggaaacaggtggtccttgattgctggacggcttccaggacgaacagacaatgaaatcaagaattattggaacaccaacattggaaggaaacttcaaaatggtggtgcaggaagcactttaaacacaaatattcaacaagatcaaaacgttaaagaccaagagtggcactatgataagggttcgtgtcttgttcagacaaaagcaacaacgtggactaataaggtcacagtcaccaatgaaattagtcgacacaatgaagggattataattaagagcaatgttatcggtgataacaaaatgaagggttttctattgtctccatctaaagagagtaacaatgatccagtgttggatttcatggcagatcttgagatggatggaaacttcttctcggagctcattgagatggatttgccggaatcatcttgtcaagaaaataagatattggaagataacggtaaccctatcatggttgataaagtctacttatctccaaaatcatccagtgataccatccactacccttggggtgattcatggtatgatacaaattttgattttttaccagtgacaatttttatggagtccggatttgattggctctga

SEQ ID NO: 15990 - DNA, 1203 bp, Glycine max
  Peptide Sequence Number=SeqID_132768
atggagcactcgaagaagaagaagaagaagaaaggcagccaaaaccctgaggccaagttccaattcgagctcaacacatgttccaaggcgaaggacctccgtggcgccatatccctctatgacgacgccgtttcgaacaacacccgcctcaaccagcatcacttcaacgccctcctctacctctgctccaactccgtcgccgacccctccctcaaacccaccgccctcgattacggcttccgcgccttctgccacatgtccgccctcgccgtcctccccaacgaggccaccgtcaccgccgtagcgcgcctcgccgcggcgaaaggcgacgccgattacgccttcgacttggtgaagagcatgggcaagaactacaacaacgctttgccgaggctgcgaacctacgatcctgctctgttctgtttctgtgaaatgcttgacgcggataaggcctacgaggtggaggagcatatgagtggggttggagtgagcctggaggaggcggaagtcgcggcgcttttgaaggtgagtgcgcggtgtggtagagcggataaggtgtatgagtatttgcataagcttagaagctctgtgaggtgtgttagtgagtcctctgcggtggttattgaggagtggtttcgtggcagcaagtcctctgaggttggcgaggtggaattcgaggccgggcaagttaaagagggagttttgaggaacgggggagggtggcatggtcagggatgggttgggaaaggggattgggttgtgagcagaacgagtgttggtgctgatggacattgttgttgttgcggggagcaattggtttgtgttgatattgatgacgcggagagggagaagtttgcagggtctgttgctgccttggcctttgaacgagaggtcaaggccaattttagtgaatttcaggcctggcttgaaaagcatgcctcttatgaagctatagtggatggagcaaatattgggctctaccaacaaaattttgcagatggcggatttagcatttctcaggttcttgatgatgttgtgaaagaactgtacaatcggagtgggaagaaatggccgcttgttgtgctgcacaacaagcgtctaagagggctgatggaaaatccttctagcagaagactggtggaggagtggatgaataatggtgcactgtatacaactccaaatggatccaatgatgattggtaa

SEQ ID NO: 15991 - DNA, 1533 bp, Glycine max
  Peptide Sequence Number=SeqID_132769
atggaattgggaagcataatgcacttccttcaagataagaccattttagtcactggtgccactggcttcctcgcaaaaatttttgtggaaaaaatattgagagttcaaccaaatgtgaagaaactttaccttcttttgagagccagagatactgaatctgctactcaacgtttacatactgagatcatagggaaggacttatttagattgctgaaggaaaaactgggtacaagattcaattcctttgtgtcagaaaagttggccgtagtgcctggggacatttctcaagaggacttgaatttggaggacccaattctaggggaagagattttcaatcaaacagatgttatagttaatttagctgcaacaactaactttgatgaaagatatgatattgcattgagtataaatacattaggagttctgcacgtgttgagcttcgccaaaaaatgtgtcaaactaaaagtgctaatccacgtatcaacagatgccaattttgcctcaaggttattgcaacaagtaattatattaggatcacgtgtttcatcttatgtatgtggagaaagagaaggactcatactagaggctccacatcactttggtgtgtcactaaatggagtgcccggaccagacattgatatggaaaagaaaaaggtggaggacaaattgaatcagcttagagaggaaggagccatagaacatgatattgaattggccatgaaggacttgggtactcaaagagcaaccatgtatggatggccaaacacgtacgtcttcacaaaggcaatgggagaaatgcttgtaggaactacaaagggaaacatgaacgttgtaattgtacgtcccacaatggttactagcacttacaaagaacctttccctggttggattgaaggtttaagaaccatagacagcatagttgttgcttatggtaaaggaaaactagtatgcttccttgcgaatcttgaggcagtttttgacgtgataccggctgacatggtggtgaatgcaatgctagtggccatggtggctcatgcaaatcaacctagtgatatcatatatcatgtgggttcctctgttgtaaatccagttatgtaccttaatcttcgagactatagtgtaagatatttcacagaaaaaccttggataaacagggatggaaagcccgtcaaggttggcaaatttaccatattgagaaacatggatagcttccgcaaatatatgtacattcgttacctgcttcccttaaagggactagagcttgtcaatgcagcttcatgccagtattttcagaaaatgtatcttgacttcaatcggaagatccgtactgtcttgcgattggttgaactttacaagccttacttgttcttcaatggggtatttgataatacgaatacagaaaagttattatcatcggcaagacaaggtggggtagagaccgaattgttttactttgacacaaaaatgattgattgggaggactatttcatcaatattcattttcctgggatcatcaagtatgccttcaagtga

SEQ ID NO: 15992 - DNA, 429 bp, Glycine max
  Peptide Sequence Number=SeqID_132770
gttcactacacttttgtgaaaggaaacctaaaacttcagatgccaccatcatattcattggtcatccagatcatagaagaagggatgaaaaacagaaatgcgaaagaggctactatacttttcccaagcaaagctcctacagataatacacctatgccagtatgccctcagctttacagcttgaagagagaatcggaaaaaggttattggcatgtacccctagcaccaggcactagctgtgagtctacgagatgttggctctgcattacccggccatgtggtcatgatgttgttgctactgtttctaatggtgttagtagcttggattcccaagtcgatgaaaacaatgccacttctgtcactgaggttgtgtggggggtttcagtcatggttccaaagcgggtagtggttatagtggccgatacttaa

SEQ ID NO: 15993 - DNA, 525 bp, Glycine max
  Peptide Sequence Number=SeqID_132771
atgacaggtccaaagattccattgttccaacctcatcactcgcctaaattaggccaaccgttgaagcccgcgtatactttctctctctcaattgcattcccccttcccatttctgagaagacgcaaaatgggaacaatggcgctgaattagcaccaccggcgtattgggtgtcaagtccaccgctgcctccgcctcctccgccacctcctccgccgttgtcactgtctcctccgccgccaccctcaaaatctatgacactcagtttcgttcccccgccgggagcgccgccgccctatcctaacaatatgcccaacgtgagaagacctcctcaccgccgccgccgccaccgcagaccgcctccgccgccgccaccaccaccaccgcacaagatgaatgccggtaaaaaggttggacttttgtttgtgggcattgcggcaatcatgcaagttggcgtggttgggttcttggtaatcaagagaagacaacttttgaagagcgatgacagatacgagagttgttcttga

SEQ ID NO: 15994 - DNA, 232 bp, Glycine max
  Peptide Sequence Number=SeqID_132772
atgacattgttatttagcaattttttgcccaaggacctaaatgccaatttccccctgaaaaagtatcagtggttttgtttcatcccgacagggggatcgcacccacaagacacccaggggaccggaaaaagtccaacagggcccgggggtttccagttcgggttaggggcctttatcattcatacagggtgcccgtcccccccccccccccgacaaggtcacgtcatcatag

SEQ ID NO: 15995 - DNA, 270 bp, Glycine max
  Peptide Sequence Number=SeqID_132773
atggagctacaacaacgtattataattatcattataactatagctatgctctccgctaaatacccacttatcatccaacaggatgttggtggttttcaagtcatggtggatgattgtgtgcttcgcacctgtgtggagataatgcagcctgcatgtgatgccgatgcaaatctgcaagcgttgcttccacaagagatgtgcgttattggtgtcttagagatgttggcagagggtgccacacgccatgaaatcatagtcaaggatcattaa

SEQ ID NO: 15996 - DNA, 324 bp, Glycine max
  misc_feature (279)..(279): n is a, c, g, or t
  Peptide Sequence Number=SeqID_132774
atgacccacatgaagaaaactggccaaatgatgtctgaggcagcaaaggaaattgttgagaagattgattcgttggaggagcaggcctcacagggttcgtttgtcgcccatggacgtcaggatgtactaactgctaccattgggcgactagaacaccctggtcgtgtgcgtgctgttggagttggtgtcacgatcaagcaatactttagaccggctccgaggacttcccgcacgtcttcctccatagctcccaaagacctggagcagctgacgcaacanatcagggaccagctggaggagtcaatcacagacaaagtgacttga

SEQ ID NO: 15997 - DNA, 139 bp, Glycine max
  Peptide Sequence Number=SeqID_132775
tcctttcgctaagcgcaagccttgcgctaagcgcatctctgttcatgtgctaagccgtgagtctcaagcgcttagcgcccaacccttgcatctaaggctgatttggtccactaagctggccaaggttgagctaagctaa

SEQ ID NO: 15998 - DNA, 528 bp, Glycine max
  Peptide Sequence Number=SeqID_132776
atggttttgcaaggtagaactatttctatcgatcaccatattgacagttcaacagttgatgtcagtgacataccacctttcacgaaagacatgtctttgattaatgatgaagaaccacaagataatatgataacaaaaggtgatgacaaaggtgatgacaaaaaactcaaaggtcaatcaaagaatgagttcaagatattcaagatagaatcaagaacatttcaagattcaagaagaaagttgaattcaagaatcaagaatcaagattcaagagatcaagattcaagaatcaagagaaggcctaatcaagataagtatgaacagatgataacaaaagatgatgacaaaggtgatgacaaaaagctcaaaggtcaatcaaagaatgagttcaagatattcaagatagaatcaagaacacttcaagattcaagaggaaagttgaattcaagaatcaagaatcaagattcaagaatcaagagaaggcctaatcaagataagtatgaaaaggttttctcaaaacttgagtag

SEQ ID NO: 15999 - DNA, 150 bp, Glycine max
  Peptide Sequence Number=SeqID_132777
atggcccaggcagttagtgtaggtgtcgagtctggccgtggaaaaggtttaggtatgttttgggatgatttggaagccatgaaaggcaattcaatagaaattttgaaattttgcagaactcgtgtccactatccatgtcgcgtccaatga

SEQ ID NO: 16000 - DNA, 324 bp, Glycine max
  Peptide Sequence Number=SeqID_132778
atggactacctcaccactaccttgggagacaccaataccatcttaaagcatgtgttcctacaaatactagagaataacctatttagcggtgcttcccatgaagatcctgcgcaacacctgaggaagttcatcaagtttatcaacacagtgagacagaaccgagtatcaattgaatatcccatgggcccaaaatctaccctaaggctcatgagaatcatagagctttcttctgcatccctggcccaatcttcttggagtctcctagccatggctctagtgatgggtcccttctttgggaggattgcatcatcccctcactcttga

SEQ ID NO: 16001 - DNA, 522 bp, Glycine max
  Peptide Sequence Number=SeqID_132779
atgggaaaattggatcatctaaaggaaaggctcagggccattgaaggaggtgaagattatgcctttgctaacctagaagagttgttcctagtacccaatatcatcacccttcccaagttcaaggtgccagactttgacaagtacaaggggactacttgccctaagaaccatctaaagatgtgttgtcgaaagatgggggcatacgcaaaagatgagaaactgctgaaacatttttcccaagaaagtcttattgggacaactgtcacctggtatactaacttaggaaccttcctgagtccattcttggaaggacctaatggtttccttcgtaggcagtgtcagtacaattctgatatggctccagataagatgcaactacagaacatgtgcaaaaagggggcacggatctttcaaagaatacgcccaaagatggagaatcttggcaacttaagtggcacctccaatgatggggaacgagatgatctcaataatagtagacacattaccagtgttttactatga

SEQ ID NO: 16002 - DNA, 309 bp, Glycine max
  Peptide Sequence Number=SeqID_132780
atgaaggccgacatgaaagccatgaaagagcaaatggccacaatgatggaggccatgatgagcctgaacccaatatatggtgggcaaagatttgggaagtacggacggccccataatgtgaaaattcaaaacaagcacgccttcccgccatatggctcgcctcccaaggaggatgtcaataactacactcccatactcattgaaagccaacaacctcaatctgatcatgcacatgtctctcaacccatgggggagacacatggaatgccccaccataatctagtcgacttcgagccttgcctcggataa

SEQ ID NO: 16003 - DNA, 420 bp, Glycine max
  Peptide Sequence Number=SeqID_132781
atggacacgcttaggctatttccttggttgatggtgcgtaccacattgcatctgagagttgaggagaaagaagactcttctccaaaagctacaaatgtcatccttactgaaaaggaccaagcatcaaagaaggttgaggtttctactgatgggaactcaatgcaaaataaggaaggacataagaagaaaaaagatattggcatctcctcaggcataatagacttaaagcctacaaacatctctctccaccttgttgattgttcagttatatatcctagtggggcaattgaggatgtgttggttaaggtggacaagttcatctttccgactgactttgttattttagatataatggttgatgaggatgtcccaatcatattagggcgacatttccttagtacttgtgatttaaatgttgag

SEQ ID NO: 16004 - DNA, 498 bp, Glycine max
  Peptide Sequence Number=SeqID_132782
atgattcccgttaagagaaaagggaaaggcataaagtctaatgcactctaccggtgttgcatggggtcttcatgggcagcaccaccaaatatgttgttctctaacatttgtaggtgtggaagaaatgacttccaagattattttgatgatgccaaagaatcaagagttaagcaagttccaaagaatctggagtcaaaaagcttcaagaatcaagtttcgagattcaagattcaagattcaagaacaatcaagtttcaagaatcaagattcaagaacaatcaagatcaagattcaagactcaagattcaagaatcaagagaagattcaatcaagataagtactaaatttgttttttcaaaaacattgagtagcacaagaatttttcacaaaatctttcaccaaagagttttactctcttgtaatcgattaccagaaggtagtaatcgattaccagtagttagcattgttttcaaaactgatttacaaagttgtaattga

SEQ ID NO: 16005 - DNA, 231 bp, Glycine max
  Peptide Sequence Number=SeqID_132783
atgaaaaagaaaaacctcctcaagatagaggtgtaccttggaaaaagtggtcctgaagttatcgctagaagtccatctgggctgcaaagctctctgtcatcagttgatgggtgtagcggtcaatgggcttggcttaaacactgcagttgggtcatgaagaacgttggccttggagacattaggctgaaaggttgcagacccgatgatctccctgaaattgtggaaggttga

SEQ ID NO: 16006 - DNA, 336 bp, Glycine max
  Peptide Sequence Number=SeqID_132784
atgattagaagttgtccacacaatggcattactgaacaaaggctagttcatggtggagtgtcctcacacaataagatgagtttggatgttgcttgtgggggaaatctcatgttaaatctctttgcttatgccattaaaatcattaaagacatgtgctctaacccctacaacaactcatgggatgaaatgattatgaagagaggcatcaaccagcttgaaccaaaccctaagagggaggatacccttattaaagaggaccaagcacctgagaaaattgaggttcctactgatgggaacccagtgccaaagaatgaaggagatattgacatctcttaa

SEQ ID NO: 16007 - DNA, 195 bp, Glycine max
  Peptide Sequence Number=SeqID_132785
atgaaaagagctctttgctatgcaaacgatggcaatcagcagggaaggtcaccatctgttattgtcattggtggtggcatggctgggattgctgctgctcgttcgctccatgatgcttcgttacagggaagtgtcctgggtgatgctagtcagtttagaattcagctggttttgtactcacatttgggtgaataa

SEQ ID NO: 16008 - DNA, 528 bp, Glycine max
  Peptide Sequence Number=SeqID_132786
atgacaccaaggaggttcgaaacgacgatgacaatgaggatcacaagaacaatctttaataggggagatagctcaaagtgtggtggtaaattcaacgcattagaacttattccgattaatgtggaaatgttgaagctttttcctgcaaagatggaagtaaaagctgattacatcgggttgctgttaattgcatcagctagttatgatccccgggtggaaggtgcagcagttgttgtctcgctaagcgaggatcacgtgcttagcgagtatcatccgctaagtgagacattagcccgcttagtgagtaaggtgaatctagaagagaatctgtcacgcaagcacatgctcaacgtgtcaccagctcgcctagagagtcatttgtttcttatggcgcttagcacacctggctcactaagccaaagttcacttacttgtactaagcgcgaaaatggcgctaagcgcgccttcgaggacagaaaaccctttttaaagcttgaagtgaaggaaaagagagagcttggcggatag

SEQ ID NO: 16009 - DNA, 1080 bp, Glycine max
  Peptide Sequence Number=SeqID_132787
atgatgagtgcaagtgcaagaaataggtctcctttcacgcaaactcagtggcaagagcttgagcatcaagctcttgtttttaagtacatggttacaggaacacccatcccaccagatctcatctactctattaaaagaagtctagacacttcaatttcttcaaggctcttcccacatcatccaattgggtggggatgttttgaaatgggatttggcagaaaagtagacccagagccagggaggtgcagaagaacagatggcaagaaatggagatgctcaaaggaggcatatccagactccaagtactgtgaaagacacatgcacagaggcagaaaccgttcaagaaagcctgtggaagtttcttcagcaataagcaccgccacaaacacctcccaaacaatcccatcttcttatacccgaaacctttccttgaccaaccccaacatgacaccaccctcttccttccctttctctcctttgccctcttctatgcctattgagtcccaacccttttcccaatcctaccaaaactcttctctcaatcccttcttctactcccaatcaacctcctctagacccccagatgctgattttccaccccaagatgccaccacccaccagctattcatggactctgggtcttattcgcatgatgaaaagaattataggcatgttcatggaataagagaagatgtggatgagagagctttcttcccagaagcatcaggatcagctaggagctacactgaatcataccagcaactatcaatgagctcctacaagtcctattcaaactccaactttcagaacatcaatgatgccaccaccaacccaagacagcaagagcagcaacaacaacaacactgctttgttttggggacagacttcaaatcaacaagaccaactaaagagaaagaagctgagacagctacgggtcagagaccccttcaccgtttctttggggagtggccaccaaagaacacaacagattcatggctagatcttgcttccaactccagaatccaaaccggtgatgatcctgcttcttcttccctactctcattatcacaccctttttaa

SEQ ID NO: 16010 - DNA, 1311 bp, Glycine max
  Peptide Sequence Number=SeqID_132788
atgggagcatcatggttgcatggagtttccaatgaaaatccactggcttcggtgattgggaggctaggtctacccctttaccgtactagtggggataattccatactctatgaccatgatttggaaagctatggactttttgatatggatgggaaacaggttcctcaagagttggtagcaaaagttggtgaaatatttgaggcaattttgcaggagacagataaaataaggcaagaatccagtgaagacatgtctgtacttcgtggtctttcaatcgttttcgataggaagccagaactgaggttggaggggattgcttataaggtacttcagtggtatttatgtagactggagggctggtttgctgcagacactgatgctatttcactgaaaggatgggaccaggtggatgtggtggggtgtataggaatcctgtcatctgaatataccatcatattgcatgattgtgaaaaggaggtactgctccctggtggtcatggtcttatggtccgtggctacttgcctgttgtaaatagcctagccaagggtcttgatattcgattggggcacagggtcacaaaagtagttaggcgatataatggagtaaaggtaactgtggaaaatgggaaaacgttttttgctgatgctgctgttattgctgtcccacttggggtgcttaaggcgaagaaaatattgtttgagccaaagcttccagactggaaggaagctgccattgctgatcttgggattggacttgagaataaaatcattttacactttgaaaatgtgttttggcctaatgtggagttcttgggagtagttgcagatacaccttatgaatgtagctacttccttaatctccacaaggccacaggtcgtgctgttctcgtttacatgccttctgggcagcttgccaaagacgttgaaaagatgcctgatgaagcagctgtcaacttcgctttcatgcagctcaagaagatttttccagatgcttcttcaccgattcagtatcttgtgtctcgttggggatcagatataaattcactaggttcatatagctatgatgcagttgggaaaccccatgaactatatgagaggctacgggtcccagtagataacttgttctttgcaggggaagcaacaagcatgagctatccaggatctgtccatggggcatactccactggaacgatggctgctgaagattgccggatgcgtgtgctcgagcgatatggagaggttgatttattccagccagtgatgggagaagagggttccatgtctatcccgcttcagatatcgcgtctttaa

SEQ ID NO: 16011 - DNA, 2823 bp, Glycine max
  Peptide Sequence Number=SeqID_132789
atgaatgagcagcaaaggatcactgatgttgcttcttcctctaactcttcatctatgtcatcttctaaacaatatgatgttttcctgagctttcgaggtgaagacactcgaaggagcttcacaagccatctatatgaatctttgaatgaagtgaaagtccaaacctatatagatgatcgacttgaaaagggagaagaaatctcacctacactcaccaaagccatcgaaaattctcgtgtatctattgtcattttctcagagaactatgcttcctcaaagtggtgcttgggtgaactcatcaagattatggaaagcaagaaagaaaaaggacagattgtgattccagttttctacaacatagacccatcccatgtgaggaagcagacagggagctatgagcaagcctttgaaaaacatgagggagaacccagatgcaacaaatggaaaactgctctcactgaagcagccggtttagctgggtttgactctcgaaattacaggactgatcctgaattacttaaggacattgttggagctgttttgcgaaaattgcctcctagataccaaaaccaacgtaaaggactgattggaattgaggaccattgtaaacagattgagtcgttactaaaaattggttcaagtgaagttaaaacccttggaatatggggtatgggtggtataggtaaaaccacccttgctactactttatatgacaaactgtctcataagtttgaagatgcttgcttcctcgcaaacttgagtgaacaatcagacaagcccaaaaatcgtagttttggtaattttgatatggctaacttagagcaattagataaaaatcatagtaggcttcaagataaaaaagttctcattatcctagatgatgtcactacctcagagcaattagataaaataattccagattttgattgtgatttcttgggaccaggaagtagagtcattgttacaacaagagataaacaaatacttagccgagttgatgaaatatatccggttggggaatggagctttgataagtctcttcagcttttctgtttgactgcttttggagaaaaacaacctaatgatggctatgcggatctatcaagaatggtggtttcctattgcaaaggtattcctttggctttaaaagtcttgggtgcaagtcttcgatcaagaagtaaagaaatctgggaatgtgaattgagaaaacttcagaagattccaaataaggaaattcataaagtattaaaactaagttatgatggcttagatcgttcggagcaggacatatttctagacattgcatgtttcttcaaaggacgagatagatgttgggtaacaagagtactggaagcttttgagttctttccagcacctgggataaacatccttttagataaagctctcataacaatttcagatagcaatctgatattaatgcatgacttgatacaagaaatgggtcgagaaattgttcatcaagaatctaaagaccctggaagacgaacccgattatggagacatgaggaagtgcacgatgtattgaaatataacaagggaactgatgttgttgaaggcataagtttagatttgtctagattaaatgaggatctaaatttgagctccaattcccttgcaaagatgactaacttgagatttcttcgaattgatggagaaagctggctgagtgacagaatttttaacgggtaccttcctaatggtcttgaatcattgtacctttctaatgatgttgagccattgtactttcctggtcttgagtcactagtactgtactttcctaatggtcatgtgtcatcgtaccttcctaatggtcttgagtcattttactttcttgatggtcctgtgtcattgtaccttcctaatggtcttgagtcattgtactttcctagtggtcttgagtcattgtctaatcaactaaggtaccttcactgggatctatgttatcttgagtctttgccacctaacttttgtgctgaacagctagtagtgcttcacatgaaatttagcaagcttaaaaagctttgggatggggttcagaatcttgtaaatttgaaggaaattgacctttcgtattccgaagacctcattgagatcccaaacttatctgaagcagaaaatcttgaaagcatttcactttcaggttgcaaaagcttgcataaactccatgttcattcaaaatctctccgtgcaatggaacttgatggttgttcatctctcaaggaattctcagtaacatcagagaaaatgacaaaattgaacttatcttacaccaatataagtgaattgtcatcatcaattggtcacttggtgtctttagaaaagttatacttaaggggaactaatgttgagagcttgcctgcaaatatcaaaaacctttcaatgctgacaagccttcggctagatggttgcaggaaactcatgtctctaccggagcttccaccatccttgagattgcttgatataaatggttatgatcaacttgaaaagggagatgaaatctcaccagcactcaccaaagccatcgaagattctcatgtatatattctaattttctcagagaacgatgcttcctcaaaatggtgcttgggtgaactcatcaagattatggaatgcaagaatgaaaaaggacaaatggtaataccagttttctacaacgtagattcatcccatgtgaggaagcagacagggagctgtgagcaagcctttgaaaaacatgagggagaacctaggtgcaagaaatggaaagctgttctcactgaagcattcaatttagctgggtggaactctcgaacttataggtaa

SEQ ID NO: 16012 - DNA, 483 bp, Glycine max
  Peptide Sequence Number=SeqID_132790
atgtttctccacattgtgttcctccttttccttctctcatccacttcccatgccactgtccaagacttctgtgtggcagacctcaaaggtctcaatggccttgaactatctgcagcaaggttggaccttggtcctagtggtgttatcccactccacactcatccaggtgccaatgaactactcattgtgcttcaaggtcacatccttgctggattcatatcttcaggtaacatagtttatcagaaggtgctgaaaaagggagagctcatggttttcccacaagggctgttgcacttccaaattgctgttggtaagagaaaggcccttgcttttcctgttttcagcagtgcaaaccctggcctccaaatccttgactttgcactgtttgccagcaacttctccactcctttggtgacacagaccactttccttgatcctgacctagtgaagaagcttaagggtgttcttgggggtagtggctag

SEQ ID NO: 16013 - DNA, 678 bp, Glycine max
  Peptide Sequence Number=SeqID_132791
atgtctattcgaacaaatcgctttaaagcagtggatagagtgttgaaggatctggagagagtagaaaaagaagggaaattgaatgatttgaagtctgagttgaacaagataaaggaggtgtttttgaagaaaatatggaattcaactctaaagttgctgccagctgctgcctcatctggacaatcatctcatcatgctcaagctgctgcctcatctcatcatcatgtcacaccactcccttcttccactccacaacttcatcaggaggaggacttgcaaagtattaaggactgttataacaaccttgatgatgaattcaaacgtatcttctcatctctcttgcagtttcctgaaaatgctgttttcaagagaagggaaatcgctctctggttctctcagtatggtgatcatcgttggaattcagtttgggttgattctattttgaaaagtaaagtaattgtaccccatggtaattgcaattctcccattaagagtaaaattaaaattaatcaaaaaataaggaacaactttcaaagtccattgccaactgctcaggcggatcatgcatctcgccattttcagtggcggcaccaatgttcaccctccaactcagcatcgttctcgctatgtgcaatggcggaacacctatgtcaccagtttttcgggcggcatccataa

SEQ ID NO: 16014 - DNA, 390 bp, Glycine max
  Peptide Sequence Number=SeqID_132792
atgtctctaccaaggcttccaccatccctagaagagcttggtttagatgattcaataactattcctcatcttccaacatctgacttgtgcggtttcgtttactgcatcattctttctgtgggatcagccttaattggtaatgtttggtgttctacctatgaagatggcatagaggtcagctgggacagaagcaatataatatttatatttggatggaatggtgatgaagagaggataaaagaatgtggggtcttcccagtatatgccacaacatcaggattgaagctggtcagcaatagtggcaaagaaatttttgaatgtgaatccattgagtgggaacaacttctacatacatcaaagaggaggaagatttcatgccagcagaaatga

SEQ ID NO: 16015 - DNA, 480 bp, Glycine max
  Peptide Sequence Number=SeqID_132793
atgaagttggagaggttttcctttaaaaaaaaggtgtctactatcgatataattaattgggatccaaacttggagaggttgtttgtttatttcgtaagattcagttcctttgattctgtaatggtcaaaatgggagcatcatcttataatggcaaatttcccccgaaggggtccttttacaaagtaattctcaaaatgggattctttctaaacaatttttgggatgggtctgtttttgacgtgaacttccaaagaaaacgccagcagcaatggcgatttgagcatgcagcaacacgtggagggaaaatcgccaatatcagcggcgatttcgtgtcacctggactcgccagtttgactggcgagttgcaccctgtctcgccagacacagtggcgacatgcctccaggctagcgcttctgccggtctcgccagtttgactggcgagaaacttgaaaaaaaatttgttcattttctcctataa

SEQ ID NO: 16016 - DNA, 232 bp, Glycine max
  Peptide Sequence Number=SeqID_132794
atgatgttgcatgctgtaatgtgcataaagaaggaaggagatttggcacgaaattctgttagaagaaagggacacgtggctcacgatccgcaaagtgagggaggcaggcatagcacaaggttgagaagggagaatccaagggtgaagcaatcagaggaaaaactcgaagaatctcaggaaattgctagagatgtcactatcactaccggaacatacatgagcccgcttagag

SEQ ID NO: 16017 - DNA, 252 bp, Glycine max
  Peptide Sequence Number=SeqID_132795
atgggatgttacaccttcacccttggattctcccttctcaaccttgtgctatgcctgcctccctcactttgcggatcaatttcgtgccaaatctccttccttctttatgcacattacagcatgcaacatcattttgaagagaggttggagaaggaaggatacatgtcaattccttttgatgagaacgaagaaagtgatactgctctatctcagctgcaatcttctcatccacagtctgtggtgtcattctga

SEQ ID NO: 16018 - DNA, 852 bp, Glycine max
  Peptide Sequence Number=SeqID_132796
atgaaggatttgtgggtgcttcaactgggtcgtttcatgcaagattcaccaaaacatcatattgaagtggacagtgaagaattcctcaaggagttgagtggtcacgaggatttgctctgtcttagccttcgagggatatcaagaatattcgagcttccaccttccatcgtaaaaattgagagcctaggaattctagatctcaaggcctgtcacaatctagaaacgctacctagtgatatttcatcattgcaaagtctctggtatttgaatttgtctgagtgctacttgttggacagaatgccaaaggggattcagaacctgactaggcttaaggtactgaagggatttgtattaggtagttctagcaagactccctgcagaatatctgatattgctgcaaatttgaaaagactagtgcgactcagcatacgtataggaagtggggctgtgatccaagaaggcgagtttgaaagcttgaaaaagttgtcagaacttgagcatctaaaaatatcatggggtgtatttgacacaaggtacattgatattcagataagtgtgccttcaagtttgaaaaagttgcatcttgaaggctttcctggccaaaatattccagaatggttgaagcctagcaaactatcttgttcattgagagagctacatataacaggaggaaaactcaaaagtttggatcatggtgaaaataatgattggggtgtggagatggtgtatctcaagtacctaaaggatttggatgttgacttggaacatttgagaaagttgtttccttctctaaggtacgtagaaataaaacaaatcttaaaccagccataccttgaatggagcattaattga

SEQ ID NO: 16019 - DNA, 1293 bp, Glycine max
  Peptide Sequence Number=SeqID_132797
atgcttctcccacccttcctcactctcactttcctcctccttttcttcaatgcttccgtcgctgcgatttactcaacgacaacatgttccaacatagtgtcgctgagatatcgcagcgacagaatttccgtaacggactttggaggtgtcggcgacggccgcacgctgaacacgaaagcgttcagggcggccgtataccgcattcagcaccttagaaggcgcggtggcacggtgctttacgtgcctcccggggtgtacttaacggagagcttcaacctcactagccatatgaccctttatcttgctgctggtgccgttatcaaagccacgcaggagttggggaattggcctttaattgcacccttaccatcttatggaagaggaagggagctccctggaggaaggtatatgagttttatccatggagatggacttagtgatgtggtaatcacaggtgagaatgggacaattgatgggcaaggagacgtgtggtggaacatcaatgttgtggttcgatatgtcacaattttggcccctcgtgactctcctaatactgatggaattgatccagagaactgtatctcatcttttattggagccaaactgttcaagggaagtattgagattactatcgccgactccactagtgctatcatgctatattcaagttcaaatgtctgcatagaagactcatacatatctaccggagatgatcttgtggcagtgaagagtgggtgggatgagtatggtattgcctatggtcgccctagctacggtatcaccatccgacgcttaacagggtcatctccattcgctggcattgcaattggcagtgaaacctctggaggggtggagaatgtgctagctgaacacatcaacctcttcaacatgggagttggtatccacatcaagaccaacagtggcaggggagggctcatcaagaacatcacagtggctcatgtgtatgtggagaatgcaaggcagggaataaaaatagcaggtgacgtaggggggcatccagatgaaaaatttaaccctaatgctctcccagttgtgaagggtatcacaattaagaatgtttggggagtgagggttaaccaggcaggtttgatacatggattgagaaattcccctttcactgatgtttgtctgtcaaatatcaactttcatggcatgagaggaccaagatctccctcctggaagtgttctgatgtgtttggatttgctcatcaggttagcccttggccatgttctcagctgagcagccaagagcctggatcatgtgccatttag

SEQ ID NO: 16020 - DNA, 2169 bp, Glycine max
  Peptide Sequence Number=SeqID_132798
atggaagatgataaggaagatcctatgagtacaattgtacctcaaggtactcaagaagatgaaatagaagaatatgaagatcatcatttgtccttcaatgctttgaaaggtggtaggggagttggcactatcaggtttatagcttttattgaaaatttaccagtgactgtgttgattgatggtggcagttctgataatgttttgcagccaagggtggccaagtttttgaaattacctgtggaaccagctactcaaattagagtaatggttggtaaagtatttttgcttcctatttttggtgctgatctcattttacgagctagttggttgaagactattaactctcacaatgctgattatgatgctctgcaattgaagtttttgtggaagggtaaatttactaccttacaaggagattgtcaattggtacctaagcaagctcaattacattgtataagaagaatagtggccactaattccattgctgaagtttatagtctgcaattgatggaaccagatgttgttcctaagtctatgcttgatttaccagttacaatggagcctgaattagccttactattgcacacttacagtgtggttaagccttacagataccctcatagtcaaaaggaagaaattgagagattggtgtcaggaatgttagatgaagatatcatacaacctagcaagactcctttttcttctcccattatattggtaaaaaagaaagatggttcatggagggtgtgtactgattatagggctcttaatgcaattactatcaaggacaacttccctattcctactgtggatgagttgattgatgagctttttggagcttccttcttttctaaattggatctaaggtctggttatcaccaaattttgttaaatccggatgacaaacataagacagcatttaggactcatcatggccactatgagtggttggttatgccatttggcttaaccaatgctcctactacttttcagagccttatgaatgacatttttgttggaatattaagaaaatttgtactggttttctttgatgatatgctggtgtatagtgctaattggaaacatcatttataccatttagaagtggttttaagtatcttgaaacaacatcaattgtgtgcacggttttctaaatattgttttggagttcaacatattgattacttaggacatacactatttggttcaggagtagctatgaagggaactaaattggaagctattcaaaagtggcttgagcctagtaatctcaaacagttgagagcatttttaggactcaccgatttttataggaggcttgttaagtcttatggcattgcagcccctttaactgatttgttgaaaaaggattcttttaaaaggagtgtggctgcatcagaagcatttcaacaactcaaaattgccatgacatctgctcctggattgactattcctaattttaacgaaatttttgtattggagactgatgcctcaggaagtggaattggtgttgtccttagccaaaataagcatccaattgcttatttctctaagaaattgtccttaaggatgcagaagcaatcagaaaagcctcaaagaattgttagacagaagttgcacactcctgaacaacagcaatggcttcctaagttcttagggtttgactttacaattcagtataaaccagggaaagaaaatatacatactgatgctttatctaggagtttcatggtggctgtatctactcctatacattcatggattaataaagtgatggatttgactcaaactgattctcaattatccaaaatttatcaaagctgtttgcaaggtcagaatccatcttctgaatatagtattcagaatggcctattgttctttaaaggcaaaattgtgttacctcatgatgttgggttgcttaatcaaatcatggaggaatttcacagttctaagattggtggacattctgaagttaatagaacaacaactagaattggtgctcaattttattggaatggtatgagaagtgatattagtaaatttgtgagggaatgtgtcatatgtcaacaagctaaagttgatcatgtttttccagctgggttgttacagactctcctcattcctcaacattgctatttggtacgaattatatttgccccaactgaatga

SEQ ID NO: 16021 - DNA, 993 bp, Glycine max
  Peptide Sequence Number=SeqID_132799
atgtcgtggtctctcgaaatcgggagagaaaactctgctgtgcgtgatgatgggaagagttttgaagtgggatctcagaaaggcgactatgagactgccactcaccatggcaatctggcaagccttggtgttacattgtgtatttctaccacgagactctacagcaaggccaagtttctcaaagctggtgataccttggcaaggaacccccttgagaaagcccaccctgatggtcaacctttcaatccctcaactcctgtaaaatgttgtgaggaaggggggaagagaattgattccttagagcaaacaccaagcagctgtatctccaatgtgctaagtactcaatgtgacactcttgattctacggaaggaattaggacagggagtcttcacagtttggataagaatgacaagactacagcttctgtttcaccttggccatcaaccacacacacgaggaggaacaagtctgtatgttttgcatgtgacagtgatttatcgtcctgtgactcatctgattatggtgggcgacatatgaaaaaaacagattcagcaaataatgagagtacatataaaccatcgcctaatcctaccccgatgaagctatctgacgagatgcaaactcctggaactgcttacccttcagcaaaagacttgccaaatgctgtcattctggaggagagaaacaagagaatgcagaccagttataatcaggtccgcaaaacacctgctgataggcctatcattgggatggttgcagctcactggattgaggatgaggattctcaagctcctcctccaaagtggtgggatggtaacggcataccaaattctaccaataagtataaaaaagatcagaaagtaaattggcatgcaacatcatttgaagagaggttggagaaggcattatctgaggagactgtcatctctcaaagggtaatggtaatggggacaaatgataactatcattggtcacggaatactcattcataa

SEQ ID NO: 16022 - DNA, 309 bp, Glycine max
  Peptide Sequence Number=SeqID_132800
atgactagcttgtttcttctccctgttattcctttctctcaccttatccctttctctcagaatgcttctcaacctcctggaagttctccgaacaatggctccccgatggtgcaaccgattaatgcttctttgcctgttaaggagatctcacttggatttcctcacttcgatggaacgacgccggtgatggagtggatcttcaagctggagaaatttttcacttatcataatactccttatgcgtctagagtggatattgcgacgatgcattttgataaggatgtagtggcatggttccagatgtcgtag

SEQ ID NO: 16023 - DNA, 468 bp, Glycine max
  Peptide Sequence Number=SeqID_132801
gataggtgatggttctggggttttggtcttggaggaatttgagcatgcaaaaaaccgaggatccaaaatctatgcagaggttcgtggctatgggatgtcaggtgatgcatatcatttaactcaacctcctagtgaggggagaggagccattttggccatgactcgtgctttaagacagggacaacttacctgggcttatccaatctcaaagactaaatcgaagcttcatgagaagcacgtaagggctccattggactacgatgacacaaattatttccgggatgatgtctttttttacgtgggaggaatgcatgacgccatcaggaatggcaagtcctccacggatggtccacgtggcagcggactcgccaggactagtggcgatttcaagccaactggtctcgccagtcaaactggtgagttggtccctgcatgtctcgccagacgcagtgacgataaagccatggg

SEQ ID NO: 16024 - DNA, 499 bp, Glycine max
  Peptide Sequence Number=SeqID_132802
ggtatatgaagagaatgatggtgtaatatttgaatgcagtaaaaaagcgattcagattaaacgtagaattagtttcaatgctttgaaaaaaaaattggagataagatttttagtttctggaaaatatgttgctttgcaaatttgtgatgacgaagatgttgaaaccatactcgaaagttttcaacaacaagatcaaatgtcagatatggaattatacatagaaaaggatgtggctggtggttctatgtttcattctgcaaattctcttacatcatgtggaaataatttatctaataatgaggcgcaaccgccaagaaatgtgagcaatttacatggtgatgaagatgatgatgatgattatcttgtgtctaactcatacgttgaagagtctttagacgaagatgatagtgttgacggtatctctgatacagacgatgaagtcaccgacatgattcaaccagtaagaattgttcacccagcagaaggtataatttattaa

SEQ ID NO: 16025 - DNA, 234 bp, Glycine max
  Peptide Sequence Number=SeqID_132803
atggcagcaagaaggcgcgggtcgcgaggaagaagaaggagcaaaagaagaaaagagacaaagcagaatgaatggtgtaagtttggacgcaaaaaattttcttccggggaagatattacagctgcggaagaaaaaaacttcttccgtggagtctcgtggaagacgtcttccgtggaatctcacagaagacgtcttccgcaagactccacggaagaagcagtcttccgcagttga

SEQ ID NO: 16026 - DNA, 697 bp, Glycine max
  Peptide Sequence Number=SeqID_132804
atggcgaggattcctgacaagattaggtctattgatggatcaaaagaaacacttaagcttgatgttaggatcaccgatctttggttcgttgggactcctaacaagtctgagcaagcggaaatggtttttgttgattttgagggtgatcaaattcatgctatttgtaaatcggaccacctcaagtcttggaaagctgatttgaaagagaattgcacttatgttatgcataatttcaaagttgttaagaatgatggtcaatttagagtgtgcgaacatgagtacaagttattttttattggagtgacggttgttagagaagctgatttgcatgaactgccttttaaggaatttagatttgttgaatttgcaaatgttgttgctggcaattttgtgtctggccttggtgaaattttgtcttgcacactttgggagaattactgtgctcagttcctatcctatttgaatgaacgtggggatgatgggccaatggttattatattgacgcatgccagaataaaagatgcacagggaagttatccagcttcagtgagcaattccttcaaggcgtcaaaactattgattaatgatcctatattagaaattcaagaatttaaagagaggcttttagatttaggtgttgaggtgagtcgagttttgctacctggcgatcaagcaagctcacaagtttcagggggaa

SEQ ID NO: 16027 - DNA, 213 bp, Glycine max
  Peptide Sequence Number=SeqID_132805
atgatggtagacaccttgccggtgttttactatgagaaattagagggctacatgccctccagcttcacagacttggtattcgccaaggaaagaattgaagtaggtttgaagagagggaagtttgattacgtctcctccacaatacgcgcaacatcacctgagcttctcaactcgcgccgaggactctcccaattcagcacccgtacaagctag

SEQ ID NO: 16028 - DNA, 1223 bp, Glycine max
  Peptide Sequence Number=SeqID_132806
gactacacaacctcatcttcagagggctacacgccctcgccttcagagggctacacgccctcgccatcagagaactacaagtcctcgccttcagaggactacacgtcctccccttcagaggactacacgtcctcccctttagagggctacacgtcctcgccttcagagggctgcacgccctcgccttcagaggactacacgtcctccccttcagagggctacacgccctcaccttcagaggactacacatcttcgccttcagagggctacacgcccttaccttcagaggactacacgtcctcgccttcagaggactacacgtcctcgccttaagagggctgcacgccctcaccttcagaggactacacatcctcgtcttaagagggctgcacgccctcgccttcagaggactacacatcctcgccttcagagggctacaccccctcgcctttagaggactacacgtcctcaacttcataaggctacacgccttcacctttagaggactacacgtcctcaccttcataatgctacacgccctcacctttagaggactacatgtcctcaccttcaaagggctgcacgccctcgcctttagaggactacacttcctcaccgtcatagggctacacgccctcacctttagaggactacacgtcctcgccttaagagggctatacgccctcgccttccgaggactacacgtccccaccttcagaggactacaggtcttcgcctttagaggattacacctcctcaccttcagaggactacacgtcctccccttcagaggactacacgtcctcgccttcaaagggttgcacgccctcgccttcatagggctggacgccctcgccttcataggactccatatctgcgccttcaaagaattcaagccactatgcattctggggcaagatttcacccgtgccgctaccaagagacgagtgcggatcatggatcacgcccgtaagacacccagtggacccggagaagtccaacagggtcctggggtttccagctctgattacgggcctttgtcagttctatggagtgcccgtcgcctccagcaagggcgagacaccacagcagcaaggggatggccaacagcgggcaacaaacgcaccaccgccacctcccaagcccctcagctcatctacaaaggcttgagcgttgcctatgacccgtggccgaccagcaggcgaccaagtccaaagccaaag

SEQ ID NO: 16029 - DNA, 531 bp, Glycine max
  Peptide Sequence Number=SeqID_132807
atgtcagtcttcgcatgctatcaggcttttcgtcttacagatagcaaagagaaagtttatacggataaccactcgggtatttccgcccgtcagcgtgactcaaatgtcagtatgacagatcttgtgagcgcggaagatgacgtaaatctccgcgtgtcaacgggcttgtcggccgcgattgacgaagggcgcagaagacaacacagcaaaaagaatgtttatacggataaccactcgggtatttccgcccgtcagcgtgactcaaatgtcagtatgacagatcttgtgagcgcggaagatgacgtaaatctccgcgggtcaacaggcttgtcggccgcgattgacgaagggcgcagaagacgacacagcaaaaagaatgtttatacggataaccactcgggtatttccgcccgtcagcgtgactcaaatgtcagtatgacagatcttgtgagcgcggaagatgacgtaaatctccgcgtgtcaacgggcttgtcggccgcgattgacgaagggcgcaggagacgacgttag

SEQ ID NO: 16030 - DNA, 642 bp, Glycine max
  Peptide Sequence Number=SeqID_132808
atggggtttgcaaatagcaattcgaaaaggaatcccacaaactacgtacatgcaggcgcacttttcaaagaattggaaacctactgtaagtcacgcttgagaccagacccctgctttgcattgaagggaagctcattacaagatatgaagcttttgtttgttgaaatgggtgttggctatgaccttcatggtcaggacatgacaactgccgcaatgagaccatgcagagatgcaatttctgccaattcaattccagctttccgtaaaggtaacatccctcgtgttacatctgatcacatgaaattgcatgtcaaactgggggtgcctcatcctctgcaacaaaatttggacaaggataaaattaggtatgtgtttccatatcaggacataacagctgccgcaatgagactgtcgcaatgtgccctttgcgggcgagcgagggcgaggctcacgggtgcgctttccaaaggaggaaagatgcgcggagtcgccaccaacgtttatttgtggaaaaaccaaaggaaaccggtcaaaatgaaaattctaagttcgggagttgtatttacgcttgaggaaggtcgacaaaagcggggcttttgctcctacgtaccctcctttggagaggaaatcagacttacgtag

SEQ ID NO: 16031 - DNA, 330 bp, Glycine max
  Peptide Sequence Number=SeqID_132809
atgtggaccaccacaggggaggagcttgccacccagctcgcccaggcgagcaaggttgcttcctccagaagcaacagccttctggaggaaggatttggaaggcccaactttcgaagaagttacggaaactcacggattacgcaaaaacacctcttttcgattttcgccacattacggaatttcacggatcgcaaacaatcggaaacaaaacaaagatcacattcccagtcaagaggatccgcccttgacgatgaaaaactctggagaatggaggattgcactcagcaatcattacacatggctccaaactcgtgggtggaggacgcatga

SEQ ID NO: 16032 - DNA, 456 bp, Glycine max
  Peptide Sequence Number=SeqID_132810
ttatttggggttcccgtcacacctagtaaggtgattcgaccgccgatcacccgggccatcattgagaagtattgcacgcataggcaggcgcagggtgatgcaccgcaggccgcagacgcaccgccaccacctcatcaggctgatccagctgggtcatttggcatggagcggtatttacagtacttggttcgccagcaggcggccaaccacagggggcaggtgcggacccataagtgtctctaccagctcagcatcagtttgcagagccagggtttcgctccttttgtgtgccctactccagatcagttcagggtagaggttgcatggcccggagattggcctgaggcccaagtaggagagccaccctcagaggctcccggcgatgcaaatgaggcccgcatggatgaggagatgacagatttactcgatttcttgggagggagcggagccacatga

SEQ ID NO: 16033 - DNA, 318 bp, Glycine max
  Peptide Sequence Number=SeqID_132811
atggagaggtgcttcatgacgagccagaagaaccagcttagcaccacagacgatatgtccctgcctgtgaggaggaagtttagctcaatctatcacagcacgacggagctcagtggtgcgagggagtggatcaagatgatgctagatttgaaggagtgtggtgatgagcttgtcggaagggggggagggcgcggaggtcggaccaggaaagcaactggaggaggacgtggcattggggacggtgagaatggagaaggaggagcggtgcgagagatccacgacaaggggtgtggcgaaggcaaggaaggagatgaatag

SEQ ID NO: 16034 - DNA, 624 bp, Glycine max
  Peptide Sequence Number=SeqID_132812
atggagcataagtttcatccatctaaggttgcggcaagggctatcactttgtccattaggcaacaatttggtcagccttggcctagatggggagcgattccaaaagatcatcaggaactttttttcctgcgttttaagctatctcaagctaggtctgatgctgcatcaagtgctggtgaatcccaactcactcccttagaccctgatgaagaacaaagacttaggagttggtgttgggttgcaactacaagaccaaagcgtaaggaacgcctttatgatactggagaccttgttcatacttacaaatgtggaaatggcagcctcatgcagcatacgcaaggatcttctagtagcgttgaagatgctgcagagattaactgcccgagggagaagctacgtcaatcaaaaagaggagatacacattttttagttagtagtccttcagttcctaccttcagaggcacgaaacattattcatcaacaacaataacctcagtaacagtaccaagaccagcaacaacaacaccaggaccagtagcaacaccaccagcaccagcaagaacaacaacaggaccaggttgggagtgcgggggcaaagcccctgcggaatgcggattaacataa

SEQ ID NO: 16035 - DNA, 390 bp, Glycine max
  Peptide Sequence Number=SeqID_132813
atgagggtgaacacagagtttgagcgcgttcttaagtatttcaatgaagatggggatggtaagatttccccatctgagcttaggaaccggctaggcatgatgggtggtgagttattgttcaaagacgctgaaaagttgattgaggaattggattctgacggtgatgggcttttgagtttggaaaattttgtgaagataatggaggatgctggggaagagaagttgaaggatttggcagaggcttttgagatgtaccgtaacactgaaatgtatgggtttataacaaccaaaagcttgcaaaggatgctgcgtaggttaggagaatcaaaatccatggagcaatgcacaactatgattgaccactttgatttgaatggagatggcctgctt

SEQ ID NO: 16036 - DNA, 234 bp, Glycine max
  Peptide Sequence Number=SeqID_132814
atgaatggtgaaaaaggaacagtgaagaagcaaagaagtgaagagggtgaagacagtgtgaaacaggccctgagtggggcagtccccacggggatccccaagttgcggggagaattgccatgcatacgtccgtcattgccgtcatcgggtgaaagtggtggtggttggcacgacaccctagaggaggagtcggagagggagagtgagaatcagagagtgcgagagagacattaa

SEQ ID NO: 16037 - DNA, 426 bp, Glycine max
  Peptide Sequence Number=SeqID_132815
atgagggtgaacacagagtttgagcgtgttcttaagtattttgatgaggatggggatggtaagatttccccatctgagctcaggaaccggctaggcatgatgggtggtgtgttattgttcaaagacgctgaaaagttgattgaggaattggattctgacggtgatgggtttttgagtttggaagattttgtgaagataatggaggcagcaggggaagaagagaagttgaaggatttggcagaggcttttgagatgtaccatgactctgaaatgtttgggtttataacacccaaaagcttgcaaaagatgctaggtaggttaggagaatcaaaatccatggagcaatgcacagctatgattggccactttgatttgaatggagatggcctgcttagctttgatgaatttagagtcatgatgcagtga

SEQ ID NO: 16038 - DNA, 318 bp, Glycine max
  Peptide Sequence Number=SeqID_132816
atgcagactgtggaggcactcaaagtgtttgttgacggtgcggatgatgtcattgttgaaggggagggggtcagtggaggttttgcattttggtgctttggtttgatgcatgcatgttataattccaggaagctaagaagaattctcggattgatggcacaaatgatgtgtacaaaattgcataagcaattagacttgctggaggaaagattacttgagaagctggaccagtatctggtacaaagacagatcacatcatgtgtggatcctgatggttggaaaactgtttttgtagataatgttgactttcgtaggtag

SEQ ID NO: 16039 - DNA, 393 bp, Glycine max
  Peptide Sequence Number=SeqID_132817
atggagaagaggaaggattttacaccaaatactgcaagatatgatgtaatatggattcaatggtgtattggtcatcttacagatgaagattttgtttcatttttcaagagagcaaaggaaaggttccacacaattaagtatttacttgaggcttcagctttgtctactaataattctttagaatgcaaagatatggagtgcatgcttgataaaattttcagggggttggcttacatccacattggtaccaaagtttgccatagagatttgaagcctcaaaatatactgggtgtatctgtcgagagagccttttttatgtggccattattccctggcgaaaatgcaatagaccagcttgaacatattataaaggtgcttggcacacccacctaa

SEQ ID NO: 16040 - DNA, 243 bp, Glycine max
  Peptide Sequence Number=SeqID_132818
atgaagaagaaagaaagcaaacggatgaagcaaaatgaagaagaaacaaaggcaacgaagaagaaagaaagcaaaacgcaacaaaaaagaaagaaaggaaacacagttggtgcagaatggacgggcaatgcaacaacacatgacacctgtaagcaatttaagaaaaagaagacacatgcaataatacgtggagcaaccaacaaacttggaagtgtgatgcagaaatgtccaaaaaaccaataa

SEQ ID NO: 16041 - DNA, 281 bp, Glycine max
  Peptide Sequence Number=SeqID_132819
tcttggtgtttttcaatggaattgttccagctatggggaggccactgaaaaaggagcacataacaacaacctacgaaaacagtgtcaaagaaatgggcacagtggaagacaacaatattctcctgtggcgccgcagcatcatagaaaataatgcagcaaatgatggtggtgttgataaatggatcgacgatttccgaccaacagatccaggtcacagtcccggtgctggccactcctcccctaccccaaaggacgctactaacggtgccccaaggccatag

SEQ ID NO: 16042 - DNA, 777 bp, Glycine max
  Peptide Sequence Number=SeqID_132820
atgtcattgacttcagagggctacatgccctcgccttcaggggactacacgtcctcaccttcagaggactacacgtccttgcctttagagggctgcactccttcaccttcagagaactacacgtcctcgccattagaggactacacgtccttgccttcagagggctgcacaccttccccttcagagaactacatgccctcgccttcaaaggactacacgtcctcgccttcaatggactacacgtccttgccatcggtggactacacgtcctcaccttcagagggttgcatgccctcgccttcaaaggtctacacgttctcaccctcagagtactacacgtcctctccttcagagggctacacgccctcatctttagaggactacatgtcctcactatcaaagactacacgtcctcgtcttcaaagggctacacgcccttgccttcagaggactacacgtcctcaccttcagaggattacacatcctagccttaagagggctacaggccctcaccttcagaggacttcatgtcctcgccatcagagggctccatgccctcgccttcaaaggactacacatcctcgccatcagaggactacacgtcctcacctacatgttggatcaagtggccatgtaataattaagaagggggggttgaagaagaagacagcggaaaataaagagtgtagggaagaagaagacaaacacaagagttttatactggttcggcaacaacctgtgcctacatccagtccccaagcgacctgccttccttga

SEQ ID NO: 16043 - DNA, 894 bp, Glycine max
  Peptide Sequence Number=SeqID_132821
atggatattgatttgactctacaactaagagatcagattttggtgcaggtgaaaggctatgctttttttgtcaacatcaccgacgagaggctttttaatgtctatggttgctgcaaggttatatggcatttggaaattaactgtaaaacatctctgatacctttaaaggaaggggaaggtggggaaaaaaaatcagaaatcattgggcagcaaggggataacaatgttgttgtactagagccttctcctcataaggaacaactagttgcagcaactcctgttgagtccatttttgaccatagggctcaaaatgtccaacctgaacacccaccagaaagttcccctgttttccataatcaaatggatgttgttgttccagaaggagtatccaaggatctttgtattgtttccaaattttgggcaaatgaggaaggctcaaatgaagaaaatgttatccctttgggagaaggttgggtcttcttggttgatttcaatgccattttgggagcttatgagaaaattggagggtgccctctacttggagcctcttgtgatgatttctccaattggaacattctctcaaacctcactcacctccactctagaggagtcaaattcacttggactaatggtcgtctccatgtggagcttgtaggcctaggatcttcttcatcaatggattcatttgctacttggaagatgaatggaagcggaatggagaaggaagagagagagaggagatgtcacttcaaggagaagatgagtctagaagaagctcaccaccataggaggccatggataatagcttggaggaagaaggagatgaatgaagggagaggaagagaagagcacgaaattttgtgctctaaaagagctctgaaatctgaagtttaa

SEQ ID NO: 16044 - DNA, 354 bp, Glycine max
  Peptide Sequence Number=SeqID_132822
atggatgatagatggggtgagccagatgcggggttcgatgaacacggtgttactctaccaaatatggacacacaagatacattgtttccatttatatcaccaaccaagccattattgggtagaggacatagaaccaaacaaccttcaactcgatcacaagattatgtgacaaataccaccaaaagattgagcccatccaactgttcaccctctccaaaggcagactcaggtgcaccctatcctataactgattatgaaaaggagtctgtcacttatactaacacagtgaaagacagtcagtggagagatgcaatgaaaagtgagatatatgcacttgagaccaatggaacttag

SEQ ID NO: 16045 - DNA, 225 bp, Glycine max
  Peptide Sequence Number=SeqID_132823
atggttgctgttggaggaggtgggttggatgatgaagggatgtcttcagctcttgctctctttcttgaggccatctatcccgctaagcctaaaacttgccacgatgatgtgcgcttagctctccctgagccacgcttagcggtactacacagtaaaattttcacaaattctactaatttatgggagcttagcgaaatgggtcgcttagcccagtcactgttataa

SEQ ID NO: 16046 - DNA, 1092 bp, Glycine max
  Peptide Sequence Number=SeqID_132824
atggtggacctcaaacatcaacagattggtaatattaagacagtggaagcacaagctatcttgagcacagtgagggagttggggatgacctgggagctcgaccaacaaaatataattgacaaaataaaggaaatggaggaaagggacctgaaagaggcagataagttgggtgaatctaagaaggaaagcattgataggaacatgtgtcaagcactatggggggataaggagataggctgggaaatgcaaccagtggataacacagctggtggagcacaaggagatagcagcatagaggaatttaatcaatggatagatgatttggaggtagaagaagcaccgtgggagcaatttggggacacattcaagaaggtcaagctgatccaagatgaattgaacagatttgaagagatgacaatggatacacaactttcatcccaggagacaagggttagaaggcagctacaggcagatttgtgggtggctgcccactcatacgagtccttactaaggcaaaaagctcgctctagatggatcaaaaaaggcgactgcaactcaaggtattttcatctaatgatgaatgcctcttgtagacataatttactgaaaggcatcatgagtgaaggtggatgggtggatgaaccccaaaaggtgaaggaggtgagagaggctgtttgggaatgtggaagtgataaaagtcctggttcgaacggtcttaatttcaagttcattaagaaattttgggaaatcatcaagtctgacgtccttcgtttccttcatgaattccacgtaaacgggatctttcccaagggaggttgtatttacaagattgtcagcaagttcttagctaaaagaataaagaaggtgatgtcatccattatagatggtagacagtctacattcattgaaggtagacacttactacatggtgtcctaattgcaaacaaggtagttgaggaaggttgtttagcctctgcgtccatctcgatactagtgaatgggagcccaacgaaagagtttacacccactagaggactaaggcaacgtgacccctttgcgccgtttctcttcaacattgtagcagaaggctaa

SEQ ID NO: 16047 - DNA, 675 bp, Glycine max
  Peptide Sequence Number=SeqID_132825
atgggtcagacactttatggacctgccatgactgttactttcttctccttgaatgcacgtttgcagggaaaacttgaaaagctcatcttcttgcatgactatggtcctcaaagtagtcatgcatatctcagggaacaccagtttgtttacataagatggcatctttgtttgaccaccccaactatagttgcaaactttgtcaactttgcccttgttattttctccactgttttgggtgcctattggaagaatagctatgaagcatggatacctcttttgttcaaagtgttgccgtgttgggcaaattcgtctgaggaaacacctgttttgtcacctttagtcccagtttcattattgggtagttcaaaaggtgaagaccagaagcagaaagttgttactaagcaaagtccaaagaaggtcaacttggttgctgctctggttcgtggtatgcttgttaaagatgcattgatgcagttggaattgacaataaaacgagcagcaaaaactgtatatcaggagaactattccaacttcttgattggcaattctgagttacccaattccgaggagaactatgtcctgaaagaggaatgccgagcttcaattctgagttacccaattccaattcaggggttgaggatgttacaagagtctgggatccttgctgaccagtga

SEQ ID NO: 16048 - DNA, 330 bp, Glycine max
  Peptide Sequence Number=SeqID_132826
atggatttagtggacaccgttgttgaactgcattatccaaagacgggttttataaacaccgtctttgaatctgaattggttgccgtcgtgaagcacaccagcactgtcgtggttgtcgtcgacgattatacaggccagatcgtcgacgattatacacttctagttttgaatatatataccctaggaaaatcgaaaagaaaaattggattcgaggccagcacctctagacaaggtaagagtggaagccagtttccttctttgatccttaaggacaaggttgtagctccaagaaagggccatgttaggacatttggttcagtcatggagtag

SEQ ID NO: 16049 - DNA, 150 bp, Glycine max
  Peptide Sequence Number=SeqID_132827
atgggagataagaaggcaaagaaggcctatatcacatgggatgaaaatgacttagaatcgtctgacaattctgaaaaagaagtggttaatctatgtctaatgggcaaagattatgaaagcgatgaagagcaaatatgtagaagaaattaa

SEQ ID NO: 16050 - DNA, 345 bp, Glycine max
  Peptide Sequence Number=SeqID_132828
atggaattgattgagaatatggctgctagtgaccaagcaatcttgcgtgatggagcacacatcccaaccaaaagaaacctgttggagctttcatcacaggacgctttgttggccaaaaacaagttgttatctgtgaaaaagagactaagttttgaattttcaaaaagtagcagttgggctaagcgcatatccaccgctaagtgcagcttcaacgcgcttagcgcaagggagaatctggcagagcatcagcatcaaagctgcgcactaagtggtacaatgcccagggcacagaatcacacagcagccacagtgcctattttgggaaaaaagccctgtaagcagtaa

SEQ ID NO: 16051 - DNA, 650 bp, Glycine max
  Peptide Sequence Number=SeqID_132829
atggcttataggaaaagaaaggcaccctctacacctacccaagccagatttgatagatccagattcacctcccaagaggcttgggagagatacactgacattgtggtgcctcgtaagcttttaccagaaaggaatgtggtagtctactatacagagtttgatgagttcaaggaggaactcgagagatgccattgggatgaggagttcactgaatttatggacggcaatattgatgttgccattacccctgttgttgtggaagagggggaaacactttgtgcttactctagatttgcactcctgaggcctaatcctcaagacttagctgctaagctctgtatcccagggaggggattcgagcttaatgctgatgggcagcctttgaagattctgaggaagaacatgaccactcttgctcagacttggagcgttctttccttttctaacctcatccacacttcccacacttattatgtcactcttgacagagccaaactcatttatggcatcatcatgaagatggacatgaatgtggggtacctcatctcccaccagatctccctcatagcacagcatgacacatccagactaggattccctgccttgaacacagctttatgtaaggctaggggagttcagtcagattcgag

SEQ ID NO: 16052 - DNA, 444 bp, Glycine max
  Peptide Sequence Number=SeqID_132830
ggagaccagtcagggtcacagtgttttgcgagaattttccaaccatatgagatcaacataggcttaaaggagcactcaaaccgtgtgacccccaaggcctacactccgaagagtccgtcagggcctctccctcctgattcagttattcctccgactgttccgatagaattcccaaacgccaaagagacggagaagagattgaaacctccacttgtactgtcttcatgcgattcctttttctcccaccacgaatattatctcaaaaatcccaatggtggaactaaaaataaaaggctacaacgcgaagggttttcctctaagctcagacataatatcaaaattcccaacggtgataatgctcgtaattgggttgcgaacgtggtgttcaaatttcacaatgatctaacggtgaatgagcccgagatcgtcatttttctaagacag

SEQ ID NO: 16053 - DNA, 351 bp, Glycine max
  Peptide Sequence Number=SeqID_132831
atgtacaactcagatgatccttcaccaaagcaagcctgggtcagaggccacctagtgaagatcgacgctgacaaccttaacatattccctgagacatctgtggtgttggcggaggtttctatccgaggggctaggagggcgagggcaaggccagctgtgcttccttccacatctgtagctcctactccatcatccacttcagcagctccttcagtcccagctcagagtgattctcaacactttgaagccatgcttcagagcattcatcagggacaaattattttacttcagagtttacaggtggtggcgcctctaggatccattccttccgttgagcagtttctggatagg

SEQ ID NO: 16054 - DNA, 327 bp, Glycine max
  Peptide Sequence Number=SeqID_132832
atggatgaaattgatccaacattggaatatttcatctttgtattggttgctcagaagatgatgcactacgtttcactgaagaattactattttgcacagagtgtagcgcatcaacatactcctgtggaagcaatgtcttccaagggtattttgatgatgccaaagaatcaagagtcaagcaaagtttcaagaaaagatttaagaatcaagtttcaagtttcaagattcaagaaaaatcaagatcaagattcaagacttaagattcaagaatcaagagaagactcaatcaagataagtactaaaaaagtttttcaaaacattgagtag

SEQ ID NO: 16055 - DNA, 144 bp, Glycine max
  Peptide Sequence Number=SeqID_132833
atgtggttcaacaatatcagagaaaatgaaaagaaagctaatcgatgctgtactgtgctgctggaaatttacgcatctctatgtttaaactgcttcattggtgaagaagcctatgtaaaagctggggaatgcttcaacaactag

SEQ ID NO: 16056 - DNA, 314 bp, Glycine max
  Peptide Sequence Number=SeqID_132834
gtcttccggaaatagtttccggaagcacttcttccggaattgggcttcgtaacttccggaagaccttcttccggaagttaagaagcccaatttcggaagagggtcttccggaaatagtttccggaagcacttcttccggaattggccttcgtaacttccggaagaacttcttccggaatatggacgaagatcaatggaggtatgactttgcgatgtcacaagaagttgatatggattatgattatgataatcaagaagaatgtggagtgaatgaacgacatgtcgattgttcaaatgcttttaatacatctcag

SEQ ID NO: 16057 - DNA, 624 bp, Glycine max
  Peptide Sequence Number=SeqID_132835
atgaatcatgagagagagagaaagagaaaagaaggtacaggtgcacatggtcaacaagtacaagagatgcacctgatcaggccactctcgttgcaagccgcacacgtgggaatccactgcgggcaagccctcgagaagcttcttgagctcgccactctcgtgcagccacctcaactcctcggccccaccaatgtaccttccgtcaatgaagacacgtggcagggtcaacccggatttgcgacccgtgacccgacggagctccgagagaaaacccgagtccatggacaggtcgcgctcgtccagcgcgacgcggaacccgcgcaggatggaacgcacctttttgcagtcctcgaacgtggcgcggaccacgcgcaggctcgtgaagtagagcaccacgcgttgctccgagcggggaatggacggcggagggagcgagttggcgagtgtgactcggtggaagatggagggtttgggtttggtggtggtggtggagggagatggagaagtgggggatgttgcattttgagagaagtgaagggggggttggtttattttgcttttagaggaggtttacgagggaaaagggatggattgggagagattgagatggccttattaaatgag

SEQ ID NO: 16058 - DNA, 228 bp, Glycine max
  Peptide Sequence Number=SeqID_132836
atgcggaaattgattaaggaaaggatagaaaataaggtggttaatttcgtgggtcttaataaggttaagtggtggctggacagaaatatagaaatggaaataactgaagctacagggctccaaatgagagcaagggtgaagatgaaaggaaggaaagaatcactctttccagcgagggcaacacacaaaggttgtgaaagtcctttgatacagccagggtgttcttga

SEQ ID NO: 16059 - DNA, 361 bp, Glycine max
  Peptide Sequence Number=SeqID_132837
gtggactttcatattggttaccatatattttgcgttggggaccattgtatctgcatatggatgttggcggttctttaataaacctgtcattcacaatggagcaaaggctgagtttctgagaagggatgtagaagagacaatctctacaaacttaatcacttccaacaagttggaaagccgttatgttgaagaggactttcaacaaagagcagggttttggggtttcgtcatgcaaactatatatcaggaaactaggcgaatcagaaagactgtaaaaagaacagttgcttgtctgtattatggaattattcaaggtatggtatgtggtggattgagaggtttggttgagatattggaataa

SEQ ID NO: 16060 - DNA, 795 bp, Glycine max
  Peptide Sequence Number=SeqID_132838
atgtccaaacaaaggttgcagggtaaggtggctattgtaaccggtggagccaccggaataggagctgaagcagtgaggatattcgtggagaacggtgcttccgtagtcatagcagacatcaaggacgaattgggtcacaacttggcaacttcgttaggcttagacaaagtggattaccgccactgtgatgtgagagatgaaaaacaagttgaagaaacagtttctttcacattagagaaatatggtagcttagaaattttgttcagcaatgctggaatcgcaggccctttatcgagcattctagacttcgatctgaatgaattcgacaacaccatggccgtgaaccttcgcggtgcaatggcagccatcaagcacgcggcacgtgtcatggtggccagagagacacgtggatccataatttgcacgaccagtgtggctggttccttcgcgggatgcgcgggccatgattacaccgcatccaaacacggccttattgggcttgttcgctcggcgtgtagcgagcttggagctaaggggataagagtgaattccatttcgccgtatgcggttgcgacgcctctgacttgtgagacattcgatatggagcctggtgaagttgaagctgcgggacatgctttggccaacttgcatggaatcacgttgaagcctactcatattgctcaagttgctctttttcttgcatctgatgaatcggcttatataagtggacacaacttggtggtggacggaggtttctccgtcgttaatcgtggccttcctagcattaaaaattaa

SEQ ID NO: 16061 - DNA, 180 bp, Glycine max
  Peptide Sequence Number=SeqID_132839
atggtgtttcggcgaggatgggcattctcaccatgggtcaaggtttatggtgagttgggattttggctcaacgcttatagaacggctggacatgatatatgtcagagtgttggtttggccagcgattcagggataaaggggatgtcccacattatttccatgacacacatgcaacaatga

SEQ ID NO: 16062 - DNA, 213 bp, Glycine max
  Peptide Sequence Number=SeqID_132840
atggctggctctactagtggctggaaacagattcttctttgttggtcacagcttttcataggcctcacctcatcccttggtctttacaaaatcattggtttgacaatacaattccgttttttcctaacaaagttaggatctctcacatttaccgtgaaggtaatggctatgcagacagcagaacaattaatctgcccttacggacacaaataa

SEQ ID NO: 16063 - DNA, 318 bp, Glycine max
  Peptide Sequence Number=SeqID_132841
atgtatgtgagcgggaattctgatatctatggattcctcgagccacagtccattcagaggtttgggcaatcgcagtttgaatctgaaagttacataaagagttggatgcagagttcacaacgcgatgtgtatcttggagcctacctaaatgggttccactacagcggacactggcagatggtgcctaaatcaaaggctcctggtaggtggattgtcgtcaagtgtaatagacaaaaaggaactactgagtgcggctactatgtgatgcactggatgtccaccatcattttaggaacttttagaaataattgggaagcg

SEQ ID NO: 16064 - DNA, 267 bp, Glycine max
  Peptide Sequence Number=SeqID_132842
atggcatttggtggacttgcagctcgcccaggcgagctgttgcttcatcctgaaatggaaaatatttcattcgacctgcctcacaccatctacatcaacatcctcagaaatctgaagggcttaggtgatctggacaacatctactatgttgccctgatcaacaaggcgttgtggtatcaaggagtttatcatgtttttgacaagatggatgacaactccaagcacaccaccatagccaaaggttcagttgttgctaagcaaaaataa

SEQ ID NO: 16065 - DNA, 342 bp, Glycine max
  Peptide Sequence Number=SeqID_132843
atggagcacgcgacacgtggcacagcgcggcgcacgagacagcagcaggatagcgcccctgacgcgggcgcgtctggtagcgccctgctgctgggcgcgactggtagtgcccagcgcgtgggcgcgactggtagtgcccctgacgcgggcacgacccagacgcgcgcctgggtcgtgcccgcgtcaggggcactaccagtcgcgcccagcggcagggcactaccagtcgcgcccagcggcagggcgctaccagacgcgtccgtgtcaggggcgctaccctgctgctgcctcgtgcgccgcgctgtgccaaggggcataataatggatggagttggaatctga

SEQ ID NO: 16066 - DNA, 2187 bp, Glycine max
  Peptide Sequence Number=SeqID_132844
atggaagaaacatttgtaccctttgaaggaatcaagaatgatctgagaggaaggttgatgtgctacaagcaagattggacgggtggaatcaaagctggtttaaggatttgggcccccaccacatacatattttttgcttccgcaataccggtcatttcattcggggaacaactagagcgagatactgatggtgttctaactgcagttcaaacattggcatccacttcaatatgtggcattatacactcaatccttggaggtcaacctttgctaattttaggggtggcagaacctactgtgatcatgtacactttcatgttcaattttgcaaaagagagaccagagttgggccgggatttgtttctggcatggactggatgggtatgtgtctggactgcactgttgctattcttgtttgccgtcttaggggcttgctctataatcaacaggtttacccgtattgcaggagagttgtttggcatgctcattgcaatgctcttcatgcagcaagctatcaaaggacttgtggatgagtttcgcataccagagagacaaaatccaaaatcaattgagtttatatcttcatggaggtttgctaatgggatgtttgctttagtcctttcgtttggtcttcttctcactgcattaagaagcagaaaggctaggtcatggcgttatggtactggttggcttcgcagcctaatagctgactatggtgtgccacttatggtcctagtttggacaggtgtgtcctacatgccagctggaagtgttccacatggtataccaaggcgtctcttcagcccaaatccatggtcacccggtgcatatgagaattggactgttattaaggcatgtaaattgcaagatatggtccatgttcctgttgtgtacataatcggagcatttatcccagcaaccatgattgcagtactttattactttgaccatagtgtggcatcccagcttgcccagcagaaagagttcaatttgagaaagccatcttcttaccattacgacttgcttcttttgggatttttgaccttaatgtgtggccttattggaattcctcctgcaaatggagtcataccacagtctccaatgcacacaaaaagtctggcaactcttaaacatcagttgcttcgtaacaaactggtggtagccgcacgaaaaagtatgggaaagaatgctagtttaggacagttatatggcaacatgcaagaagcttacaatcaaatgcagacgcctcttgtttaccaggactcctctgctcgagcacaaggactaagagatcttaaagaatcaaccattcaagcagctaccagtatgggaaacgtggatgctccagtagatgaaactatatttgatgttgagaaagaaatagacgacctgcttcctgttgaggtaaaggaacaacgtctcagtaacttccttcaatcaataatggtgggaggatgcgttgcggccatgcccttactcaagaagatcccaacctcagtcctttggggctactttgccttcatggccattgaaagtttgccaggaaaccagttttgggaaaggatcctattactcttcactgcaccaagcagaagatacaaggtgcttgaggactaccatgctacttttgtagaaacagttcctttcaagacaatagtaacattcaccatttttcaaaccatttatcttcttatatgttttggactaacatgggttcctattgccggggtcatgtttcctatgatgatcatgcttttagttccggttagacagtactttctccctaagtttttcaaagggatacaccttcaagacttggatgcagcagcatatgaagagcaaacagctctaccattcaacctcgcaacacactcagagtttggagctggtgcttctcaagttggagaaggtgaaatcctagatgaagttattactagaagccgtggcgagtttaggcacactagcagtcccaagatcacaagctccaccccaacaccaagaactgatactaacagccatctaagcccacgcctctcatttagttctcgcatgggtgagttcaaaactgagcagagtcctcggtctggtgcaagaggtcccctcagtccaaaggcaggagaagtgagattatcacatctgggaagaagtcctcttaatccagattcaaaacaacatgaccacaactaa

SEQ ID NO: 16067 - DNA, 372 bp, Glycine max
  Peptide Sequence Number=SeqID_132845
atggaaaataagaagagaaagggaaaagactatgaggtggaagacgaagagatgaagatggacaagttttacgcgctgttgcggaggtaccgagacgcgcgcgatcgacggcgaaaggagcttgaggaattagacaagagtgagaaggagaagaggatgaaggcgggaacagagcaacaccgtgtttgggtgccatcattcgaatgggaggatttcacagaccaggttcaattcagaggacaacaatatatgcaattcccaacttcatctacatctccttcgccgcttgccggtggcacagacaacaaacaactcacgaatttatttcacggattcaactatcataaggcagttcaaatggcaaccaactaa

SEQ ID NO: 16068 - DNA, 576 bp, Glycine max
  Peptide Sequence Number=SeqID_132846
atggctgcgatcgcgggagcgcacgtgtttggtgttgtgagttttcagctcaagcaagctgaaatgccctttgcatgttccagcttaatccgcaagcatattggagattctcctcagcgcaatgtggctctaagacgcagagcaaatggaacaattcttccccaaatcagagcccagaacgttcttccagactatgttccaaaatcggagttttataaagtagaagccattctcaggccctggcgagtccctcaggtttcttcggtgggccatgtgccattagatttaccaagttttatggtgaatgctggtactgattttagttttcttgattcgaaggctatgttgaaaatgggaattcgcggtgtcactgtatctgatgtcaagggctttggttctcagggtggttcaaaagagagacagggaggctctgaattttctgaagacaattttgttgccaaagttaaaatggaaatagtagtgagaaaggaccaggttgaggcagtaattgacaaaattatcgaggaggcaaggactggggagattggtgatggcaaaattttctgtaagacctaa

SEQ ID NO: 16069 - DNA, 543 bp, Glycine max
  Peptide Sequence Number=SeqID_132847
atgaaggggtttatggagtttaaggaaacaatctttcatatgcaacctgataaagctcctggttctgatgggatgttagtagttgacttcgagggccagtacctctgcaagcaatgggaagagaaaggttcagaaggaaaggcaatgaaggataacaacatcgttcagcaaatcatcattgccagctcagctctgcttttgcattttcaaacgaaatctttgaggtatgaaggcctcgtaattgttctctttgctttcgccattcgcacccctggttttgctattgtagttcctgcttccttttccggtgttgtctttgttgtgttgtcatcttcctgtggccctagagaaggaccttgtcctcaaggtagtgatcttgacgcaactgattcccgtcctcctaggaggtgtcatctggggacaagccctaccatcggaccaatacttcccaaggagcatccttcattggggatgagtgtcgccacgaaatggtttgagcatggagcaatggaacaccgattgaatgtgtactccttgtggtag

SEQ ID NO: 16070 - DNA, 1305 bp, Glycine max
  Peptide Sequence Number=SeqID_132848
atggtttctggcgtgagatggaccaccaaggaattcaaagaaatttgggctgggtataaatatgttgaatcgggtgggtcgggtggtggtgtatcgggtgggtcgagaatggatatattagaaagggctgggttatcctcatccgcgatggggagaaaaagcctaaaggcacaacggtgtcctctatggaatttctccttgcaattgaagcatagaccccgttcccggtgggaagcaatctcctccgggatagtcgcttcaagggtggtggtgaaacacgtgggggtggctgtaagaggggtggtaaaggctgggaggggcgaggtcgaggaagacgacgattgtcgagaatcttctcttgctagaagcaggccagatcgacggtctgtaccaaggtcattggttgatgggcctacacctcccaccgtatctccgaccgatgattcggttggcaagatcctcaaactcgaaaaggtactggaccacgatgcctttctgagtgagcttgaacagagctctggtaggatcgtcatattgggacgacgcaaagtgagtacgcaaagcttggaggaacaccggccaagaggtgaactggccattggtgttcatccactgaaaccatgcgagggcgtagccttccatatccaatcgagtggctcggtgccatcaaaccgaggcatgtctaatttcattatgtgtgttactgcagggacaggggaaggcggaggcaaaggtggtggagtggttgaagaaggtgacagggcagggctaaggcgctggataagttcatcaattttcaaagtcatggaattcacagactcacccaggcggtctgaggaacccaggttcttgtcagaatcgggcatgaaggcaatgagagcaccaattgataagggtgttagtggctggcttcgagggccagtacctccgcaagcaatgggaagagaaagggaatatttctataacagaatttggttaggaatgtctcctagcagcagacaacatcattcagcaaatcatcactgccaggtcagctctgcttttgcattctcaaacgaaatctttgagttcctgcttccttttttggtgttgtctttgttgtgctatcacaatgtgatctataaaattatctccaaagtgcttgctaacagattgaaaggagttatgggaaaatgtgtatttgaggagcaatcagcttttgtgcctggtagatctataattgataatgctttggtagattgtgaggatgttatggcaattgcaagttccaccaaggatgaaaaacttaatatgaagatcatgtag

SEQ ID NO: 16071 - DNA, 285 bp, Glycine max
  Peptide Sequence Number=SeqID_132849
atggatgagcacaacgttgtgttggatttagggttagtaaagggtgtattgtggccttgggtaaacactgccaaatttgaaagaaaaaggcaacatccaccttcgacaggtttgggaagtttggtgctgatatcggagtgggttaagagtcttttatcaatggttgaacaatcacccaacaaatctatgcaaaatgctttcttagcatcattgaaagcatcaactgttgatacacttttaaggcatgttatgttgatgtcaaagttaccgttgcttcttgcataa

SEQ ID NO: 16072 - DNA, 1428 bp, Glycine max
  Peptide Sequence Number=SeqID_132850
atggacctcaacaacaagattttcttaaatgcagtgaaagccttttcacctttgaaacttagactaggtggaagtttgcaagacaaggtaatatatggcactgaagataaccaccaaccttgtacaccttttgttaagaacccttctgagatgtttggtttcactcaagggtgcctcccaatggatagatgggatgaacttaactacttttttgaaaaagctggagctaagattatctttggattaaatgctcttgctggaaaatcaatacacagtggttctgcaaaaggaccttggaactacaccaatgccgagtcctttattcgatatactgttggaaatggctacagcatttatggatgggaacttggcaatgaattgagtgggagtggagttggaacaagcattacagcagaccaatatgctttggatgttgctgctttacacgacgtagtttacaatgcatatgaaaagactgagcctaagccactagtaattgcacctggaggtttctttgatgcaaactggttcaacatatttataagcaaatcaggaaaatctattgatgtggtcactcaccacatttataaccttggaccaggagttgatgagcacctggtggaaagaattctggacccttcctatcttgataaagaggctagcacattcagtggcctaaaaaatatacttgcaagtacaggtacctcagcaacagcatgggttggtgagtctggaggtgcctacaatagtggccatcatcttgtatccgatgcatttgtttacagtttctggttagtggcaactccacatgattcagatttcattaatgattccttacaattagggtatttggatcagcttggcatgtcagctgcttatgacactaaaacatattgcagacagagtttgataggaggaaactatggtttactcaatactacgaattttctgccaaatccagattactatagtgctcttctttggcaccgactcatgggaagacatgtcctctcaactaccttctctgggacaaacaagataagagcttatgcacactgtgcaaagcaatcaaaaggaatcacagtactattgatcaacctggacagcaacacaactgttgaagctgaagtgaccttcaacaacaacgctgagagtttgaggcacagaaagatgtctagtcattcaaaaaggatggaactgcctcttgcaagtgaaacagcaagagaggagtaccatctaactccacaggatggggatatacatagccaaacaatggtactaaatggaaaagctctgagtgtaaactcagatggtgacattcctcctttggagcctatatatgtgaactcatcagagccaataagggttgctgctttctctattgtatttgcccatttacctgatgctgttgtttcagcctgttgctaa

SEQ ID NO: 16073 - DNA, 765 bp, Glycine max
  Peptide Sequence Number=SeqID_132851
atggatgttaaggtgaagaaatcacagtccatagaattacaggtgcaggattgtgaagaagacatcagaaaaggtccatggagcgttgaagaggacaccattctccaaaattacgtcgccacccacggcctgaagagatcagggaaaagttgcaggttaagatggctaaactacttgcgtcccgatgttcgtcgtggaaatataacactccaagaacagataacgattctggaactccactctcgctggggcaataggtggtcgaaaattgctcggcatcttccaggtagaacagacaacgaaataaagaattattggaggacccgagtgattaagcaagcaaggaacctcaagtgtgacgtggacagtaaacagttccaagatgccttgcgttacgtctggatgccccgtttgatagagcggactcacccttcactaccaataccatcggaaactcacggcccggcccatgttgacccaaatccaaccgctccggcccaacacgagttgcatggttctggttcgggctcgggtccctctgccttggaggatgtctcatcaggagcggagttaaacgctcctttagattctgattctgaacatttggtttatgatgtttggggtacatgcgacagtttcaatgggaatagcacgttacctttaggtggtggggacttgatggagagtttgtgggaggatgagaatatgtggcttatgcgacagctttgtcatgatctggaaattaaagacaatttccttgcgtga

SEQ ID NO: 16074 - DNA, 612 bp, Glycine max
  Peptide Sequence Number=SeqID_132852
atggacagagcaagaggattctcttctcttcaattacatcactgtccacggcgaagattaagatggttgaactacttgcgtccaaatgttcgacgtgggaacataaccctccaagaacagctcttgattcttgacctccattcccgttggggcaacaggtggtcgaaaatagctgaacatttaccgggaagaacagacaacgagataaagaattattggagaacgagagtggtaaagcaggctaagcaactaaaatgtgatgtgaacagcaagcaattcagggacacgttgcgttttgtgtggatgccacgtatgctagagcggattcgggctcaggcctcatcatcggcccaagcccaccaaagcagcttaatctccaacagtaacactcaagcacacagtggattgttgtcatcagcgcttcatgcccacgcgccttctctctctgactcgagcgcgtcgtacaatcttatgggtgctgatgctggaagttgctcatctcatagctactactcagacatagcaggcaatggttttggtggtgcggacttgtggacggatcaaaacatttgctttctgcaacaccagcttgctcatcatgacttgttctga

SEQ ID NO: 16075 - DNA, 998 bp, Glycine max
  Peptide Sequence Number=SeqID_132853
caatggttgtgctttctccttctccaacttccatcaagacaagctacaagaaaaaaaagacaatgaaaattccaacgatagacctatccatggaaaggacagagttgtcggaaacagtggtgaaagcctgcgaggaatacggtttcttcaaggtgattaaccacaatgttccgaaggaggttattgcaagaatggaagaggagggtgcaaagtttttcgccaaacccacccacgagaagcgtcgagctggcccagcaagtcctttcggttatggcttcaccaatatcgggcccaacggagataagggtgacctagagtatctcttgcttcatgccaaccctctttccgtctctcagagatccaaaaccatcgctagtgactccaccaagttcagttgtgttgtgaatgattatgtagaagcagtgaaagaagtaacgtgtgagattttagatctggtgcttgagggattaggagtcccagagaagtttgcactaagcaagctcattagagatgttaatagtgattgtgttctaaggatcaatcactaccctccattgaaccagaagttgaagggcaacaagaatagcattggttttggggcgcattctgaccctcagatcttgacaatcatgcgttccaatgacgtgggtgggcttcaaatttacacccgtgaagggttgtggattcctatccctcctgaccccaatcaattctttgtcatggtgggcgatgtcttccaggttttgacaaatggaaagttcatgagtgtgaggcacagggcattaaccaacacattgggggcaaggatgtcaatgatgtactttgcagcaccaccacttgattggtggatcactccgctagccaagatggtgtcaccaccacaaaatccaagtctatataagcccttcacatgggaccactacaagaaggcaacatattccttacgcctcggagattctcgacttgatctcttcaaggcccagctagatacccatcat

SEQ ID NO: 16076 - DNA, 645 bp, Glycine max
  misc_feature (507)..(507): n is a, c, g, or t
  Peptide Sequence Number=SeqID_132854
atggctagaagtattaacaatatgatcacatattttgcaactcgtcaattcaaataccagaggtaccactctctacttcgtcgttcggatctcaatgaccacactctcatctttgatctagaaggtgcattgttgaaatcttcttcagtgttcccatttttcatgctcgttgcgtttgaagcaggagggctattaagagccatagttctgcttttagtgtacccttttgtttgtttagttggtgatgaaacggggttgaagattatggttatgatatgcttctttgggatcaaagaagagagtttcagagtgggaagaacagttttgccgaagttcttgttggaggatgttgggtcagaaatgtatgaggtggtgaaaagaggtggcaaaaaagtggggttgagcaagttgccacgagtgatggtgggaagcttcttgaaggagtatttggagattgattttgttgtggggagagagctgaaagtgttcaatggcttctacgtgggnttgatggaggagagaaaaaccatgcatgctaatttggagctggttcctgacgggaaaagaaactattcccacatcattggaatttcaggatttcgtcaggatctggatgatgattacttttctttatgcaagaaatag

SEQ ID NO: 16077 - DNA, 1395 bp, Glycine max
  Peptide Sequence Number=SeqID_132855
atggacgcgaaggatatcctgggattgcccaaaaactcgttcccatctctcgagaagaaatctcgtcctcccaaagagtctcaaagaaaaccagatggcatttcgcgcgaggtgtatgcgcttacgggcggattggcctctctcatgcctgcaattgaagcctctcagttgaagaaaaagcctcttcctctcgaaaaaatcacttggcagtggcttcctttcaccagttctgctcgtaaagataatcttcatctttaccattgggtacgagtcatcaatggtgttcctcctacgggggactattcttttgccaagtataataagtccgttgatgttatcaaatacacagatgaggagtatgaccaagtatttgtcagatcctctgataggtttccatcatctcggactgtagaggaattaaaggatagatattatagtgtttcccgggctatattgattgctagggctccatcttctggagatgttgtggcacattctattgttaaggaaccgtataatgttgcacaagaaatggagcgaaaaagagcactgtccatggtcctctctcaaacaaggcaacaagaacgaagagatgaagaggttcttgttgaagcaaaaaaaatagctgaaaaacgcctacctcccaaggttgctggacagtctcagtttgttgcttctaatgctggtgcagaagctatagagagggctgtccctggtgaaaccgtatctccatcaaatgtgcaacttccaatggtttccagtgatgcatccggtgccttttcttcattgacacttttgttcttaacacctcccaattcccaaacctcaatgtctgccctgcccacagggaagtttgacagagaaatatttcagcttcgtgtatatttgagaacatatgcacttgagcaaatggtgcaagctgggaatgcatcagctggacttcggactatcaaacgggttgagcaaactttgcaagatcttggggtcaatttgaaaccaagggttccaacgaaagctgtttgtgcagagcatcttgaattaagaaaagaaatactaacatggcttaatctccagaaacaggtgcaatataaagaggctgaaggttcctcctttcgtgatgggtcatatggtgaaacacctggcacaccaaagcatttacatcgtggtggggatcaggatcgaacatttattccagattcaatgaatttcggagtggaaagggtaggcaaaaaggaccaaaagcgcaaggtggcaaccgggaaaggtgtttcaattcacagaattctttcaatcaaaattatgaatgttgtggaaggtgtggctgtgaactcaacacctgaaaattcggattgtggtatatctagtccaactgaaattcggttcacttcggtctaa

SEQ ID NO: 16078 - DNA, 774 bp, Glycine max
  Peptide Sequence Number=SeqID_132856
atgactttagccatgctaatgtggcttccttgtggcttcatccttgcattgattaggatcacaacagcattctcacttccatacaacatctcaacgcccctattggaattcactgggcttcatctcacaacttcaaggcccaaagaagataaattattgctcaaggggcgtctttatgcatgcaaccacagaacattactagaccctctctatgtgtcgttcactttgagtagagacttagtggccgtcacatacagtttgagcagaatgtccgagataatatcacccatcaaaacggtgcgtttaacgaggaaccgcggccaggatgctaagacgataaaaaggttgctgaaacatggtgacctggttgtgtgccccgaagggaccacgtgcagagagccctatttattaaggttcagccctttgttttcggaactgtgcgttgaaataatccctgtggcaattgattgtcatgtgacaatgttccatggcacaaccgcaggaggtcttaagtgcttggacccatttttcttcttgatgaatcccacaccttcttactctgttcagttgctagagaaagtgtcaccttccattaccgctagtaatgttatcaatgacgattatgcgagatttgaagtggctaatcacgtgcaaacgcatattgggaaggccctgggttttgaatgcactcaacttaatagaaaagacaagtacttgattctggccggtaatgaaggtatagtatcgaccacaaagagtggtaggagtatataa

SEQ ID NO: 16079 - DNA, 1833 bp, Glycine max
  Peptide Sequence Number=SeqID_132857
atgacggatccacttttggaacggtacaaggttattattcttgacgaggcacatgagaggactttagccacggatgtgctatttggtcttctgaaggaagtgcttaaaaatagacctgatatgaagttggttgttatgagtgcgactcttgaagctgaaaagtttcagggctattttttcggtgcccctctcatgaaagttcctggaaggctacatcctgttgaaattttctatactcaggaacctgaaagggattacttggaggctggcattaggacagtggtacagatacacatgtgtgagcctccaggagatatacttgtatttttgactggagaggaagagatagaagatgcttgccgcaaaataacaaaagaaatttctaatctgggagatcaggtgggccctgttaaagttgtacccctgtattctacacttcctcctgctatgcagcagaagatttttgagccagctccacctccactgaaggagggtggacctcctggaaggaagattgtggtatcaacgaacatagcagaaacgtccttgacaattgatggtattgtttatgtcattgaccccggttttgctaagcagaaggtttataacccacgagttcgtgtggagtctttattagtgtcaccaatatcgaaagctagtgcacatcagagatcagggcgtgctggaagaactcaaccagggaagtgctttagactttacactgagaaaagtttcaataatgatctacagccacagacctatcctgaaattttgagatcaaatcttgccaacacagttcttactttgaagaaactgggtatagacgatttagtgcattttgatttcatggaccctcctgctcctgagaccttaatgcgtgcattggaagtgttgaattacttgggtgcactggatgacgatggtaacttaacaaaactgggtgagattatgagtgaatttcccttggacccacagatgtcaaagatgctcgttgtcagtcctgaattcaactgttcaaatgagattctgtccgtttctgccatgctttcaggttgtcatcagcaactgtcttctctgggttccatgtccccggttggcatgcaccattggattctaatacccaattgctttgtccggcctagggaggcacaaaaagctgcggatgaagctaaagctaggttcgggcacattgatggagatcatctcacactgttgaatgtctatcatgcgtacaagcaaaataatgaggatccctcttggtgctacgataactttgttaatcatagggcattgaaatcagctgataatgttagacaacaattagtgcgtatcatgtcccggtttaatctgaagctatgcagcactgactttaatagccgcgactactatgtcaacataagaaaagctatgctagctgggtatttcatgcaggtagctcatctggagcgtacaggacactacttgacagtgaaagacaaccaggtggtgcatttgcatccatccaattgcctggatcacaagcctgaatgggtcatttataatgaatatgttcttaccagtcggaattttattcgtactgttacagacatacgtggggaatggttatctagtttccctattcctgacatgcaattctcattctcatctcatacaggcaaagcgtgtcctcgagagactttacaagaagcgagaaaaggaaaaggaggaagccaggagccgcagatgaagtcagccatccacactatttttgcctttgggtttggatttggattggatattttgccttctgcagctgagacttctacatctgaaaggaatactgaatgtcgatag

SEQ ID NO: 16080 - DNA, 105 bp, Glycine max
  Peptide Sequence Number=SeqID_132858
atggtgttaaaacggtttttcaaaggaagcataagacatgcaatggcggttccaaaggcagaaaagatgcaaagacaagatgaaactaacaagaaacaagcatag

SEQ ID NO: 16081 - DNA, 1611 bp, Glycine max
  Peptide Sequence Number=SeqID_132859
atggtgatgatgagtacgtttttcttcaaatttattttcatcttttggtaccgttttttcttcaagccactcaaaagcctccgaagaagtgttagcaacatcacatatgcaacccatcaattcaaataccagaggtaccactctctacttcatcgtaattcagatctcaatgaccacactctcatctttgacgtagaaggtgcgttgttgaaatcctcttcagtgttcccatttttcatgctcgttgcgtttgaagcaggagggttattaagagctattgttctgcttttagtgtacccttttgtttgtttagttggagatgaaatggggttgaagatgatggttatgatatgcttctttgggatcaaagaagagagtttcagagtgggaagaaccgttttgccgaagtttttgttggaggatgttgggtcagaaatgtatgaggtggtgaaaagaggtggcaaaaaagtggggttgagcaagttgccacgagtgatggtggaaagcttcttgaaggagtatttggagattaattttgttgtggggagagagctgaaagtgttcaatggcttctacgtggggttgatggaggagagaaaaaccgtgcatgctaatttggagctggttcgtgaagggaaaggaaacagttctgatatgattggaatttcaggatttcataaggatcttgaccattccttcttctctacatgcaaggaagtgtatatggtgacggaagctgagaagaaaaattggaaaaacctagcaagagacaaatacccgaagccactaatattccacgatggaagattagcacttaaacccacaccactaatgactctagccatgctaatatggcttccttgtggcttcatccttgcattgattaggatcacaacagcactctcacttccatacaacatctcaacgcccctattggaattcactgggcttcgtctcacaatttcaaggcccaaaaccacaaacaaagaagataaatttttactcaaggggcgtctttatgcatgcaaccacagaacattgctagaccctctctatttatcgttcactttgagtagagacctagtggccgtgacatatagtttgagcagaatgtccgagatactcgcaccgatcaaaacggtgcgtttgacgaggaaccgcgacgaggatgctaagaccatgaaaagtttgttgaaacatggtgacctggttgtgtgccctgaagggaccacgtgtagagagccctatttattaaggttcagccctttgttttcggaactgtgcgttgaaataatccctgtggcaattgattgtcacgtgacaatgttccatggcacaaccgcaggaggtcttaagtgcttggacccatttttcttcttgatgaatcccacaccttcttactctgttcagttgctagagaaagtgtcaccttccattaccgctagtaatgttatcaatggcgattatgcgggatttgcagtggctaatcacgtgcaaacgcaaattgggaaggccttggaatttgaatgcactcaacttaatagaaaggacaagtacttgattttggccggtaatgaaggtatagtttcgaccacaaagagtggtaaatag

SEQ ID NO: 16082 - DNA, 1161 bp, Glycine max
  Peptide Sequence Number=SeqID_132860
ggctgcccatctactcttggagcaaatcgcaagtctcaagatttctttgaaaggataccagccagagacaaaaatgtgcgggcacttttcacggagaaagttttaagcaagattgaaaaggatgttggctgcaaaattaagatggatgagaagtttattattgtcagtggtaaggatagattaattttggccaaaggtgttgattctgtgcacaagattcgagaggagggtgatcaaaggggaacatctagttctcaaatgacccgatcaagatcacctgaaagaagtcctgttagtgctcggtttcaacgctctgagccccaaaggtctcattctggacctcgaaatacatctcagtttcaacaaagatttggtaggcaagagcgggcggttgaagaccgtatccgggatgacgtgcaaaagttttctagaggttctccacaaggtagggacagcataggatatgtttacagcatccttagaaagctgcaagagtgcttaacatactcttcatttcctgaagcttatggaaatagtggagctagaggtcgttcaagccagtcaagatctccaagacatgccccttatacaggaaactcatataactcatttgagggtcgtaatcaaaacatgggtgcttataggaatgatgggtgggattctcatagaagagaatctggtatccggcctggtcatcagtttgattacagcgcctccccacagactttagaagaattagagttggagtacaagaatgaggcagcagagctaatgaaaatccgtgacagagaagaagatgaagaaaatttcaagcatcgtgaggctattagagatttgagggagaagtacatgagcaaagtttccttggtaagggacacacatgcaaaacagtgggaaggatttcttcagcttgatgcgcagaggcgtcaacagcaggcagttcaacagatgccttctggttatcggggttttaaacagcagagctttcctgaatatgatggatccactgccaatcctcctccttatgctggttctaatctaccattggaatcgaggaacaggttctcagacaacatggaaacttatcctaataggcctcatgataattttggtgaatttcataggcgtggagatttcgcaaaagcttacaacagatattaa

SEQ ID NO: 16083 - DNA, 390 bp, Glycine max
  Peptide Sequence Number=SeqID_132861
atgtttcacttcataggtggtacacttctcatcaaagattgcttaagcagcaaggtctcaactccctccattcctccaactccacggacggagggagagatcttgaaatcttcaaacatgaagagcttcaacttcagtgagctaaaaactgctacaaggaactttcgtccggatagtgtggtgggcgtcaagaggcgtcaagttccaaccccttcaaggccatctagatcactaggaaacaatataacaagagttgtaagacatggagcagaaagtgtcggtgtcgacgcaaatgggaattcttttgatatcacaacaaagttgctgcacttagcatgccacccagctgagaattcaattgcttgtgctggtgcagatagcttaaagtaa

SEQ ID NO: 16084 - DNA, 345 bp, Glycine max
  Peptide Sequence Number=SeqID_132862
atggtaaaggaaagtgtcgttgtggtagagggctttccaccaaaaggcgacacgatagaggacattatttccccaaatagcaccatcatcgtggaagacgaagaagcactaaatggcattgttgtgacactgaaaattgaagaaccagtggtgtcgaatgcgggtgcaagagaggaagaggagtccaaggagaagaagggtatagaggaagaagaagtgaaggagaaatatagagggcatggagaagaggatgacaaatgtagggtttgtggggaagagagcatgcacggatttcaacttgtgcctgttagattcataccatgctttagacatcctgaatattga

SEQ ID NO: 16085 - DNA, 1043 bp, Glycine max
  Peptide Sequence Number=SeqID_132863
atggagcttgtatctaatctattaactcccgtttttgcaaggtttgttagttatgatactccagaagatgctcaatctgccattagtacgatgaatggttgtcaattaggtgatcaaggagaggtgttggcaggagctttgaagataatgttgtgtgatgataagcaacatgacatgcgaaagactgctgcatatataaaacgattagcaactctttcactgtgtgttggatcagcggattccatggcggccttggtcatagtaaagcatctccttcagaagaatgttaagtgcataaatttattggaaaatgacattggatggggtattagcatagatatcattttgatcatggttagttcagtgtctcatagcatagctctctcacccttccctttctcactcacggtccagccccaaagctttcctagcctcaaggaggccgtgaactccaaccccaagaagaagagaacttatgcccgacaagatgctcgtgcaaccgcggctgcggtttcaaccaaggccttacgcgcgacaagatactcgtataactatgatagcgacaacagcaaagggtgcaactcaaattgtgatatgaaacctgccatcaacggaaaatcaaaaagaagcccttgttctttctactcttcactccttcctaatctcgttttgttggaaattggaattccaactcacacttattctgtccccgagtcagagtcatatgaagtgtcaacaatagtgatagacctgggttcccacacttgcaaagctagttatgttggcgaagatgctcccaagagatgtgtagaacatacattgtcacatacttatgttgttggcacaattgataaaacaaacattgatggaactgctgatattaataatgagaactctgacaaaaccaagggaaaatgcaaactttatgtaggatctcagtcactaggatgccacagagaccatatggaggtgttgtcaccattgaaggatggagttgttattgactggaatattgtagacaacatatgggatcgtgcattgag

SEQ ID NO: 16086 - DNA, 294 bp, Glycine max
  Peptide Sequence Number=SeqID_132864
atggcgcgggtcgggtacgggtattgtctctccaatcccttacccgactcctcaacatatctccatacctgtgtccgatactcgacggattttaagtggcggggcgggttcgggttcggagtcgggacgggtctagtaattccatacccgtacccgtacccgacttttggttatcggggaaaacccgaacccgaacccatacccggtcaattcgggtattacccgtcaatcaggacggattcgggcgggtacccacggatacgggttttcttgccatgtctaattattctataa

SEQ ID NO: 16087 - DNA, 389 bp, Glycine max
  Peptide Sequence Number=SeqID_132865
atcaagtggacgtttcgtgtaaagtttatgtagcacctgttccaagaacggcaacggaggatgagattcgccctgtattcgaagaacatggaactattgttgagattgttcttttaaaacataagaaaactgggacacggcaaggaagttgttttgtaaaatatgcaacatttgatgaagctgatagggctattaaggttttaaacaataaatatacatttgctggggaatcatatcctgttgttgtcaaatttgctgatcgagaacttgaacgccttggggttcgagggttatgccgtaacatggaaaagaaagatcctttagaaggcaagcttctcatctttttctgggatagccgtggcctactatttgattatatgattgtctaa

SEQ ID NO: 16088 - DNA, 816 bp, Glycine max
  Peptide Sequence Number=SeqID_132866
atggcattggctgcaatcaaagggctgaataaaaccttcacaatgcgaggttgtgatcatcctttaattgttcgttttgcggatcctaagaagcctaagactggagaatcaaggggcaactatttatctgtgaatgcaaattttggtccttgttcccaagaaccagcagtatggccactgccaaattttggtgattccaatactggaggaattattctgcctcatgccccgtatcattccacaattgcacatccacaagttacttctcatatgcaaaactgggaacctggcgctactgtgttacaacatccatttcctccccatcaagtgcatccacaggtggcttcaatgtctttggggtcaattcaagctcccaaattgtcttctcagctatttattactgaggtgcaaagagaatcacatccagcagattcatcggttcaaaatatagagcagcagcttagttcacagctgccttctcagaccgaaagcaaccctagtacagttactggcattaccccgcctgatatgcctacaagttcccaagatgaagattttcctgagtgtgactggagtgaacactactgccccgatggtgataagtactactacaactgtgtaacttgtgaaagcagatgggataagcctgaggagtatgccttgtacgagaaagaatctcagaagcagcaggagcaggaggataattcctgtagtctctcacaattgtcattatcttcctctcaactagttggtcaaaaacaacaggaaacagatcatgaccacaagcaatcagaaacaagtcctgttgttggatag

SEQ ID NO: 16089 - DNA, 240 bp, Glycine max
  Peptide Sequence Number=SeqID_132867
atggagaacaatgatggtttgtggtggctaatggtggctgtggatgatggagaaaatcttcgcaaagatcccaacggtcagatcatggacaagtgtcatttgaagttgcagacaaaatttcgagaagatccaacggttaacgaaggctgggcagcgtttttaccgaggcagcttcatgtagctttctctagaggcttctttgagaagctagatccttatctatccacacccctctattaa

SEQ ID NO: 16090 - DNA, 570 bp, Glycine max
  Peptide Sequence Number=SeqID_132868
atggtggaaaaatttctacagaatgctcaagtggtcagtataggtgaaatcaacaatctcagacaggattgttactgcttaactgttggaacaattgacgaaatcattattgatgctccatggagttatgacagttgtcctaactgtacaacgacatttgatccatcaaaaggtggctcagcttgccgttcttgccataccagtgtggtcgatacaattccacggatggagcataatagggacaaaggaaacttccttctctgggatgcaacatgtatcaagctgtttggtaaaactgctggagaatgtcgagatgagttgatagcggctagggatgatattaaggaacaatcaagtaagggaaaaggaatagctgttgagccaaaaagttcaccaccaatttttgttcccacgccatcgttgtcacagtcttctgattacgatcctggaaactctacctgtttaactcccaccaaaaggattagttgtcaacaaaccagttttgatttcgattttgatgagcatgcacagtatcagttattaactaacaaacatatcagggctgagtaa

SEQ ID NO: 16091 - DNA, 246 bp, Glycine max
  Peptide Sequence Number=SeqID_132869
atggcatctaagaaaaggaaggctccttctacacctacccaggccagatatgacagatctaggaaactactaccagagaagaatgtggtagtttattacaccgagtttgacgagttcaaggaggaactcaagagaagacattgggatgagaagttaattgattttgctaatagtagcataaacattactattgtgaaggaattttatgctaacctctatgaccccgaggataaatcacctaagcag

SEQ ID NO: 16092 - DNA, 405 bp, Glycine max
  Peptide Sequence Number=SeqID_132870
gcttggaatatccagaccatgtcagagtttactcttgatggacccaaaggccgagtccgtgccatgactgttggcaacaatacactctttgctggtgcagaggatggtgtcatttttgcttggagaggaagctctaaagccgattctccttttgaactggttgcgtcactcactgggcacactaaagcagtggtttgtctggcggttggatgcaagatgctgtactccgggtccatggaccaaagcataaaggtctgggacatggatacattacagtgtacaatgacactaaatgatcatactgacgcagtcacatcccttatctgttgggatcaatatctgttgtcaagttcatctgaccgcacaattaaagtctgggcttgcattgaagcaggatctttggaa

SEQ ID NO: 16093 - DNA, 193 bp, Glycine max
  Peptide Sequence Number=SeqID_132871
atgcatctttgtttgacgaaaattgaaaacctcttgcaagccaacaggaaaagcctacgagattttccttcaatgccatacccactaggatatgccgccaagacgcaccaaaataatctcatctacaatgaattggcttatgacagggagatattggccgccgaatttgacaaatgctaccagtcgctaacag

SEQ ID NO: 16094 - DNA, 291 bp, Glycine max
  Peptide Sequence Number=SeqID_132872
atgcctcttagaattacgttgcagcgaacattgggactcaacagtattgtgggtactatcattgagaacaatgcagaggatgacagcgaagatgatacggtatctttggagcctgttgcgcgaaaggaagcacttatggcgtcaaacactcttcacaactttatgatacaatacaaaaatacaacacctgagctattgtatgcaataagaaaagttagagatgagctccaaatagacttgaactttaaaggaaaacagacaactattgaatcatatttcgatagagtgtaa

SEQ ID NO: 16095 - DNA, 519 bp, Glycine max
  Peptide Sequence Number=SeqID_132873
atgtttttgcctacagaacacttgctaataaagagaaaagatgcctatgttctggatatgctttcaacctatttaagcaacggaaaatcatctgttttgtataaaaaattagtagatcaggacaaaaaagcacttcaggtagcggctttcaaccagggacttgaagactacagtatatttgcatttttcgcaatcccaatgggacagactacaaagcaaactttacagtctgacattgatgctgagatcaaaaaattacaaacaactttaatctctcaggaagattatcagaaaattcagaatcagtttgaaaaccagtttgtaaatcagaattcaagtattcagggaattgctgcttcattagcaacaaaccacgtattgatggggaacaccaatttaatcaacaaagaaattgacatttacagatccatcacaagagaagatcttcaaaatgctgctaaaaagtacctgaatcctaatcaaagaataatcattaattacgtacctgaaaaaaaataa

SEQ ID NO: 16096 - DNA, 108 bp, Glycine max
  Peptide Sequence Number=SeqID_132874
atggcacgcagcatgtttgcttcgtgcccttatgtggtcacatctttcttgatggtttctagaggtatcatccccttcgaagaacatattgcggcagtaggtgtgaat

SEQ ID NO: 16097 - DNA, 627 bp, Glycine max
  Peptide Sequence Number=SeqID_132875
atggcctggatgggggcgacaatcagcgtcatccacagcgccatcgaaaacattgcccgtatggcagggggcgctgctcaggaatgcggctatcgacatatgcagcaggcggtaagggaaggaggggttaaacaccacggcgaaccagtccaccggcacgacctgaccgttgacgatctcatagccctgcggggtctgcatccagctgttcgacgagaggatccagaaggtagaaataatagtgcccaacgccaccatgcaggtggcgaagaagtgcagacccggcccgactttgttccagccgaacagcatcacgccgaggaacccggcttcgaggaagaaggcggtcagcacttcataggtcagcagcgggccggccatcaccagcccggagaccacgcccatgccaaagttgacggcaaaaatcttcgaccagaaatggtacagcgagcgccagaccggatttttggttttcagccgcagcccttcgagtacggcaaggtagcttgcgagaccgatggtgatggccgggaaaataatgtgaaaggatacggggcggagatcggacgagcagacgcagaaaagcgaattttaaccataacagttggcgtaaatttcacgctttag

SEQ ID NO: 16098 - DNA, 267 bp, Glycine max
  Peptide Sequence Number=SeqID_132876
atgcccggtttgagttctaacatcgtacaacacagactacctctgaatcctgagtgttccccggtaaagcaaaaactgaggaggatgaggcccgagacgtccttgaaaataaaagaagaagtaaagaaacaatttgacgctggctttttggctgtcactcggtacctggaatgggttgccaagaaggatgggaagataaagatggcgccagaggatatggaaaagaccactttcgtcaccctgtgggggatgtctgctataaagtaa

SEQ ID NO: 16099 - DNA, 550 bp, Glycine max
  Peptide Sequence Number=SeqID_132877
atgtccgccatggatatgattaagtccctttccagtaagcctgaaaaatttacgggtgaaaattttttctgttggcaacaacaaatgaaattctggcttactgaattggatttatactctgtgatttctaaaagagaaataaaaacttcaacttcctctactgatatagttcaaactgatgcaaccattaagcatgatgtttctgataaagatattttatgtcatggacgcattttaagtgctttggctgataacatatataagattttttgtcataccaaaacttctgttgagttatgggaagcacttgaattgaaatatggatctgctgaaaaaggtttaagtcgttactcttgtgaaaaaatgattgagtttcaaatgattgatggaaaatctatttcagatcagatccatgaatttgaaaacattgtttatgacatgaaattgaaaggaattgttttgcctgacattatgcttgtggctttcatgatatcaaaattgcctccttcgtggactgattttgctcgaagcttgaaacataaacatgaaa

SEQ ID NO: 16100 - DNA, 324 bp, Glycine max
  Peptide Sequence Number=SeqID_132878
atgttcctccagaaggcggttgcttctggaggaagcaacctggctcgcctgggcgagctgggtggcaagctcctcccctattttcctataaatagagggaggagtgaaggagaaagagaaaatccaagccgaggtgcttccgtaacgtgtccatgggtgattttgcgaagattttcaaccgttcttcgtcgttcgtcgttcgttcttcgtcgttcttcggtcttcaaccacgactccgcacgtattcctttcttggaagacgcacacgtgagccctcgcgtcgccctcccgccgaagggtaggttgcgaaaggaggcaacctag

SEQ ID NO: 16101 - DNA, 354 bp, Glycine max
  Peptide Sequence Number=SeqID_132879
atgactgcagggactaagctgattattaatgtatatagcatactgagagcatatgttgagactgagaacaagaatttttatggtcccggaggaccatatgcaatgtttgcaggaaaggaatgtagcagagcccttgcactcctgtcttttaaacctgatgacattaatgggaacctcgaaggtttaggtgaggaagagcttacaattttagaggactgggaatttaaattcatagaaaagtatccgaaagttggccagctcattgcagaacaaagaactcggcaaaatgagttcaaagaacaaactcaagacaatttggacaaccctaatgaatgcaaggaggaagaaaaatag

SEQ ID NO: 16102 - DNA, 243 bp, Glycine max
  Peptide Sequence Number=SeqID_132880
atggaagagaattccgaatcagctttgtctacgaacaaggaagctataagtaatgcaactaggaatctcatggagagttcgatcctggctcaggatgaacgctggcggcatgccttacacatgcaagtcggacgggaagtggtgtttccagtggcggacggctggaaacggctgctaataccccgtaggctgaggagcaaaggaggaatccgcccgaggaggggctcgcgtctgattagctag

SEQ ID NO: 16103 - DNA, 567 bp, Glycine max
  Peptide Sequence Number=SeqID_132881
atggcttccaaaaagagaaagagtattggtacaaggcccacatatcagtatgatacaaggaggttccactcctttgaggcctggacccgatacacaaataatgttctaggaagacatatactgcctaagaggaaggtagaaatataccatactgagctggacgagtttaaggctgaattggagacgtgtaacttccataaatgccttaccaatttagttgacatcagcatagatctagttttggtgaaggagttttatgccaatctttacagccctaaaggaccttcaccaaagcaagtcagggtcagaggccacgtggtgaagattgatgtagacaacctcaacacctttctagagacacctgtggtactagctgagggtgaaaccttacccgcatattccagatattgcaggttgcccgctgatattagagaaattgaggctgccttatgtatcccaggtcggggatttgttttaaatgctgaaggccaccctgggaagattctcaagtgtggagtgttctctcatactccaacctggctcctacttcccacaccccggacctga

SEQ ID NO: 16104 - DNA, 621 bp, Glycine max
  Peptide Sequence Number=SeqID_132882
agggctacacgtcctcgccttcagaggctacacttcctaacctttagaggactacacgtcgtcaccgtcaacgggttgcacgccctcaccttcaaagggctatatgccctcgccttcagagggcttcatgccttcaccttcagaggactgcacgtcctccccttcagagggctatacgccctcgccttcagagggctacacgccctcaccttcatagggctacacgccctcaccttcagaggactacacgtcccctccttcagagggctacacaccttcgccttaagagggctgcatgccctcatcatcggaggactacacgtcctcgccatcactggactacatatccttgctttaagaggactacacatcctcacatttagaggactacacatcctcacattgagaggactgcacgccctcacctttagaggactacacgtcctcaccttcagagggctgcacgtgctcgctttcatagggctacacgccctcacctacagaggactacatgtcctctccttcagagggctacacaccctcgccttagagggctccacgccctcacctttagagggttacacgtcctcacttttagttggctctacatccgcaccttaa

SEQ ID NO: 16105 - DNA, 495 bp, Glycine max
  Peptide Sequence Number=SeqID_132883
atgaattcattgcctagcgctgttcatgtgtcctccaccttcgagtctggagccccgcgaattgattgcctagcgctgttcgccaattctccattctccacttttattcggagccccatgaattcattgcctagcgctgttcatgtgtcctccaccttcgagtctggagccccgcgaattgattgcctagcgctgttcgccaattctccattctccacttttattcggagccccatgaattcattgcctagcgctgttcatgtgtcctccaccttcgagtctggagccccgcgaattgattgcctagcgctattcgccaattctccattctccacttttattcggagccccatgaattcattgcctagcgctggtcatgtgtcctccaacttcgagtctggagccctccgaattgattgcctagcgctattcggcaattctccattctccacttttattcggagccccctgaattcattgcctagcgctgttcct

SEQ ID NO: 16106 - DNA, 294 bp, Glycine max
  Peptide Sequence Number=SeqID_132884
atgccaaaggattacatgtttctcaaagttttattcaagacaaagaaatcaaagatattcaagatggatgatcaagacagtctcttgagtcttaggaagattacattaaataggaagggaattccaattgaagtagcaaaaggtttggccaagaaatttaagttaaaaaagtctttttcaagagatttactctctggtaatcgattaccagaggatgtaatcgattaccagtggccaaaactgatttacaacagtgtaatcgattacacatatatggtaatcgattaccagtag

SEQ ID NO: 16107 - DNA, 731 bp, Glycine max
  Peptide Sequence Number=SeqID_132885
atgagcatctgctcgttggaagacgtggccgcggccaccggcaagccgttctggttccagctgtacgtgatgcgcgaccgcgaattcgtcggcgacctgatcgaccgcgccaaggccgctggctgctcggcactggtgatgacgctggacctgcagatcctggggcagcgccacaaggacatcaagaacgggctgtcgacgccgcccaagccgacgatccgcaacctgatcaacctggcgaccaagccgcgctggtgcctgggcatgctgggcaccaagcgccgcactttcggcaacatcgtcggccacgccaagggcgtgagcgacctgtcgtcgctgtcgtcgtggacggccgagcagttcgatccgcggttgagctgggacgatgtggaatggatcaagcagcgttggggcggcaagctgatcatcaagggcatcctggatgtcgaggatgcgcagctggcggccaacagcggcgcggatgcgctgatcgtcagcaaccacggcgggcgccagctcgatggcgcgatgtcctcgatcgcggcgctgccgtcgatcgcggatgcggtggggtcgaagatcgaagtgtggatggatgggggcgtgcgctcggggcaggacatcctcaaggcggtggcgctgggcgcgcgcggcgcgatgatcgggcgggcgttcctttacggcctgggcgcatatgggcaggcgggcgtcaagcgcgtgctggagatcct

SEQ ID NO: 16108 - DNA, 417 bp, Glycine max
  Peptide Sequence Number=SeqID_132886
atggaattgatgagattgaatcaacatgaggagaatgataagaaaaagaaaggaattgctcttacagcttcatcatctactcaagaaggaagtgctaaggaggactcaattgaaatagacgaagatgatgatcttagtctatttgtaaaaagattcaacaaattcttgagaaaaaggacagaagattcatcctctactccaagatgttatgaatgcaatcaacctggacatctaagggttgattgtccaatgttcaagaaaagaatagagaaatctaaaaagaaagtttttaatgaaaagaaggcaaagaaggcctacattacatgggatgaaaatgatatggactcatctgaagattcagaaaacaaagtagtaaacctgagtctaatggccaagagttatgaaagcggtgaagag

SEQ ID NO: 16109 - DNA, 321 bp, Glycine max
  Peptide Sequence Number=SeqID_132887
atgtgcatcaagcaaaggttaggcttggacacatgcattaaaaccctatcaagtaaagagggttacagaaataaaaaagaaagccgacaacacatcatattggtgtcttatattcaggaacatggtcctggaaattggagggcagttcctgccaaaacagggttgtcaagatgcatcaagagttgcagacttagatcgactaattacctgaggccaggaatcaaacagggcaacttcacagaacaagaggagaagatgataatccatcttcaagatcttttaggaaacaggtacgaatcaatcttccaagcacctacttag

SEQ ID NO: 16110 - DNA, 363 bp, Glycine max
  Peptide Sequence Number=SeqID_132888
atgaccaaacttggtctctgcttgtcatctgctctggatgacaaaagggtgcggataaccgtaagaatgaccaaacttggtctctgcttgtcatctgctctggatgacaaaagggtgcggataaccgtaagaatgaccaaacttggtctctgcttgtcatctgctctggatgacaaaagggtgcggataaccgtaagaatgaccaaacttggtctctgcttgtcatctgctctggatgacaaaagggtgcggataaccgtaagggtcagtatgacaaagatttatggggcggccgacaaaagcaaagctcttgctcctacgtatcctccaatgaggaactcagacctacgtagttctggataa

SEQ ID NO: 16111 - DNA, 222 bp, Glycine max
  Peptide Sequence Number=SeqID_132889
atgagcctcagcctgcagagccagggctttacttcttttccgtgccctactccggaccagttcagggcaaaggtcacatggcttggagattggcctgaggcccgggcaggagaggcacctgcagaggcaccagcagaggctcccgacgaggcagatgaggcccgcgaggacgaggagatggccgatttacttgatttcttaggaggaagcgggtccacatga

SEQ ID NO: 16112 - DNA, 777 bp, Glycine max
  Peptide Sequence Number=SeqID_132890
atggcagaggtctccacgaaggccattgcctccctcacccagtattatgaccagcctttgagatgcttcacttttggggacttccagttaacacccacgatagaagagtttgaagagatcttgggatgccctctaggaggaaggaaaccgtatcttttctcagggttctatccctccttggctaggattttcaaagcgagaaccttggcgagccaagacgaatgggctccattcattgatgtcctggcactcttgatctttagagtggtcctctttccaaatatggatgagttggtggacctgacagtaattgacgcttttctcgccttttacgactgcaaggaaagcccggtcgtcgctatcttagccgatctatatgacatattcgaccgaagatgtgagaagaaccatgcaaggattttttgctgtacaccggccctctatgtatggttggtctcacacctttttcgcaaaggggagagacacattttccagctagaaggtcaccgctcgtgcgccaagaagaaggaggcaaactgggaccaactcttagcaagcaaagaaagatcgtccgtcaattggttccctcgatggaaggaaggaataaccgacgttctcatctcatgtggggaatttccaaatgttcctttgatggggacgaggggttgcattaattataatcccgtcctcaccataagacaacttggctaccccatgaggggggcacctgttggatcaagtggcctcagaataattaagaagggggggttgaattaa

SEQ ID NO: 16113 - DNA, 897 bp, Glycine max
  Peptide Sequence Number=SeqID_132891
atggatcattcacccggccagcgccagtatgcgtcgctggagatgtaccgcacctactatcagggcaaatatcagctcaacgatgagcagatggatcagtttgagcgcgaacagctggcgctggctgccgaattctccacgccgaaccgcaacgccatcgctggcctgtgccaggcgcgcggtattccggttgccagccacgatgatgccacggcggcgcacgtcgcggagtcacacgcggtaggcagcgccattgccgagtttcccaccacgctggaagcggcacgtgcctcgcgcgactgcggcatgcgggtactgatgggcgcgcccaacattgtgcgcggcggatcgcactccggcaatgtcgcggcgtggcagctggccagccacggcctgctggacatcctctcgtcggattactatccggccagcctgctggatgcggtattccgcctggtggccgacgagcgtaatgcgctgacgctaccgcaggcggcggcgctggtcacgcgcaacccggcacaggcgattgggctgcacgatcgcggcacgattgcggaagggctgcgcgccgacctggtgctggcacacaccgatcacgggcaggctggtgttctgatggcgcgcctcatctggctgaccgggccctcgggctcgggtaaagacagcctgctgaacgcgctgcgcgaggcgccccccgacaagctggtgatcgcccatcgctatatcacgcggccggccgatgccggcggtgaaaaccacgtggcgctgagcgaagccgaatttcgccggcgggaagcgctcggcctgttcgccatcagctggcgcgcacacggcctgagctacgcgctcggcaaggagattgaccactggctggcgcgcggtctcaacgtgctg

SEQ ID NO: 16114 - DNA, 315 bp, Glycine max
  Peptide Sequence Number=SeqID_132892
atgcaccgcaggccacagacacaccgctgccacctcatcaggctgatccagctaggtcatttggcatgtgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcgcggggaaggggagaaacgttaaggcgttggaccattaacgatctcttgtttttgaaaggagagaaacgttaa

SEQ ID NO: 16115 - DNA, 114 bp, Glycine max
  Peptide Sequence Number=SeqID_132893
atggctaaagcatttaatagatttggcatgaaaggagctttaattgtccattcaggtttggatgaaatgaatcctcttgtccctatacctagaaactacttgattattccgtag

SEQ ID NO: 16116 - DNA, 186 bp, Glycine max
  Peptide Sequence Number=SeqID_132894
atggaggagaaagtaaagctgaaaattagtggaggtttaaggagcacctacttgaagctcttgtgctctgataccacttgttggaagcttgcttatgaagcttctatggaggctggatctttgagcttcaataagcgaaagataaaggagaagaggttagaggagacgtcatccactagagaataa

SEQ ID NO: 16117 - DNA, 207 bp, Glycine max
  Peptide Sequence Number=SeqID_132895
atgcaatctcagggactttcactgcctcccgagcctctggttagtccctccggtcctcgagtgggtgtggaggaggttacaaatgcagatgctccagttcctgtacccactgatgaggtttccttagtggggcaggcacttcacaccttccttgcttggtcgacacatctggtcaagtctttatcacagcagcgtgcctcaaattag

SEQ ID NO: 16118 - DNA, 261 bp, Glycine max
  Peptide Sequence Number=SeqID_132896
atggaagcaaaagcgcaaaaatggtggtctaggggcgaaaaccagcaaaacccgtgggtgcaggggtgctcgcccaagcgagctaaccctgcatctttttttttccaaaaaaacaacgagcgttgtgttcccgtgtcctctagcatgaggttcttcatagtcatccacctattcatctgctcccccgaacacaagttcaagatcatcacaggatccaaacacaacaacacacagggagtgagttatcacattcctagctaa

SEQ ID NO: 16119 - DNA, 141 bp, Glycine max
  Peptide Sequence Number=SeqID_132897
atgagtggtgctacttctgattctgtcccacaatctattgaccctaattcgcagcacgtttgcaacccaatttcgagcattctcactgttgggaattgtaaaaacatgtcggagctaagagaaatacctttcgcaccgtag

SEQ ID NO: 16120 - DNA, 231 bp, Glycine max
  Peptide Sequence Number=SeqID_132898
atggataatcattcgtggtgttatccaacttgcattcaatgccacaagaaaactgacatagaggcagcaccattcaaatgcggatgtggcaaagagaatgatcaacctgtcctgagtgaatgtgctgagttgattggtcaatcaacggatgaagtcaacagggcatgttccaaggtagatagtctaaaccttgattgcaatgatgctccacaagttgaatctataagctaa

SEQ ID NO: 16121 - DNA, 219 bp, Glycine max
  Peptide Sequence Number=SeqID_132899
atgggtcgcgctcttcaaggcgcacctaaccctgggttcgtcagaagaaaaggcagaggcggcagtcggagacgacggcagacggtggccgaagacgacggcgacgccggagacagtcagaacgagatcgagaacaaaaacgagggaaatgctgcaaatttgttattaggtcatagccactcaagcattttcacatcaatttacccctttttaggttag

SEQ ID NO: 16122 - DNA, 702 bp, Glycine max
  Peptide Sequence Number=SeqID_132900
atggctcaggacgtcatgaaacttctgttccatgattgttttcatgtaatggctcaggacgtcatgaaacttctgttccatgattgtttgcctgcaagggctcaggtagattatcgtggctatgaagtaacagtggaaaactttttacgggtacttacaggacgtcatgaaacttctgttccaaggtccaagagtcttcttagtgatgaaggaagtcatattcttctgtatatgacagggcacgggggtgatgagtttttgaagtttcaggactcagaagagcttcaaagtcatgatttagctgatgttgtgaagcaaatgaaagagaagcataggtttaaggagcttctaataatggtggacacctgccaagcctctaccctgttctgccagcttcattcgccaggtgttttggcaattggaagtagtatgaaaggagagaattcatattcacctcatttggactcagatgttggtgtttcagttgttgatcgctttacattttacactcttgctttctttgagaggctgaatatgaatgacaatgcttcattgagcggcttgtcctcaaggtgttggggcttcaaaccatggcttccaaaaacagtaccgagatcccaaattaaagtgggtgtaggaatgagtgaatgtagattagtgtggcagagacaaagccatttggcagcatcgagagtggcgtag

SEQ ID NO: 16123 - DNA, 273 bp, Glycine max
  Peptide Sequence Number=SeqID_132901
atgagggctgttgattttcaaggtgaaaatagagacattcaactgctggtgcacgttcatgcattgggaatgcaaaaatcttccaatatgcctcacagggcaacacatacctgcccccaaaacttgtctcagaaaaatgacgatctcgggctcattccccgttggatcgtcatgaaatttgagcaccaccttcacaacccaattccgagaattctcaccgatggaaattgtaaaaacatgtcagagctaggaggaatacccttcacacagtag

SEQ ID NO: 16124 - DNA, 3440 bp, Glycine max
  Peptide Sequence Number=SeqID_132902
ctcagaacaaaccggcatttagccagcagcgcgacagcgataaagtcgtcgcatcaattactcaggataatcatgatgcgagcactcttattgttcttcaccttattcagcagcgcctttgccctgcaggccgccacgccaaaagacacgctggtggtggccaggccgatcgcgatgcgccacaaaaactcgcgccgctgctcgccacctcatggcagcccggcagcacgccgcacagcctggtgttcaatctgaaaccggacgcgcatttcgtcagcggtaacccggtgaccgcgcaggacgtggtgttttcgctgacgcgcgcggtgcagctcaacaaagccccgtcgtttattctcgctgagtttggctggacggcggacaacatcgccagccagttgcgggttgtgaacgatcatcagctggagattcagtggccggcgcaaattggtcaggatctggcgctgcgcctgctgaccgcgccggtggcctcggtggtggacagcaaaaccgtgcagcagcacatcaccgccaacgacagcggcaacggctggctgcacactcactccgcgggcagcggcgcattcagcatccagcaatatgtgccgcagcaggcgctggtgctgagcgcaaatccgcacgccagcccgcagccgcagctgaaacgcatcctgctaaaaggcgtggccgatgccggtgcgcgccgcctgctgattcagcagggcgatgtcgatgtggcgtaccagttgggcccggaccagatcgatgcgctgaaaaacgacaagcagttgcgcatcgaggccttcccatcgagcctggtctattacctggcatttaatacgcaaaacaaagcgcagccggcgctgggtaacccggcgctgtggcaggcggcgcgctggctggtggattacaacgccatttcacgcgatctgctgaaaggccagtaccgtattcaccagagcttcctgccgcagggctttgacggcgcgctggagaataagccgttccattacgatgtagccaaagccaaagcgatcctcgcgcagggcggtatcaggcccggcagcaaattctcgctgacggtgatcaaccagccgccgtacatcgacgtggcgcaggcgctgcaggccagctttgccaaagccgacgtgcagattgagctgcagccggtggcggaatcggaactgtggggcaaaatgcgcggccgtgatttccagtcgatctttatttactggggcgcggactatgtggatccgaataccaacgccagcgcctttgcctataacgtgccgggcggctctaaaacgctggcatggcgcgtcggctgggagattcccgaactgagtgcgcagacgcgcgccgcagccggtgagagcgacgccagccagcgccgcgcgctgtataccgcactgcaacagcgcgtacagcaggattcgccgttcgtggtgatgctgcagggcgcacagcaggtggcggtgcgcaataacgtcagccacgtgcagcagggtatcggcgtgagcctgctgtttttcgatgcggtagagaagagtcattacgcaatgccggagagcgcaaacattatgactaccccactgctgatcgcccagacgcctgaccttcaactgcatctgctgcccgccatggctaaccgtcacggactgataaccggcgcgaccggcaccggtaaaaccgtgacgctgcaaaagctggcagaatccttctccgccatcggcgtgccggtgtttatggccgatgtcaaaggcgatctttccggcattgcggccgcaggcgacggctcggaaaagctgctggcgcggctggcgaagattggcgtcaccgactggcaggcgcagaaaaatccggtgatgctgtgggatatcttcggccagcagggccatccggtgcgcgcaacggtgtccgatctcggcccgctgctgctggcgcggctgctcagccttaacgaggtgcagtccggcgtgctgcaaattatcttccgtatcgccgacgatcagggcctgctgttgctggacttcaaagatttgcgcgccatgacgcaatatatcggtgacaacgccaaagcatttcagacgcagtacggcaatatcagcagcgcctcggtgggcgccattcagcgcggcctgctggcgctggagcagcaaggggcagaacacttctttggtgaaccgatgctggatatccgtgactggatgcgctgcgacgctgacggcaaaggcttcatcaatatcctggcggcggaaaagctttatcagcagccgaaactctacgccaccagcctgctgtggctgctggcggaactgtatgaacagctgccggaagccggcgatctggaaaaaccaaagatggtgttcttctttgacgaagcgcatctgctgtttaacgacgcgccgccggtgttgctggagaaagtggaacaggtgattcgcctgattcgctcgaaaggcgttggcgtgtactttgtcacgcagaatccggcggacataccggataatgtgctcggtcagctgggtaaccgcgtgcagcatgcgctgcgtgccttcacgccgaaagaccagaaagcggtgaaaagcgccgccgaaacgatgcgcgccaacccggcgttcaataccgtggaggcgattcaggcgctgggcaccggcgaggcgctgatctctttcctcgatgagaaaggcagtccgtcgatggtgcagcgcgccatggtgatcgcgccgggctcgcgcatggggccggccactcctgatgaacgcaacagcctgatcaaccattcgccgctgtacggcaaatacgacagtgccgtcgatcgcgaatcggcgttcgaaatgttgcagcaaggcgtacaggccgcgccgcagcaggccgatgcgccgcccggcaaaggcaatagcgtggcggtggatgacggcattctgggcgggctgaaagagattctgttcggcagcaccgggccgcgcggcggcaagcgcgacggcgtgtctgctcggtggacgccgccgttaatcgccctctgctatgatcgtggtatggataaatatcaacaattaaaacggagcaagcgtctggccctgtcgctgctgctgattgccgccgcgacctttgtcgtgacgctgtttctgccgcccacgttctgggtgctggggctgaaggcgattgccgaagcggcgatggtcggtgcgctggccgactggtttgcggtggtggcgctgtttcgtcgcgtgccggtgccgtttatctcgcgccatacggcaatcattccacgcaacaaagatcgcatcggcgagaatcttggccgcttcgtgcaggagaagtttctcgataccgattcgctgctggcactgattcgccgccacgatccgtcacagctgctggcgcagtggctcaatacgccgggcaacgccgatcgcattggccgccatctgctgcag

SEQ ID NO: 16125 - DNA, 207 bp, Glycine max
  Peptide Sequence Number=SeqID_132903
atgcgtctaccggggaaggagagtctgccgatgggatcccccataaccataaatgagattttggatgctagcatttcgtttctaaatgaccatttagaggaaacaccgggttcgacaaaaatagaagaaaatcactcaaagtgtatcaatcttgcacagtgcggggcgagaaaaaaagtcgctagcgcacgggattttggctggtaa

SEQ ID NO: 16126 - DNA, 654 bp, Glycine max
  Peptide Sequence Number=SeqID_132904
atgttgctgcctcgatggaagcggcaggcgccgcggctgggccgcgccgaatggatcggcctgctgtggctgagcctggccgggaacctggtgtatttcctgttgctagtcacggcggtgcagtgggccggtggcgcggcggcgtccttgattgtcggcctgattccggtggtggtcaccctggttggcgtgcgcgagcagggggcggtgccgctgaggcagctgctgccggcgctgggcctccgctggttggcgcgccgaccggacctgtccagccatgactggtcgctgctgaccggcgtgacgactggcggcctggccctgctgctggtgccgatggccttcatcggccacaccggcagccattcggcggcgcagtggagtggtttctgggcgatcagcgccggtgtggcagtggtggcctcgatcctcggcaacgcattctggaaccgcgccagccgcctgttgccgctgaccctgactggccagatgatcgtgttcgagactttgttcgcgctgctgtatgccttcgcctggcagcagcgctggccgacgctgctggaggcgctggcaatcgtgttcctggtagccggcgtgatgctgtgtgcgcatgcccaccgcacaccgcgggcgatcgccgaacatgccggctga

SEQ ID NO: 16127 - DNA, 660 bp, Glycine max
  Peptide Sequence Number=SeqID_132905
atgcatttgcaaaccaatcctgcttcccataccaaccatcatgacctcaaacaattttctgattggctactagacataggcgatggcaaacttggagaacctaatgatgaatatgacaaaatcaccatcccagatgagtttcttatcaaggactttaatgatcctatccagtcaattgttgaggcaacatatccagacttattacaaaactatagcaacggagatttcttgcaaaagaaaattgttctagcctctacaaaagatgttgttgatagtataaatgactatgtcctagctttgatacccaccgaagagaaagagtattgtagtgttgataaatctgatgaactactcaatcctgcatttggaattctaacacctgaatttctgaactcattgaaaacatcaggaatacctaatcacaagttaaaaatcaaggttggcactcccatcatactattacgaaatttggaccaggcagatgggttatgcaatggaactaggcttattgtcacaagacttggttcaaatatggttgaagcaaagattattactggacccaatataggtcataggacatacataccaagaatgaatatgtctccttctaattctccatggtcattcaaactaattagaagacagtttcatttgcaatga

SEQ ID NO: 16128 - DNA, 519 bp, Glycine max
  Peptide Sequence Number=SeqID_132906
atggctgagagaaagggacctccatcccctactagagatcataggatgttgttagatgccttaagtcaaaggatgaaccaagttttgagggagcatacgaagggaatgtatgagaggcttgagagtttagaaaaccaaaatctgaattgggaaaatgagaaacatggagatatggatagacatgagtttgaggctccactagtgacatcgtggactgaggaaaatccagggaggcgtttttatggttgttgtctatacaaggatacaggtaggagagggtgtaatttttttcagtggcatgatccagttggcaacaatcgtcaaaagaaaatcattgtagggttgatgaaggaggttgatgaattgaagttgagggaaaaggatttgcaaaccatgattagtgagatgaagatgaaggaaaaatgtttatggattgtattggttgtttgttggcttaagcattttatgaactacttcaggcatgtacaactcaagttgtccatttggcataatacataa

SEQ ID NO: 16129 - DNA, 1461 bp, Glycine max
  Peptide Sequence Number=SeqID_132907
atgaaggcatggccagctagggtgatatacccttcttcacaagagaacacaaatagcctcactagatacccttcttcttcctcccactcttcttctcctccttcaatgggaatggtctatgccgacatggactctctctctctttgttcccactacggtactgtggtttcttctcatcaccaagattgctatgtctccaacgggggcacaaactggggttttcccttcatgagggaatgccccaacaacagtgatgatgttgctgaagaagaagagggtaaaggctctgatagcagtactggtgaagacagtgacaaagttaaccaccatgctaataactctaacgatgagaacaaccctaatgagaataattctaatagtggcggttcggggcattccaagctttgtgctagagggcattggagaccagcagaagattccaaactcaaggagcttgttgctctttatggccctcagaactggaacctcattgctgagaagttagaaggaagatcaggaaagagttgtaggttgaggtggttcaaccagttggatccaaggatcaataggagggcattcagtgaagaagaagaagagaggctgatgcaggcacataggatttatggcaacaaatgggccatgattgcaaggcttttcccagggagaacagataatgctgtgaagaatcactggcatgttataatggcaagaaagtacagagaacagtccagtgcctacaggagaagaaggctgagccaatcttcttctgtttacagaagagtggatgaaattaacacaacaataacaacgacaaacagcattgttgtctccagagacacagaacaacaagcaccaccaccaccaccctattgtgtcaatctctcaaataatggaggacttgccaacaacatcatcaacaacaacaacaacattaacatgatgtctagttttccatatgctgctgcatccttccatggaggagtagtgccttcttctggtgggattgaatttggcttaaattcctcaccccacatgactacagccaaagaaccattctcaaccaccaagctggcccctcctcatattgccttgtatcctcaacaaacatcacttgatttcttttcaggtgttagaagcagcagtgacatggtgggagagtattttggccagaaccttcatcaccaacaacaacaaccttcatctggtttctaccctcaatacccccaatatgtgatgctaatgaatcaccaccaccaacaaaacaatcacaacaacttttacggtttctcaaattccacatcacagattttattaggccacagtgaagcctcactatcatcatcagtggcagcagaagaacacagagatcatcaaaacttgagcagtgatcagtgccccccagatgcaacaacaacaattccacctccatttattgacttccttggagtaggagccacttga

SEQ ID NO: 16130 - DNA, 690 bp, Glycine max
  Peptide Sequence Number=SeqID_132908
atgaaagactttctggattacctcgactccctcaaaaattacgagaaatcaggagttcccaaaggtgccggcaccgattccagcgacggtttcgatcttggtagaatgagatgcctcatggagcgttttggtaaccctcactccaagttcaaggctgttcatattgctggaactaaggggaaggcatcaacagctgcttttgtatctaatattctgaggaatgaaggttattctgttggttgttacactagttttgcacatcatggacagcaggctttatttttctcaagcagtccacatatcctgaccatccgggagcgcattttactgggaaaatccggccatctggtgtcagcgaaattgttgaatgatctctttcgtaggatcaagcccgatattgaccaggcaatgaaagaggaaaatggttgcataagccattttgaggttttcactaccatggcattcctcctatttgctgatgagaatgttgactttgctgttattgaggctgggttagggggtgcacgagatgcaacaaatataatatccagctctgggcttgttgcatcagtcataaccactataggtgaagaacatttggcagctcttgggggttctttggaaacaattgcaatggcaaaggcaggaatcataaaacaagaccgcccagttaagtgtttctctctatag

SEQ ID NO: 16131 - DNA, 258 bp, Glycine max
  Peptide Sequence Number=SeqID_132909
atgtcactactggaacctctacattacacaaacacatcacgtgagtttgggactcagagtcgtacaatgatgcactcatttccatgggaatacgatgccaacaaggaggtggcaaacgcgacgaggaggttactcggtttgtgttccaggggattaaggattattggtaatgtgaaggttagggatttgggagtaatgacaatgtttgcatttacgggttctagggaggaagtttactggacgatgcacatgggtgag

SEQ ID NO: 16132 - DNA, 162 bp, Glycine max
  Peptide Sequence Number=SeqID_132910
atgacaagcaacggcggctcgtggtggccaccaatggtcgtgggtggtggaggaggagtctctagggtgcgagctcgtctcgctaagtgggagtccacttttggcgctaagcacgacttttcatgcttagtgcaattcttctcgggttgggatttgcgctga

SEQ ID NO: 16133 - DNA, 309 bp, Glycine max
  Peptide Sequence Number=SeqID_132911
atggatggtgatgatgaaaatgaggatgtccttccttgggatccaataacatgttccgggcaaaggactaaaaagagaaaggaaccctttggtgttgaagatgttgcacctaatacaaaaataggtcaagtcaaaggatcttcatcccttagaggaaaagagcaaatgatagaagttgaagataatgcaatcttggaagaatttgaaaaggagtttcaaggcattgattttgggaattcaaaagaaaaagttgaagggcatgccccattactagaccatgaggaatatgattatattgggaaggtgtaa

SEQ ID NO: 16134 - DNA, 327 bp, Glycine max
  Peptide Sequence Number=SeqID_132912
atgagggatcatcaaatcctcctagcaccgatcctaggtggaaatattatactcgaggacaaggaaatagttgtgtgtgcaatttgtagcaaggttacaaaaggtggaattactaaagcaaaagaacacttgatggcaaagccatggattgttgcagcttgtgccaaatgtcccaaaaaagttagagtagaactatggggatatttgaaggataagaagaagcaagagaatgaaaaatttcaagggatgcgtcaacattttcttgaagactatagtgataatgaagaagaaagagctgttgatgaagggtttgcaaatattgaataa

SEQ ID NO: 16135 - DNA, 384 bp, Glycine max
  Peptide Sequence Number=SeqID_132913
atgggtcgggtgtttgtcgtcgaccacattgtgaacgaacatcctttaaatgtaataagtggccctaagtggctctgctacagtggcccatctgttaccatactgggcatgggccgcgatgatggtgccgtcctcttgggccgagaaggggcggtgctccacagcggggctaagctatttgcaccatcggagccgacacgagttgctggaccttcccttaatgtagcggttctctctgctgcatacctagcagtcatgttgggtacgaaattgcgactaaaagttgggtacgaaattgcgactaaaagtaccattttgtttccaaataggctgacccaatacaaagctagttatatgtcgaaaaagttcaagttccttctttaa

SEQ ID NO: 16136 - DNA, 678 bp, Glycine max
  Peptide Sequence Number=SeqID_132914
atgttagcttgggaatcgcaaaggtttttaatagttaaaaagttagcagaatcaaccttattgatctttgctggacaggacaagggtaaagttgacaacgaaggcaaccaacgtgtaagggaaaataggcgttatttcttttccttgtatgcgaggtacatttgcgaggaaaaccttattcccttgaatctagagatcgaagcaacttgtagaaggaacaacactacaagaagaagaagagaacaacaagaagtgcaaatcaatcaaggagagagaggatcctcatctgaattatcctctccctctcctgtgaccagtccacatcctttctctaaagaacgggtcatggcagaataccatccacagaggatgacgctagaggactactctagctctactacacctcaatacttcaccaacatagccagaccggacgttcaagctgctaacatcatatatccacatttctttatccaattgatccaagggaatctattccatggcctgctgagtgaagagccatacacacaccttgccacatatatcaagatttgcaacatggtgaagatagtgagagttctagaagatgccatccgcctcaacctattcttcttctccttggccgatgaagcaaagagatggcttccctcgttcaaagggaatagcctacatacatag

SEQ ID NO: 16137 - DNA, 108 bp, Glycine max
  Peptide Sequence Number=SeqID_132915
atgagtagtgaaagaggtgcaattcagcttggatttcacgcaactttcgcgctaagcgcgattgccacacttggcgagtatgacggtaatctcgtgctcagcacgtga

SEQ ID NO: 16138 - DNA, 630 bp, Glycine max
  Peptide Sequence Number=SeqID_132916
atggctctacaatttctgaaacaccccgtaaccatctcacgaggcttgcacaacgagacaaccttaacttttatttctcggctacgaaatccaaagctcctattctcagtgagatgcgaagacaatgctcagattgcaacttctttcaggagctatgctactgcaaaatcagaaaaggttttgcaagtgaggaagaaaaagcggttggatgaaatatgtgttgaaaaatatcagcaatatagtagatccgtcatccagtcatggattttgcaagcatgtggtaggaatggcctcatctgttgtgaggtttgcactgaggtatttgtaaccttttcttcagctcttagagaaggcaaagtatatgtggatgggaaggtgataaataaagctggtacccctgtgcctggcaaagctgttgtggagataaaagctgatgttcccaaatatgtatgtagagctggacataagttagaagctgccgttgaactgcttggtgttgatgttgctggtaaagtagctcttgattctgggctttcaactggaggatttactgattgcttacttcagtatggtgcatcacatgtttatggagttgatgttggttatggacaggttacattagaggtgtga

SEQ ID NO: 16139 - DNA, 375 bp, Glycine max
  Peptide Sequence Number=SeqID_132917
atggctccgaaacacatggagcagttgacgcaaaaaatcagggaccagctggaggagtcgatcacagaaaaagtgactcgacaagtactcacactacctcctgagcctgtagatggtcgttcagctactcatgtcagcacaaaggaaaatgttgttatctggttttgttcgttgcataataggctagacttcctgaaaggaattattatcaggtcagatatatttttcaatacatttacattagcattatttgggaacatcaatattttaattgtgcaattcacatccatgtttgtattgaacaatgctttgaaaggatttgacgatactccacaaagtaaatccaaggctactgctaggtggattgttgttaaa

SEQ ID NO: 16140 - DNA, 399 bp, Glycine max
  Peptide Sequence Number=SeqID_132918
gtgatgcctgccgtggtcaatgccatgaaggaaaatgcagcattagtgactttggttaaaccacaatttgaagctcgtagatctcaagtaggaaaaggaggaatagtgaaagatcctgctgttcatcaagagagtagtctttacagcaatatggcttctctatgggtttctgcttgtgctgctttaagtaagactctcaaattgttctacttctacaaagaaattggagaactcttcgagctaatagtccttgagaagattataaagggagtagagaattttggtttctgttgtaaaggttggattgagtctcctctgaaaggtgctgagggtaatacagaattccttgttcacttcaacagaacccataatatagaggttcctgaagatctggagtaa

SEQ ID NO: 16141 - DNA, 516 bp, Glycine max
  Peptide Sequence Number=SeqID_132919
gtcaatcatgtcagcggtgctgtcgacgcggacgaaagcgcgcccggcgctgtgcggcggcaggttttccagcagcgcggccagcgcaggcagcgaggaaggatcgcccgccaggcagtagaaatcggccgccggcagcatcggtttggggccgcccgggttgctgataccgattttatcgccgattttcgcctggcgcgcaaagtcgaccgctgggcctcggtgatcgtgaatcgcaaattcgatgtccacttccgcctgttccgggcgcacggcgcgaatggaataggtgcgcacgatcgggcgcacggcgtccgcggcccagcgcgggccgttttcggtcagcgtcggcagatccggctgagtttggtcggcgagcggcaaaaagactttgatgtgcgcagcggcggcgttggccgggtagtagcgcagatcgggcgcggtaaaggtgatgcggcgcaggtgcggcgtaatgtcctgtacggcgctgacggcgatcaggtagggggcgcgtga

SEQ ID NO: 16142 - DNA, 390 bp, Glycine max
  Peptide Sequence Number=SeqID_132920
atgaaggcacaggccatccagaagcagaatactgccccccacgttttgtctcgtgggggttatgattatttggagcagaagctcctggctgagaagaccaagaagaagatgcaggaagctgcacagttaggaagtgttgatggcgtcatcgaccctccatccccggattcgtttgaggagcaggccacacagggatcgttcgtcccccatggacaccaggatgttctggtcgctgctattggacgtccagagcaccctggacgtgtccgtgttgttggagccggtgtcaccatcaagcaatactttggatcggctccacggacgtcccgcagcgcttcctccctgcctcctgacgaattacagcagctgactcagcagatcagggactag

SEQ ID NO: 16143 - DNA, 1449 bp, Glycine max
  Peptide Sequence Number=SeqID_132921
atgtcagaggttaaggaccctgcgataaagctttttggaaggacaatttcgctgccacacacacacatcaatgattctttttcttctgcttctgcttcaggacctgcttgtgccccttcatcttcctcttctcctcgtgaagttacctcttctgcaacacaacaacagcatgaacctgaggaaccatcaaggaaagtacttacctcatcacaagatgatgatgatgcctcacatcaaaccacagaggatttgaaatcttccacaacatcttcaggcatatttgagaatcctaagactccctcagcagaaaccgagacatcaataccgaaatcctccacaaatggagaaaaaagcgagaaaagtgcttctgaagaaaaaacactaaagaaacctgacaaggtacttccatgcccgcgatgcaatagcatggaaaccaaattctgttactacaacaactacaatgtcaaccaacctcgccatttctgcaagaactgccagagatactggacagctggaggtacaatgagaaatgtgccggcaggagccggtcgtcgaaagaacaagaattcctcggcgaccgtgtcacattaccggcacataatgttctctgaagggcttcagggagccacactcaatgcccccaatggattgcataatgctgttatgacctttggtcctgattctcccctttgtgatacgatggcatctatgttgaacattgctgagagagcacaaagttgtgttccaaatgggtttcatgtaactgagccaaatagttttgtttcctatagaaaggaggaggaggaggaggatggtactagtggtcactctactggagttaattctgttgcaacaacatcaactttaagccatagtggctcacatgaatcattggataaaaaagttgttgaaggtttcactcctcaatttccatactttccaagtgcaccttggccttatcctatccctcctcctacatttttcccacaagggtaccctttatcattgtatactacacctgcatattggagttatatgccaccctcttggaataacaatatatcagctatctcaccccaatcttctgttaacaactctgtctctaaccctactttggggaaacactcaagggatggaaacatcattgcttcatccaattcacaaagagaaatgcatgacatggagcacaacagctcagaacacaatgccttgatccccaagacacttagaattgatgaccctagagaagctgcaaagagttccatttccatgtggtcaaaactagggatcaagaatgatgacaaggccagttccggaggccttttcaaggcttttccatcatccaagggaaatgatatcaatcatcaaatggttgaagcatcatcgccggtgttgcaggccaaccctgcggctctatcgcggtctcttaccttccgcgagcagacctaa

SEQ ID NO: 16144 - DNA, 204 bp, Glycine max
  Peptide Sequence Number=SeqID_132922
atggataagtggttttattgcgggaaaggtgaggttggggaagcacgggatgggagatttgggatttggggtttggggcttggggcttgggctagggttagggtttggggaagaagaggccttggagtgtttgatatgagaaaaaatggtataaggacgccaagtacatatcttgatcatgagatcccattagataatgaataa

SEQ ID NO: 16145 - DNA, 1137 bp, Glycine max
  Peptide Sequence Number=SeqID_132923
atgaataatttttcttttatgacacacattctaagatggttaagacggttctaccgaaccgccttagaatgcactagggtcaagttaaataacgacgggtttatgtatagaaacgtcattgtttttaccacaagcgtgtacataattaatcttgaaatccctagacaagctagcgcttccatgagtctcgtctcttgcgcctcctttgaacccttcctccgtctcttgcgttttcgcttgcaaaaagacgaagctctactatacacgatccacgttgtcctcgcaaaaatgcggagctccacgcaacgaggtctactatacacgtcctcgcaaaacccacactcccacgccaaaatgatgtcgtcttcgaattcccaaaaccccgccgccgccgccgcagcatcgtcggaggcccaaggaagctcctccgacactctctccgttgaccccgcgctcaccctctccgtcgccagaaacagcggtggctccgccattctcagagcggccttcgaccgatatagagggatcgtgttcaagaacatccctggtgtcgtgctcaaagccccctctttcttgtctttttgttttgctgctaccactactgtgctaccgatctccggtcaccaacaggttagatgtggtgctgtacaatctgtgacattgagttcatcttctgaagaagcccttgatggaataattggttttgggcaatcaaatttttctatgctttcacagctttctgcatctagaaaggtgaaaaaagtattttcacattgccttgacaatattcgtggtggtggaatatttgccataggggaagtggtggaactaaaagtcagcaactccgttggtaccaagatttttgccttagaaaagaagactgcgaagttgagaggaattgagaaggctctagttgcacggcatgaagctggtcatgctgtagtaggtactgcagtagcaaacattcttgctggacagccacgtgttgagagtcttcatattgaattggcttctttggtttgtcctgaaaagttgggaatacctaaatacaaagtgggagaggatgatgggccattggggaatgggccgagaagaggcctactaagagagagacagagagagggtgccgggtgttag

SEQ ID NO: 16146 - DNA, 726 bp, Glycine max
  Peptide Sequence Number=SeqID_132924
atggatctattaattagttttgtgacgtatagacaacaattgaggttgcaccgttcccaaaaagctatctactgccacttacaccattgggaagatgcatcaattaattatctgcaccctactactaaactatcctgcaccacactataccctacgtttcgctgcaaacttcatctcaccatcttttcgccataccttcaccttcagagcagcagcaaaatgagtatcacatcctccactgtgtcaagtagaatgtcatatccgattgtgaggccaccgtcgatcatgcaattcatggaagccttccacaacgattgtagaagcaaacttcatgatgatgaaccaagcaattttgatgatgccaaaagcccaaaaataccatcattcttccatcgacaatgggcaccaaattaccccgagtttgttcacttcagatatgacggagctctctaccaaatacgagtccgacagcagcgaggcaaattttttttaatggatggactcaaagactttagaacacagttacaaatctacgagtccaccttgatcaacttctttgcctgcgatcataactgcatctttgatgtacacttcattcctccactagatcaacagacatgtgccagaccacgactttcatcgaggcaacacatctggactgttgaaataactcaatgcatccttggtgtccctcaacttctgattttaaaatgtcgcatgatgtga

SEQ ID NO: 16147 - DNA, 366 bp, Glycine max
  Peptide Sequence Number=SeqID_132925
atggtggaagggattttgtactgctatgattatttggggaaaatcaaagggttcaatgtggggcgcgaggtgtgggaggagttgaaggggttggagaagggtttgcccagatttgaagggagtacgcaattgatggatgaatattttggtaaaagagccattgatggggtggtagtccctagaaaggggatgggccatgcatctagagatactactaatgctagagatcgaaatgctcaggaagactatccaaggctctctgttgctgttgccggtgattggaagtttgatgtgtacatgggcattgataagtttgttcatgggatgatagatggtgctcaaaaaattacagctcttaatgggtaa

SEQ ID NO: 16148 - DNA, 1218 bp, Glycine max
  Peptide Sequence Number=SeqID_132926
atggctgaagctcattctatttcctcccctatggtgtctaattgcaagctatctaggcatggtgttgatgcatctgacgtggatgataggcgttccacctcaggggccgccatctttcttggcccgaacttaatatcttggtggtctcgcaaacagaaagtcacagccaggtccagcactgaagttgagtattgtagtttggctcaaacttctactgagttgacatggattcatgctctactaacagaattgcaagttcccttcactactcttgttctttatggtgacaaccagagtgctgtatccattgctcacaatactatgttccacaatcatacgaatcatatggaaattgatgtcttcttcgttagagaaaaagttttggccaagcagctttcaattttgcatatcccagctctagatcagtgggcaaatgtgctgattaagcctctttcttcagcaagatttgaagttctcaggggaaaactcaataagtctaaattgatgtgtgaaaaacaaagtggaaaggtaattaaggtgataaggacagatgtggagctgaatatacttcacatgactttcaaaaataattgtgatgaagggatgcttcatgaagtacctactccttatacaccccaacacaatggggtggctgaaagaaggaacagaactatcatgaacatggtgagaagcatgttaaaaggcaggaaattgcctaagtatttttggggagaagctgtgtcaataacttgctttattctgactagaattcctacaagaaggttgcaagagataactccagacaaagcttggtcaagaagaaaaccaaatgtttctcatctcaagatctttggctccttaagctataagcatgttccagaacaagtggggaagaaactggatgatagaagtgatccaatgatcttcattgggtatcatcctactggagcctacaaactatatgatccaaaaggcaagaaaatagtaataagcatatatgtgatagtagatgagtcaaagtggtggaatagggatgagtgcagtcccgaagcttgtgtggaaatgagattacttgaggaccagattactgaaccagaattatcagaaaccattcaacctagaagacctcaaagaaataggcaacaacctcggaggttgaatgattgtgagatactgcctgacaaccttgtgatagaagaaggagtatggtccatctag

SEQ ID NO: 16149 - DNA, 468 bp, Glycine max
  Peptide Sequence Number=SeqID_132927
atgtccaccacccttagtgaacctttttctgagtctgttccagcacctacttacatccctgttaacactcatcctatgcaaacaaggtccaagtctggaattcacaatcctagactgcatccttccttatttcttgctcattctgaacccaaaacagttacacaagccctgaaaaattcagattggtttgctgccatgcaacaagagtatgatgctctgctgaaaaacagaacttgggacttagttcccctaccttctaatagacaggctagtgggtgtaagtgggttttcagagtaaaggaaaatgatgatggttccatcaacaagttcaaagcaaggtttcttgaggagtcagtatttatgacacaccctcctggctttgaggttgaagataggtccctagtttgcaagtttaacaagaccctctatggcttgaaacaaccccaaggcaatggtttgataggctga

SEQ ID NO: 16150 - DNA, 621 bp, Glycine max
  Peptide Sequence Number=SeqID_132928
atgagtagagagagaaacagtgggtgggagagagttaggaacagaagaaaggctattgagagggacagagtgagtttgagagaggatcccagacggacctacgtcaggaacagggatggacagcaacaatgctataatcgagcaaactggagggatcatactgacatatcatctttctacttcacgcaatttcccgaggacataatcgagaaggacctgtggtaccacttcaaaaggtggggtgatatgagggagattttcatctccaaacaaagaaacaacaacagtaggaggtatggttttgctagatttaaaggggtgaatgacgcgcacagtttagaaagacaactagacaagatcgtcattggtggttcaaagttgtacatcaacatcccaaaatttgggagagagatggcgagaaaggtagcaccagaagacaaaccaatggggactgatgagaaacatgaaaatgaagcaactcaacggaggcaaccacatccgagaatgaatccagtctcgtatgcggcgatggtggcgaggaacaagtggaattcaggacaaaggaagacaccacacaacgagcctcaatcgcgaaggctcgctctcaacggtacatcttga

SEQ ID NO: 16151 - DNA, 566 bp, Glycine max
  Peptide Sequence Number=SeqID_132929
atggaagcaaagacacatctcttttggggggagagtgacccttatatctatttcttttcatttttcagggttcctaacagagtggtggacaatatgtctcccaaaggaaaaagggggcttaggcctcaaagacatcaggaccttcaacctagcattgcttggcagatggagatggaacttatttcaacatcaaggagaattatgggccagggacctaaaactggttcttcatcaatcgcagcaaggaaatgcctttcaaaatggaatagtgtggaagtcagcaaaatcagcttatccagcaaatgggaacttacacggacacaggatgggagtggaatttcatatggaggagaccattacccaactggccaatactcagcacaaagtgcttacaacctgctgatgggggaatccatgaatgagaaccaggacggagtgtttgaggaattatggaaactaaagattccaaacaaaatatccttctttggaacaacgaccaagatgcaacccatctattcttccaatgaagtaaaaccctccctctatggtgggaatctttgtcctgg

SEQ ID NO: 16152 - DNA, 366 bp, Glycine max
  Peptide Sequence Number=SeqID_132930
atgtctcttccacctctaagacctcacaatcactcacaaactcatctcaagctctcaggacggcttcctcttcaagctctggtctctgcagatcttaacacaacaaaatctctcaaactctctagaactttgatctttctctctctagaactctctagacatgcagaagttgtagaagcaaagcttcatggtgaattaaagaacaattcaagagttcaagataagaatcaagaagaattcaagactcaagaagaaagtctagagacaagaatcaagattcaaggttcaagatctcgagaatcaagatcaagattcaagactcaagattcaagaatgaagagaagactcaatcaagataagtcttaa

SEQ ID NO: 16153 - DNA, 241 bp, Glycine max
  Peptide Sequence Number=SeqID_132931
atggctctccatcaaccgcaacagggtaatgcttttcaaaatggaatattatggaggcaaaatcagatcatccagcaaatgggagctcacaaggacacagggtgggagtggaactttatatggaggagaccattgtttgacagtgagatcgccatggctggtagtttccaaagagatgttgaaggcaagtcaatccacccacatagaagagatgattgggtttggaaagcagatccaagtg

SEQ ID NO: 16154 - DNA, 375 bp, Glycine max
  Peptide Sequence Number=SeqID_132932
atgtttgcacagtctggccgttgggatatggtaataacaccttttgatgtctcgttaagcgagaagggtgcgctaagcgcaattccaaccagagagggaattgtgctaagtgagcaggggcgcgctaagcgagccatagtgcagtggaacgtgaaaaacacgatttttcactctcctcttctccaaaatgccacccaaaccctaaaacctcattttctaccacccaagatcacctgtggccaccgtgagttgctgttgcttgccattgaacccacacaccaagaggaatacttcaatcagagcggaatcctcagaatcctcctcaaggattcggtggagaaaatctcccaatccttcatttcatactttatttga

SEQ ID NO: 16155 - DNA, 717 bp, Glycine max
  Peptide Sequence Number=SeqID_132933
atggcagacaacaccagaatgaaagagctcgccaccgacgtgaagaaaaacgccgacgatatcaagaagttgtacgatgaagttcagatccagtttgagcgttttggtgctgtgacggatgctcgatttcaaaccatggaggatctgcaatcgtccactgatgggaaactggataaaatcaacgaagctctttcgatgttattacgcaactcctctcagacctcttcccatggtgttacgaactcaaacaaagctccgtttcaggtaagaaatgtcaagctcgatttcccccgttttgatggcaaaaatgtaatggaatggatttttagagctgagcaatttttcgattattatgaaacccctgataaggatcgattgactatcacatctgttcatcttgatcaagatgtggtaccttggtttcaaatgatacagaaaacacatccttttaattcctgggctgagttcactcgtgccttagaactggattttggaccttcaatctatgattgtcctagagctaccttgtttaagcttagccaaactgggactgtgagcgattattatcggcaatttactgctttagcaaacaaggtctatggattaagcactgatgctcttgttgattgttttataagtggcttaaaccccgatattaggagagatgtgatgattcacactcctattaacattgtgaaagctgtgtccctagcaaaa

SEQ ID NO: 16156 - DNA, 462 bp, Glycine max
  Peptide Sequence Number=SeqID_132934
atgaagttttatcggggaagtgttgatggaatctttttcatagtcaaagtggttagtggtgtgatgtatgtgaaggattcttgggtgaatgggaaaagcttggaaagtctcttcccaagattatttcttatgtcggatcagaaagaggaggttgtgagaggaatgatgggaagttgggtggaagataggtggaggtggtcattgagatggaggagagtaccctttgagtgggagagtgaactcatttttcaagttaaccttcttttgtcaaatgtgcaggtacacaaagattattccgattcttggttgtggttagagagtacatggagtacctactcttctaactcggcctatcaagcacgttttgcggaagaagatgctcatgagttaagctcaactcttgcggaggtgtggaagttgaaaatccctctcctaaagtggcttttcgcatttggagggtga

SEQ ID NO: 16157 - DNA, 448 bp, Glycine max
  Peptide Sequence Number=SeqID_132935
ttgccacatggagtatggaaatgcatttgaggacaaagctaatactatggatatttcagaagatgctcctgatgatctagaaggtttggatgcttcagctgcacatgttgcgaatttgctgtctacagaacctgcagacattaagcttggtgttggagggttcagtatgggtgcagctactgccctgtactctgtgtcctgctttactgctggaaaatatgggaatggcaatccttatccagccaacccaagtgcagctgttggtttaagtggctggcttccgtgctcaaagaccttgagtaacaagttacaaggggtagatgaagctacaaggcgtgctcagtcctttcctgttttgctgtgtcatggaaaagggcaaaaaacaaagtgcagtgagcctgcccagtctgctgcagataagtatgaccctcaaggcagtgataattag

SEQ ID NO: 16158 - DNA, 2004 bp, Glycine max
  Peptide Sequence Number=SeqID_132936
atgaaggaccggttccccctctcggcgatagacaagcttctcaacgagcttggccgtgcctcctggttttcaaagcttgacctgcaccaagggttccaccagatcctcatggctgatgaagacgtcgctaagactgtgtttcgaacccacgaaggccactataagtatcgggccatgcccttcggactttgtaatgcctcttcaacgtttcaggcagctatgaccactatgctccgcccattccttagccagttcgccatgcaccgttaccacctcaagtactccaagtgttctttcgaacaacgacagcttgattacttgggccatgtgatctcgggccgcgacggatacgccgccatcgccatccccctcacctccttactgtgcaaagaaacttttggttggtcgctagagtcacaagcagccttcgaacaacttaagaccgccatgacttcggcaccggtgctggcccttccgaaatttgatttgcctttcaccttggaaactgacacatttggcatcaccatgggagccgtcctactccagcaaggccaccctataacctttttcagcaaggcattctgtccacgtgtccaccaggcctccgagtatgtccgggagctatacgctatcacaactgccattcctaaaaacaataccacttggccaaactattgggcttcgactatgatatctagtacaaggccggcctctcgaatgtcgtcgccaactcattgtctcgcattccggtacctgaggtccaaacgcgttcgtgaagagccttcatcttgccctgactaccacatgtcaagggacctcctcttctacaagaacgcgatctgggtcaatcccagcaaccctcttatttcggcgcttctcatgaagttccatgctacccctattggcggtcacctagggatgaagaagattctccatcgctacccctgctcgcacggctacacagtcctcctagttgtcgtcgactgcttttcaaaaggggtgcaccttggtgccctactggcgcgcttcactgcgtacaaagtcgcggcattgttcctcaatattgtgtgcaagcatcatgggttcccgcgaagcatcatctccgactacgaccctatcttcattagctccttctggcgcgagttgtttcgcctgaatgacacctcactatggatgagcacggcctaccacccccagtcggacgaccaaactgaggtcatctatgggaaaccaccacctgcagtaccctcatacattcccggcgccatcgagaacaaagatgttgacactatgctacacactcgtgataagattcatgccaagctccgaagccagttgctcaaggctcagacaacaatgaagcaatatactgacaggcatcaccgagatgttcattacgacatggggcagttggtttatgtgaagcttcgcccttatcgacaatcttcctaccgcggccaccaccatcccaaacttgccaaacgttactttggcccttttcgggtacttgaacgcattggtagtgtagcttatcatcttcaactcctactcgactccaagctgcatcctgtgttccattactccctactacgagctcatcatggcccccttgaccttctaacatccctactcccacttgacgccattaatcatcaccccattcttgagcccttaaccattttatcatctcgcgaagatccttcgacgtcaccaccaaccagaatggtcttggttcaatgggagggccttgccccaaaagactcgacctgggaaaagtgggacgatgttcaacattgtgtccaccttgatgacaaggtggtcttcccaggcggcggagatgttagcaacaacctcgttatcagtaccagcaacttggaccataatcatacaggtcatgcagcccatgcagagtcatgcaacgtaacatgtgaagaagcagtctcgagccaaggaagacctaggagaagcaacgctcgaccaagctacctgagggacttcgtatga

SEQ ID NO: 16159 - DNA, 399 bp, Glycine max
  Peptide Sequence Number=SeqID_132937
atggaggaggcacataagggggagcaagacaaagagaaaggaggggaagaagtgaagtaccgtggcgtgagaaggaggccatggggtaagttcggagcagagatcagagacccaacaaaatctacaggaagacaatggttagggacatttgacacggcggaagaagcagctagagcttatgatcgtgcagccattgaattgaggggtgctcttgcaatccttaattttcctgatgagtactatgctcatctcccttttgtatcatcaaacccttctatttcaagtaatggaagttcctatgctgcacaacagaaggaggttattgagtttgagtgtttggataacaaggtgttggaagaccttcttgagtccgaagtgaaaagaaggaacgaggactaa

SEQ ID NO: 16160 - DNA, 369 bp, Glycine max
  Peptide Sequence Number=SeqID_132938
atggacattctggcgtggtggtgggagggaggtgggtggtgtaaagatcgcggagaaaaggaagaggaggtcgttaatggcgagaatggggtggtcaagcaatggtgtgatatcaagggggtgtggatagcagagataagtggaaaggggaagaagtggaatgggtgtgtatcatacgccatagttggtgggccgaagcttgggaaggggagaaggcggaggtcaaccgtgaaggggtggccttggagctggacttcaaccgtcgggcaccaagataggcattcaaggagtgagccattacccaccataatgcggagtggttcagtctttaccgcttggaggttaagcaatttagccacttgcggttga

SEQ ID NO: 16161 - DNA, 357 bp, Glycine max
  Peptide Sequence Number=SeqID_132939
atgaggcaattgcaagcaagcttaggagctgatgaagagggtaggaggagtgttgttgatccaacatttcgcaaggcatggttggatcaatcattgaagacaatgatggagatttatgtgaggtgcttggttaaagagctagcagataggccatctatagaatatgttttgtggaacttgcagtttgcatctcaaaagaggtttagggctgaccttcaaggtaagatggaagggaatgaaattgtggctgaaggtccacggtgcagtcttcatagtagaaaggtttacagtgccctgtctgttgactatttaaagatgttcttgctgaatgtcccagcgactgtggttgcactatga

SEQ ID NO: 16162 - DNA, 1133 bp, Glycine max
  Peptide Sequence Number=SeqID_132940
atggatgtcaataatgcctttcttcatggaaatattgaggaggacatatacatgtctcaaccaccaggatttattcatcctcaactccttgatcatgtttgcaagtttcaaaaagcactctatggccttaaacaggctcctcgagacaggtttcaagctttgaaacaatgcatgattagcattggattcacaaactccaagtttgatgcatctctatttgtttacaagcatgacctcgtgttggcctactttcttgtttatgttgatgatcttctgctcacagctaagttctctctcatagaccttggagaacctagtcattttcttgggcttgagttggtccctacacagaatggtctcttcctcacccactactacaaaaatagctttttacaacatccattctacaacggttgtatgagaaccgctttagaaagtggcacgctgaccctctcactctcacgctctcatactgattcgctcactcgctccaagtcctgctcccgccccgccacctccgaccttgctccctcccccgccgccgctcctgcgtcgtccgcccccgcagcaccctctccgatctcttcacccgcgatgacaccaggaaaacaaaacattctcactctacgtggtgagatcgtggtcagtgagggacattcgtttgaggtggagtttgttgagggaggagtggggcatgaggtcgaagtcaacgaagcatggctcgcccttgatggtcatggaccggacgcgggggaatcggctggtggtgctacggggggatacggcgtagcagtttccgatgaagagctttgtgcggcacgctttccaggacgttctccaggacctggtccggcagaggggagagagctgactgcaacctatgaaagtggagagttacatcctggttaccttaaactagcattggcaaagtcgttgaataaaattctggaggaagagtacatgcttgcaaaaccagcaagagatgctgcagccaaagcaaaaatggaagttgaagcaccatcaactgaggaagtgccacttcatgaagaaattgaatggaatataagtatccttgtgcactgtgactcctatcagcttgctcttgggactatatgctccgctctgctcataag

SEQ ID NO: 16163 - DNA, 888 bp, Glycine max
  Peptide Sequence Number=SeqID_132941
atggttattggctacggaagattaggaaaactagatgaggagattgatggatgggaattaagattgggggaagaagtggatgaaaatagaggtaagcactttgctatatccaataaagatacagggttgggatttggattgaagcttgttggtggttatggtgctagccatgggaaacaaagacaaccaaagacacgtaatttggagtactttggtgggcatatgaccaaaatggtaatggtagtgaagcatggtgtgggagggtactggcagtttcaactaggtgacggtgtttgcattcagatgagccattatgttgaggggtgtatggtggagtggttaagtgagatgttccatgtttttgaaggaagggaaggatttgctttagggcttgaaggtaagggtgaccaagacactgatgccacaattttattgagagacgactatggacatggtgaattgttagaggagacaaagaagattgcaacttgtacacctgatcttcagtctttccttgtagaagaaccactcccattgtcaggctctttacctcaaaatgccaagggaaaattcaacagactcagaaccattaccattggcaatgtgaagctgatcctgaccagtgtagtaattggaaatagagagatgactgatgtcattggtcacatggaaagtcatgtaggcaataacatgttttggccgtgtgtcccttacgatcacaatactgccaatttgatgaggaggaatttggttgtttggagccttgactattgtctccgaaggaggaggaatttgtgcaatttgatgaggcatgatgagaaggttagaggcagtggtaagttccacaagagaggttgtatgggcggaagccataggaaaaggctgtga

SEQ ID NO: 16164 - DNA, 990 bp, Glycine max
  Peptide Sequence Number=SeqID_132942
atgggcctaaagagcctcccaagtcaatatgtccaacctttggaagagagggtgatcaatgttgtacctcaagagtccattcccatcattgacatgtccaattgggatgacccaaaagtacaagatgcaatttgtgatgcagctgagaagtggggcttcttccaaatcatcaaccatggggtgccccttgaagtattggacagtgtcaaggatgcaacttataggttttatgggctgccacctaaggaaaaagttaagtacacaaaagagaattcttcaacaaagcatgtgaggtatgggtctagctttagccctgaagcagagaaggccctagagtggaaggattatctaagcctcttttatgtttctgaggatgaggctgcagcaacatggccccctgcatgcaggaatgaagcgctggaatacatgaagagatctgaaatcttgatcaaacaacttttaaatgtgttaatgaagaggctaaatgtgagtgaaattgatgagacaaatgaatcattatttatgggttcaaagaggatcaacctcaactattatcctgtttgcccaaatcatgatctaacggtagcaatagggcgacactctgatgtctcaacactaactgttctccttcaagatgaaactggtggcctctacgtccgagcaccgaaccaccacggctggattcatgtaccaccggtctccggtgctatagtgatcaatataggtgatgcactccaagtaatgagcaatgggagatacaagagtattgagcatcgtgtgtcagccaatggaagcaagactagggtttcagtgcctatttttgtgaaccctagaccctcagatgttattggccctttgcctcaagtgcttgctagtggagagaaggccctgtataaaaatgtgttgtattcggattatgtgaagcatttcttcaggaaagctcatgatggaaagttgacagttgaatatgccaagatatgccaagtttaa

SEQ ID NO: 16165 - DNA, 546 bp, Glycine max
  Peptide Sequence Number=SeqID_132943
atggttgacaacacacgcatgaaggagcttacaggggatgtcaaaaggatcctggagatgatggaaaaccgcaataaagaatatgctgctcggtttgagaccttagaaacaacactggagtatatcactggctatgaacaatcacccttttcaggtggatcagatgttttacaatggatattcaaggctgaacagttttttaactatcataaaacaccgggtgagcaacgattaattattgcttcaattcacttggataaagaggttgtgccctgctaccaaatgatgactcgtgaaaattcattcaaaacatggattgcttttacgcgagccttagagacagaatttggcccatcaccgtatgaatgtcctagatctcagttgtttaaactcgctaaaattggttcagttcagtcatattacgtgcagttcacggctttagctaatcgagtacaaggaattacacaagaagctctattggattgctttgtgggaggattaaaacctgatatcagaagggatgtcattgcacaatcacctacatga

SEQ ID NO: 16166 - DNA, 441 bp, Glycine max
  Peptide Sequence Number=SeqID_132944
atgatgaactcgctaagcgagcatgctacgctaagcgagttcatcaatactcattgtatcctgcaagagttggctcacaataggccaatcatatctatggagcattttcttgagcaagtagcctggcctgaagctcaacttctattggtgagacccaacgaggctgctcagcctaaacccacacctgtgcaggtcaatccagagccagctaacccacaatctccagtggtgaatccaccttcttcacctgagcttgaagcagttccgccatctcctcctctgattgtcatttctgacgcatcatcaaatgaagcagctgcccctcctgattcaccaattacagaaacaactgacccccatgtttccccaattggaggaattgttgatctttctaattcgtcatctagagaagttgttgctctcaccgaaatcccagtttaa

SEQ ID NO: 16167 - DNA, 321 bp, Glycine max
  Peptide Sequence Number=SeqID_132945
atggctagacatgatacatgtcagggtttggtttggttcaaggataaaagggatgccccacattatttccatgacacaaatgcaaaaatgatgatttggaaattttatgcaaaactagtcatgcatgcacctatgtggacactcaagtggtggcggtgtgtctattgcccactactggccatcccaatgctgttgtggtgtttcgccctgcgcctgcctgggggcgcagtacttcttgatgaaagcccggttaatgtgggacctaatgaccttgttgggggcaacgggcactccgtagaactaacagaggcccgtaattag

SEQ ID NO: 16168 - DNA, 273 bp, Glycine max
  Peptide Sequence Number=SeqID_132946
atggtgaaaaagtttggaaaatttctcaaaagatccaaagacaaaaaattctctaagccttcaaagaagatagaaagtaacaacaacaccttcacatgcttcaaatgttggaagcaagattcaatggatgactcctcaaccattgaagaaactaaggtaaattctgaatttgaagaagttttggaaacatttaatgaaatacatgaagaagtgaaaaggcttgttgtttcaaacaataagttgagaagtggtctaaaattgcatatcacttaa

SEQ ID NO: 16169 - DNA, 741 bp, Glycine max
  Peptide Sequence Number=SeqID_132947
atgagaggcgctccacttctcatcgcagttatagcagaaccctttattgcagcagaatgtcgtctcctcgagagtgcgttgaataaagggtggcttgggtttgctagggttggggttggggaaaggatgggaaggcgcgcgaggacggtggcttgcagcagggacaatggttggagggcttgtacctcacaacggatttccagggcaaggccagaaataaaacaacttaaaaggaatggggtaggaggtgatgaagccgttccggtgcatccattagaaccagctaagggttgggccatcgagataaaaggaagcggcagtgatacggtcttcgtcgggggttccttggtagtcaaaaaattgggtgatcttgaagatccaacccaagggatcgtgcccattgaagtgagggacgtccagctcaacggggtgacgacgttgtgggttgagtggctagttgggtcaggcgattgcacgggacgtcaaccttgcttgccaactcagaatgcttctcggacagggaagaaatggcttcttctaatcggtaagtggtggtgcgtcaagtggtatggtctgccattagagactgccggcagatcggaccaatgttacgagcaaagggaacaggaaggggatgcgggttcgctaacaactaactataatagcatagttaatgatgaacgatcatgggtgatcatacgaagtccctcaggtagcttggtcgagcgctacttctcctag

SEQ ID NO: 16170 - DNA, 372 bp, Glycine max
  Peptide Sequence Number=SeqID_132948
atgcttttcatggacacgaacaaaagtcatagttcggctccaacttggaagaagactgcgcaatcgcgtgtccttattggactagtgttattctccggtggctccttccttccttcgccatggcgttctacgtgctctcgcgtcgtttatcagctggatccaactcaacgacgctcctcgccctgcgttttgcttcctcttccagatccttctcctcttccttcagggaagaaagagatacctttggacccattcaagttccctccgacaaattatggggagcacaaactcaaagatcgttgcagaacttcgacatcggtgggccccgcgaacgcatgcccgaacccatcattcgcgcttttggcgtcttga

SEQ ID NO: 16171 - DNA, 756 bp, Glycine max
  Peptide Sequence Number=SeqID_132949
atggcatattggacagatgtatctgtcaacactgttgagctgctactaaagctaacaacatatagtcggtctacaatccgtgagaagtcattcgctgcgaaaaccaagagatggttagaggaaacaccttatatgaaaaatatcattcttatgctcgcccttgttggtacctgcatggtgattggagatggtattcttacaccagctatatctgtgttatctgccgttggtggcatcaaggtgaatcacgctgatttgagtaacgaagtagttgtgctggttgctgttgtaatattagttgggttattcagcatgcaacattatggtacagataaagttggttggctatttgctccaattgtccttctttggtttcttctaattggaggcataggaatattcaacatctgtaaatatggcagcagtgttctaaaagctttttcaccattgtatatataccgctatctacaacgagaaggcaaagatggttggctttcccttggtggcattttgctcagtataacagggacagaagctctttttgctgacctagcacactttccagtttcttctgtacagattgcatttactctgctagtgttcccttgccttcttttagcctactctggacaggctgcttaccttatgcataacttggatcattcagaagatgcgttttatcgttctattccaggtttgttatatttgtcacactctatattggaattgccacttgtgatactcctatgctgttag

SEQ ID NO: 16172 - DNA, 486 bp, Glycine max
  Peptide Sequence Number=SeqID_132950
atgtctctggatcaggtgcttttcaaattggcgaataaatggaagggaactgaaagaataaagagcttcttatggaaactgtcacaaatgtatttattggaaaaagtccaattttttgcggttaagttagacctacacccacattctaagagtatcaaaacctataaacctattgcgagttctaaacagctcaatgagaataaggtggacatcaaatggaaatttccagattttggagatgttgctctaaattgtgacggcgctgtgaacgatggaggtggtggtttcagagctaatttaaaagccatactggttggggttaagctggcttggtcgagaggattcacaagaataagagtggttctgatgcatccttgttataatgtggttcaagggattcatgaagtgcattccggttcaggcaatattatttggaacaacatactaaaggaagctaatcaagttgacctgcaaagaaagccttaa

SEQ ID NO: 16173 - DNA, 321 bp, Glycine max
  Peptide Sequence Number=SeqID_132951
atggaagatatctcagattacaagtgtaacatcaatagcagtgagtacttccctctctccggaatagcgaggaagaggaactcaatagttgaccaaagtgaattccaaattgtatcgattcatcagagttctttggacgaacatacaactgtcagggacttatttgcccttaaagcaaatggaaatggtcgcctcttggcccttttctttgctaaagaaagttgcatttctttttctgcacccacaagcaaaaccgctgaaccactcaactctcttcggtttttcagattacaaaggtggaagagcatagacaccatttag

SEQ ID NO: 16174 - DNA, 179 bp, Glycine max
  Peptide Sequence Number=SeqID_132952
caacacgcctaacagcccttctaccacaaccacaaaaaagaacaacttgtgatgaaactcttgttcgagatgatgatgcattgctcctctgcgacattgttgatagtaagagagaacgaaatggtgcgatttttgagggttatgttaaagaagaagaagaagaagaggaggatatatga

SEQ ID NO: 16175 - DNA, 249 bp, Glycine max
  Peptide Sequence Number=SeqID_132953
atggcaattttacggaagcattacgggtgtcccggaagccccggaatcccagtggtcaacaaaacggggggttatggtggccatctagctcgcccaggcgagctagttacggaaacttacgaatttcgtaacgatacttgttttctttccgtaatgttacggaaccttgcggattacataatcatcctcttttggacttacggaatgttacggaacctcacttatttatgcaacgatgcttccatttga

SEQ ID NO: 16176 - DNA, 1095 bp, Glycine max
  Peptide Sequence Number=SeqID_132954
atgaagttcagatacaaggagcttgaggaagccactgatgggtttcaagcactgataggaaaaggtgcatctgcttcagtcttcaaaggaattctcaacgatggaacttcggtcgctgtgaaacgaatcgatgcagaggaaagaggggagaaggagttcagatcagaagttgcagccatagctagtgtgcatcatgtgaaccttgtgaggctattgggctattgcaatgctcctacagcaccaaggtaccttgtttatgaatatgtctcgaatgggtctttggattggtggattttttccaaaagggtatctcagaggcgccgtggagggtgcttgtcatggaatttgaggtacaatgttgctattgatgttgccaagggacttgcttatcttcaccatgattgcaggtcaaggatcttgcaccttgatgtgaagccagagaatatacttttggatgagaattttagagcacttgtttcggattttggtctagcaaagctaattggtaaggaagagagccacaaggaagtgtctgctattagaggaacaagagggtacttggctcctgagtggctcttagagaagggtatttcggacaagactgatatatatagttatgggatggttctcttggagattgttggaggaaggaaaaacgtgtgctcggtggaaattgatgaaagggccaataagtccaagagaaaatggcagtattttcctaagattgtgaatgagaaagtgagggaagggaaattgatggaaattgttgatcctaggttgttggaatgtgggggtgttgttgatgagacgcaagttaggacattggtttatgttgctttgtggtgtgtgcaagagaagccacgattgaggcctagcatgcctcaagttgttgatatgcttgaagggcgtgtaagggtggagatgccacctgataccagaatggttgttgttgattttctatgtgtggatgaagaaagtgcaactgatagtaatagcatgccaaggttggactttgtgtcgaatcaaagaacacaaagcaatgtggagtcttcttctacctactcgtttgctaccaccattatgtcaggaagatag

SEQ ID NO: 16177 - DNA, 798 bp, Glycine max
  Peptide Sequence Number=SeqID_132955
atgggaacctctgcgaacgctgtcgcaggtggtcgtggcggcgcccctgtccccaaagacgtcgactacgctaattacttctgcacctatgctttcctctaccaccagaaggagatgctctccgaccgcgttcgcatggacgcttacttcgacgccatttttcaaaacaaacgccacttcgctggcaagaagactgttttggatgtggggactggaagtggcattcttgctatatggtcggcacaagcgggtgcgaggaaggtgtatgcagtggaagcaaccaagatgtcagaacatgcgcgtgcacttgtcaaagcgaataatctccaggatgtagttgaggtcattgagggatcgatggaggaaattaccttgccagagaaagttgatgtgatcatctctgaatggatgggttattttcttctgcgtgaatctatgtttgattcagttataaatgctcgtgaccgctggctcaaaccaacaggagtgatgtatcctagtcatgctcgcatgtggatggcacctatccggactgggatagtagatcacaaattgggcgattacgagtcgactatggatgattggcaccactttgttgatgaaacaaaaacctactatggtgttgatatgagcactttaacgaggcctttttcggaggagcagagaaaatactatctacagttggatgatggtttgtacaaacacaattctatgtgttttactagattgaatgatcctaatcactacttggaactcatttttgctgggattgtgagaggattgcatgctggagtgtaa

SEQ ID NO: 16178 - DNA, 261 bp, Glycine max
  Peptide Sequence Number=SeqID_132956
atgaaagagaaaaaggaattggtgttgtgggtgctccagaaggttcgtggcagcggtggccagcagcagcgatggtggaggaagatcctttgcgcttcttcgatgattctgtcatttgatgaagttttaatgaatttcaattggtgggtgaactctggaggtggtggcggtgcgtctgttgcccactactgtgatgcctcgccctgtgcctgcctgggggtgcagtacttctcgatgaaagccctgttaataggggcctaa

SEQ ID NO: 16179 - DNA, 222 bp, Glycine max
  Peptide Sequence Number=SeqID_132957
atggattctctcttcttcttcttcttcttctttctcaagccaaccgctaaatttcaaaaaaagttgcaagttccagatgtggagttttcaaagccctgcttcaattactttctgggtgtagagctatcaagagaaaggatatatatggtgcttgggagcaatatcttggactggaacacgatgatagtgctccaaaaaagccctatgcagtcaaccgggtaa

SEQ ID NO: 16180 - DNA, 1194 bp, Glycine max
  Peptide Sequence Number=SeqID_132958
atggagaataatggggttagtgttgacggtcagtcagatcactttagtagtgtttctgataataatctgattcacgcatccatgccttactatggagtcattgaagatatttgggagcttgattacggtcaatttagagtgcatgtgttcaactatcgatgggttaatggcaacacaggcgtaaagcaagacaaactgggctttactttagtagacctgcaaaagggtggttacaatgacgacccattcatcatggcagtgcaagctagacaagtgttttatgtccaagatccgtccaactggagatggtcagtggttgttcaaggcagaaaattctctatgactgactatagtgatggttcatcagttgatgtcagtgacatgtcagccgtctgtcaacaaatgcccatcataaatgccacagatcaagatgatgttgtacatgcaactcgaaatgatcattatgaaggtttatgggagaataatcaaatgaagactagacaatccactcggctaagaaggttgactgcgagaagcttggatcagccacggcctacagttaatgtaaatccagccactggcagaagatcaggccctcataaagagaagtttcatagctatctaggagttgttgcacgagacaagattccaattgtgcactccagttggaatgatgaaccagaaactctaaagaatcttatatgggattacattttggtcaaattcgacatccccgagggtgacaatgcaaaaaagaaggggcaagcaaaagatgatccttttgttaagtatggtattgatgtagcaacttgggcggaatttgcaaaaagccagcaaacccctaattggcagggaataaagaaaaaggcgcgggagattcaaaaatacaatgactatcctcacttgtctcatggaggttacgagcttcttgaaaataaattaatggaccaaaaaaggaagacacaagaacaacaagttgaatttactgaaaacccctcattgtatcttgacccaccatcccccattttgagacaaatgaagtggaagatggtctgcacaaagcaatatggccagatgaactctactgtcgccaaagaaatatctgacaaaattgactcttcagaagagcagaccatgcagggtagctttgttccttctggacgtcaggatatattgaacacgactattggctga

SEQ ID NO: 16181 - DNA, 255 bp, Glycine max
  Peptide Sequence Number=SeqID_132959
atgaagattgccaacattacattgaaaatgggtaaaggaatcacaaaaagaagtctacataggaccttacctaaatcgtgcaatgaaaacattaagcacaagtgcacaaggaatggcagatcaacttgtgcctcaatgattgaagcaaagtggttttatgatggaacaccgataagcaaagagaccatgacaacactccggcataaatgggcgggatattttctccaaattaagaacaacttggaagttaaataa

SEQ ID NO: 16182 - DNA, 117 bp, Glycine max
  Peptide Sequence Number=SeqID_132960
atgaaattcttatgcctcatgttcaatcaagacatttggacaaaaggagaaaggctacacagtggaaatggttgcagtggcaacgatgcattgttagatgtcaatcactgtccataa

SEQ ID NO: 16183 - DNA, 294 bp, Glycine max
  Peptide Sequence Number=SeqID_132961
atgattataaggggccaagacatttataatagccaagataaggctattacttcaccttcctctagtgaaagtgaagaaacaaaaggggaagaatctagtgaagaaatctacccccaagaagaaggacaacctttaatggttaaggaggagtgtaaggagacatacattaaagaaacttcccctattagacaacctccacatcttgtcctttgtaaaaagacacttgttagcactgccacacctcttgggcttgagattattcctcaagtaaaggaattgttggatgagagtttg

SEQ ID NO: 16184 - DNA, 228 bp, Glycine max
  Peptide Sequence Number=SeqID_132962
atggctacagctaggtgggtactcaagcatccagtttatggcattgtgatactaaggcttgggatttacacaaaacatgaatctggggatcccacggtcatgtggttccgcatgccaccagactcttgggtgacggtaacaaaaagtggggtggtcgacaaaagcagggcttttgctcctacgtatcctcaatttgtgatgaggaactcaaacctacgtagttcttga

SEQ ID NO: 16185 - DNA, 925 bp, Glycine max
  Peptide Sequence Number=SeqID_132963
gttaaagagaaaattgagaaatcttaacctagaaccaaccattgaagagcagattaataatctgcttattgaaaccttagaggaagaaacaaaaacttcatcttccacattctctgaggagaacctcaacataatcaaacaagatgaccagccatcatctacggacgatgatgaacgagaaatcaatactctaacaagagaacaagatctcttgtttgaggcaaacaattccataccagatccccaggaaaagaaggtttttctggaaaaattaaagaaaactctggaaaccaaacccagaccaaaagattttattacaaataataaattcgatgttagtaatatattcaagagattagaaaacacttcagcaaaatcaaccacaattcaagatctccaaatagagatcaataattttaaaaaggaagtaaaggaacgtcgtcaacaacaagaaattcatcagatcatcctatctcaacttgaagaaaacagtgattctgagagtatagaaaagaatgtagaaaatgaaaatctggaagacaaaatgtttatgggattaatcaacaagattaagatccaaaaattttacataaacattagaataattattaatgattttgtcttggatacaatggccctatttgatacagggactgattcaaactgcattttggaaggattagttcctacaaaattctttgagaaaacttcagaaaaattgaccacaacaaatggcttaaaattaaagattaactataagttatctagtgcaattattgaaaatcaaggtcttaggattaatacaaactttcttttgacttgccgcatgcattctggaatagaagaaaacatattgtcgatctcccctatgagaaagactttaggtaaaaagaaattcccacaaaagctagaccaattcagatga

SEQ ID NO: 16186 - DNA, 1101 bp, Glycine max
  Peptide Sequence Number=SeqID_132964
atggggtgtttttcttcaaaagtcatagccagatcaattagtttccatgaagagagaaagaagagatcacggagaaaaactaacggcattccattgctggaagatctgatcatctccactggtggcagtgaccagtaccttgctcttgtctgtgcagctaacacagtatccaacaaactgcattctggaagtttaagttctaatacttcatcaaaactggccattgagcctgccactgccacttctgaaactatcaagaagttgaagccatcatcagcaagactaagccaaggagaagggaaacaaattgagagtgataagaacaggtccaaaagttggcaccagtttccagaacacattgtggactctcttgttcaggagaattcatctggttttgaagataaacatgactcgtgctctaagggtgctgcgcgtagtaggagctttcacacagtggaggaatatgatgatatagttaaaaaaatatggttggccgaatgccacgatggtcagcaaagtgagtttaatgatgaagaagatgctggttcaggaactaatacaactcatcatactgagcataaggattgtatcatcaagaagatgcaaccaccaaacttaaacaaaaagtattcattggaagaaagaaaagtagtgaaggagatcaacaacttgagtacagaagcagaaagccacatatctagttcaggtattaagaatgaggaagtggttccaagccataaaagaagcaccattgagaagggaattaagagaaaagctgtggcgaagaggctagaatcacttagaatcccatctggtgttgaatatccagccattgctagtcttagagaatggctccctgcaggtggaatatactctcctggatcctatgtcaccccaaaatttggcagttattctataatgaacattaggaatgcaaatgaatccagtgaggattctatattcagtccagagttggtgtctgcatttgaacaatgtatgcaaaaacttgaggcagaagaagaaaacattctgaaacaaattgtagagaatgtggaggaagaaagtgaagcaagcagccccaagaaaggacaccatgcatag

SEQ ID NO: 16187 - DNA, 954 bp, Glycine max
  Peptide Sequence Number=SeqID_132965
atgactgtagttgtgatttggatgcttcaaaggtgtcatatttttactccactgagaaacaataattccaaaggcaaggcaagggacacaacaagtgaagagacaaagcaacaacaaggcctatccaaaccagtactaaccaaccacaagcagaagaaaatgcattctgtaatctgcaacagcgccgtttcactttcgccttaccactcttgtcgccggaaacctaaccgattgcgggccaaatcctctctgctcgttcagaaacaggacacccaactcggcgagccactctccgactccgtctccgtctcgcgccgcctcattctccttcgccatgccaagagttcctgggataaccgctctctccgcgaccatgaccggcctctgagcaagtctgggaaagaggatgctgtgagagtttcccgcaggctccaacagttgggttggattcctgaacttatcttgtctagtgacgcagcgcgtactaaggagacacttaagataatgcaggagcaagtgcaggagctggtggaagccgaggttcattttgtttctagtttctattcgattgcagctatggatgggcaaacggcggagcaccttcaaaaaattatttgtagatattcaagggatgagatacttactataatgtgcatgggacataataggggctgggaagaagcagcatcaatgttttctggggccactgtggaattaaagacgtgcaatgctgcactgctcgaaactgctgggaaatcttgggatgagtgcaaggttttcatttgttattatattagctttgaaaagatatgcaagaggttggatttggaagcatcattacttattcaaggaacccaaaacgcctcagttaaggctacagagctgatgactttggaaagtatatactggagaaaagatgaatgtgatgcaaaagcttcagttagatctgtttaa

SEQ ID NO: 16188 - DNA, 231 bp, Glycine max
  Peptide Sequence Number=SeqID_132966
atgggtgttaagtatagagcaagaattaagcagaggttggctctttatcatggaattatgtccatatacatgcaattttcaaatgatgcagaagagaccttctctagagccctcaagctactattggttaatgttgacgagtcaagtggcctagaaaatcgtggtcagacaattgcaaagatgcaaatgaggttagaaacaatgctattcatgttggtctattgtgtttga

SEQ ID NO: 16189 - DNA, 207 bp, Glycine max
  Peptide Sequence Number=SeqID_132967
atgagcaacacaaaacaccaacttcggaaggagaatgaaaaagatgggagggtgagaaggaacttagtagtacggtggaggtggaggtttgaaggtggtggcgatgaggtcatgcttgtagtcacaaagagtgttagagcaatgaatagaggcaaggtggtcatatggtcgattcatggtggcaacgagggtcatggtggaggttag

SEQ ID NO: 16190 - DNA, 585 bp, Glycine max
  Peptide Sequence Number=SeqID_132968
atggagctgttcatttcatggcttcaaacaatgactctggagttagagattttgatatggagagatttcagctttcgaagcatttctgctttccttggccaaaaaatgatacaagagaatgggaagaaggatagaatgcatacttcattgagccctgatgggaaactagttgttattgttggagactacccagaagggttactggtggattctcaaacaggaaagactatcacaccttttcgtggacacttggatttctcatttgcatctgcatggcatcctgatggccacatatttgctactgggaaccaagacaaaacatgtcgtgtttgggatgttcggaacttgtcaaaatccgttgctgttcttaaaggcaatcttggagctatacgctcaatacgtttcacatctgatggacacagttcatggcgatggccgagccagctgactttgtgcatgtgtacgacgcaaagcatggatttgagaaggagcaagagattgatttttttgcagaatcactctttattggtgtttgggaccgcacctacagaagccttctacagctcaatcgatgcagagaagtag

SEQ ID NO: 16191 - DNA, 255 bp, Glycine max
  Peptide Sequence Number=SeqID_132969
atggcacaccaaatattgataggtgtgagattcacatatgacgagggaaagcacactgctgagacattgaccatggattaccacagaagagttggagtcgaggtgagaatagctaggattttcaacacctacgggccacaaatgtgcttagatgatggttgtgtcgttagtaactttgtcgctcagtctggtggcattaatgcaaccactaaggaaggagcctttgaccatttatggggatgggaagcagactag

SEQ ID NO: 16192 - DNA, 450 bp, Glycine max
  Peptide Sequence Number=SeqID_132970
atgccaattgttatggatactgctatcactgcaagagattctatacgtggatgtagggcagatgccaatgaagctgttgttattcttcttccatcaaatattactgtttttactcttgacttctcagggtcaggcttgtctgatggagaccatgttagccttggttggcatgaaaaagacgacctcaagatggtggtgtcacatttaaaaagcaacaaactagtatctcatattggtctttggggacgatcaatgggtgctgttactagccttctttatggagctgaagacccttctattgctggaatggtgttggatagtgccttttcaaacttatatgatctaatgatggagcttgctgatgtctataaaattcgacttccaaagttcacagtacacattctctctctccttcactccctatgtgtgtgtgcacatgtagtactttag

SEQ ID NO: 16193 - DNA, 999 bp, Glycine max
  Peptide Sequence Number=SeqID_132971
atggctgtacaatacatgcggcgggttattgagaagaaggcaaagtttgatatcatggacctgaactgtttgctggttgcaccgaagacattcattcctgttttacttggacatggtaatgatgaccaattcattcagcctcaccactctgatctcatctctgaatcatatgcgggagataaaaatatcataaaatttgatggtgatcacaactcctctcgaccacagttcttttataattcaatttccattttcttctacaatgtcctccaccctcctcacactcctagagtttgtaagcttgagaaatattttgattttggggatttgaagactggttctgctgtgaatgaggtaaagatcacttcagagaagctgagtctacaagaaatatacctgaatttaaacattgtgaccagaatgcagtttgtgaactcaaacaatgatacaccagcaagcttcaaggggcatctacagtctgcaactacagatgctgcgagttcatcttctgctcctccaagcacttcaaattcaatcacagcatcagttagtgaacttatttcaaaagttgctccagtaaccgccgctgagtccatgattagagaggaaccaaagcatggaaataatgaacctggccatgatgagcctgcagatatgaagattcaacaggatgaacaaaatgacccgactgaagattacttctcatactgtagctcaactagagaaagctggggaagatgttctactttagtactcagcgatgaagaatcttatccagatttcagggatgatgataatggttctgaggtatttgcaacacccctgggaagtatgagagaaatggctgcagacccaaaagaagagggaaaggatcagaagaagaagaagaaagctgaaagatcctcaaagaagctcaagtctgagagatttgacaagtgggagtccctcagtcaacggctgcgactttgcattttaaagggaagaccaaagccctcgtga

SEQ ID NO: 16194 - DNA, 984 bp, Glycine max
  Peptide Sequence Number=SeqID_132972
atggaagttatacctaattattggctaacatcgctagatgtggaatctcatgaatctctggtttctggtgctgagtgggaaagtgaaagccccaaggctggtttttcttctacagcttcaggatggccttcctttgatgacatcaaatcatcttctctcacttattctttatcagcagaagagaaagcaactgtggcagtgctgcaattgcagcacagagcattagaagcttgccagaagttcttagttggggatgctggttctgacagtgacgaagatgatgaggaggcagaggatgatgagctgctagataatgattctaaagaatctgaggagtataagttctttgaaaaagtgtttgcagaagatggtgaccttaggagatattatgagaacaatcataaggaaggagatttttattgtttggtttgtgggggtattgggaacaaggtatggaagaggtttaaggattgtattggactaattcaacactccactgccatactaaggacaagaaggaagcgagctcacagggcctatgcacaagtcatctgcaaagttgttgagcccaaaaatcctgctgtgggttatactgatgatacaaattcaaatgatgttcttccaaagtttgctagaagggggctcaatttttttgagacgcaggaggagagtaatgagcaaaacagtggaagcaacaacactttgtctgagtctgaacgcgtgacaaaagctgagacagaaattttggccttgaagaaagccattgccaaattaaaagatgaaaaggaagctggcttgcttcagtatcagcagagtttggagaaaatgtctaatctcgagttagaagtgtctactgcacaagagaattctcgaaaactcgatgagcaagcaagtaaagctgaagctgaagttcaagccttgaaggaagcccaaatcaaattacaggctgaaagtgaagctagtcttcttcagtaccaagaaaaa

SEQ ID NO: 16195 - DNA, 1560 bp, Glycine max
  Peptide Sequence Number=SeqID_132973
atggaagagtttaagattctttttgtctttctcatgactttgctacttgtgctcaaggtcacaatctcgctctggtggagaccaaggaaaattgagggccatttctccaaccaaggaatcagaggacccccttatcgtttcttcattgggaatgtgaaagaactcgtgggaatgatgatgaaagcttccgaaaaacccatgcctttctctcacaacattctcccaagagtgctttctttctaccaccactggaagaaaatttacggtgcaacattccttgtatggtttggacccactgttcgagtcaccatctctgatccagacctcatccgggaaatcttcacctccaagtcagaattatatgagaaaaacgaatctcccccacttgtgaagcagcttgaaggtgatggactccttagcctcaaaggagaaaaatgggctcaccacagaaaaatcatctctcccacctttcatatggaaaacctcaaaatgttgataccgattatggcaacaagcgtggttgagatgttggagaagtggaaggcaatggcagaggagaagggtgaggtggaaatcgaagtttcggagtgttttcaaaccttaacagaagatgtcattactaggacagcgtttgggagcagctacgaagatggcaaagccgtttttcggttacaagcccaacaaatggtcctagcagctgatgccttccagaaagtgttcattccaggttataggaggaatataaattcttggaaactggacaaggaaatcaagaaatcgttggtgaagatcatcgaacgacgaagaaaagagaatgcgtgtgggaaagaagaaacaaaaaggccaacggatttgctggggctcatgatttgggcttccaacaacaacaacaacaccacctccaatgtgaacgtaacggtggatgacatagtggaagagtgcaaaacctttttcttcgcaggcaaacacaccacttcgaatttgctaacgtggaccacgatcctgctcgcgatgcatccgcagtggcagatacgggcacgtgaggagctcgtgagtgtgtgcggtgcacgtcacatccccaccaaggaggatcttgccaagcttaagacactgagcatgatcgtgaacgagtctctgaggctctaccctcccacaatcgcgaccattagaagaacaaaagccgacgtggagctagggccgtacaagatcccgtgcgggacggagctcctgatccccatcctggccgtgcaccacgaccaggccacgtggggcagcaacgcgaccgagttcaacccgggtcgcttctcgaacggcgtgtcccgcgccgcgcgcctccctttcgccttcatccccttcggcctcggcgcccgcacctgcatcggccagaacctcgcacttctccagaccaaactcaccctcgccgtcatggttcgaggtttcaacttcaggctggcgccgacttatcaacacgcgccaacggttctcatgctgctctaccctcaatatggtgcaccaatccgtttccaaccaatacccgcacccactgtgaattgttactga

SEQ ID NO: 16196 - DNA, 387 bp, Glycine max
  Peptide Sequence Number=SeqID_132974
gttactcaaatgaagcaggagcatgacaagaggcaagcaagcctcatagctgaacacaacgaacagctaaagcgtacccaactgcaagctgaaaatgaattcagagagaaaacaatgtttatgaggaatgatcatgaagctcagatcaaagcattgaggtgtgaacttgaagatgagtgtcggaagctggaagaggagttgcatcttcaaaaatccaaagaagacaggcaaagggctttgttgcagttgcagtggaaagtgatgagtgacaagtccaaagaggaccaagaagtgaattcaaaacagagcatcaaaggaggaggccatcctcatccttcaaaagggtctcttaatccatatgcagaggatccctatgcatttgattag

SEQ ID NO: 16197 - DNA, 687 bp, Glycine max
  Peptide Sequence Number=SeqID_132975
atgataactatttgggatgctgctaaaaagaaaggtttcaagttgtactacaatgaggagatgccttccaggaaaatgaagatagaaatagttaatcacccttggaattggagctccctgttcaaccggaaaaggcttgtccatgctcctgatgctaatgatctccatgatgctcaacaaaagaagaaggctgaagaagaagaggttgttgttgttgctatgaaagaagaagttgcctccatccaagctaaagcatccgctaaagttgtggatgacaccattgtacgtggggtcatcattgatcttaccaacactggtgtcatagacaaaactcctgaggcatccgatgcagccatagctgatgaagttgaacacaacattatagaccctccgtccaagcagtcaacaacttcaaatgagactacttctggagacaagggagaactcaatgtcattatcctctactccactagttcaggccctactctcctgaactatgcacaacctgctactatttccaaggatcaaactcagatgtctatgcttggagctgctgttgtagctgcacttgttcctcaacctccacctatacctcaacctcttgaacctacaccatcaccaatccttggccaaacaccaccaccacctccgtcttcacctccaccaccaccacctgctcagggctga

SEQ ID NO: 16198 - DNA, 111 bp, Glycine max
  Peptide Sequence Number=SeqID_132976
atggagggcacatgcttgaagaatatgtacagcacctcaagtggtgttggaactgctcagaattcattcattgtttgtcaaaaggagcaaatgctttttcccaacttctaa

SEQ ID NO: 16199 - DNA, 2343 bp, Glycine max
  Peptide Sequence Number=SeqID_132977
atggataggtttggacgaattattgtccagatccgaaatcttaaccctgaagtagcactacaatccatgctacttgccttacggcttggtatatttacggacagtctgttcaaaaaacctcctaattgcatgaacaagttacgtgaacgagccaaatcctatattcaaatggaggagatgttcaagttcaaaaaagaggtccgacaagccgaacaaaagcccgacaagaaagaaggaggtaccgagaccaactcacacaagttgaacaaaaggcacaagcccgacaagcgtcaatctcacccaaggggacccaggtatgagcggtatacacccctgacggccaatcgaaccataatccttgaagaggccttcaatgcaaagatacccataaagctaccttcaccacttcctcccaagtcaggtcacaacacagaagattgttgggctctgaaagccaaaatagaagagctcatacaggctaggtatctagcccaatttgtgaagagacctgacaaacacccaacaagagcaagatccagaggacaccaaaaagaccaacacataaatcacgatgctgatagaagaaggtatagagcaaaagatagagggagacagaggcaccaccagcaaagccgcgagtgtcaaccttcgcaggaccaggaaaatgagcccgcccaacaaaccagaggtgtaatcaacaccattgcaggaagatttttctatggaaatctccttcccatcactttcaccaataaagacttcaggggcatcaaccctatcaaccaggatgacccaatgattgtcttcatcgtgattgccaatttcatggtgtctaagactagaggctacgttgacctaatgaccaccttcgatcaaggccagctctcaaggagcttcatagtcagttatttaattgttgatgcggataccttttactttgctttgattggcaggaaagtgctgaacgaactcggagccataatctccatgctgcatctcaagatgaaattctcaaccttgatgggagacatcgtgactgttaaggaagaccaaaagcctcaccccagagcgggtggtagcaatcaagtcatgagcatggacaaagggtttccaatccaaactctgatcgtctatgaagcaagtctggatggaacattcgatgtggatccacgcgatgacactatggacataggcccaaaccctattgaagaacttatcaagttacagctcggacccaaaccagggcaaaatacacaactctatagggacctcactagccaccaacacagacgcatagctgatgtcctacacaggaacacaaacctatttgtgtggcatccatctgacatgttgggtattcatcctagaataatatgccacaagctggcaatctatcctcaggccaaaccagtgttacataagatgagaaagatgggagaagagcgacacaagacaatcaaagaggaggtggacaagctccttaaggcccaatttatcaaagaagtcaagtactctacctggcttgccaatgtcgtcatggtcaaaaaggccaaaggtaaatggcgaatgtgcaccaactacatcgatctcaatagggtgtgtcccaaggatgcatatcttttgcccaacatcgacaggctagtcaacaatgcgtccgggttccaagtactgagtttcctagatgcatattcagggtacaatcagatcaaaatgcccgcccctaatgaagagaaaacaacattcatcactgaggatgttaacttctgctatagggtctatgtcgatgacatggttgtcaagtctcaaagaatattccaacacttggcaaacctggaaaaggtgtttggagaaatccgcaagtatgacatgtggcttaaccccgaaaaatgcacttttggggtttgtggaagaaagttcttggggttcttgatcacacatcggggaatagaagccaacctcgataaatgcataaagatacaagagatgcacaaccctactagcgtcgaggaagtccaaaagttgaacgatagactagcatctctgtctaggtttctcccaaagctcgccgaaaaagaaaagccattctacaaactactcaggaaaactgagccattcctatgggacaaatcccgtgaacaagcctccttggccttcaagaagacaattgccacaccatctcaccaagtggtagtcaagatgaactaccccatcaagcaggtgttacgaaagcctaaactagaaggaaggatgacagcatggtccgtagaactggcaaagttcgatctccagtacgaacctcgtggccccatgaagatccagttcatggcagactttctagcataa

SEQ ID NO: 16200 - DNA, 2910 bp, Glycine max
  Peptide Sequence Number=SeqID_132978
atggtgagggcctttgaggtcctatgccccttcttcaacatccgtcctagtgtgtcaatgtttttgtattttttccaaatgaaattgtcaggcaaaataggttgggtatccctgaacaacgtgtccaagaagctattcgagtttgacttgaacatgttttgccgcttcaaggaccgtttcttcaagtcggaccctaccaggttcaagtcttttgatgaggatctgttgaccctagtggagagggttgacaaggctatcttggagcaactgtcagcctctctggatgcgtgggccatcttgtcccttcccttagcggatgatccactcgttgccttagatgatatcataggtgacttcacttggaggcccttggtgaagcagggtggacctactggtggagtcatgccaccgactattgtcgagcctcctgttagagaagagggccaacttgttgctaaggttggccctaataatgatgaacttgttgaggtctcccctaacgtgccttcctctattttggcaaagaggaagcgtgatgacggctgccgagttgatgctgattcggattgccccttcgttttgcaaggttcgactttggctccatcggctgtccaagctactgcttctgctcctactactattgttgctttttctcctccagctcctccttctgcgcctgttcaggaggtttctgcttctcctactattgtagttactacactagtctctttggttggtcctatcgtgggtcctctctccaccattgtagcgcccttgctgagagctgttgctctagtgttagcgtcgcctttgtcctcctcttctcaccttagtgtctccctagatcatgtctacacttcttgtgatactgactcgatgtggagcatatggtataggtcagagcaaagaaccctaactggctttgtgtctacttttaacaagaacctttctggcaatccggaggaaaatggacaaccgcaccaggaatttctaagcaaggtggcgtccttagaggatgagatcgccaagtggagggccactgctcgaagtgtttggagagtgaagcatcctaaggtggccaatgccactgttgcctttgctgaagccgtcaggtcgaaccaccagtttctatccaaggtttgtggtgttcttgctaggctgttatgcaccaaattggatggtgatgagttatttaagcgatgtggatgtggacctcaaggcccggttgaaagagtcagagtcaaggttggaggagttcgagctgagggtgtcataggagaaagaagccagcagaccgagttcttcaccaaggatcttgacttgggtctttttgatccattcaaggacgtgaagaatagtgaactgcttgacgaagaagagatagttattgcagaggaggatgctggcgagaagcagggcaatgaagccaatgtttgtgcaagaaaatggaagaatagaagtgaaaagaggaagaagaatgaagaacaattgagagaaaaagagaaaaaagagaaagcttacacaacaagtcttgtcaattatttggtgatgcttcattttgctttgtggagcttctcccctgatgcttgtgaggagttggcgaaacttggcaaaaataaggctcaccaagggcagaccttgggcttaacgagctttggactagggatatattcatcctgggttgaccttgggtttgacgagcctttggagaagcgagactcaccaagggcggaccttgggtttaacgagcctttggagaagcgagactcaccaatggcagaccttaggtttgatgatcctttggagaaagcctttggagatgtaagtctcaccaagggcaaaccttggggtttgacgagcctttggagatacgaccagggatgcatctgtcctgggacaaaagacttgagtaggaaaaagagtacaacacctggtcttgcaataggacaactgaattgggtccaagcattcccgctcggggatattttccagcttcaccttggactcgccacacttagtcgccaggttgaaaggctcgaggttgaacctttttccacccttatgttctctttgttgtgttgttcctggaacaatagcctccttgttgatggctctccgacttcgatggggatcatggcgtctgtgccatatgtgagtagagaaggaggccctgaggataactctatttgctacctccacctaatcattggtatggggatgtttgatagaagtgaattttccataagcctgagttttgaattgagtgaaaatggcataagggaggccatatttgcatttgaggaacttgaccactcctgggacttttggaaatggtcccagtatgtccatcccccatatgacgaagggccaaatggagctcaagctatggagattgtaagaaggggtgcatggaacgtctgcgaattcttgacatcgtcttcattactttgtgttgtcaaaggcattgaccctgagtatcagccaatagtagccgatacacaccattttggttgcatgcgagcgtccccgatatggaggcatttgaacaggggtattgtcaaccctcttttgaatagctcaccattaaggatgactcatctagtctggtttctcttcttctgctaccataacatgcttggtgtttatcatgggagcttggagtgtcttctagatgatgggcttgagatgctcgatctttttggtgctgaccagcttggaaagcaggtttgctttggtgatgctctccttgggtatgtagtacaactcaaagcattcatagatgtcaatgagagtttttgtggtatggctttgaagttgagcttgagagtttactctaaaatgacattgctagagtcttcaaggatgatacccgccctacttcccttcatgttgaacactctgtccatgtag

SEQ ID NO: 16201 - DNA, 300 bp, Glycine max
  Peptide Sequence Number=SeqID_132979
atgtcgtttcggaatgttactcttaagttttggcacatgggaacaaagctgctcagctttgggattcttgttgttgataaggacatattggtgtcacgtgcccctcttggtcttgggtccaacaaatttataaccgaaaacaaggatttggatgagcgtacttcgtggacagatgttggtttgataacttcaaagttcaatccacaaccaaatctaggttccaaagtcagagttgggacaaaatatgaagcccttccattaatactatttaaatcagtaaaaaaggattatacaggatag

SEQ ID NO: 16202 - DNA, 222 bp, Glycine max
  Peptide Sequence Number=SeqID_132980
atggcggatgctacacgaaatcgcattctcgaacgtgaaattgaagatcgtgtggaaaatcgtctcagttccaagattgatgaaagattcatggagatggcagttttgatgcacaaatgcaggaccttctacacaacaacagtaagggcgcgaatcattctccaactgggggaaacccaattcgaggtgagagatcttcttattcttgcggaacacgtctag

SEQ ID NO: 16203 - DNA, 234 bp, Glycine max
  Peptide Sequence Number=SeqID_132981
atgacggtacaaatagaggcacaggcacaattgaaggataaggcagacatgcaagcacaaatgcttgcacaaatgaaggcacaagcaaaaatgcaacaacttttgcaacagcaaatgcagacacagatgcagttttttaggacaaaaatattgcctgcgataaagataccatcaccaccatcagtccaaaaacgtgggaagaaccataatgaagatgatgttactgcagtgtag

SEQ ID NO: 16204 - DNA, 582 bp, Glycine max
  Peptide Sequence Number=SeqID_132982
atgacaagcctcagtgccacaacaaaacctacagaagttcaatcaccatcagttacaaaggctgttctgcctacaggaataacagttttggtcaagaagattgagtgggaagagaggagcagcaaggttgcgtcggaatttataataagactgggaaatgcaaggcacaagaatttagtcagattgttggggttttgccacaacccacatctagtctatcttttgtatgattacttgcctaatgggaacttggctgagaaaatggaaatgaaatgggattgggctgcaaaattcagaatagtagttggaattgctagaggactttgcttccttcaccatgaatgttacccagctatacctcatggtgacaaaaaggccagcaacattgtatttgatgaaaatatggaaccccatttggtagaatttgggttcaagcaagtattgaggtggagcaaaggctcatcacccaccacaaataagtggggaacagggacaaagaactcaaaagcatttgcattgaacaataatactcaattagtaaacgacttaacagagaaaggagaatttgagtgccccaattag

SEQ ID NO: 16205 - DNA, 612 bp, Glycine max
  Peptide Sequence Number=SeqID_132983
atggatgatagtggatcactatcacctagtgcaatggtggcacccattctttcaagtagatgcatcaatagaatggaaggtggccatggttttcttaagttggatcgtctaacctctatacacttgcgtggtcacattgtaaggttttgtgtagagattgatttgatgaaaaaactggttccatccttaaggggtcttatttcagaggatgttacaaccgttcctgtgtcatcggaaggggtagtggagaaccacattggaatgaattcaataacactcaagggggtgaagatttcgatccttagatgttggttaggagggggcaatcaaattttggataaggctttggaattaaaggagagtagcctgaaagatagaggtgtaggttctggaaaaggagtggtccctacaacaaaatattggcacgctgaattggcgggtaaatcaagtgtgccagggacctcgagctcagtgcaactcaaagataagggaggaaatgatgaaatgattattgataattctaggatgaccaatctgaaccaagaagaggatattgtggtggaagtagagaagccttgggctcttattggtgacttcaacactattctttag

SEQ ID NO: 16206 - DNA, 246 bp, Glycine max
  Peptide Sequence Number=SeqID_132984
atgggtgtcaagcacctcacaaggaccaaagaaaggtcgcatgtcatcaagcaaagcttctctcaagctcgtcgtggacctcgtgggtcgtggctcgtggtactcgcggcttccaagcttctctcgagctcgtcgttgacacaagcagcaagctgccaagcttctcttgagcttgtcgtgttcgtgggtgggactcgcggcttccaacagaaccaagcaaccaccgcacctcacctaattgagtag

SEQ ID NO: 16207 - DNA, 1098 bp, Glycine max
  Peptide Sequence Number=SeqID_132985
atgaccgcagataaattggtggaaatcataggaagtataaagcaagagttgaggaaagaggtagaagacgaaaacaaacggactatcgacttattgcaaaagcagttggatgcgatcaagagtgagttatcacaaattcaaacgcaacagtcagctccttgtagaccgtctatccctgatgtattggttgcacgtgtcagcaccaaagaaagctgtgtcgaggctgctgcaaatgttgttgctaaggagcggtctacacttgatgcttctattgtggggttatacattgtgtgtggtgatagtacacaggtggtggcttcgggaaaaatgtatggagttggtggcattatacacaatgttgcttacgcagatgatgtagtaagggtttgtgttgacacaatttacgatggtgacgccagtgtcccgtttcccactgcagagattcagtatgtcagggacgcgagtagcacattcattgcatggcccagacatctagtgaagcctataactgatgattcaaatcataatgcgcgtttgccagttggacgtcttggtgaggctgaggttgcagcggaacctgattcgttgggcgaattgatgaagacattgttttacatgtacaagagtccagtggaagtgccgtgggaggcgacgcaatttggacttcctgatgttggggcaaaatttttcatcgcacatgctgatctagcggaaataatatcaggtgacaagtgtttgaacatatctatcctgcagttgtggaccatttttatgaataactgtggtagaagcaaagttgatcaatcactgtatggtctgttggagcctcaatctatacacaatgctaaggacagatgtgaacaatgccaagaatacattcaaatatgggtcaaggaatcacaaaggcagttgtacttaggggcttacttgcatcatgcaatgaagacaataaccagttctttccatggcatgtctaatcaagctgcacctcggtgggttgaaccaaagagtcatgtccaaactggagcgtacgagtgcagatattatgtcatgcattggatgtggtgcatagtgactggtggattgaaggatgactag

SEQ ID NO: 16208 - DNA, 1971 bp, Glycine max
  Peptide Sequence Number=SeqID_132986
actaagcagtctaaacctgaggcttcttctaagccaccattgtttcctacacctcctaagactgtttccaagacgcaagataccctcaaaacaaaacaacaagcctctaaaacgttaacccctacgtatatgagtgatagaagggcaaaagggttatgttatttctgtgatgaaccctttactcctgagcatggattgagtcataaaacacttcaactgcatgtgatggaagtggatgagttacaggagggtgcagaggaagaagtgttgcttgaaaactcaatggggtccagctctacagatcctcaaatttttgtccatgccctcatgggaattgccaatttccacaccatgcgtgtgacgggctactaccaaaagaagcctctccatgtgttgattgacagtgggagtacccacaattttctagacattgaggtggccaagagattgggttgcaatagtgatgcttttgattccctgagagtggtggttgctgatggcacaaagttaaatgtgtctgtagtcgttagaggattccagtggacaattcagcaaacaaaattcacttctaatatgttactcattccattgggatgttgtgatttggtcttaggagtggattggctagtttccttgggtgatattgtatggaattttaataagttgaagatggagttctatgttaagggaaggaaacatgtgttaagaggagcctctactaggttgaaaacagttaagaagcaacaattggggaaggctatgtcaactggtgttcatttgtcaattttgcaagtatgtgatggacaaaggggtcttctgaactcacttagtactcaagctgctgataaagaagtccctcctgctattgtcaagttattggatgagttctctgatttatttcagaaacctagtgggttacctcctagtagacctagtcatgaccatcagattccactagttccaggtgttggtcctatcagtaagagaccatacagggatcttaacaagcataaagttgagaacaagttcccaattcctttagtagatgatctgttagatgaattggctggttctagcattttctccaaaattaatttgaggtcaggatataatcaagtgagaatggatcctgctgatgtgtataagactgcttttaagactcatgctgggcattttgaatacttagtgatgccctttggtctcactaatgcacctgcaatatttcaagggcttatgaactcaatttttaaggagtttttgtggaagtttctactggtgttctttgatgacattttggtttacaattgttcattggaagaccatttgctacatttacacaaagttttgataactatgaaggcgaattccttgtttgctaagaagagtaagtgctattttggggtttctatggtagagtaccttggccacttcatttctaaggagggggtatcaactgatccagctaaagtgcacacaatagaccagtggccattacctcaaactttgaaacaacttagaggcttcctggggttaattggatattacataaggtttgtcaagggatatgaagaagctactgaggctccagttttggctttacctgacttttcaaaaatctttgtggtggaggtggatgcttcagtcaacaagttcaagatcaagataaatttcaagtttcatgagaagaaatcaagaagattcaagaatcaagagaagtttgatttcaagattcaagagaagaaatcaagaagacttcacaagggaatagagggtacatctacttgggttgttgtaactgagaacaagagagggtacatctcttgtggatcaattcaagtggagggtacatccacttggttgttcaaagagaacaagggagggtacatcccttgtggatctttgcttgtaaaggctttcacaaggttgaaaagaaatctcaaggactgtaggtcgcttagggactggatgtag

SEQ ID NO: 16209 - DNA, 195 bp, Glycine max
  Peptide Sequence Number=SeqID_132987
atggagagcgacgagggtgaggttagggttctgcaagacggggaggcagatcaaaatacgaaaaaagtgaaattccgagacagtgttgatggggatatgctttatggttccaatggcaatacttcgtataaggaaaagcttcttcttccttttggagggattggagaagacgggaagaattacatagaagagtag

SEQ ID NO: 16210 - DNA, 552 bp, Glycine max
  Peptide Sequence Number=SeqID_132988
atgaatgaaagtcttatgagacacacttcaaagttccacttctctccctcttttattccttcaatttcgtgctccccccttctctctttcttttcctccattaaagcatcctttagtgaaagtgaagaagcaaaaggggaagaatctagtgaagaaatctacccccaagaagaaggacaacctttaatggttaagggggagtgtaaggaggtaagtgtctcctccaagagactagctaagaaggaaagtcattttgaaataaagacaaatattaaagaaatttcccctcttagacaacctccacatcttctcctttgtaaaaatacacttgttagcattgccacacctcttaggcttgaggttattcctcaagtaaaagagttgttggatgagagtttggttcgtaagagcttaaatccttgtgctttgttggtgtccaaaataggtgttgagggaaggagcccagagtatgaagaacctcaagatttgaggtcaaatcctttccaaggtggagggaatgatgcaatcctacctcgcaagggcattggatag

SEQ ID NO: 16211 - DNA, 119 bp, Glycine max
  Peptide Sequence Number=SeqID_132989
atgcggggttacctgatggttacccgtccctttcgtcaaccaggggtaaacgagcacgttgacacacggagactaccatcgtcttctacaccttttgtcgtcctcacccgtgaagtcag

SEQ ID NO: 16212 - DNA, 177 bp, Glycine max
  Peptide Sequence Number=SeqID_132990
atgatgctagtctccgctcgtcaacgggctcgtttgccccttgttgacgaaaggggcgggggcgggcaaccaaaaggtaaccccgaatgtcagctgccttcacgggccaggacgacaaaaggtgaagaggacgatgttagtctccgggcgtcaatgggctcgttcgcccctggttga

SEQ ID NO: 16213 - DNA, 234 bp, Glycine max
  Peptide Sequence Number=SeqID_132991
atgaatgccttgccaacattgactcttcctccaccgccccatagccccgtcgcaggtcctatgaggtttgaccgtcgtcactgggtggctcacggtcaaacctcttcagaagcctccaaatgggaactagagaatgagagcggtgacatgcttagggtttctgacgatgacaacaaagagtggaggatgacgaaggagttcatagattgcgacatggcttctgtattcagctaa

SEQ ID NO: 16214 - DNA, 249 bp, Glycine max
  Peptide Sequence Number=SeqID_132992
atgttccaaccatgtaggatcggcacaggcttaaagaagcactcaaaccgggtgacccccaaggcctacactctgaagagtccgtcaaggcctctccctcctgattcagcttacaacacaagtaatgtcacatcaagtgttaaccacacacttattcgcaggcaaaactcattcacaatttcacatctcatagtgtcacaacccatcatcacatgtttacacgtatctcacaaattaacacatgtttaa

SEQ ID NO: 16215 - DNA, 111 bp, Glycine max
  Peptide Sequence Number=SeqID_132993
atggattttccaacaccacctcatccatatacaggacatgcccttgtggtgactcctattgctaaacaatgcactgaacttaatggaccatttggttggaaggaagcatga

SEQ ID NO: 16216 - DNA, 857 bp, Glycine max
  Peptide Sequence Number=SeqID_132994
taagaatagacaagaataggaaactcattcggttgaaggatctttctatagctttttgctttgtggtagttgttttcttgtttaacaacttgggtttgtgttgttctttgaatgaagaaggtaatgctcttttgaagttaaggcagaaaataatgagtgactcttttggtgctttgtcaaattgggttgatgatgaggcttttgttgacccttgtaactggtttggagttgagtgctcagatggaagagttgtggtctcgaatttgaaggatctctgccttggaggaactctagcacctaagtttgtgaaacttatcaacataaagtctatggtgaatatgctacaatattttgaggaaaactctttctctgggaccatccctgaaggatttgtagagttaaaagaactggtggttttggatttgggatacaacaacttcagtggacatctacttgttgatctagggagtaatatctcactagcaatcattttactggataacaatgaatttctcgttggtttatcaccagaaataaatgaattgaggatgctttccgaatgtcaagcagatgaaaatcagctaaccaatggtgctaaaatgtcagcttgtacagaaagagtcaccacatgccttgaagaattacaagtgaactacaataatgaccgttcaagcctggatgatgtagcttcatgtggagcttgtaggccttggatcttcttcatcaatgaagtcctttgcttcttaaagatcaatggcagtggaatggagaaggaggaaagcttgaaggaagaagaagatgagtggagggagaaggaggcaaggagcacgaaattttatgcctcaaatgaggtttga

SEQ ID NO: 16217 - DNA, 171 bp, Glycine max
  Peptide Sequence Number=SeqID_132995
atgggcccaaaatctatcctaaggctcatgagaaccctagggtcttctcctacatctctggcccaatcttcttggagtctcctagccatggctctagtgatgggtcctttccttgggagaattgcatcactggatatggtgatgcaggaaacatacgaaaagacacgataa

SEQ ID NO: 16218 - DNA, 378 bp, Glycine max
  Peptide Sequence Number=SeqID_132996
atggctcatgaatatcaaggtaaaacactgttgattctcatttattaccctcatttattgctttcaattgacatcttacttgagcgtcaaagtgtcttttgtaggtaccttaccctccgatgtttcaagcactatttagagaagaaggaaaatcatctagaggacgtaagcaaagaagaaagttacatgcctaccccatacaagtacataaggaatttaggatcctcaaacatcattatagtagatttatggggattgagttcaatgcttgaagttgcttgggaaaatgctaatatggctcattcttgggagctagggttgcatattttaagggattcaccaacatcaaagtatgatttcaaactcgtgtcaaactaa

SEQ ID NO: 16219 - DNA, 327 bp, Glycine max
  Peptide Sequence Number=SeqID_132997
atggccctttcccaagattacctctttagctggttatcacaggttggatgggatgtgttaggtatctggctgggtcgagtacttgatactacggaagggtatcatctagatcgagcacctgatgccatagaagggtatcaagtgagcatatggcactatcgaaaggcaatagagcccaaaggaaatggagttagtgttaggtatttgaccaaatatgacccgtttaggatagggaaactcaaaagagtaatcaggggattgctgcatctgaaggttaagagtgaccacaacatgttgctgagagggtcaagtagtagttgctactga

SEQ ID NO: 16220 - DNA, 578 bp, Glycine max
  Peptide Sequence Number=SeqID_132998
ggttcccaaacgttagagagaaggagaagggattgaagcctccatttatactatctttgtgtgattctgttatcccccaccatgaatattatctagcaaatcccaacggtgaagtgggaaaagaaaaggttacgatgcgaagtgtatctctcttagatctgacagtttctcgtaatttccaacgtgtttctggtctgcaggaaaaagataggattttgggagaagggggaaaaacgaaaatgaggagaagaggaggcattgtcagtgtgaaaactgacctaacatcgaacgatggtctcaagtctgttgttggatacaaagccattaagtgggatatatatgcaattgagctagggaaatattttgttgatcatcaatgtcctgctaatatttatgttgaacaagttgtcgatgatgttaactggtttgaaggcaagcttcctagaattgttgagggtgcaattgattctcaaactacccaaggtggtaggagtgataagggtactgctgaagttaaagtcactgagaatgatgatccagttaggagtgagtttgatgatagtgacgaggcaaaatga

SEQ ID NO: 16221 - DNA, 258 bp, Glycine max
  Peptide Sequence Number=SeqID_132999
atggaaggtggagaggatgcaaatgtgagcgtatcacaaaaacccttcgagctcactcagttcagaagcaaattcaaaatacaaacgtatttgaaaaatgcaagcgttgggaaaatggtgccacaattaatgcgtgaaatgggtcacgtcattggtactgtatatggtgcatcgataatggtgctacaattaattcacatgagaagcgtgaaatgcatcggtattgatactgcattaattatgaaggtaccacattaa

SEQ ID NO: 16222 - DNA, 315 bp, Glycine max
  Peptide Sequence Number=SeqID_133000
atgatcttagcaagagcaccggtacaccacgaaaatagcgtcagcactggtacaagttcatccaaggtggtgttttgtttgactttgtgtgcattctctgggatcagcggcggtaggctccagcgtgcagacgaaggagagggatttggtggagaaggcaatgtggcgatagtgtggaggtggcggtgcaatgacaaagtgggatcgacgaagagagggagaaggaagcttcctagaatggaaaatggaaatgtagaaatgagaagcttcttagctcaacgacgtgacctcataggtatggaggtgaagaggtag

SEQ ID NO: 16223 - DNA, 231 bp, Glycine max
  Peptide Sequence Number=SeqID_133001
atgtcaattcatgctacagtgatttattatacggtgcgttttcaacaaataacgtttcctaaattaaacgagaaggtggaagaagacactaaagctgtgatttttatctacaaaaagcttcgatttttatctcaaacagttgtagcaatggcaggaattcttgacagaaaattagctgactctggtgatagggtagctgataatcaagaagcagcaaaattggagtgttga

SEQ ID NO: 16224 - DNA, 315 bp, Glycine max
  Peptide Sequence Number=SeqID_133002
atggagcattttcttgagcaagtagcctggcctgaagctcaacttccattgatgagacccaacgaggttaattcagagccaactgacccacaatctccagtggtgaatccaccttcttcacctgagcttgaagcagttccgccatctcctcctctgattgtcatttctgacgcatcatcagatgaagcggctacccctcctgattcaccagttgtagaaatagctgacccccttgtttccccaattggaggagttgcaaatctttctaattcatcatctggagaagttgttgctctcaccaattccccagtttaa

SEQ ID NO: 16225 - DNA, 294 bp, Glycine max
  Peptide Sequence Number=SeqID_133003
atgtctgatatgccatttagaggcttgaaaagtgcaagaaaacaagctgtgttttcggcgttttctggaaaacgcaatgaactcgctaagcaagaatctttatctgaagaactcgctaagcgcacttactgcgctaagcgagttcatcctttgaggatgaacattcatccttttgctgaactacctatggctaagaaaggcagaatcgttaagcccagttatagatggaatcaagaaaaagagctagaacagaagacatcccttcatcatccactccagctcctccgtcagtaa

SEQ ID NO: 16226 - DNA, 252 bp, Glycine max
  Peptide Sequence Number=SeqID_133004
atgcctaaatcatctcccaacatgcatgtgaagcaagaagtatcaacaagagtcaagccaaggctattgtgcaagcaatcaatggggcaaaacacatcgaataaaatagatgatgatggctcaaattctcaccaaggagaaaaacaaggatttcaattcacaaaatgccaagaaactcctatttcaaaaacaattacccattacctgtacataacctataattcaaagagaaacatgcaatgttgtacataa

SEQ ID NO: 16227 - DNA, 894 bp, Glycine max
  Peptide Sequence Number=SeqID_133005
atgttggtgcacccaacactaaacgggaaaaggcagaaatacccctcatcaatccgcgaggcgtttcttcttcttccgcaagcttctggttcgtctttcttccgcgaggtgttgcttcttcttccgcgagctgcgtcttcgttccctgcaagtggctctccttcttctgcgcattcccgttcttccgcgagctttcgttgttccgttcttcatcgaggtaagcctattgtcccttctgttgttccttgcgaatgtcgttttgcttccattgttcgtttctcaggtgtagttggtaggaattgcaatgctgatccagactacgacgaggtgtcaccatgtgcatgtcggtggattgccataaagaagaatgtcaagaagatatctacaacgacgtacaggcagcgcctggataatctcaggattctagatgtctgctggatgccatatgcggagcaccgaccgtgcattcctgcacaccctgtcgattcatgggtgtcatttgatgacgtagacgataggtgggcgcactactctgaccatctggcgccagcaggtgacatatgtgttgtgccaggtcagtgtgcgcccgactacatcgattggttcttcgtgatatctcattcattcatgactgcgccacaaacatcatatcctcctcgagatgcatctacgacacagcccaaacatatccctcaggagccagcaccagcatcgacacatgcggattgtgatgcagatgagcctagacatgcaatgataaatgaggcttgccatgccatagcggagacgttggagcatcatctcagcctaaatgaagtcacgccaggcacatcgacacatgagctcatccaaaaatgcctcaggatttccaggggtgtcatagaagactgcaat

SEQ ID NO: 16228 - DNA, 156 bp, Glycine max
  Peptide Sequence Number=SeqID_133006
atgtaccttgaaaggccaaagacaccagagaacgcagcaatgtggcccgtgaaacgaaaagagacgcagattagagggagagagaggaaaattaaaaagaagggtgggagggaagtaagttcgaaagaacgaacattgaggcgaaaacggcattga

SEQ ID NO: 16229 - DNA, 336 bp, Glycine max
  Peptide Sequence Number=SeqID_133007
atggaggagaaagggcacgcaagaaacttcaaggaagcacagcacacacactcaaagagaaaggaaaagctccgcaacaacttgggggaggagaagtgtagaaaaatttatgttcatggagcatttttttataagagaaaacgtaaggaagcaacagtcacaagcctactcctccattttcagctacaactgcaacctgcaaccctaacctatcactgcactcatcagaaacactgcaaccctagcctgcgtaacactgcatggttgattcctccacgtcagtatcgccaatgggagaggcgagagcttcctccacgtcagtatcgccattgctga

SEQ ID NO: 16230 - DNA, 219 bp, Glycine max
  Peptide Sequence Number=SeqID_133008
atggacgctactgttgctatacgcactcttgaagcaacttataagtcatcagccaatgtagttgctattgaaactatgattcttaaacatactcaaaagccatggccacctgcggtagttgccctgcccactagccattctggccaccccgctacacctgcggggcacgttgtaccgctagccattctggccacctgcggtacttgtatactcgtctga

SEQ ID NO: 16231 - DNA, 354 bp, Glycine max
  Peptide Sequence Number=SeqID_133009
atgaaggatggctgcaacagcaaggtaccaagccgtgtaagtggtcattccaagacccaaaaaagaccagattcggtaattgtggaaggaaggtatgaaaacagtggtggcacagcaagctccaaaaatataagtccaagtccgtttatccaatttgtcatttatgtagtagatgttactgtttggatcaaagaagcaagaaccaaaaaagatgagagaaaagaaaaacaacttcaagttgcccactctatattacttcaagttgcctttaaaatcgaagcaaagatgtcaccttgcacatgctataagctgtatcacagatccaaagaggaggaaagtacagttgaaggctag

SEQ ID NO: 16232 - DNA, 778 bp, Glycine max
  Peptide Sequence Number=SeqID_133010
atgaaagatgatgagaaaagaaaagtgcaagatgatcaaaaagccgaaaacattctaacttctggtttatcttctgatgaattcttttgtactgcaaggtgccaaaatgcaaagaaaatatggaaaatgcttgaagtcactcttgaaggcaatgcagacataagaagagcaagtcttgaaaaaaagtttgaagatgatgagctgaacatcaaaatcctcaactgtcttacaagaacttgggaacaaaggatcacaatgatcaaggaatccatggacttagcatcaatgttgatggaagctctctttggaaaattgcttgcatatgaacatgagttgattcaacaatctcatgcagaagaaacaaaaaagaaaaggaattgcactcaagaagatagaaaacgacaacaacaccttcacatgcttcaaatgtggaagcaaggtcacatcaaatctaaatgtcctatttaccttagaaaacaacttgttgaaaagaaaggaaagaaggaagaaaaatatagaaaggcctacatagcttgggaagacaatgcatctgcatccttcgactgttctagtgaagaagatattgcaaatgtgtgcttgatggcaaattcaatggatgactcctcaaccattgaagaaactgaggtaaactttgaatttgaagaagttttggaagcatttaatgaaatgcatggtgaagtgcaaaggcatgttgtttcaaacaataagctgagaagtgatctaaaactgcatatcactaaattggcttcaacacaaa

SEQ ID NO: 16233 - DNA, 759 bp, Glycine max
  Peptide Sequence Number=SeqID_133011
atgttgtctcagaagcaagcagaggaagccatagtcacaaacgagacagaacataaagttggcagcactagggaagaagagaaggagcaaggccactccattttcagcctcaagagcatcctttggcatggtggttctgtttgggatgcatggtttagctgtgcttcaaatcaagtggctcaagtgctcttgacactgccatgctccttctctcaacttggcatgctatcaggaatcatttttcaggtgttctatggaattattggaagctggactgcttatctaatcagtgttctctacatagagtaccgcaccagaaaggaaaaggaaaacgtcaacttcaaaaatcatgtcatccagtggttcgaagtccttgatgggttacttggtccatattggaaagcattggggctagccttcaactgtactttcctcctctttggatctgtgatacagcttatagcatgtgcaagtaacatctactacataaatgacaaattggataaacggacttggacttatatttttggagcttgctgtgccaccactgttttcataccttccttccacaattaccgaatctggtcttttttgggtcttggaatgaccacttacacggcttggtaccttgctgttgcagccatccttcatggccaggtggaaaatgtcacgcacacgggtccaacaaagctagtgttatacttcactggagccactaacatcctctacacgtttggaggacatgctgtgactgtgtaa

SEQ ID NO: 16234 - DNA, 267 bp, Glycine max
  Peptide Sequence Number=SeqID_133012
atgcaaacctatatgggaatgcttcttaacctagcaaggaacttgaggaatcgcttaggagttggtggactgattgcagaggacataatgttagtttacctcattacctacattctcacttcgaggtcaagtaatcatgctcagcattcaatgagattatcgaaagatgttgaagctaaagctccacaaaagcctgcacatcagtggagttcttttcagtcattcatgattaagaagatgaatgttatgcttcacctccatcaatag

SEQ ID NO: 16235 - DNA, 876 bp, Glycine max
  Peptide Sequence Number=SeqID_133013
gactacacgtcctcaccatcagagggctgcacgccctcacactcagaaggactacacgtcctcgccttcagagggtcatgtaccttcacctttagaggactacacgtcctcgccttcagagagctgcacgccctcaccttcagaggactacacttcctcgccatcagagggttgcacaccctcaccttcagaggactacacgtcctcaccttcagaggactacacgtcctcgccttcaaagggttgcatgccctcacctttagaggactacctgtccttgccttcaaagggctacacaccctcaccttcaaagggctacacgccctcaccttcagaggactacacgccctcgccttcagaggactacacgtcccccttttcagaaggctacacgctctcacctttagagggcgacacgtcctcaccttcggagggctgcgctctccctcgtcttttgagggctacgcgtcctcactttcaggacctgtaatttcccttcgaccattctttttcccgggccaccccttgatctcaaaggagggccaactgtgcgagcacaaccagaggaaggctatcgcgcaactactgtgcataccggggcaaggtttcacccgtgccactgcaaagagccgagtgggtcacgcccacaagacacccagtggacttggagaagtccaacagggccctggggtttccaactttggttacgggcctctattagtcctacagggtgcccgtacccccctgcaagggattgcatccgcaagacacccagtggacccaaagaagtccaacagggtcctggggtttccagctctgattacgggcctatgtcagttctatggagtgcccgtcatccccagcaaggtcatcaag

SEQ ID NO: 16236 - DNA, 195 bp, Glycine max
  Peptide Sequence Number=SeqID_133014
atgaagaatcttgcaataaaggatttcctaaaagagagggtaaggtcagagtttggtgacaatattgtcactatttgcaccttccttcaggtgacaagggccaaggaagaaatcctagtgtacctcattgaaaatggtgagagtttcaggggtggaatagggcctaggttcaggcaaatagatggaagcagctag

SEQ ID NO: 16237 - DNA, 830 bp, Glycine max
  Peptide Sequence Number=SeqID_133015
atgcaaaacaacgtcaagcaatttgtccaccaatgtgccacctgtcaacaagccaagtacattccaaagtcacctgcaggattactccaacccttgcctgtgccctcgtcgccatggacggacctctccatggatttcatcaccaaccttccaccctcacaaggttacacggtgattttcgttgtcgtggaccatttcaccaaaggtgctcatttcggagctttacactcacatttctcagcccacaaggttgccattcttttccttgacatggtatgcaaacttcatgatcttcctcacagcattgtttcagatagagatcccatctttattagccgtttttggcaagagctattcactaagtgcggcacgaagttgcgcatgagcacatcataccatcctcagacagatggtcaaaccgaggttctcaatcgcacgctggagcaataccttcggtgctttgtacacgaaacacctaccaagtggttctcgtacctatcattagtagagtggtgttactacacttctattcattcatcaacgggcgttacaccatttgaggcgacttacggctacccacctccgacaattcctcagtacttgctgggttcatcttgtgtcgatgtcgtcgattacctcttatcatcccgccaggatctttggaacctcatccacaagagacttatgaagacccagagtgctatgaatacccacgcggacgccaaacgcagagatgtatcctaccaagtcaacgattgggtctacgttaaacttcatccctatcgtcagacttccctgaccaacacaaagtaccataagctcactaaaag

SEQ ID NO: 16238 - DNA, 1011 bp, Glycine max
  Peptide Sequence Number=SeqID_133016
atggagccgtccgacatcgccaaaactgtttttcgaacccaccaaggccattacgagtatcgagtcatgcctttcggcctgtgcaacgctccatccacgtttcaagctaccatgaacgagcacctcaaacccttcctccgcaaattcgtcaccgtttttttcgatgacatcttagagtctcacttgcagcacctcaccaacgtctttgatagtcttactgcgggccaattttaccttaaggagtccaagtgcttactagcccagcgccaactcgaatacttgggccacattgtctcacagcaaggtgtagcacctgatccttccaagatacaagccatggtagattggccgattccaaccaccatacagtccttagggctcactggcttctaccacaagttcatcaagcaatatgcctccatcgccgccccattgacaacgctacttcagaaagacaattttcattggaatgatgatgcctctgcagccttcattcgccttaaagaagcaatgacacaggcaccagtgttggcattacctgatttcaccactccattcacggttgaaactgatgcttcaggtctagtaatgggagcagtactcacccaacatggacacccactggcatttttcagcaaggttttctgcccacgccttcaacgatcttcaacatatgttcaagagcttcacgccatcaccacagtcgttcgtaagtggcgacaatatctgctgggacattccttcatcatccttacagatcataggagtctcaaagatctcatgagtcaagtaattcaaatgcctgagcaacaaatttacttgtcaaaactactaggttatgattataccatcgagtacaagtccggcaagtcgaacgttgttgcaaaagctatctcgtattctgtcggggactacagcctcattctttgtcctatcgacaccgaatttcaccttcctcgacgacctgcgtcattccttggccgacaatcaccacttcagacaacaatgtga

SEQ ID NO: 16239 - DNA, 294 bp, Glycine max
  Peptide Sequence Number=SeqID_133017
atggatggtgttgaacatcataagtgtttgataaagagtatattggctaagagatcatgggactctgaagcaggaataaatggagtagctcagcattttagatgcaaaatgcagaaaatggtagatcataagtatgagaaccatcaaaaagtaaatggaaaacagagtgcatttggggctaaggtaaaggaaaggccgagtggcctcaaagtggccaaccaattgctagatgcacttcatattactgaaaatagcgttgctccagagatgatttcatcagcaggagtgccttaa

SEQ ID NO: 16240 - DNA, 252 bp, Glycine max
  Peptide Sequence Number=SeqID_133018
atggatgtcaaagttgttgctacacctactacttgtcgtgcaccttattgcagcaacaacaactatgacgaagttaagatgagaaaaaaatgtggtacttcacttgatgatacttcactcaaccctctagttggtcagaatccttcatcggtcagaatcctccactggtcagaacccttcataggtagtttctcattaagtcattatcaatcaatatcaagactgcttgcatcacctaacagcttgccataa

SEQ ID NO: 16241 - DNA, 309 bp, Glycine max
  Peptide Sequence Number=SeqID_133019
atgtgggtgagcagagagcaagacaattgcgacggaggcatgggaacctcatgcgagggtggtgtgacggtggtggagcttgtgcaacgccagcatgattatgatgggcaacggaaaaaaatcatcggtaatttatactttccgacggaaaaattatccatgggtaaatttcgtcaagaattcaaacattccactccgtcgatcaatttcattggtaatgcagacatttccaaaagaatacattccgtggaaaatattttgtcggtaataatgatttttcttgtagtgtatgcagagcaaatactttag

SEQ ID NO: 16242 - DNA, 771 bp, Glycine max
  Peptide Sequence Number=SeqID_133020
atgagacgggttgttacacctgacgtatgctggatgccttatggtgaccatcaaggagttagggtgtttgacctcatttcatgctttcaaggtgagcttagatggggttccattatggtcacacatcgcccggagagggtggtgcgccaatttggctacattcagaccattcctccaccgcctattagtgccaccttgtcatttgaggatatggacaacagacatccacctgtcccacagcatgagacatacgtggagctagatatctcggaggtcccagtggcaccagaagctggatcttcacaggcagctgatcagcctaaacatgtagtggatgcttgtgaagcgatcgtagaaaggttgaagcatatgctcaacctaaggatggtcactgcaggcacagagttacatgacatcatggaagactgccagaggatcgctaggggggcccatggaggaggcaatgaggcgggaggcggcggaggagtggaggaggttggattaggtgaggaagggggtgttgagcggggaggtggcggaggtgaccgcggtgacgagggaggtactgaaggaggaggaggaggagagggggagaaggaggaggagagggagaggagggagtttgtggtgcacgtgctgctgctggatgagaaggagattgggaggagggtgctggagaagaagaagaaggatctgttgagtaggtacacgagtgaggggcttgtggaggagcagactgaggccaaggacatgctcaacattcagcgttag

SEQ ID NO: 16243 - DNA, 219 bp, Glycine max
  Peptide Sequence Number=SeqID_133021
atgaacgaagaagaacgaaaaatgttcacggaattgatcacgaaaacgtgttggaccccttcccctcagcctccaatgccattttataggaaaaatggaggaggagcttgccacccagctcaccacggcatgctcagctcgcccaagcgagctggtggcttaagcttgaagcaacatgcacgcctaggcgagcttttgcttcctccagaagattcctga

SEQ ID NO: 16244 - DNA, 789 bp, Glycine max
  Peptide Sequence Number=SeqID_133022
atgattatgttggtggagttgctagaggtcttggatgaggaatctagagctgagactgcacagtgtcatggggcatatagtgggagctatgcatggggagctgccaccctagtgaatatgtatgatcagttaaatgatgcttctcaaagcactggccgacagcttgttggttacattactttattacagtgttggatatatgagcactttcccagtgttcatgagagcgtgactgatgaagggtatgatgagatgtcaccacgtgcctgccggtggcttactacgaaggcttatccgaaggcattcacatcatcgacgtaccggacatgtatagatgcactgacgatccctaatgtgagtttagttattagaggggtgtgggtagttaaaactctagcttctcatagaagcctctcgaggaaacttctcaaagaagcctcacgaggaagcttctcaagcaagcctctcgagaaaagcttctcaaggaagctacctgaagttgtctcggtttataggacagatttccatgattggaccgttgcgatctgcgatatatcttctgccttggaaaacagccatttctttctccttctttcttccaaaaccatttcctgcatcccaagcttcttctctcacccacagccaccagtagccaccacagaccgccgttgttctccgttgaaaccccacaccgagaggaactcttcaaccgaagcggaatcttccaaacttgccttgcgatttcggttgagaacgaagccccggtctaaccttcgtggttttccttga

SEQ ID NO: 16245 - DNA, 279 bp, Glycine max
  Peptide Sequence Number=SeqID_133023
atgcagctccaaaaggccaccaacagagaagacgaagatgcgcaaaggagagcggaggagaagacaaaaacaaagatgaaagatctgggttttgtcctagttggcttcagtgttgtcgtcttcatcgacgcgcatggggcacttattcttcgacgacaaatatggacatgcgacaagggagatcgaatgagagagatttgtgcgatgaaggcaatatgcgaggtggatgacaacaatatttacatggagaaggcaacacgcgagatagtgtgggagtag

SEQ ID NO: 16246 - DNA, 1002 bp, Glycine max
  Peptide Sequence Number=SeqID_133024
atggaacagactctcaaagtgtatgtatacagagaaggagctagaccaataatgcactccccatttttcacaggactttatgcttctgaaggatggtttatgaagcaaatggaagctaataagagatttctaactagagacccaaacaaggcccacttgttttacttaccttttagttctcgaatgctagaggaaacattgtatgtgcagaattcacataatcataagaacctggttcagtatctgcataactatgttgaaatgattgcagggaaatatactttctggaacagaactggaggcgctgatcattttcttgttggttgccatgattgggcccctggagaaactaaggttgacatggctaattgcatacgatccctttgtaatgctgatgtgaaagaaggatttgtttttgggaaggatgcatctcttcccgagacgtatgtccgcgatgctaagatccccactaaggatctcagcgggaattcagcttcgaagaggacaacgcttgcattttttgcagggagcatgcatggttatgtgaggccaattttgttgcagcactgggaaaacaaagaccctgacatgaaaatctttgggagattgccaaagtccaagggcaacaggaactacatccaatacatgaagagcagcaagtactgcatttgtgccaaaggctatgaagtgaacagtccaagagtggtggaagccattttctacgaatgtgttccggttataatatccgacaattttgtgcctccctttctcgaggttctgaattgggaatcctttgcggttattgttctggagaaggacattcctaacctgaaaaatatactcctttccatcccagaaaagcagtatcttcggttgcagatgagggtaaaaaaggtgcagcagcatttcctttggcacaagaaccctgtcaagtatgacatatttcatatgatacttcattctgtttggtacaacagggtcttctctgcaccagctaggtga

SEQ ID NO: 16247 - DNA, 405 bp, Glycine max
  Peptide Sequence Number=SeqID_133025
atgtcggatcaatttgagccatttatacagggtttcattgacaacattgtggatgtgaaagtggatggtaactttggatattggtccattgccactttattaggtatggacgaagattcttggttgttggtgcacaaccaattggttaaagaacttggaaaatggtcagatgactatatcaacctcttcgatggcatagacaaatttgacgaattaaggcggtccctacttgttgatgggttttccaaggttagtatggataagtggatgaatataatggagatgagatatgtcattgcatcaatttatttgaatgaccgttgtcctttaccgcctctagcattattatggtctaggaattctcatcctcagacatgtggcctcagaaatcttaagaaggggtga

SEQ ID NO: 16248 - DNA, 283 bp, Glycine max
  Peptide Sequence Number=SeqID_133026
atccgacgatgagtcctgcgaaggtactaataccgagggccctgacgttgattttgaacgagtagcaaaccaagttgaggatgaagaagatgaagatgcggggtttctcccggagctagaaaggatggttggtacagcaatgaccacaccggttcgagatgagttggtggtttttctacgaaactaccaagacgtcttcacctggttgtaccaagatatgcccgtggctcgataccccgaatgggtggccaatattgtgtcggtctctaacaaggataggaag

SEQ ID NO: 16249 - DNA, 174 bp, Glycine max
  Peptide Sequence Number=SeqID_133027
atgtacctcctttcaaaggcaggagtgacccagacgcctaccttgactaggaagaatctttattgggcttatggataccattgcattattgagcagataagggaaggtggtgtctggtcttggatgtgcagcagtggattttatggccgatctaggggtggcctctatggatga

SEQ ID NO: 16250 - DNA, 149 bp, Glycine max
  Peptide Sequence Number=SeqID_133028
atggaggagttgattaacaaaacacaactctctcccaaaataatcccaacatcatcacgtcggctcggtgactccacaaaggaatctcacttctcgtactctactgttgtcattctgttcccacaaacaaaggttcgcgatcatcacag

SEQ ID NO: 16251 - DNA, 333 bp, Glycine max
  Peptide Sequence Number=SeqID_133029
atggctcgcagagacaaatatggtcatctgctcctttgtggagacctcaatgtctttcgaccgagactgtttttgtctccatttcttcatccagagacaaccatgtccaatgttccctttgccacccaaagacaagcgagtccgatggcaagcggggacagaccatggtctttcattgttctcaaaattattgaagtttcccctgctatcccgagacaatcgagtccgatggcatgcggagaccatcacagtcatctgtttttaatcgctttcaaggtttcgctgattgggctagcggttggttgggtggagaattcacttgaacgaaattag

SEQ ID NO: 16252 - DNA, 330 bp, Glycine max
  Peptide Sequence Number=SeqID_133030
atgacatgcgggggtaccgtatggttatccgcaccttttgtcatcccgagcggcaagtccgatgaaatgcgggggtaccgtatggttatccgcacctttcgtcaaccaggagcaaacaagcccgttgacgcgcagaaactagtgttgtcatcttccgatgacatgtgggggtaccatatggttatccgcaccttttgtcatctagagacgtcgagtccgatgacatgcggggacggcaagtctgatgacatgcgggggtaccgtatggttatccgcaccttttgtcatcccgagacagcgagtccggtgacatgcggagatactcaagtg

SEQ ID NO: 16253 - DNA, 453 bp, Glycine max
  Peptide Sequence Number=SeqID_133031
atgaccggccctctcaatgagtcaatctcttgctttctcataagggtgggccctcgggtactagtaccctcaccttcagaggactacaagtcctcaccttcagagggttacacgccctcaccttcagaggactacacgtcctcacctttagaggactacacgtcctcgccatcagaggactacacgtcctcaccttcagaggactacacatcctcacctttagagggttgcacgttctcaccttcagagggctgcacaccctctcttttagtgggctggacaccctcaccttcaaagggtgacacgtcaccgactttagaaagctatgtgtccttactttcagtgggctccatagctgtcgcaacctgcccttttgcgggcgagcgaggtcgacaaaagcggggctcttgctcctacgtaccctccatcgaagaggaaatcagacctacgtag

SEQ ID NO: 16254 - DNA, 548 bp, Glycine max
  Peptide Sequence Number=SeqID_133032
atgaggaccttggacaccatgaaattggcaattatgatggagacaaccatgaggtcatcctggttgatagggttgatgcccttgaagtccctatctgtgaatgcgatgggagggaaaattcatgggtccaacaatcttttgtattgtgaccgtaactacgatggcctcctcaaggatagtagtgcgattggtcgtcaagggtgtgtaatgctcacacctgggttcttttggaagaggctagcgcttgtcgagcttgctagtcgcatattgagaattgaagcattcaacaagggtgttgaagttgtctatggacgtagggaagacatgacacaagattgtgtcgtcgttggtgtagagattcgtctggagtgtgtcgatttccatgatgcgatcgacaaaggggtgtcaatgagtagccttccctttagaatgatgtacatgggagagattgggatcatctttggtgttgacggattaaagccttcgaaaggggtctcgcgtctaaagctagaccgcatgctaagcatgagtgaaagagaggccacggg

SEQ ID NO: 16255 - DNA, 1150 bp, Glycine max
  Peptide Sequence Number=SeqID_133033
atggataaccatcagcatggaaatcatagtgatccagcacaagctaggataaagaaaaaaggaatcaggcaacacaaagttaatgatcaggctcagaatattgattctaatattcctgattcatcagaggataagagttctgaatcaacacaagtttcttcacctgaaaatcaaaactatatgtcctcagctaatgagcctgcaattaatagagaagggtattttgatcttggtgaccaactcatgcagtgtagccactgtaatgcaaatatgtggtatgatgaaagaatctcaaaacatgaaagaactacaaattcaagattcagcttatgttgtggaggtggcaaagttgaacttccattgttacaaaatccacctaaatatctctaccaacttttgtatgatcatgatacatctgatagtaaaaattaccaacagaacataaggacatataacatgatgttggcctttacttctgctggtattaagttcaacaaatcaattaatcattcaagaggacctcctacaataagaattcaaggtcaaccatgtcatataataggtagcatgttaccaatgcctaggaaagaacctaaatttgcacaattgtatatctttgacacagaaaatgaagtgcagaataggattaatgcaataagcagtccacataatcaaattcaagggcacattgtttcacaacttagtgagatgctggatgaatacaacgtgcatgcaaaaaatttcaggatggcaagagatagattgcaagatggtcaagtggataatatcaagttgaaattgattgcaaatcatgaaaaagatggtcgtacatataatgtacctactgttccagaagttgcagcgctaattgtaggcgattttgatgcaaattcaaaaagggatattattattgaaactcagcatggacaattacaaaggatccatgaattacattgtagctatctagctctacaataccctctcctatttccttacggggaagatggatatagacctaatatcctacatagcagtgcaccagatgaaaggctttctcacatcagaaacaaccaaaaaaaacttcgagttgacaagttttgcagcttacaacagtcattggatgatggaagcacgaaaggcctaaataaag

SEQ ID NO: 16256 - DNA, 1713 bp, Glycine max
  Peptide Sequence Number=SeqID_133034
atggaagtagagaaggaaaataccacatctactattactgcagaaccctcagtatctgcctctgatggtcaagatcctgtttcttctgttaatgcatctctacccgatcctatgcaacctgttattccacaggttattgcaccttttgttgtaccttctttagctccaattcctgcaattcctccgcctcgcccactggcaccgcttccagttcggtcacctgtcattaggccacctgtgccacaaaatggcgaggttggatcaagtgactctgattcagacaatgatgattcaaatgcaagaattaaccaagggggtggggagtatgagatatcggaagagagtagactggtgagagagcggcaggaaaaggcaatgcaggagctcatgatgaagaggcgtgctgctgctcttgctgttcctacgaatgatatggccgtgcgagctcgccttcgacatcttggtgaagctataactctgtttggtgagagggagatggagagacgggacagattgcggatgattatggcgaagctggatgcagaaggtcagctggagaagctgatgaaagctcatgaggaagaagaggctgtggcttctgcttcgaaagatgaggctgaggaagaactgcagtatcctttttacactgaagggtcaaaggctctcctggattccagaatttatattgctaaatattctttggcaagggcagcattacggattcaacgtgcacagaggagaagggatgatccagatgaagatatggatgcagagatggattgggcattgaagcaggctgggaatttgagtcttgaattcagtgaaattggagatgatcgaccactttctggttgctccttctcaagggatggaaaatggcttgctacctgttctctgacaggagcttccaagttgtggagcatgcccaaaataaaaaagcattccatcttcaagggtcacacagagcgtgctactgatgttgcttattctcctgttcatgatcatttagcaactgcctctgctgatcgaacagcaaagtattggaatcaaggatctctactgaagacatttgagggtcatctagaccgtcttgcccgcattgccttccatccatcagggaagtacctgggtactgctagctttgacaagacatggagattatgggacatagaaacaggagacgagttgcttcttcaagaaggccatagtagaagtgtatatggtctggctttccacaatgatggatcattagctgcatcttgtggactagactctctggctcgtgtttgggacctccgaactggaagaagtattcttgcactggaaggtcatgtcaaaccggttctcagcatcagtttttcacccaatggatatcatctagccacgggtggtgaagacaacacttgtcggatttgggatttgaggaagaagaaatccttttatactattcctgcccactctaatttaatatcacaagttaaatttgagccacacgaaggttactttttggtaactgcctcatatgacatgactgctaaggtttggtcaggccgtgactttaagcctgtgaagacactatctgggcatgaagctaaagttacttctgtggatgttcttggtgatggcgggtctattgttactgtctcacatgatcgcaccataaagctgtggtccagcaatccgactgatgaacaagctatggatgttgactaa

SEQ ID NO: 16257 - DNA, 198 bp, Glycine max
  Peptide Sequence Number=SeqID_133035
atgaccaagaacaacaaagtgacgtcgaggcatgattgtgtaaggcaactatggaaggatttgtatagttgcaaagcaccatcttgtactatgccttcaaaacccacatcgattcatgggacaatcctgatggggagtgttgttgaggagttattcctcaaagcaatggatgaccacagagtggtatttgggagatga

SEQ ID NO: 16258 - DNA, 345 bp, Glycine max
  Peptide Sequence Number=SeqID_133036
atggaaataggaagggaaggggagaagctttttgtagtgcgagaaatgaaggaaaataaaaaaattattcaaatttttcttccagtagcagcttccagatttgtatatggttccaaaaaatatattacgctccagcggggcctaggaaaacgcacccaatggaaggtcaccgtccacgatggtgtgccatctattgctgacccatggttccagtaccttcatgaaaaaaaatttatggccgaagatgaggttgtcttctacttccggtttgatgaccatgcatgggagcttttgatcaggaaagatatcgaatgggacgaggaggacatccaccttgacgactga

SEQ ID NO: 16259 - DNA, 174 bp, Glycine max
  Peptide Sequence Number=SeqID_133037
atgagtgagatacgaaggtttggaggtttgggaatggaggaacgtcgcaagagaaaaggggctgcgcagggaagtctggaaaatgttatatttatagagcaggacgcgtggccatctgttctagtgaaaaacgattacagtattgatgtaatcgattaccagaacaaaaaatag

SEQ ID NO: 16260 - DNA, 288 bp, Glycine max
  Peptide Sequence Number=SeqID_133038
atgacacgttcatactattgttatgctaggcatgttgagattgtcaagttgtcatctaattcttacattcaagttttagatgttggatcaaaggattccaaggagaccttacctatcgtggaatcacctaggactaagctgaaggctagttacacttttccaccggggactagatgtcctctagtattggagactagtgtggaagaggcgacgttgtctattacaaagcttagggctttagagtcagaggaggacaacgagaggacttctcatgacaatcttccatga

SEQ ID NO: 16261 - DNA, 889 bp, Glycine max
  Peptide Sequence Number=SeqID_133039
agggctacacgtccttgccttcacagaagcacacatcctcgccttcagagggctacacatcatcgccttaagaggactacatgtcgtcgccttcagtgggctacacgctctcgcattcgtagggctacacgccctcaccttcaaaggactattcgtcctcatcttcaaaggactacacgtcctcaccttcagaggacttcgcgccctcgccttcagaggactacacgccctcgccttcagaggactacacgtcttccatttcagaggactacacgtcttcccatttaaaggaccacacagccctaccttcagagggctacacgtcctccccttcagaggactacacgctctcgccttcagaggactacatgtcctcaccttcagacgactgcacgccctcaccttcacaggactacacgtcctcgcctttagaggagtacacatcctccccttgagagggacttcaagcccttaccttcagaggataacacgtcctctccttcagagggctacacgtcctggccttcagaagactacacgcccttggcttcgtagggcatcacgccctcaccttcaaaggactacacatgctcgccttcaaaggactacacgcctttgccttcgtagggctacacgccctcaccttcagaggactacacatcctcactttctgagcgatacacacccttgccttcagaggactacacgtctaagctttcagggggctacatgtccttgccttcagcgggttacacgtcctcgccttcaaacggccacacgtccaagccttcagagggatacacgtcattgccttaagaggactacatgtcctccacttcagaggactacatgtcctccacatcagaggactacacattctcccctttga

SEQ ID NO: 16262 - DNA, 255 bp, Glycine max
  Peptide Sequence Number=SeqID_133040
atggaggagcttgatgctcaggtggcctggccaggagaccaaccctcttcttttggagggggtgaggcctctacagcccaggagcttgatattgaggagccaccaacaccaacaccagcagaggaggagactacttctgatcagatccagccatatacaccagttacggagcctgagcagtctatccaggatttatcagcaactccagcactggatctgaatgaagaccagccacaagaggagcaagacgtttaa

SEQ ID NO: 16263 - DNA, 318 bp, Glycine max
  Peptide Sequence Number=SeqID_133041
atgtgggaagcatcatccaccttgtggcatggtataaagtgtgccatcttgctaaacctatccatcaccacaaagatagagtctacacctctttgggttctaggaagcccaaggacaaagtccatactaatgtctacccaaggtgcagatggaatgggaaatttcaatagggatttaccggaaagcgcattgggtcgtcaacctaaattactaaaccctcgatccctcgtcaggctgaatatccaagcttcatccgtagatccctcatttaagactgcacccgatttagacaaccctcttaggtttagactaacataa

SEQ ID NO: 16264 - DNA, 381 bp, Glycine max
  Peptide Sequence Number=SeqID_133042
atggtggcacctccagactctattcctttaatagagcagtttaatgagtgggtagcctggcccgggactcagtcttctcttcatagggaagatgaaggtcccacagcccaggtaccactgcagatggaggatgagccatctgagactaccactccagagcccttggtcagaaggaagaaggcagatgaaacacaagaagctgtagccacttctgagaaacctcttgaggccacttctgagccttcagaactagtggtagatacaacttcacctcagcaggcaacagacccttccactcctgaggatctaactacaccagtcctatctctgaacacctctcctacagctacccctgtgcttcacttaacaaacgaggaagat

SEQ ID NO: 16265 - DNA, 1266 bp, Glycine max
  Peptide Sequence Number=SeqID_133043
atggagctggctagaacggttgtggagatgcagtccacccttgattcactaaaagatgagcagaaactgatggaatcagaatttgaggagcagcagaatgagctgagattgatgcaagaaaaggggaaaagtgttggacaaggaagatctgaaatagaagcattaagagataatcttaagcataaggaagcagagatggaggacttgaagcgccgtcttgaaatcccggttaatgatcatccaactatctttcctgaaattgtgacagcaaatggaacaatagcagcacaggatgaaaatgggaaggatgagatttcaggtgaatctgccaaacacgaaggtgatactgataacaatgaaggcacaattaaaagtgaattaaccaagttcaaagatggagaggttgcaactgagataaaagatgaaattaggattgatcgggagctaggaaaggcaaatgaagaccctcgagatgatgggggtggcgcggcaaaagatcttgatgatgttgaagaagcggatgggagagaaaagaaagcaatacaagagtatgcaggacaagtagagaataatacagatggtggagatcaggtgaagcaattggctgggatgaagaggaaacatggccgtgcaagtagaacaaaagggaagcgctggagaaccactgtcaagaatagtttaatggagaacaatggggtttttgaaaaccactcgggagatagaaaggtttacaaagatgagttgaaaggtagaagatttgggaaagtctctaatgagggaaattttgcaagaaaggatgtgggattgaacaataacagccatagaaaaggcaagccactagccaaattgttgaagcctgaaaaccatgaaagcaaagaagatgccaatgacatgaaagtgaataatacaaaacaccaggagacaaatagtggaactaacatatactcacagaatcagatactggatgaaatgaggcagttagaagagaatgaacagagtcaagtccaacaaaactggagcaagaggcatatcagaaaagctgacaagaatgcagggaaaacaaaatccaaggtgttacttgaagggcctgaagaattagaggagattttggatgtaaagaagcaagaggaggatcccattgacagtgaccatgatgatgaggataatgacaactatttcttcaaggatttgcactctgaatttttagacgaaaaggatgaatacaaggaagagatagacgagtcagagtttcagactgatttgtaa

SEQ ID NO: 16266 - DNA, 822 bp, Glycine max
  Peptide Sequence Number=SeqID_133044
atgaatattaaaatcccagatattaacgtgaaaaaaaacgaaaactttgccaaccaacaaagcattgaaagcaaagtcaccactcttgaatctgtggccacccagattgagaagaatggccaaaacaacaacaaaaatcttgccttgggaacagtaaaagaaagcagaaaaagcatgtttgcatctctacaggtgaaatctgagctgtgccacaagagtatgaggaaaaatgtcggttctcattcaggaaggatgtttagtgataagaagtggattctccccttttttgcaagtttgattatatctatgagtctagttctgacagccattcttggattacttagttctgatggcgggggagagcagtcaccatttgaaatcatttccttcaagagatcagaggattcaagtggatattttgtggaatcagatatagagaagtccttaaatgttagtgtggtgaaaagggaggcaccaaggtttgcatatcttatttcaggcaccaagggtgatagtcataggatgatgaggacattagaggcagtgtaccacccgaggaatcaatatatcttgcacttagatcttgaggcgccaccccgggaaaggttggaattggcaaatgcagtgaaagctgatccaatatttcgtggggtggagaatgtgcgtgttatgtctcaatccaatttggtaacttataagggtcctacgatgattgcttgtaccctccaagctattgcaatattgttgaaggaaagttcagagtgggactggtttattaacctcagtgcctcagattatccccttatgacacaggatggttag

SEQ ID NO: 16267 - DNA, 186 bp, Glycine max
  Peptide Sequence Number=SeqID_133045
atggctcatatcaagaaattcaaccatattttaaccaattgtgcttcatcgagaaaactcagaagcgcggataaggaacaaaagaagaaccctcgccccaaggtgaaaaacgaccgcgtttcgatttacgcctttaggactagctccgttttcagagaacacgtgtggtgttcgaaaagaagctga

SEQ ID NO: 16268 - DNA, 171 bp, Glycine max
  Peptide Sequence Number=SeqID_133046
atggatcggaaaattaccggcgaggccacggcggtggatgagttgaaggggaatgcggctccacgtgcaaatgaggccatggcttctgcgaaggaaagagagaaagagggcacagtgttgtggtgctgccgatgctattcgaggacggaaatgcccagagggagcttttaa

SEQ ID NO: 16269 - DNA, 178 bp, Glycine max
  Peptide Sequence Number=SeqID_133047
acttaaaattgaaattgaaatccttcgtaatcaggctgatgagactgctgagctattatcagaattagcagaagttgttacacaagagaggttcctcttagaggaattcgatgatatcttccacaccatacgtgttctagagggtgcttttgtttttgatggaacaaaaaagaagtaa

SEQ ID NO: 16270 - DNA, 426 bp, Glycine max
  Peptide Sequence Number=SeqID_133048
atggcaacaagagggggaggctctgatgattcatgggtggcgaagacccacaaagcgatgaagaaggctaacaattcggttattggttacgtgacttccaagtctcactggccattgcctcatggccacataagcttgaggcctcaacacaagagtgtggagaagattatgagcatgggttttgatctctttaggcataagaaaccttcaaacgacgaggtggttcatgagttgcgtctgcttgataaccgtttgacccaatggcggtttgcaaatgccagagctcatgttgtgaatcatagaatgtctcttctggctaagggaaatttgataggtgctttggatggtctagccaatttgagatattcagtggtgctattgaagatagagtttgagagagaaaagcttgagctgaagctagatgat

SEQ ID NO: 16271 - DNA, 312 bp, Glycine max
  Peptide Sequence Number=SeqID_133049
atggtggtgacgggtgacggagaattagggttcgatttccggagagggagcctgagaaacggctaccacatccaaggaaggcagcaggcgcgcaaattacccaatcctgacacggggagttggaccttgggttgggtcgatcggtccgcctccggtgtgcaccggtcggctcgtcccttctgccggcgatgcgctcctgtccttaactggccgggtcgtgcctccggtgctgttactttgaagaaattagagtgctcaaagcaagcctacgctctgtatacattagcatgggataacaccacaggattctga

SEQ ID NO: 16272 - DNA, 396 bp, Glycine max
  Peptide Sequence Number=SeqID_133050
atgtctccgttacttttcaggacttcgagctgcttgacaccagttgtcgcacaatccgttaggtttttcgtcgtttcgataaagaatgcggaaaatgcccaaaagggagggcaaaagggtcattttgaggatttttcagacccatggcttgcccaagctagccgctggctcgcctgggccaccataagacttaggggtgaagtaaccagctcgcctaggcgagcaaggttacttcaggttgaagcaacagctcgcctaggcgagctgctattcaacctcctcccctcatttcctataaataggcgtgagggggataaagtaatgggttcagactttcaaacattgaaagatttagtgaaattaaggagaagaaggagaaagaagaagaaaaaatga

SEQ ID NO: 16273 - DNA, 165 bp, Glycine max
  Peptide Sequence Number=SeqID_133051
gcttgccatgcgatcaaggaggcgttggagcagcatctaaatgcgctaggcacatcgacacatgaagaggtcatccaaaaatgtctcaggattgccaggggtgtcacagaagaccgcaatgtgtatgtgaggtctcgacgtaggcggtgcacgaatcaacaatag

SEQ ID NO: 16274 - DNA, 699 bp, Glycine max
  Peptide Sequence Number=SeqID_133052
atggtgagagatctcccaaaagaagttagagacattacaaatgtcatcgatgaatataacctctcctgtgaggataagcaacctggtgatcctcgatgtgcagctttactatgtgaggttgttgccttcatcaaaactcaaatccttctccttcaaaatgcgtataagattcaggatgttaaatcgcttgtttgtgttgaaagagatggtttccaaacccattttcctttagaaccaagactaacaagttctagaggaaatcaaaatgtcacctggcagaaacttcgaatggatcctctctttattgaggaagacaatgttgtggggcttgatggccttagaggtacattgaaaaattggttgacaaagggaagagaaaaacgcactgtcatctctgtggtgggaattcctggggtgggaaaaaccactcttgccaagcaagtttttgaccaggtgcgtaacaatttcgagtgccatgcattgatcacagtgtctcaatcctactctgcagaaggactactgaggcgtttgttggatgagctttgcaaagtgaaaaaggaggaccctcccaagggtgtttctaacatggagtcattgaccgaagaagtcagaaaccgcttgcgcaacaagaggtatgttgtcttgtttgatgagggatgtgaaggttgcgggatattgttggaaatcatcatttgttga

SEQ ID NO: 16275 - DNA, 120 bp, Glycine max
  Peptide Sequence Number=SeqID_133053
atgcaatcacagggacttgcactgccttcgaagcctgagggaatgatccagacacgggtgactcaaacaaatgcaggttgtacatcgaagaaaatcctccccgcctggttgcccttgtag

SEQ ID NO: 16276 - DNA, 504 bp, Glycine max
  Peptide Sequence Number=SeqID_133054
atgccaagcgtacctgagctaagcgcatttcgtttcggcaaccgttgggctaagcgagcctcgctcgctaaattgccatacttagtgtatttttttaactgtatgatggcttctaggaaatgtaagagtatcggttcaagacccacaacacaatatgatacaaggagatttcactccttagatgcttggaaccggtacacggataatgtcctagggagaaacatcttgcctgagaggaaggtggagctctaccacactaagttggatgattttaaaaatgaggtggagaggcgtaatttctataaacgcctcaccaatttggtcgatgggagcatagacttggctttggtgaaagagttctatgcaaacctatacagctttgagggcccttcaccaaagcaagccagagttaaaggccatctactgaagatcgatgttgatagcctcaatacattcctggagacacctgttgatgcaatcctaccccgcaagggcattggatag

SEQ ID NO: 16277 - DNA, 198 bp, Glycine max
  Peptide Sequence Number=SeqID_133055
atgtttgcctacagtcctgtcgctaagcacaagcctcgcgctaagtgcatctttggtcatgtgctaagccgagagtctctagcacttagcactcaacccttgcatctcaagctgattgggtccgctaagctggccaaggctaagctaagccaatttcaattcgatctgaattcggctaagcggcggcatgatcgctaa

SEQ ID NO: 16278 - DNA, 258 bp, Glycine max
  Peptide Sequence Number=SeqID_133056
gagaaggacatgagaatcatggtggcaaaacctcggatagggtctaggcctcctaagtgtgagaaaagatgcaacacttgtgggcactgtgaagcagttcaagtcccggttgcacctcaaattcaaacccatagaaggcattattcatcagcaagagcaaccaaagctgttacttattcatcaagagatgatcatctttccaattacaaaccaatgagttggaaatgcaagtgtggggactaccttttcaatccatga

SEQ ID NO: 16279 - DNA, 1314 bp, Glycine max
  Peptide Sequence Number=SeqID_133057
atgactttaaaggtcgcgtgcttcagccctccgttctcgcatccggtgttgtactactctcacttctacttcttcagagactcccactcctacctccgtgaacttcttcttctccccaggaaacgagtagtgtcgggagttcagcccacgggttcaattcacctcggaaactattttggcgccatcaagaattgggttgcccttcagaatgtgtatgatacacttttcttcattgtggacctgcacgcgatcacattaccatatgacacccaacagttatctaaggctacaaggtcaactgctgctatttacctagcatgtggagtggatccttcaaaggcttcagtatttgtacagtctcatgttcgggcacatgtagaattgatgtggctgctaagttccacaacaccaattggttggctgaacaaaatgatacagtttaaagagaaatctcgcaaggcgataaaaaacaaaggcagaaataggccaaagtgcaagggtgaaactggagagaacaaaagttacagagcaatgggtatattgggatctttgaggaagaaaagagagtcaaaagagatagcagagacctgtgtctgttttgggatgggcttgtctttggccaatgtaggtttgctaaatcaggcccatgtttttcttcagtgctcctcatgctggcttggagatgaagaagttggggttgcccttttgacttatcctgttctgatggcttctgatatacttctatatcagtctgattttgtccccgttggtgaagatcaaaagcagcatttggagttgacccgtgacttggctgaacgggttccagagccccttatacctccagccggagcccggataatgtccttaactgatggcctgtccaagatgtcaaagtctgcaccttctgatcaatccagaatcaatattcttgatcctaaagatcttatagcaaacaagatcaaacgatgcaaaactgattcatttccaggtttggaatttgacaactctgagaggcctgaatgtaacaatcttctttccatataccagcttatttcaggaaagacaaaagaggaagttgtgcaggaatgccaaaacatgaattggggcgctttcaaacctcttttaacagatgccttgattgatcatttgcatcccattcaggttcgctacgaggaaatcatgtccgattcaggttatttagatggagttttggcacaaggtgctagaaatgcagcagatatagcagattctacacttaataatgtttaccaagcaatgggatttttgaagagactgataattgatgccaaataa

SEQ ID NO: 16280 - DNA, 1881 bp, Glycine max
  Peptide Sequence Number=SeqID_133058
atggatgacgaggagagagagaggcttctggagagggagagattgcaaatccaggtcattcgccagctcgatctcgaggacctcgtagtcgaagaagtcgaccactccgacgaagaagacatcgacggcgatcccgacgaggagtatgcgcttttcctttcgcaataccatttggatgcttctcttcctcctccctcatctgccgaattcaatttcgatacctatatcgcgcctttgcatacctatctcggtgatgtcgaagacacgcgccacaggactgcgttcttggacggtggcgccatattgaaccttcccctcttttgtctcggagcttctgctttcttggacggcgctttgttcgtggatgagacaaacaatgaagtaatagtgaacaattttgggaaactcgtgctcctacaggatggaaaacggggttgcttatgcgtctggactggatgggatttgagcttcactgagccttttcatccatctgcactgtctcatggagttgtactttttcctggggctactcttccccttagagttattgaacctcatttggtggctgctgttgagagagctttaactcaagatgatattccttgtaccattggtgtgattcgaattcacagggatactgcaactcggaggacgaaatcagctagcattgggacaactgcagagattcgacaatttgggcgcctgggggatggttctctgaatgtggttacccgtggacaacaacgatttcgcctaagacggtcctggactgatgtggaaggagtgccttatggagagattcaagttattgaggaagatctgccactcagaattccaagggatgcttttggcaaatcagcaccattgagtaatatgccctgtagccaaggtgtctcacataatttgtctccaaagtattcccatgttaacatgcaaaggtcaaaaaatgaggaaaatgattcagaaccaaattcagaagagagttttgagagtgagctctcactgatggaaaggaaaatccatctatcagttgttggctccagttatgtgcatgatactatggatgaatcagcaaatgataatgatgttaaatttatgcataactcagatcaggaaattagatccaatttggattcaagaactgggaaatgttccacttctggaaagcagtcatcaaaagaagagcttagtagatgtaaaaatatctgtgcctacccgtcttataagatttccaaagcattctggccccactgggcgtatcagatgtttgactcttattcgcttgcacaaagggctgcagatatgtggaagcgaatagttgggatgcctgacatggatagtctcattaagaagcctgatattttatcatttcacatagccagtaaaatacctgtgtctgagtctacaaggcaggagcttttggatattgatggcattgcatataggctgcgcagggaaattgaattactagagagcattgatcttatccggtgtaaaagctgcgagactataattgcaaaaagaagtgatatgttggtgatgtcaagtgagggtcctcttagtgcatatgtgaatccaggtggttatgtgcatgagataatgactctttacaaggcaaatggtttagctctcgttggatcagcagcaacagattacagttggtttcctggtttttggtctagacagtgttttattgctgagactctagacccttctacccatgtacttctcaatcggtatgcatggacaatcgcaacttgtgcaacatgtaaaacacaaatgggatggctttttacagccaggaacaaacaactgaaacccagctatttctgggggattcggagctgtcaacttgcagaggaaatacgccaaaacctttag

SEQ ID NO: 16281 - DNA, 684 bp, Glycine max
  Peptide Sequence Number=SeqID_133059
atggagaaattgttgagggaacctacgggggggtcattgggcaaggaattttaccaaaaactggctcgaagtttcaactattcctctggccgtgctggcaagcctatcataaaatggacagagattgagagttggtttcagactaggctccaagactcaccacaagtccctagcagtgagttgatggttcctaaatgcaaggaaggagaaactatgcaacacccatcagagttggaatttgaagcaagatcatcaaaagatggagcatggtatgatgttgaggcatttctagctcatagatttcttagcacaggggaagctgaagtccatgtcagatttgttggatttggagctgatgaagatgagtggatcaatatcaaaacttcagtacgccaacgctccattcctttggaaagcacagagtgttccaacctgaaaatgggagacccagtcctgtgcttccaggagaggagagatcaagcaatttactatgatgctcacattgtagagatccaaaggagaatgcatgatattagaggttgcagatgtctcatcttaattcgttatgatcatgacaacagtgaggtgagctttcaaacagtcagcaaaggacctgggtgcagcaggaagcaactagcacttgacattgagtatcgtgctcgttcatgcaaatttcatagctaa

SEQ ID NO: 16282 - DNA, 1188 bp, Glycine max
  Peptide Sequence Number=SeqID_133060
atgcctgagctgcgttcccggccacacataagccgccttgtagacagcgcaaacgccaatccgaccactcagccagcctcgccgccggccgccggagcctgtcgaaggaagccagccgtcgccgccgctccgaccgggaggaatcgcaggctgaacaacgcgattgccgtcgccgccgatcaaatcctgaacgccgaagacgaaggtggtgccgttcgtggaaccagagcgaggaagctgaaacaagatcaaggagtgaaggagaatattaaaaataagaaggtttcagttagggttttggaagtggaaggcatggatgagtacgatagtggtagccgcagtgccgataaggctcccggagctgaagacgaaggcaccacacctcctattccagagaaggttcaggttggtggttccccattgtacagagttgagagaaaacttgggaaaggaggatttgggcaggtttatgttggtcggctgctcggagctgcgaattctagtgaacgaactggtgctggggctgttgaggtagccttaaaatttgagcatagaagcagcaaagggtgcaattatggacctccatatgagtggcaggtttacaatgcactaggtggtagtcatggtgttccgcaagctcattataagggacagcaaggtgactactatattatggtcatggatatacttggccctagtctgtgggacgtttggaataacaacaatcctcacatgatgtctactgaaatggttgcatgtattgcaatcgaggctatctccatattagagaagatgcattctagaggatatgtacacggtgatgtaaaacctgagaactttttgcttggactccctggaactcttgatgaaaagaagttgtttctggttgatcttggattagtcaatgtccaggttatgagtgattttataaactatattcttgccacaggggcacagttcgttatgctagcgtgcatgcccatcttggtagaacaggtagcaggagagatgacttggaatctcttgcttacactcttgtctttcttcttcgtggtcggctaccttggcaaggataccagggagaaaataaagggtttcttgtctgcaagaaaaagatggccacttctccagaaactttgtgttgcttttgtcctcaaccatttcgacaatttgttgaatatgtggtga

SEQ ID NO: 16283 - DNA, 323 bp, Glycine max
  Peptide Sequence Number=SeqID_133061
ttgctgaaatactactagtaaggatagtatgtgcatacaatcaggaagtccatgtcatatttgttgaatttagagttgaggaagatgagtggatcaataccaaaacgtcagtactccaacctgaaaattggaggcccagtcctgtgcttccaggaaagagttcgcttgaggagactttgccacagatcaatcttaggcgtatttgggatcaattcttcttgacattcaaggtgagctttcaaacagtcagcaaacgacctgggtgcaagcaactagcacttgacattgagaatcgtgctcgttcatccacatttcatagctga

SEQ ID NO: 16284 - DNA, 2289 bp, Glycine max
  Peptide Sequence Number=SeqID_133062
tctccctcttcttcatgggccaatgccgcccttacgatgcctgagctgcgttcccggccacgcagaaaccgccttgtagataacgcaaacgccgatgaaatcgtgagcgttcgtggaaccagagcgaggaagctgaaagacgatcaaggagtgaaggagaatattaataagaagaaggtttctggtagggttttggaagtggaaggcatgaatgagtacgatagtggtggccgcagtgctgataaggctcccgaagctgaagacgaaggcaccacacctcctattccagagaaggttcaagttggtggttccccattgtacagagttgagagaaaacttgggaaaggaggatttgggcaggtttatgttggtcggcggctaggagctgcgaattctaatgaacgagctggtgccggtgctgttgagatagccttaaaatttgagcatagaagcagcaaagggtgcaattatggacccccacatgagtggcaggtttacaattctaactttgcgatgattatatcttgtagtgcattaggtggtagtcatggtgttccgcgagttcattataagggacggcaaggtgactactatattatggtcatggatatacttggccctagtctgtgggacgtttggaataacaacaatcctcacatgatgtctactgaaatggttgcatgtattgcaatcgaggctatctccatattagagaagatgcattctagaggattacgtcaagatcatcacctcatcgcaaccaccaccaccaccatcatcgcagccatcaccaccatcattgctaccaacatgatcgtcattgccgccattgctgctgctgccaccacctccatgatcgctgccataaccaccgtcatcgccaccaacataaccgtcgctgccaccaccgccatgatcgctgctatgatcgccattgccgcagcgatggtggtggttgtggtgacgattttgacatatgtgcacggtgatgtaaaacctgagaactttttgcttggaccccctggaactcctaatgaaaagaagttgtttctggttgatcttggattagcaactcggtggcgtgatagttcaactggccttcatgttgaatatgatcaacgtccagatgtttttaggggcacagttcgttatgctagcgtgcatgctcatcttggtagaacaggtagtaggagagatgacttagaatctcttgcttacactcttgtctttcttcttcggggtaggctaccttggcaaggatatcagggagaaaataaaggatttcttgtctgcaagaaaaagatggccacttctcctgaaactttgtgttgcttgtgtcctcaaccatttcggcaatttgttgaatatgtagtgaatttgaagtttgatgaagaaccaaattatgcaagatatatatcccttttcgatggaattgtgggcccaaatccagatatcaggccaataaacactgaaggtgctcagaaggttggacataagagggggcgattgaccatagaagaagatgatgatgaacaaccaaataagaaggttcgaatgggaatgcctgctacacaatggattagtgtttacaatgctcgtcgaccaatgaagcaaaggtatcattataatgttgctgatgtgcggctggcccaacacattgataaaggaaatgaagatggtttatttatcggcagtgtggcttcttgttctaatctttgggcactcattatggatgctggcactggtttcaccgcacaagtttatgaactctctccccacttccttcacaaggaatggattatggaacagtgggagaagaattattacattagtgccatagccggggctaataatggatcctcattggttgtaatgtctaaaggtacccagtacttacagcaatcctataaagtcagtgattcgtttccatttaagtggatcaacaaaaaatggagagaaggattttatgtcactgctatggccactgccggctcaagatgggcaattgttatgtcccgtggggctggtttttcggaccaggttgtggaacttgatttcttgtatcccagtgaaggtattcatcgaaggtgggatagtggttatcgcatcacctcaactgctgcaacatgggaccaagctgcttttgttcttagtgtcccaagaagaaaaccagctgatgaaactcaggagacactccgcacatctgcttttcctggtactcatgtcaaggaaaaatgggcaaagaacctctatattgcatctatttgttatgggagaacagtgtcttaa

SEQ ID NO: 16285 - DNA, 291 bp, Glycine max
  Peptide Sequence Number=SeqID_133063
atgtggacaggtaatgatgactttgaagttttaaatgtacacctctattattctaacgacttcttacttccggttttcgaagtctacatgatggggttctcctggtcagtcgttctacatgactggatgctcattgtatttattccttacaccaaatattgcaagagtttggttggtcctggcaactattatgttgctggagcaacccatatgtcatggaaatcagaagctgttcaaggaactggtgacccgcggctattcaacaatctgaagggcaaaagtccagattga

SEQ ID NO: 16286 - DNA, 4041 bp, Glycine max
  Peptide Sequence Number=SeqID_133064
atggctagatttcgtttccggcgcctccgattcctcgccatcttcgtcgtcgtcgtggtgttcgcgagtgacgaattggagtcagagcgcgagctctcggtgaccgatttggattggaaccttttccaccaggactactcgccgccggctccgccgccaccgccgcctcatccgccgtcggtatcgtgcgtggacgatctaggcggggtggggactctggacacgacgtgcaagatcgtgaacgacgtgaacctcacccgtgacgtgtacatagcagggaagggcaattttaacatcctccctggggtgaggttcctctgcgagattcccgggtgcatggtaacggttaacgtcactggtaattttagtttaggtagcaactcgtcgattgtgactggggcctttgagttcgagtcggagaatgctgtttttgggaacgagtcggtggtgaacacgacggggatggcgggggatcctccgccgcagacgagtgggacaccgcagggggttgagggaggtggcggagggcacggcgggaggggtgctagctgtctcgtcgacacgacgaagctcccggaggatgtttggggaggggatgcatattcctgggcgtcgctgcagaacccttacagttttgggagccgtggagggtcgacaagcaaagagagtgactatggggggttgggaggggggcttgtgaggatggttgttcatcaaattgttgagatgaatgcaactgttttggctgatgggggtgatggagggaccaaaggtggaggtggctctggaggcagcatctacatcaaagcttatagaatgactggcaatgggattataagtgcttgtggaggtaatggttttgctggcggtggaggtggcagggtttcagttgatgttttcagtaggcatgatgagcccaaaatatatgtgcatggtggtaagagccttggctgtcctgaaaatgcaggtgctgctgggactctttatgatgcagtccctcgaagccttatagttgataactttaacatgacaactgatacagagacacttctattggagtttccaaatcaacccctttggactaatgtttatgttcgaaataaggctagggccacagttccattgctttggagtcgtgtacagggtggggtgttgagctttgggctacgacactatgctacatcagagtttgagttattggctgaagaattgttgatgagtgattctgtgatgaaggtatatggtgctctacgtatgtctgtaaaaatgttcttgatgtggaactcaaaaatgctcatagatggcggggaagatataactgtggcaacttcgttacttgaggctagtaatttgattgttctcaggggggcttctgtgatacattctaatgcaaaccttggagttcatggacaaggtctgcttaatttatcggggccaggagattggattgaagcacagcgtttggttgggcctggatctgtcttgcgtggtccactggagaatgcaacaactgatgatgtgtatctttactgtgacaaagaagattgcccctatgaattacttcatccccctgaagattgcaatgtgaactcatccttgtcattcacacttcagatctgcagagtcgaggacatccttgttgaaggccttataaaaggttctgttgttcatttccacagggcaaggaccataagtgttgaatcttctggaacaatatctgcctctggaatgggctgtactggtggtttgggccatggaaatactctaagtaatggtattggcagtggtggtgggcatggtggtaccggtggtgaagcattttataatgataatcatgttaaaggtggctgttcatatgggagtgcaaccctgccctgtgaacttggtagtggaagtggaaatggcaactctactggaaccacagctgggggtggtatcatagttgttggatcattagaacatcctttgtcaagtttgtctattcaaggttatgtaaaagctaatggaggaaattttgaaccgcaaatcagaaacgaaaaatttgcaatatttgacaattttactggaggtcccgggggtggatctggtggcactatactaatgtttctacatatgctcaccattgggaaatcagctgttctttctagtatggggggatatagcagttctaatggaagtggtggtggaggtggtggaagaattcattttcattggtccgacattcccactggtgatgtttatctgccaattgctagtgtgaaaggagacattcagatctggggaggaaagggtaagggccagggtggctctggagcaaatggaactataactgggaaggcttgccccaaagggttgtacggtaccttttgtgaggaatgtccagctgggacttacaaaaatgttactggatctgataaatcactttgtcacagttgtcctgtcaatgagcttcctcaccgtgctgcttatatttcagtccgaggtggtattactgaaaccccttgtccctaccaatgtgtttcggacagatatcatatgcctgattgttacacagcccttgaagagttaatttacagatttggtgggccttggctatttggtctttttcttatgggtctcttgatcttgttggcactggtgcttagtgttgcaagaatgaaatttgttggggttgatgaattaccaggcccagcacccacccaacatggttctcaaatagaccactccttccctttcctagagtcacttaatgaggtgttggagacaaacagagttgaggagtcccagagtcatgttcacagaatgtactttatgggacctaatactttcagtgagccctggcatctgccacatacaccttcagagcaaataaaggatgttgtttatgagagtgaattcaatacatttgtggatgagattaatgctatagctgcttatcaatggtgggagggagcaatacatagcgttctttctgttcttgcttatccgtttgcttggtcctggcaacagtggcgaaggagattgaagttgcaacgcttacgtgagtttgttcgatcagagtatgaccatgcttgcctacgttcgtgtcgatcacgggccctctatgaagggatcaaggtaaatgcaacttctgatttgatgctggcatatatggacttctttcttggtggggatgaaaagaggatagaccttcctcctcgattacatgaaaggttcccaatgtcattgccttttggaggtgatggaagttatatggctccattcacccttcacaacgataatatccttaccagcctcatgagtcagtcagtgcaacctacaacctggtacagattggttgctgggctgaacgcacaactgcggttagttcggcgtggacgactaagagtaacatttcgacctgtcctcagatggctcgagactcatgccaatcctgcattgagtgtccacggtgtgcgcattgaccttgcctggtttcaggctacaaatactggctattgccactacgggctaatggtttatgctcttgaggaaggttatccagccactggaggaagtgctgacggagctttaagaactgaggaaagatcacgggtcctgagtgttataaaggaacttcctttggggtttgcaataagcagagctcatttaagccctggtggaagagttgaagacaattatatgaggcgactaatgaatggagctgctttagatgtaaacaatttgcagatgcttgacgagaagagagatatcttttatcttctctcttttatacttcagaatacaaaacctgttgggcatcaggttgttgcatttctttgtggatatatacattacaactctcaatcgtcttccagtaaaagacacccgagcattcagccatggagtatcatggacgaaagtgaatggtggattttcccagctggattggttttgtgtaaattattccagtctcaactcattaattggcatgttgccaatctggaaattcaagaccgttccttgtatagtaacgattttgagctgttctggcagtcatga

SEQ ID NO: 16287 - DNA, 1197 bp, Glycine max
  Peptide Sequence Number=SeqID_133065
atggattcagaaggagcactgccccaggttcaggaaatagagcaagaaggtgtcggtggagggactaacaagaagatggaggtaaaaaatgaaaccaagaagaagaaaaagaagaggagttcttatttccccaggtttggttgtttcagaatcgaacatgatgcttctggtggaggttttgatattgaggttgttgatgaatctggtcagcgtcccacccctacccacttgatcattatgattaatggtcttgtaggcagcgcacagaattggaaatttgctgcaaagcagtttctgaaaaggtatccagaagatactattgtacattgcagtgaacgcaattcttccatgttgacatttgacggtgttgatgtaatgggagatagactagcagaggaggttatatcagttataaaacgtcacccaagtgttcagaaaatttcatttgtaggtcactctttaggtggcttggtggcaagatatgcaatagccaagctttatggtagagacatttctatggaactttctcaggggaatggacattgtgaaagtcagatttcagatcaagaatgtcatgatagaaaatatgaaggaaaaattgcaggactagagcccataaatttcattacctctgcaacgccacaccttggttctagagggcataaacaggttcctatgttttgtggattttactctctagagaaagcagtatctcgtgttgcaggggtttttggtaaaacgggaaaacatctatttttaacggatagagacaatggaaagccccctcttcttctccagatggttcatgactccgaagatattaaattccttacgtcatcgatcaggcgtcgaaaggagcttccaaagcgccagcatctttcaagacatgagaagtacccgcatattgtaaatgtagagacaactaaatctacttctgttgctgatgaagttcctgatgaatccaaagtgagtagtggatccagtaaacttgactacgaagagattgatggagaccatagatacagagtgatccaatcatttgtcttaattttgtttctatgccaagaggaaatgatcaaaagcttaacaacaatgagctgggaccgaattgatgtcagcttcagtggtagtatgcagaaaattctcgcacatagcactattcaggcaagtttctacttcttgaaatacattatgtag

SEQ ID NO: 16288 - DNA, 330 bp, Glycine max
  Peptide Sequence Number=SeqID_133066
atggaggccgagaacggcggtggcgcagcaacgattatgcagagacggaggaggaataagctatgttgcggtggaaacatgccaacaagaaatgtaaaaaatgtgaccttgatgaagcaaacttttatgcctgtcagcgaccctcgaagtgcattgtgcctctgtgtcttcaatctctgcgaagcaacgatggagaagttgatcagtaaagttttcgtcaaaggatatgcatgctgctgcaaccccaagaatgttccctctatattgaagaatgaatcaactcacgttcacccttttaatctaggagttaatgggtcgccaacactatag

SEQ ID NO: 16289 - DNA, 213 bp, Glycine max
  Peptide Sequence Number=SeqID_133067
atggggaagaacaagggtcatcaatcgcactcagctgcaaagcaaattatggtgaagggtactacctcaggtaaatcccaaacatctgctacttctggtctggctggttgcttggatgttgtccaagcaaatcagaatgcttatacttcttcacaggataatcttgggcaaggtgctcgtaaaaaaggcagggacaaattctgcaaaaactga

SEQ ID NO: 16290 - DNA, 2056 bp, Glycine max
  Peptide Sequence Number=SeqID_133068
atggttttgcaagccatcttcaacgacgcattcttctcgacgacgggttcttcttcaacaactctcttcattggcagttctgcaagcactcttgttgccgtcgattcttgtcatcatcggttcccatcattgttgtttcttgtttgtggcggaattgctacttgtctgaaagttactgatgcatatttggttgatttgaggagggtttatgaagaggatgaaaacaaattaaagtctaagaatgttcctttacctactgacaaaaggactccaacaccactaacattaccaccaaaaagaagaaaaacaagcaatatagagagtgcatttaatattgaggatatgaatcatcttagagcagagatagcaaggatgttttattctaccagcttgtcattccatcttgctagaaatccatattttgttagttcttattcatttgctgctaactgtaatctaagtgggtttcttcctcctagttataacgcattgagaactagtcttttacagcaagagaggtctcatattgaaaggttgcttcaacctatcaaatctttgtggagtttaaaaggagttacattggttgcagatggttggacagatgctcaaagaagacctttgataaacttcatggcaatatctgaagaaggacctatgtttttaaaggccattgatgggtccaaggagtacaaggacaaacattacatgtttgacttattaaaggatgtaatcaaggagaagctgaatttcctcattttttggaccccttgtgtggttcatgctttgaatcttggagtgaaaaacatttgtgctgcaaagaatgttgatggtaatgagaatgtcttcaataaatgtgggttgattgctgaagtaattggcgatgcttcttttatcaaggttttcatcatgactcattcaatgagattagcaatttttaatgagttttcttctcttaaattgctttcaattgctgaaactcgttttgcctctatgatagtcatgttaaaaagattaaaattgttgaaacgttgtttgcaaaatatggtcattagtgatcattggaatagttatagagaagatgatgtcagaaaagctgcacatgtaaaagagttgattttgaatgatatatggtgggataaagttgattacatcctttctttcatggatcctatatatagcatgattagaatatgtgacaccgatgcttctaatcttcacttagtgtatgaaatgtgggattctatgatagaaaaggtgaagacaaccatctataggcatgatgaagtgctagaaaatgaagtttctagtttctttaaagttattcatgaaatacttaattctaggtggagtaagagttgtaatccacttcattgcttagctcattctctaaatccaaggtactatagtgataattggcttaataaggttccaaatagggttcctcctcatagagatgatgaactttctagccaaaggattaaatgtcttaagagatattttccacatgttaatgttaggacaaaagtttatgaagaattctctaaattctcatcttgtgcgggtgactttggttcatttgattcaattgaggatagatgggcattagatccaaaaacttggtgggtgatgcatggatcctctacacctatactccaaaagctcgctttaaagcttctagtgcagccatgttcttcctcatgctgtgagaggaattggagtacatactctattcattatttgaagagaaacaaaatggatccaaagagggctgaagatttggtttttgtgcactctaatcttaggcttttgtctagaaaaaaggaagggtataaaaaaggagagacaagattgtgggacattaatggagatgtacatgatccacttgatgatagtgctggagttcttgaaatggaagatttatctcttgatgagccagatttagaagctatgcttttcttagatgatggcaatggaggagaagaaaatgaaacaattagagaagacgtccttaatggagcctgtcctacagaagagaagagtgattgcttggaagcag

SEQ ID NO: 16291 - DNA, 1146 bp, Glycine max
  Peptide Sequence Number=SeqID_133069
atgacagtagtagagtacgagaacaacaaggcgagtcgttacagccgaggtcacccttggtgcttcttctctattttagcaaagaggaagcgagataaaggtgttggggtgtcatgccataagaagttgagggcccctttgagccttagtgcattgaggcaagctgtagggttgatgcctggttcgggtcacccttcgagtttgcaagatctgcctctagctccattgtctgtcgaggctttcattgctcttattgttgttattcctccttcttcacctcctcctgttgtgcctattcaggaggtttcttctactgctaaagttagtgtgctagccgctttggctagtatggtgaccatgaatgctcttgtgatgccgccacatttttcttcagctccaccagttcctccctctgttgtgttggcgtcgacgtccacctattctcacccttgtgtttccttggaccacatctacacctcaagcgatgcagattccctgtggaatgtgagttacaagcctgaacagaagaccatggttggctttgtgtcagcctttgacaaaaatctcatccaagcaactgggttccaacatgttatggattctaccaagggctactgctcacaaagtttggagaatggagcgcctgaggtagttaatgccacagtcgccttcactgaagctatgaagtcaaaccaccaactatcttccaagggcattgtggcaaagaaggatgagtttgccaaggtagtggcggacctcgaggctcggctgaaggagtcggagtttaggctaaaagagtctgagttacaggtgggtagggaaagggaggccagcaaagagcttgaagaggagttgttgatgtacaagaaggaacttgacttgggtattttttactctttcaaggacgtgaaggatgatgttttgcttaacaaggaagacatagatgttgaggagaaggatgctagcgaggagtttgatttcaacctgattaaagatcttgccactcatctggtggtgcatccttttgctttgtggagtttctcccctaatgcttatgaggacttggtcttgtcgaccagtttggcggtagtttgtcttgtgaaacctggacctttgactgtggtcgtcgtggttcttaaggagtga

SEQ ID NO: 16292 - DNA, 705 bp, Glycine max
  Peptide Sequence Number=SeqID_133070
atggaaattgttaggaggggtgtgtggcacttctgcaaacttttggcatcgtctgcacctcctggtgaagtcgagggtgtcggccctaagtgtcgaccaatggtagctgactcacaccactttggtggcaagggagcgtcatccggtgtgaaggctgtgaattccttcatgaagttttctcatgacataacttgcctgttggttgttcaggcatttaagcaaggtgtctatggtgggagtttggagcgtttcctagatcatagtcttaaggctttaaagttgaaattgagggcttgttctaaagtaacattgtcagggccttcaaggatgattcttgtcgcccttccctgcaccttggacgccccgctttcgcaaaacctatttgacggggtagttcatcttaactaccacttggtgactctgaaagtatggtctgagacatcaggccaaggtaacaaggttgagctaacgacttcattagctactaagagatataggagtaggggtactcctggcctgggtcaactcagaactggtggtgtggcaatgatcttcttgaaggctaagaaggcttggatgctagtccaccatttagcttttggacttcctggatcccaggaacttgcctccgccgatcccggaagtacatttttccaggttgaggcgcatgttgtatttatagagttctctgaagacttgttctag

SEQ ID NO: 16293 - DNA, 180 bp, Glycine max
  Peptide Sequence Number=SeqID_133071
atggaacatagcaaaagaggggctcatcagggcagactcacaaaaggggaccttgggttttgtgaggctttagagaaacgagactcaccaaggggccctgaggataactcttttggctgcgtctgcctaaccgttggtctgaggatgttcgacaaaggtgacgaagtgcttgacgcctag

SEQ ID NO: 16294 - DNA, 636 bp, Glycine max
  Peptide Sequence Number=SeqID_133072
atggacctgtttgcttggcaaccatctgacatgccgggaatccaccccagcattatcttccacaagctccctgtttgtctccaggctaaactggccaaccgcaaatggcgaatatgcatcaactacactgatctgaatagggcgtgtcccaaggatgcataccttctacccgacatcaacaagctagttgatgaagtgtcagggttccaaattagacaaaatgttgaggtctacgtcgatgacatggttgtcaagtctcaaaccatagcccaacacatggaacacctagaacaagtcttcagagaactctataaatacaacatgcgcctcaacctggaaaaatgtacttccgggatcggcggaggcaagttcctgggcttcatgatcacacatcagggaatagaaggaaaccatgaaaaatgcacaactatactagagatgcatagtcctactaacatccaggaagtccaaaagctaaatggtggactagcatccctattcgggttcctcaccaaaaagacacagttgttctacaaattgcttaagaaaactaaacaattcctttgggacaagacctacgaacaagccttcttagccttcaagaagatcattgccacaccaccagttctgagttga

SEQ ID NO: 16295 - DNA, 312 bp, Glycine max
  Peptide Sequence Number=SeqID_133073
atggctaagcgcatggacaattctagaagaaggatgagctgtatagaggcgctgagcgaaagccaactcgctaagcacaccgtcttcaccttcaggttgagcgaagttttgtgctgtggaaagactgagagagagctgagcttgatgaggaagccatctcgcggagctttggatgagattttaagagattatgaggaagcttccttgctatggagagctaaaccctcagttggttcttcctatggggtacttgatcctgcaacactcgcccaggcgagtttggctcgcctgggtcctcaagttgagttttga

SEQ ID NO: 16296 - DNA, 510 bp, Glycine max
  Peptide Sequence Number=SeqID_133074
atggcctcttcccaactccaccctaatagttgggccatagtaggggcctttgtggtcctatgccctttcttcaacatttgccctagtgtgtcggtgtttctttatttccttcggatgaaattgacgagcaagattggtcgggtccccttgaacaatgtgtccaagaaattgtttgagtttgacttgaacgtctttcgtcgtttcaagaactgtttcttcaagctcctggctactaacgtcgtggctgatggtttgccactaatgttcaaccgagacaaggaaccccgcttcctgttctactgggccattttgccccttccctcggtgaatgatcccctcgcttcctttaacgctcttatgggtgacttcccttggaggccacttgtgaagcaagtcataccttctggtcggactgtgccaccgtctgctgttgcccctattgttggagaaggaggtcaacttgctgttgaggtttgccttattgttggtgttgctgatgtaacaccctga

SEQ ID NO: 16297 - DNA, 237 bp, Glycine max
  Peptide Sequence Number=SeqID_133075
atgtcttcatttctttctgactctaccattggcgtgggtggtagcaattccagggagaacactcgccatggtgcttctgacaacaaatcctcttcctcggagaggttaagggtttcgcgccatgctggtggaggcacttctcacctctacgagagggcacatccttttgttgcttccccgaccggggagcctgtcacgattactatgatttcccccccttttgtttttgagaagtaa

SEQ ID NO: 16298 - DNA, 162 bp, Glycine max
  Peptide Sequence Number=SeqID_133076
atgacgcaacaaaggagaagcacctccacggaggaggcgcggcccttgatggcaccaagtgcagggcctggcgacacaaggccaccacagggtcgtaacaatggtggtggcgtccatatggccctcagcgacgccaaggtgcctaccaacgaggtgaagtga

SEQ ID NO: 16299 - DNA, 477 bp, Glycine max
  Peptide Sequence Number=SeqID_133077
atgccgaacaacatgatagaagcagcccggacaacacttgtccaagctcgggggcttgacaagcttgacagacctgtaattctcacacctttcaaggttatcactcttgacaccggacaacacttgtccatgctttggggctcgacaaaattgtcactctcctacttgtcaaggcttttacctcggacatcaaacaaactccctcgacgtaggacaatctccttcgacactggacaacctctctcacccgtattcaattatctacaaagctacacattatatgtaagtaacaattatctactagcttttatctttaagatagacattatctctaaccttatctataagtcacctttatctattggctattatctacaagctggtaattatctgcaaggattgttacatcactgtaacaacccctatcaacatggacccgcaactccctcttcacactataagtatcaggtttcctag

SEQ ID NO: 16300 - DNA, 4740 bp, Glycine max
  Peptide Sequence Number=SeqID_133078
atggaatttcatctttcccaaacttatcatgaaggacttctcaagttacaagcaaaagagtatgagaaggctcgcgagctcttagaatctgtccttaaagatcctcttattgctaatgctcaggtggatagtagtgccagtgatggtcatctattgcaactcaggcgtttctacagatttttggcattgaaaaaccttgccgctgtttttcttcagcaaggctctacacattatgagaatgctctacgatgttatcttcaagctgtggagattgattctaaagattctgttgtctggaaccggctgggaacactgtcatgcttgatgggctcactgagtatttcacgttgggcatttgagcaaggactctcatgtagccctaataactggaattgcatggagaagcttttggaagttcttattgcaattggtgatgaggttgcttgcctttctgtctctaaattgattttgaggcactggccctcgcattctcgtgctttgcatgttagaaataccatcgaagaatcagaacctttgcgatttgctccaagaggcatagacaaattggaacctcaacatgtgcggctcaaatttcctgacaagaggaaagctactaatgagaatgtagatgaggatgttgcattcaaaaagctgaaccagaataaagaactgcacctgacagaagtttcctgggtggctcttgctgatgcacttctggaaatcttatcaccacaaagttccaagatggatcctgaaaaagcattcagttctcctgatattaggctaagcataatcttacctagtagctcagaagctgttatgaacactgtggaaatgaaagggtccaattgtgaaaatagtgtttctggtgatggtaacatagaacgatcaagtgcttttaaagagaaagaagctaatatccaagaagaacaaccgcatgaaaggcgaagttctcgacttgaaaggctccggagtcgtaaaccagggaaagaagaatctgattcttcttgtggaaaggaccctaccaaggttgtcattcaatatttagagccatttatttctggtggattggggggtcaagatacaattgatagagataccacgaaagtatcctgtttaggaaattctgaatattataatgtttctgcatttttaagagaaacttcaaacaattatggtgcttatcatatggggcacttgcttttagaagaagttgcaagacaaggtctcacatatcaggatgcttttgtcaaatttttggagttggaaaagttgacaaggcattggggaaaggagagaactgctgaatgtaatatttttcttgctgagctgtattatgactttgggtcatgctcccccactggttctaaacaattggaatttatttctgagacgtcttatcatctttgtaagattatagaatctgtagctttagattatccttttcacttgactcatgccttgaatgaaaatagtttttcaatagatagtaaccaagagacccatggaaaaacaataaatacctcgactgagagcaattcaaatttagacagctcacttctgatgaaaaactgtcccctttggtctcgattcttctggctaagtgggagattgtctattgttgatgacaacagggcaaaagcatgtcaagaatattgtattgctttgacacttttggcgaagagagaaaaggaaaattctctatgttcagtcccccgcccacattgcaaggctgtaaaagagctaaactttgatagagttcttgatgaaattaatatattaaaggtcaatttcttgatggaaaagtctgtcattaagatgatggaacaagaaaagtttttggagtgtgtatccctgctttctccacttctattctccacacaggatgtctaccccaattcattctctttatccatgactgataaaagagatgaaaagataacttccactgaacttatggctgtagatgttctaatggaagcatgtcaaaaaacaaagccaatggatgtagagatgtattttaattgtcattatagaaagctgaaaatacttatgacaaagatgggtttaaagacatgtattacatcatttaagtcttctgatcaagcacctattttaactgtgtctcctaattttgatattgattcaaaggaaagttctagcaagaactgtagtcacttggtcacggatgaagtgaaggcactctctgactgtatttcacaagtgaagaaaattatcgatcaacatggagattctgatggcctttctgttccaacaagcagcatttgtcaaatgcaatccctgctgttgttaatcatgagctatgttggcaacatacttgccctcaacaaagcctcagcacaagtaatttctgatcaagctgaaagcagctgtttcgttgatgcagccattgttttctgcaaactccagcatcttagcccaaccatgcctatcaagactcaagttgatttaattgttgcaacacatgacttgcttgctgaatatgggctttgctgtttgggtgaaggtggcaaaggtgaagaaggaacatttcttagatttgcgataaagcatctcttggccttggatacgaagcttaaatccagctttaaccataaagaatcaatgcaatgtgaagaagtgtccaaaaacagtctcgtcaatgtgtctgttgaagaatcaaaattggatgcattagacatccagatggatttgaccaaaattgatgaaattaattcagagaaaaaggatgtttctgaaggaataatatccaaaggcatttcatcttgcagagttcatgataaagacggtaaggaagtagagtttgaaaatcatggaggtgctggcactggcagtaagttaattaagggcgaaaatttaagcaatcaattgattgaatgtgaagatgaactttctgaatatgaacgggaggaacttgagtctaaaattgactgtgccttagatcagtgctttttctgtttatatggattacatctgagatctgattcatcttatgaggatgatctagtggtgcacaaaaacacaagccgaggagattatcaaaccaaggaacaatgtgctgatgttttcaagtatgttcttccctatgcaaaggcatcttctaggactggactggtcaaacttcgtagagttttaagagctattaggaagcacattctgcagccaccagaggacctcttggcaggaaaccctattgataagttcttagatgatcctaatctatgtgaagataagctctcagaggaggctgggtctgatgggtttcttgaatctattactaagagaatgtttcctgatgtgggtggccttgctcagtataatgcaacattattgaggaggtctgagccatatttggaggtatactgtaacttgtattatttcttggctctgtctgaggaaatgagtgcaacagataagtggcctggatttgtgctgaccaaggaaggggaagaatttgttgaacaaaatgcaaagctcttcaaatatgatctcatgtacaatcctctgcgctttgaaagctggcagagacttggaaatatttatgatgaggaagtagatttgttactaaatgatggtagcaagcacgttaatgtagtagggtggaggaacaatgctactttatccgagagagtggaaacaagccgaaggaggagtagacggtgcctactaatgagtttagctttggcaaatacatctgctcagcagtgtgagatacacgagttattggcattggtgtactacgacagtcttcaaaatgtagtcccattttatgatcagagatctgctttgcccttaaaggatgcggcatggatgatgttttgtgagaactcaatgaagcattttaagaaagccttcgcacttaagcaagattggttgcatgccttttacttgggtaaactcagcaaaaaacttggatattcacacgaaattgcattatcatattacaataaagctattgctttgaacacatcagctgttgatcctgtctataggatgcatgcctcacgtttgaaattattatttaagtgtggaaagcagaatttggagattttgaaggttctctcggcaaactcctttaatcaatctgtaaaagaagctgtcacaagtattcttattggtattgatagctcatttttaaatacaaaggagagacatattgatgccaattttgtggaaacaaagcatgaagagttgctcaaattggatacagtatggtctatgctttacaatgattgcctttctgctcttgaaacatgcgtagagggggatctcaaacatttccataaggccagatacatgctggctcaaggactgtacaaaagaggtgagagtggtgatatagagagggcaaaagatcatctatctttctgcttcaaatcttcacgctcatcatttacaataaatatgtgggaaattgatagcacagtaaaaaaaggaaggcgcaagacaccaggtactgctgggaacaaaaaatcccttgaggttaacttacctgaaagttctcgaaaatttattacttgcattcgaaagtatttgctgttttatctcaaactattggaagagactggagatagatgtattctcgaacgttcatatgttgctcttcgtgcagataaacgggtgatgaaaattaccgttagagatatggatacacagtttatgcaggcacatgggaaggaagccccttcacaaccagagcaaaatctgatcttgaactaa

SEQ ID NO: 16301 - DNA, 813 bp, Glycine max
  Peptide Sequence Number=SeqID_133079
atgatgactactgctcccactacctctactttcttcttcctcctctcttctctcaatccccacccacctcgctccttcttcagacacaaaccactctttaacaacccctcccttctcctgcgccctcctttgaggtctcctcgacacttaacccgcgccgacgatgacgacggcgacggcggcggccccgaccactacgagatggacgaggacgaaatggaggagctcgacaacaagaaggactttgacatcgagtacgaccccctcgtccccgccgccgccgccgccgccgccgcctccgccgctgatgacaacatcgccttcgtcgagagcaagagcttcgtgtccacgcagggctgggactccgacacagtcctcgactacaaaatcaacgaggacgagttccacaagatctgcctggtcgattgcgacttcttcattcgcaagccccccgaccccgacaacgatgtctacgatttcagagagatgtatgttactcctccggatacagatgtttattcaattcccaaggttctcgctccaatgccgcagaagtacattagatgtgcgcagagtgattatggaagctacaatgtgacagagccacctattgatgcgcctcgagatcctctgtataaaactgagagggagatcctcaagagttgtgaaatattactgaacagtgaacagtcctcttatggaatccagccggacaatgagctttacttgagttatttgcctcaaaaaggttgtttcacacttctatgtaatattaggctgagattggaggagttagtgctgccatatgcatga

SEQ ID NO: 16302 - DNA, 483 bp, Glycine max
  Peptide Sequence Number=SeqID_133080
atgcctgacgaagctcttatcatcttcaagttgagtgatccgagtatccatcctatcaaattagaagagaagtggaatcacccctttgtggtggaggtgaagggaggaggtaatcgcaccgacaccaatggaaaacaaccttttaaccttgacatatggttcatcatccaaaggaacattgaaatgatgaagaaaaagagtaacaaggtggggataaggcagagatccacattagaatcaaatcctcctcagaggcttgagcaagaaaacaaggtagatgatcgaggagatgaaagggaaggaggaatttgtgttgttggtgctccaacggttccgtggcgacgatggccagtagcagcggtggtggaggaagaaccctttcgcttcttagatgaaatgaaggagatatggagttttgaagattgggaagcttggagcgccgtcactcaagggtctacgtacgaaggagctgcaaaagcgtga

SEQ ID NO: 16303 - DNA, 108 bp, Glycine max
  Peptide Sequence Number=SeqID_133081
atggatgaggcaccaatatttcttctaaacacttttgaggtttcaatagcggttagtgcagaacatgatgcgagtgtggatatatggagccttggtgtgctgtgctga

SEQ ID NO: 16304 - DNA, 270 bp, Glycine max
  Peptide Sequence Number=SeqID_133082
atggaagaagaaatctctcttcaagagaagaatattacaatgaagatcatctatttctcaaccctgtcttctggtaatcaattacacttcctggcatcttcagaggtttcaggttccactgcggagcaaagaaggtggatgcttaacgatttcgatattggaaaacctctcagaaagggaaaatttgaccaagtgtatttggccagagaaaggagtgataagagccattgcattacacgagacatgaccattgttgttgatttgtactga

SEQ ID NO: 16305 - DNA, 3036 bp, Glycine max
  Peptide Sequence Number=SeqID_133083
atgtcgaaaatacacctcttcatgctgaagtttccttttcatttgctcttgttgctcagcgtcatagtaccctttcaagtaatttcacaatcagaaaataccgaacaaacaatcctactcaccctcaaacatgaactgggggatccaccgtcgctccggtcatggataccgtcaccgtcggcgccgtgcgactgggcggagattcgctgcgccggcggctccgtcaccaggctcctcctctccggcaaaaacatcaccaccaccaccaagaacctctcttccacaatctgcaacctcaaacacctcttcaagctcgacttctccggcaacttcatctccgacgagttcccaacaacgttgtacaactgcaccaacctccggcacctcgacctgtcggacaacaacctcgccggaccaatccctgccgacgtcgaccgcctcgaaacgctcgcttatctcaacctcggcagcaactacttctccggcgagataccgccggccatcggaaacctaccggagctgcaaacacttctcctttacaaaaacaacttcaacggaaccatccccagggaaattggaaacttgtccaatctcgaaatcttgggtttggcttataaccctaagctcaaacgcgcgaaaatcccgttggagttttccaggttaagaaaattaaggatcatgtggatgacgcagtgtaacttgatgggagagattccagaatatttcgggaatattctcacgaatctggaacggttggatttgtcgcggaacaacctaacagggagcattcctcggagtttattttcgctgaggaagttgaagttcttgtacctctactataacaggttgtcgggtgtaatacctagtcctacgatgcagggtttgaatttaaccgaacttgatttcggtaacaacattttgacgggttccataccccgagagattggaaacttgaagagtttggttaccttgcacttgtattcgaatcatttgtatggtgagattcccacaagtttaagcctacttcctagtctcgagtatttcagggttttcaacaatagcttgagtggaacactccctccagagctaggcttgcattcgaggcttgttgtgattgaggtttcagagaatcatctcagtggtgagttgccgcagcatttgtgtgtaggtggtgctctcattggtgtggtggctttttccaacaattttagcggccttttgcctcaatggattgggaattgtccttccctcgccacggttcaggtttttaataataatttttccggggaggttcctttgggtttgtggacttcgaggaacctttcttcattggttttgagcaacaactcattttccggtcctcttcctagtaaagtgtttttgaatacaacgaggattgagatcgccaacaacaagttctccggtccggtatctgttgggattacttcggcgacaaatttggtgtattttgatgcgagaaacaacatgctttcaggtgaaattccgagggaattgacgtgtctttctcggcttagtactctcatgcttgatggtaaccaactttctggtgcacttccatctgagattatttcatggaaatcactgagtaccatcacactctcaggaaacaaactttctggcaagatccctattgctatgactgttcttcctagcttggcttacttggacttgtctcaaaatgacatatcaggtgaaatcccacctcagtttgataggatgaggtttgtttttctcaacttgtcctcgaaccagctatctgggaaaatccctgatgagtttaataatctcgcatttgaaaacagcttcttgaacaatcctcatctgtgtgcttacaatccaaacgtcaaccttcctaactgcttgaccaaaaccatgccacactttagcaattcatcttcaaaatcacttgccctgattctggccgccattgtcgttgtgttgctggccatagcctccttggtcttctatacattaaaaacacaatggggcaaaagacactgtgggcataataaggttgcaacgtggaaggtcacatcatttcagaggcttaatctcacggaaataaacttcctctcaagtttgacagacaataacctcataggaagtggagggtttgggaaagtttaccggattgctacaaatcgtctgggtgagtatgttgcggtgaagaagatatggaatcgcaaggatgtggatgacaagttggagaaagagtttttggctgaggttgagatcctgggtaatattcggcactcaaatatagtgaagcttttgtgttgttatgctagtgaggactccaaacttcttgtttatgaatacatggaaaatcagagcctggacaaatggctccatggaaagaagaaaacatcaccttccgggttaagttggccaacgaggttgaatattgccattggggttgcacaaggtctgtattacatgcaccatgaatgctcacccccagtcatccaccgagatgttaagtctagcaatatattgttggactcagagttcaaagctaaaatagcagattttggtcttgccaagatgttggcaaacctcggtgaaccacacaccatgtctgctctagcaggctcttttggctacattccaccagaatatgcctactcgacaaagattaacgagaaggtcgatgtatatagctttggggttgtgctcttagagcttgtgacaggaagaaagcctaataaaggaggtgagcatgcatgcagcctagttgaatgggcgtgggatcattttagtgaagggaagagccttaccgatgcattcgatgaggatatcaaagatgaatgttatgcggtacaaatgacgagtgtcttcaaattagctctcctttgcactagttctttaccctcaactaggccttccgcgaaggatattttgctagttcttcgccaatgttgtcattcaggttctacatgtagaagagcgggaaacgagtttgatatcgctcctcttcttggtgatacaaggtacatctatagttacaaggagtaa

SEQ ID NO: 16306 - DNA, 240 bp, Glycine max
  Peptide Sequence Number=SeqID_133084
atggttagccttaacagagcaaccagaggagaaactctagagaacaccagaaacgccatcattactaacgaagaacgcttgagcgactacctcgaggttgctgcagctggtgtctcgctaagtgaggctaatgcgcttagcgagtatcatccgctaagcgaggcattagctcgcttagcgagtcaagggaatctggaagagaatctgccacgcaagtcatttgtctcttcctgcgcttag

SEQ ID NO: 16307 - DNA, 666 bp, Glycine max
  Peptide Sequence Number=SeqID_133085
atggctcaattaacaaatataaagcaaggtgacggtgataggttttttgtggtatccttatatgtggatgatctcttagtcgctggcagcaacattgagcttattcaacaattcaaagaagacatgatgcgagtctttgagatgactggtcttggaaaaatgtcttatttccttggaatagaaatcaagcagagacaaaatgaaatattcatttgtcaacaaaagtatgcagatgagattctaaagaagttctgcatggataactgtaagagtatgagcactcctatgtgtcaaaaagggaaattgtgcaaggataatggaacaactaaagtgaatgagtccgaatatagaagcttggttggctgcttgatgtatctaacaacaacaaggccagatattatgtatgctgtaagtgttctttcaagatttataaattgtgctaatgagtctcatcttagagctgcaaaaagagttctcagatatgtcaagggaactgtaagctttggtgttaagttttgtttggcaccaagctttgagttgcaaggttattctgatagtggctgggtcgggtctttaaatgacatgaaaagcacttccggtttttgtttcaacttcataggaatatttacttggagttcaaagaagcaagaaattgtggctcaataa

SEQ ID NO: 16308 - DNA, 219 bp, Glycine max
  Peptide Sequence Number=SeqID_133086
atgagtggaatgagtatgaaaatggaaagaacgcttatcgctagttgtgcgccgattagtttagtttcaatgagaatcttagtgctgacatgtcacgatggatctggaccgtccgactcggttttaccaggatgcggtggtcacacaaaaccggtgggcgcggttttaccggatactgttcgatctaaagtgttgacaccaccgctgttttggacttaa

SEQ ID NO: 16309 - DNA, 330 bp, Glycine max
  Peptide Sequence Number=SeqID_133087
atgtcacaagttgtagtgttcaaatgtaaattcaaggaatataaatataagctccaatctcaaaggagtaatagacagagtagagtattacaccagaagaatattcagctctcctcttctttaatatttctccaacaaactggtatcaagagctattttctcaagggatttgtgagtaatccaatagcaaatcttaccttccttgattcaatccataacatggattctgaaacaccctttacagcattagcgccactagtgtttaagggtaaaaattataaattatgggcagccaggatgaaagcccacctcgaagcgaatgatctctag

SEQ ID NO: 16310 - DNA, 1176 bp, Glycine max
  Peptide Sequence Number=SeqID_133088
atggacattgaagcaggtaaggatattccttcaagagacccagcggaactcgacgacgatggtagagtcaaaagaaccgggaacgtgttcattgctaccacgcacatagtaacggtggtggtgggtgcaggagtgttggctctggcatgggccatggctcagcttggatggatagctggcatagccgtgatggtcctctttgcatgcatttccgtttacacttacaatcttatagctgattgctatagatatcctgacccagtcagtggcaagaggaactacacttacatgcaggctgttgatgcctaccttggccatgctgcttattgcaagttttcaaataatccctatatgattggttttgggattttccaaattttattgtctcaaatcccaaatttccacaagttaacgtggctttcaaccattgctgctgctacctctttcggttatgcattcattggaagtgggctttctctggcagtggtggtctcaggtaaaggagaagcaaccagtatatttggaaacaaagtaggacctgatttatctgaagcggataaagtttggaaggttttcagtgctttgggaaacattgcacttgcttgctcttttgctactgttatttatgacataatggacacattgaagtcatatccaccagaaaacaaacagatgaaaaaggcgaatgtgttaggaatcacagcaatgacaatacttttcctgctatgcggtggccttggctatgctgctttcggacatgacacaccggggaacatcctcaccggctttggattttacgagccattctggttggtcgcccttggcaatgttttcatcgtaatccacatggttggagcatatcaggtgatggctcaaccattgtttcgtgtaattgagatgggtgctaacatggcatggccgcgttcagatttcattaacaagggctaccccatcaaaatgggctccttaacatttaacatcaacttgtttaggctaatttggaggtcaatgtatgtggtagtggctacagttattgccatggccatgccatttttcaatgagtttcttgccttgcttggagcaattgggttttggcctctcattgtcttcttccctgtacaaatgcacattgcacagaaacagttggttccattcgtggaattagcaagaatataa

SEQ ID NO: 16311 - DNA, 372 bp, Glycine max
  Peptide Sequence Number=SeqID_133089
atgctctcactcatcataccttcttgtaatttcaacaaacaaaggcttgccccccctaggtctaagtcatgttttggcttttatcctaatttccgcaagctgtgcgcatccaaaaatggcaaaaataccgttgaggcatttcaccgagcacttggtgggcgcacttttgggtaccaacaacaagggaataggggcaatgtggcttgccccatcatttcagaacacaacttaggcctaaggccatcccctacaacccctcaattcaaagaaacaaagcataaacttgccccgaattgtctcacggaattggtcaaattatgtaccattcaaagcataaaaggcatcaatggaaagctagaaaccaaaggataa

SEQ ID NO: 16312 - DNA, 426 bp, Glycine max
  Peptide Sequence Number=SeqID_133090
atgggtcagattctacaggaccaaaccttgtgggagttaaggaatgatggaagaaaagaaataaaaaaaaaatgggacaaaaggattgatcgcgaaaaagatttcttgttcttattagaagatcgtgattggatccacatatgtttgagtggcagtaagggtgacttatctgtcaacttttccactattacacccaaaaaaccaaactctgctttacgtaaagttgccagagtacgcttaacctctggatttgaaattactgcttatatacccggtattggccataatttacaagaacattctgtagtcttagtaagaggggggagggttaaagatttacccggtgtgagatatcacattgttcgaggaaccctagatgctgtcggagtaaaggatcgtcaacaagggcgttctagtgcgttgtag

SEQ ID NO: 16313 - DNA, 1239 bp, Glycine max
  Peptide Sequence Number=SeqID_133091
atggcttctaggaaaaggaaagccacggcttccaggccccagcctcacttcgatactcatagattcacctatgaggacgcttggaaccgctacgttgacaacgtggttcttggtcggaatatccttccggaaaggaatgtgaagctttttgtcacagagtctgatgagttcaggacaaacctagttagaagaaactggcagaggacgctgaccaacctcatggaggggagcatagatgtggctctcgtgaaggaattttatgctaatctttatgtctcagaggataagcctccaaagcaagttagggtcagagggcatttaattaagtttgatgtggattccctcaacacttttctggagactccagttgttctagagccaggggagactcttcctgcttactccaagttctgcagactgagaccagaccctcaggagctggctgcccgactttgtatctctggtagaggatttgttttgaatgctgagggcctgccatggaagttgttgaggaagtacctcactactctagcgcagacttggagcgttctgtcttatttcaaccttgcccctacatcacgcacttttgatctgaacttggacaaggcaaggttggtatatggattagtgatgaagatggaaatgaatgttagagccctcatctctggacagatcactcttatggctcattccaactcctcgaggctcgaatttccagccctcattactgccttatgcatggcccgaggagtcacctcagattccttgacttttgagtccctcagcctagccattaacttggcttacataaagaagaactattggacgaccccacggtcaactttccagggacccgcaaggccagggctagaggatctgaggagtttacatagtttggctcaacatcagccaattatgagcatggaggagttttctttgcaggtggcctggccaagagtccaaccttcttctcatggaggaggtgaggcctctgcaactcaagagcctcaaccaaatttggagactgcacctgctgctcaggaggatgatacaaagtcatttgtactagaaacttatccagaggcagatccagtgattgcagaggtcagtccacaggcatcaccaatatctacaccaatgctgaatctgagcaccctacaaggatcaccagcaggcacgcctgtgctgcatttgaccgatgatgaggtcatggatcaggacccaccgcaggaccagtga

SEQ ID NO: 16314 - DNA, 360 bp, Glycine max
  Peptide Sequence Number=SeqID_133092
atgaggcaccaaatccctatgataggtggaataatcaacatgaaaataaagaaaaaggtatgttttattccattacttaatagtgatcaagggtttcccatggaccctaagagaataaaggtcattcctgaatggcctactccaccaagtgttgaggaaagaatttctgagtttcaagaacctctgaatttgaggtcaaatcattttcaagggggagggaatgatgcaatcctactgatgagaatcatcaaactggccaaatacaggctaaatgcccaagtggagaaggacgaaggcctaagtggagaaggacaaagcccccgagtggagaaggatgaaggccgaagtggagaaggatga

SEQ ID NO: 16315 - DNA, 330 bp, Glycine max
  Peptide Sequence Number=SeqID_133093
atggaggatacattggtaaaattcaaaagtgaatttgcagtcatggagcttgaaattcaggccttggccagattagcagaagaaataactcaatgtggtatttcagaaggttcaaggaagatcaatggaaagtacattcattctcaccttgttgctagattagaaggtataatgtgcaaatacgttgttttttcctacattgctgtaaatgaacaattaaaggaacaaataaaggaagtcgatgcagcacaatcaaaggaggtttctgtgttttgggttggcatggctgaggtaaacacattcaagattagacttccaaatgttcaataa

SEQ ID NO: 16316 - DNA, 228 bp, Glycine max
  Peptide Sequence Number=SeqID_133094
atgttgcgaaagggctcactcaacgagccagattggctaagcaagtctcatttgcttagcgaggaagccaactctcttagcgagagcggaatcctagagaatgtaaagccagagagcaacgcacagtcagcccacccagtgaatcttttgtctcttctcgcgcttagcgcgtccaagcctgctaagcgcccagtcactaactctcgctcagcgagacatgctcgttga

SEQ ID NO: 16317 - DNA, 372 bp, Glycine max
  Peptide Sequence Number=SeqID_133095
atggagctacatcagaaacttgtatctgatgaggattcacagaaatgtatgccgaaaccgattggatatgctgaaatggacaatgcagtggctgtagttgatccattgggagaattagttaagaacttgtttagattgttgtacattattgtcatgtttaaggtctcatctctaaacacagggaatattcttttcaaatgtttcaagaacgacaggatgggaaagcactcagaaacttcaatgaaatgtggcttcccagagttcaagatgggactttcacagattggcctcttcctaccaaacttttactgcagtgtgtatcctagaaggccttttatctatagagcaaattctatgccaattagtttatag

SEQ ID NO: 16318 - DNA, 312 bp, Glycine max
  Peptide Sequence Number=SeqID_133096
atgaagtgctggcgcagaccggccgcttcaaagtgtatcgcgccgtatatggccgcggcacgaaagcgcgctaagcgtagtaaaacccacgatgcgacggggaaaacgttgctttttgcagcagtcgtttcaccgtcgcaaaatatgtatgcgaaggtggcggaattggtagacgcgctagcttcaggtgttagtgtccttacggacgtgagggttcaagtccctctcttcgcaccaataatcacagagtttatatcgcgtgcactgcgcgaaggtggcggaattggtagacgcgctagcttcaggtgttag

SEQ ID NO: 16319 - DNA, 273 bp, Glycine max
  Peptide Sequence Number=SeqID_133097
atgagaattggctcccaaaacccaacacccccagatttcaagagagaagaagttcacccttacctgaaattgaaggtcccacgaggtagaggtaggctcctagactccgaaaatagcttttccttgcaatttggtgtggaaatgaagaggaatttggagcttcaaaagagacaacaatggtggataagaagaggaagaaaagcaacatggagggagaaagaagggctgctggaagtttctggagaaggagagagaagatttggctttttataa

SEQ ID NO: 16320 - DNA, 585 bp, Glycine max
  Peptide Sequence Number=SeqID_133098
atgcgtcgggtgcacactcatctccctcggcttatggatcaggaagactcccttgcaaatcctttgtggaaacgtatctggaagtttcctgtgcaggagaagttgcggtttttcctttggcaatttgttcatgctgcttttctaactaatgagagaagattcggaggcagttcttcatattatttgagattgtcctcacgctccaaaggtgtggatgcttatgggccttgcctcaatagaactacaaggccttggatatggtggctactattttggcgccttaggttcaataataaaattaaacacgtgtgtacacgtggcccaatcaaatcgtgcggccagggaagctgggtttcgttgcttgtcgccgtaagatacccaaaactcgtacaccggattccaaattctagcagctggtttggcgccaccggctatccccggtgggttgtggaggttaccgacacgagccggttgcatcaaagaaacctaaacattgatgtatgtttgcgtaggctatgccctggccacaaacatggttcagatctggtgtacgcccgtcacatgccgaatatagaaaatgcatga

SEQ ID NO: 16321 - DNA, 255 bp, Glycine max
  Peptide Sequence Number=SeqID_133099
atgactattgaagaatcaattcatgttttctttgatgagactaactatattaggcaaagaaaggatatacttgatgatattacagatactttagaagatacgcatattcatgaagaagtccacaaagacaaagaagatggaaatagcatagattctcaatccaaagaaaatcaaataaacatggatcttcaaagggagtggagaacttcaaggtatcaccctcttgataatatcacaggtgacatcttaaaaggg

SEQ ID NO: 16322 - DNA, 378 bp, Glycine max
  Peptide Sequence Number=SeqID_133100
atgcatcgtcctgtagggaaaactactcatcgacacccgttcgttgaccaaatcatggaagttgacatatccctaggttggaaaccactcaacctagagagctggtcacatcgtgtgacatcagccgcactagctagtttgcgacaagcagatgatgaacctcttaaaaaattcatggataggtttggatgcattactgtccagatttgtaatcttaacccagaggtatcattacactttatgctccgtactctaaggcttggtaagtttgcggatagtctgtgtaaaaaaccccctagtagcatggacgagttgcgcgaacgagctaaaggatacattcagatggaaaagatgtccaagttcaggaatgaggtctaa

SEQ ID NO: 16323 - DNA, 189 bp, Glycine max
  Peptide Sequence Number=SeqID_133101
atgaaattttccagaggaaaagtggcgcttaacgcatcatccacgctaagcccactgattaagctaaactatttagctaaccaatcaggggtttgtgcgcttagcgttggaccttgtggcctcaataacttaagagggataggcttagaatgcagaagaagcaacaatcaatttaataatgttctttaa

SEQ ID NO: 16324 - DNA, 733 bp, Glycine max
  Peptide Sequence Number=SeqID_133102
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatccgtggcgccttcgcctttctgggggattcaaccttggcttcctgctgacgatcacaatgctcgtcgtgcacggcacgatgcaggtcaacggacatcccgacgtctcccctgcgatctccggtattgcgggtctcggccacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16325 - DNA, 416 bp, Glycine max
  Peptide Sequence Number=SeqID_133103
aactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtgcctctggtcgatggaacaatgtagcaagggaagtcggcaaatggatccgtaacctcgggaaaaggattggctctgagggctgggcacgggg

SEQ ID NO: 16326 - DNA, 783 bp, Glycine max
  Peptide Sequence Number=SeqID_133104
atgcatttccccctgatccttgtctcacccgctcgcccggagaatatcggcgcggccgcccgcgccatgaaaactatgggatttagcgagttgcgtattgtcgccagtgacgcctggcaggatccggccgcgcggcgtgtagcccacggtgccggtgagattcttgaccacgtgaaaacctatgacacgctgagcgccgcgctggcggatgtggatttttccgtggccactaccgcccgcagccgggcgaagtttcgctattacgccacgccggcgcaggtcgaaaccatcctgcaggagaagcgtcagtggctgaatcgtatcgcgctggtgtttggccgtgaagacagcgggctgactaatgaggagctggaacaggtcgatctgctgaccggcattccgatggcgcaggactatccttcactgaatctcggccaggcggtgatggtgtactgctatcagctgtcggcgctgcaccaggtggcggccgcgccggttgaggcggctaacgcgcagcagctgcaggcgctgcgtcagcgctttcatcagctgctgataattgctcgggaaaaccggcgccggacagtgagtgatcgggcgtctgtggcgctgcctgaacgatcgcaatccgtttcggcgtctgcggcgcagcactgcgcagcagcaccattcgggtgcaaagacaaattcgttgacttaacgtgcgctttgctttacttctggaaggcagatggacaagacaaagacagacagaaaaaatctcaatgcgtaaccacagcctga

SEQ ID NO: 16327 - DNA, 1853 bp, Glycine max
  Peptide Sequence Number=SeqID_133105
atggcggacgccgatatctccaagactgcgtttcgaactcacgaaggccactataagttcaaggtcatgccctttggcctctgtaatgcgccatcaacatttcaagcagccatgaacgatgtgcttcgacccttcttgcgaaaatacgttgcagtcttctttgacgacattctccccgcactcacttatctcggccacatcattttggcccatgacgtcgcaccagacccggataaagtccaggccatgttcatccgtaattacgccgccatcgctgcgccacttacttctctactgcgtaaggaccaattctgctggtcatcggcttcggagcaagcctttcgggacctcaaacaccagatgacacaggcccctgtgctggccactcccgattttacctcgccattcatccttgaaacggatgcttctgggttcgctatcggtgccgtcctctcccaagacggccaccccattgcattctatagtaaggttctttgcccgagattgcagaaggcttcaacatatgtctgcgaactccatgctgtaatccagacgccggagcatcaacagtacttgtcgaagttgttgggctacgattatactataaagtataaaccaggtgccgcgaatattgcggctgatgcattatccagaattccagcccctgcaacaaccttcttctctctgactatgcctcacgtcaccttcctcgacaaactccgtcaggctgtattgcaggatccccaatatgttgaattgttacagcaggttcaatcttccccggcaacccacgaggatttattagttcacaaggatctcctcctccgccgtggccgcatatggctaccttttccgacgccgttcacctcattcctcatagaggaattccactcctctccattaggaggtcataccggcgccgctaagaccctgcatcgtttgcgtcaaacctttgactggccccatatacagacagatgggtacaccgtgatcctcgtggtcgtagacagatattccaaaggcgcccatttcggagccttgcctgctcaacacatagcttcgaaggttgccactctcttcttcgatatgggacccaatctttatcagcagtttctggcgggagatattccgtttgtccggtaccaagcttcggatgagtaccgcttaccatccgcagaccgatggtcaaacggagaatggtcatatagcacaaccatgcactccagtacaggagtttcccccttcgaagtggtttacggcaaaccacccccgtcccttctccattatgagccaggaacttccaccatcgaagctgcggacgacttcctcgccacttgcacgacccttcaccagaccctgcagcgccgtctgcgaaaagctcaggatgtgatgaaacaaacagcggataagcatcgtcgcaacgtccaatttgctatcaatgactgtgtctacgtgcttgaaaggataggtcctgttgcctacaagcttcagttaccaccttattcaaaaattcacccggtgtttcacgtctcacttctgaagccccaccacggtcctttaccaagctccgccgccgagttacctgcgaacaccctccacaacgatcctctggtcgagcccttaatgatcgtggattggaagtacgacgataccagttctcctccagtcaagaaggtcctcgttcaatgggccggattagctcccgaggatacctcttgggagtcctgggacgagttggccagagcatacgactttgagggcaaggtcgattttggggacgagagtgttgatagcaataaggctatagcagcaaaacacacacctacaaacatacaagctaaaaggcctaaaag

SEQ ID NO: 16328 - DNA, 1131 bp, Glycine max
  Peptide Sequence Number=SeqID_133106
atgccagagcatcacaccagacaggtgacctcagacaaacttgaggaagcgattaaccgcctttctcagagccataattccctcagccagaaccacaccacactcaactccaaaatggactttatccatctctccctcagttcccaaattgaatctatcctcgaacggttggccacgatcactgtcacccctccctccccaagctccctaccccaacctcctccttctccagtccatcgtcctcgtatgaaacttgatgtgccccgttttgacggcacagatccgctcggatggatattcaagatatcccaattcttcgactaccaggggattcccgagcttgagcgtttgacggttgcagccttctacatggatggacctgcactttcatggtatcagtggatgtcgcgtaatggttttttcccctcctggcccgccatgcttcaagcactcgaatcgcgatttgcttcttcttattacgaggatcctcagggggccttgttcaagttgcaacaaacaggcatagtcagtgagtatctcactcaattcgagcgcctagctaaccgaatcgtgggacttcccccttcggttctccttagctgctttgtttccggtttacttctgaaactcagacgcgaggttcaggctcttcgtcctttgtctcttcctcaggctgtggaactcgcgcgtctgcaagaagacaagttgttggatcgacgtcgtggcccatggccaccctcgttgcctcctcctccactagtgtccaagccgttgaccccatccgcttctttgccatccaaacttctgctgaaacgtctcaccactgaagaaatggccctccggcaagaccagggtctgtgctaccactgtgaggagaagtggtctcatggtcaccgctgcaagccccacctccatctactcatcgcggatgaggaccctgactctcccgcggacccgttttctctcgacccgccctcggtttcctcacaggacccattactggtacctcagataagtatgaatgcgatggaaggaaccctagccccccaaacctttcgccttcgtggtgtcatacgtcaccaccaggtcatcatattgatagatggcggcaacacccataattttatctaa

SEQ ID NO: 16329 - DNA, 630 bp, Glycine max
  Peptide Sequence Number=SeqID_133107
atgaccaaggtgcaaacctggaggcatgctttaaataaatccgctgatttatcaggaaatgaatcatcaaaatttcgaaatgatgctgagctgcttaaagaaattgtgaatcttgtgctaacgaggttggataaacctttggttaactcaaaagaacttgttggaattgacgaaaaaatagcagacttagaatcattgattagtaaaaagccacaagacaccccagaagaagtatttaataaactacagtctaattacgaaggtggttgttttttggccaatgaaagagaacaatcaaagaaccatggaataaagtctttgaagaatttattgttttatgaactgctaggatgtgacgtgaaaattgatacaccaaattcactacctaaagatattgttaggagaatttgtcaaatgaaggttcttactgttcttgacgatgtaaatgattcagaacacatagaaaaattacttggatcgattgataattttggaccaagcagtagaataatattaacaactagagatgagcaagtgcttagagctaacaaagtcaatgaaacataccaactcagagaatttagttccaataaagcacttgaacttttcaatttgcatgcctttagctaa

SEQ ID NO: 16330 - DNA, 1743 bp, Glycine max
  Peptide Sequence Number=SeqID_133108
atggccaccatactcacaaacagcagcaagattaatagtgggcgattcggtgttctaaagttcatagcacaagtaatacaaggtcgatggtttatgctttgtgcctccttctttatcttggcaggagcaggtggagtctatgtgtttggatcatattctgaagcaatcaaacgttcacaaggttatgatcaaagcacactcaactttttagggttttgcaaggaccttggtggaaacttaggtgctcctattggtttcattggagaggttactcctccatggttagtactcctcattggctcagtcctcaactttggtggctatttcatgatctggcttgtggtcactggcagaatatccaaaccacacgtgtggcaggttggtctctacattgcaattggtgctagttctcagaactttgccaacactggagtaataaccacgtgtgtcaaaaacttcccagaaagtagaggcacaatattaggtattttgaagggttaccttggactaagtggagctatcatgacacagctttacttggccttttatgggaatgattctgagtctctcattcttctcattgcatggcttcctgctgctatatcaattgcatttgcttctgtgattcggatcatgaagattgggactaggcaacccaatgagcaaaaaacaatgaacaactttctttttgcaccaattgtacttgcattgttcatcatggcaatgatcattgctcagagacaaattcctttctccaaagcagcctatgctggaagtgcaactgtggtatgtgttcttcttattatcctccctttgtttattgctgttagaaaagagttctcaccgtggaacatcatggaaaaagtacttgcgcatgctgcaaatgaggtaatcatagagaaaccacaaatagttgaagctaaagaaaaagctaaggatgatccaaacgggtcatgtttttccaacatattcaataaacctgaaagaggagaagatcacaccattttgcaagcactcttaagcattgacatgttgttattgttgatttcatcgtttgctgggtatggaacaaacgtaacagtggtggacaatttgggacaaattggtgagtcccttggatacactggcaacacagtgagatcatttgtgtcattagtaagcatttggaatttctttgggagggtcttgtctggtttcgtgtctgaaattttacttcacaagtacaaagttcctcgccctatgttgttggtcttttcgcatttcgttacatgcatcggccaccttcttattgtgttcccagcacccggttcagtctattttgcatcggtgataattggattttcctttggtgtagtgtggccaattttctatgcactcgtttctgaactctttggtctaaaacattttgccacactgcagaattgtgtgcttatggtcattcctcttgcatcatatgtgctgaatgttagggtcactggcttcttttacgatagagaggcaaaaaatcagctaataaaaagtggcaaagaatgggtgaagggcacagaattgacttgcattggaactgaatgctacaagctcccattgataataatggcatgtgtatcttttttcgcaggagtgacttctttgatctttgtgatgaggacaagagagttctataaaagtgacatatataagaagttcacagagaaggcagaaacggagttgactacatcttcggttgtttgtgacgaagagcgc

SEQ ID NO: 16331 - DNA, 687 bp, Glycine max
  Peptide Sequence Number=SeqID_133109
atgaccactaacaacacgaatactcgccaatttggagttgtaaagttcatagcacaagtaatacaaggtcgattgttcatgctttgtgcctccttctttatcatggcaggagcaggtggtacctatgtgtttggatcatactctgaagaaatcaaatcttcacaaggttatgaccaaagcacgctcaactttttagggttttgcaaggaccttggttcaaattttggtaccccagttggtctcttgggagaagttgtccctccatggttagtgatcaagcttggctcagcctttgattttggtggctatttcatgatctggcttgcggtcactggcagaatatccaaactccacgtgtggcaggtttgcatctacattgccatcggttctagttccttgagctttgccaacactggagtaataactacaagtgtcccaaacttcccagaaagtagaggcagaatattaggtttattgaagggttaccttggacacagtggagccatcatgacacaggtttacttggccatttatgggaacgattcggagtctctcattcatcttattgcatggctccctgctgctatatcaattgcttttgcttctgtgattcggatcatgaaggttggaaccagcactaagaaccccattgagccaaaagtaatgtaccagttgctttttgcatga

SEQ ID NO: 16332 - DNA, 417 bp, Glycine max
  Peptide Sequence Number=SeqID_133110
atggaattcttttctgttgaaacttttgattgcattcaagcctttcagaacctaggtcttatacctttcatgtcattacaattgcctgtttatcctgaattggttaaagccttttattgtaatcttgaaattcaggacaacactttgatttctgaggtttttgggataaaaatggtcatcgaccaatcccttttccatgacttaacccaattgtccagtgacggtgtaccatttgaaggtacactgaatgacgattggaaatttgatttctctgcacaagatgcccgccagttggtttgcaccaacaatgcggatatgaccggacgccttcttgccggttcattggcttttgaaagccgcatccttcattatctgattgtgcggattttgcgtccacgatcttccaatcttgcctag

SEQ ID NO: 16333 - DNA, 297 bp, Glycine max
  Peptide Sequence Number=SeqID_133111
atggaacgagatgagaaaagatttgagtaccgtttctgctattcttcggaagaaaatagtgtggacgaagataaggagggtggaattggtgctgtggatgcgctgttgatttcaatcggtgaaatcaaaagaaaagtgaaaaagaagaagattgcaagttatgggagtcgatttgatgaagaaatgagtaagataggaaggtttggaggtttgggaatggaggaacgttgcaagggggaaggggctgcgcaggggtttctggaaaacgtgatatttatagagcaggacgcatggtaa

SEQ ID NO: 16334 - DNA, 783 bp, Glycine max
  Peptide Sequence Number=SeqID_133112
atggctgcaagattaggcccattagtacctatgcaacactcaaggctggaaaaagagaaacttgaatccaacaagtggactgcaaactgggttggtgatcctgatggaactagatttgaggtctgccatcatgaaacaagaattgatgtcgatctacaaaaccagtcatgcacatgtaggatgtggcaacttacaggtctgccttgtaggcatgcgattgttgccatcagatacaataaccacagatcggaggactacaatgatggcatgctgacgattggatcttacaatgcaacctatgaaaattacatacaccctaccaggagtcaacaatattgggaaactacagcgtttgataggccaacaccaccccatattaaaaagagacctggtcgacccaaaaaatgtagaaaaaaatatcagaatgagggccaagtcagtaacattagactaaaattatcctacaaaaaggttacatgtactagatgcggtctcaatggtcataataatagaggatgcattaatggtggtgttccaccaagaccaaaaaagtggaaacctacttttgaagaatgcaataactcaaatgcaaccacaacaacaccagaaacaatcttcatatctccactgatgtcaattgcatttagatcacctccacttaggcctcaagcaccaattcgaattataatgcgagatggagtatctcataacaagaaccaaccagattacatgagcttcatacctacaccgggaatgcccaaccgccaagattcgaagaactaa

SEQ ID NO: 16335 - DNA, 312 bp, Glycine max
  Peptide Sequence Number=SeqID_133113
atgaattgcattcccatacctagatcttctccacaattccaccgaatttatatatgtttagatgcatgcaagaaaggattcaaggttggctacagaccttttattggtcttgatggttgtttcttgaaagggtactatggcggtcatttgcttgcagcagtgggacaagatgcaaacaatggcttacttcctgcaatgcaggaagttatgccaggtgtgaaacataggtattgtgttatgcacttatggaggaatttctcaaagcagtggaaagacaaagagttaagaggtctagtctggaagtatgcatga

SEQ ID NO: 16336 - DNA, 327 bp, Glycine max
  Peptide Sequence Number=SeqID_133114
atgtgcaccattggtcaaccaggggcaagcgagcccgttgacacacagagactaacatcgtcctctgcacctttttcatccgaagatggcgagtccgatgacatacagagatacccaagtggttattcgtacaaaacgatttatagtaatcctggcccgagaagtcaggtggcaggcggagatacccaagtggttatccgtacaaaacgatttctgttaatcttgacccgagaagtcaggtggcaggcggagatacccaagtggttatcccataaacacttttttgctatccgtcagactcagagtccggtagcatgcagagactaa

SEQ ID NO: 16337 - DNA, 447 bp, Glycine max
  Peptide Sequence Number=SeqID_133115
gtgtctgaagcttctgtcagcagaaaccgtagcactataattgttcctgctggaagctccagggatgaaggatgggcagcattcaggaacgttttggcagagatcaatgaagcctcaaggcttttcattctgcccaatcagcaaaattctgaatcctcagagcgtcttgttggactttcggatgatgttggtgctggcttcatatctggtcatagtactcaacctgccacttcttctgagttgaatgtggacagggctgatcagaaaagattcttctttgatcttgggagcaataataggggtcatttcttaagaatatctgaggttgcgggttctgatagatcctccattattcttcccctgtcagggctcaagcagtttcatgagattgttggtcactttgtcgaaatcacaaaggaccgaattgagggaatggcggttgctaat

SEQ ID NO: 16338 - DNA, 216 bp, Glycine max
  Peptide Sequence Number=SeqID_133116
atggcaaccatgcatgcacaaacccattctataagcaaacttcacaaatttatgggtgctcgcccaggtgagctaaccccccctttttttcatgaagaaagtacgcgctctctatggatcggcgtttgcttactcgaaacccctagggatactaggctgcctcctagtagcgcttctcgattgtccggagctggacgcgggacaacgatctgttga

SEQ ID NO: 16339 - DNA, 402 bp, Glycine max
  Peptide Sequence Number=SeqID_133117
atgacgtctatgcgtactgtactgaatattcttaattttgtgttgggcggtttcttcaccacgctgggttggctcatcgccacggtgttcagcgtgctgctggtcatcacgctgccgctcacccgctcctgctgggaaatcaccaagctgtcgctggtgccgttcggcaatgaggcaatccacgtcgatgagctctacccggaaaaaagcaatgcgctgctctccgccggcggctcactgctcaacgttatctggctggtgctgttcggctggtggctgtgcctgtcacacatcgccgccggtatcgtgcagtgcgtttcgatcatcggcattccggtcggcatcgccaatttcaaaattgccgccatcgcgctgtggccggtggggcgccgcgtcgtctcg

SEQ ID NO: 16340 - DNA, 482 bp, Glycine max
  misc_feature (423)..(423): n is a, c, g, or t
  Peptide Sequence Number=SeqID_133118
tcgtctgcaaaggattctacccgccgctcgatgggaattgcgcttcaaggcgtctcgtagggctaatccgccctcacgaggggtcaccaacggcacgtgcctttggggggccgaggccccctactgctgctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttangacacctgcgttatcttttaacagatgtgccgccccagccaaactccccacctgacaat

SEQ ID NO: 16341 - DNA, 374 bp, Glycine max
  Peptide Sequence Number=SeqID_133119
tcaattctttcctcgctgtcaggttgtctattaatcggctggtggtatggagccagcaacttagtctgagcctatttaaagtactgttaaaatcctgtttgggtcacgttgcacgctgtcgcaacatgcccttttgcgggcgagcgaaggcgaggctcacgggtgcactttccaaaggaggaaagatgcgcggagtcgccaccaacgtcgacaaaagcggggcttttgctcctgcgtaccctccatcaaagaggaaatcagacctacgtagttctttcttaagggtgaatcaagcgattctttttacttggaaggtgatcattttaaggcgttggaccttaaaagtgatccatttacttggtaagaaaaactga

SEQ ID NO: 16342 - DNA, 711 bp, Glycine max
  Peptide Sequence Number=SeqID_133120
cgccgcgctatccggaggacgagctggccagcgagccgtggtacagcatcgcgcccaacgacgtgttcccggaggagttccgccacttcctgtgcggcgatcggcgcattcggcaggtgtttgaagaattgcacagcgatctgtttaccgcggagtattggcgcgggttacagcagcgcatccgcgaggggcacgtggaagacgtgttcgcttaccgcaagaagcagcggttcagccagcgcagcggggcggcgcggactagctagaggagtccatcacagaaaaagtgacccggcagctcatggcatccttcagccagatgcaatccctgattcagtcccaaatgcaatctcagggacttgcactgcctcccgagcctctggttggtccctccggtactcgaataggtgcggcttgtacatcgaagtagatcctgcccgcctggttgccctggggagagtttgtgagggatccactattgttcataacactcctttgttgcctggccaagtaaaggtgagtgtggaggaggttacacatgtagatgctccagttcctgtacctactgatgaggtttccatagtggggcaggcacttcacaccttccttgcttggccgacacatctggtcaagtctttatcacaacagttgtctctccggcaaaaccacctccaaagcccgatccacaggtcgatgatccgctttatctga

SEQ ID NO: 16343 - DNA, 372 bp, Glycine max
  Peptide Sequence Number=SeqID_133121
atgaagaaggcatacatcacatgggatgacaatgatatggaatcatctgaggattcagaaaatgaagagataaacttgtgtctaatgggtaaaagttatgaaaacgatgaagaggtatctttgaagaagaaatggtacatagatagcggttgttcaaaacatatgatgggagatgcatcaaagttcacatatatctctcccaagaaaagcgagcatgtaacttatggtgacaacaacaaaggtagaattcttggagtaggaaaaataggtatgaattcttcaaactccattgaaaatgttctacttgttgaaggccttaagcacaacttgcttagtgttagtcaactatgtgataaaggctatctagtataa

SEQ ID NO: 16344 - DNA, 177 bp, Glycine max
  Peptide Sequence Number=SeqID_133122
atgttggtggcgactccgcgcgtattcctttcgtggaacacgcatcccgcgagtctcgcgtcgccctcccgccgaagggtcaggatagcgaaaggtggggcagtcgataaaagcgaggcttttgcttctacgtatcatcgatttgtgatgaggaactcagacctacgtggttcttga

SEQ ID NO: 16345 - DNA, 198 bp, Glycine max
  Peptide Sequence Number=SeqID_133123
atgacatgtccaagagcacgacgaggtagcttgcaggatatatcactctattacagtgttggatctatgaacattttccatttgttggttccgctattcctgccgagaattttgatgatgggagaccgtgtgcatgtcgatggacctatgggaaggcactgcccatttccacatatcgcaggcgtctggatagactga

SEQ ID NO: 16346 - DNA, 209 bp, Glycine max
  Peptide Sequence Number=SeqID_133124
atggggacaaatcaaaacggcaaaaggttttatcaagtcaaggttaaaagtctagatgtcactagcctcaaggaattaggacgattgatgggacctctccaaaggcaagccttccgcaaagtgtacggaaagattctagatttggccgcagcggaggtatttatggaagctgtcgtatccctcgcccaatactatgaccagccgttgag

SEQ ID NO: 16347 - DNA, 605 bp, Glycine max
  Peptide Sequence Number=SeqID_133125
aacaagcatgccttcctgccatatggtttgcctcctaactacacaccacccaatgttgcacatgctcccgatgagaatgttgacaattccgcaccaatacctgttgagagccaacaaccccaagctgatcatgtacatgtctctcaacccataggggagacacatgaagtaccccaccacaatctagctgacttcgagccttgcctcggatatgccactaaggggcaagcagttggtggtgtatccctgcctaacactttgggggggcctcaatatcacccacaaccacaacccttgcattttacgatgggaagactccctcctgctatggtggacagggagaaattggatcatatagaggaaaggctaagggccattgaaggaggtggagattatgcctttgctgacatggaagagttgtgcctagtacccgacgtggtcgttcctccgaagttcaaggtttcggacttcgataagtacaaggggactacttgccccaagaatcacctgaaaatgtatagcaagaaaatggggacatactcgaaaaatgaaaaattgttgatgcatttcttccaggaaagtcttattgggacagccgtcacctg

SEQ ID NO: 16348 - DNA, 344 bp, Glycine max
  Peptide Sequence Number=SeqID_133126
ggatcgcgcccgcaagacacccagcggacccggagaagtccaatagggtcttggggtttccagttctgattacgggcctctttcaattctacggagtgcctatctccccagcaaggtcatcaggccccctactaactgagctttcatcaagaagtactgcacccccaggtaggcacagggcgagacaccacgacagcctggggatggcctgcaacgggcaacagacgcaccgccgccacctccaaagcccctcaactcatctacaaaagctagagcgttgcctacgacccgtggtcaaccagcaggcgaccaagtccaaagccaaaggtaagcaaaagtactag

SEQ ID NO: 16349 - DNA, 309 bp, Glycine max
  Peptide Sequence Number=SeqID_133127
atgaacgtgatactcaaatttcacgacgatccaacggtgaacgagtcccagatcgtcgtttttctgagacagcacctatcgggtcctcatgaatcgagtttgcaaggcttgaagaaaaactggccaagaggtgaactggctgttgctagtcatccactggaaccacaccagggcacgaccatccatataaaacgaagcaatggtcaagcgttcatggtttggggtcgcatgggttacatgtttctcaaagctttattcaagacaaggaaatcaaagatattcaagatggatgatcaagacagcctctag

SEQ ID NO: 16350 - DNA, 420 bp, Glycine max
  Peptide Sequence Number=SeqID_133128
atggagaaatcagaaaagaaaaattttagtgaaaagaaaatgaagaaagcgtacatcacatgggaagacaatgatatggaatcttctgaagattcagaaaatgaagagataaacctctgtctaatggctaaaagttatgaaagcgatgaagaggtaatatcttcaaataacttatccatttcttttgatgaattacaagatgcatttgctgatttgcataaagagtcaatcaaacttgcaaaaatctttagaacaaatcatattcatggacaagattctaaaggaaaagggaaaggaagcaatgaagatcctcaagaagaagcaaaatcaaatgatgaacttccaaaagaatggaaagcctcaaaagatcatcccctcgacaacattattggtgatatctcaaaaaggggtaacaactag

SEQ ID NO: 16351 - DNA, 367 bp, Glycine max
  Peptide Sequence Number=SeqID_133129
atgccgacgcccttcccttataaaaatgataaggcactgccatggaaatatgccgcacaagggtccaacaaaaggaaggacgtgtccttcgtacgtgttaaagaggacctgccgttcactaaagttacaaatatttccggtatgagtggcatgactcatagtggacggatcttcgctgcgtccgagctaccagtatggtcaaaggacaaagggaaggtgaaggcggacataggtgaaagagataaggtgggcttgacctcaaatgatgaggtccctattggaaatatcacagaggaaagggacgacttcgacaagaaagtgatatcagtggaggaggcgaccaagttcctaaggatcattcaacaaa

SEQ ID NO: 16352 - DNA, 674 bp, Glycine max
  Peptide Sequence Number=SeqID_133130
tcgcggccgagcgctgcgaattgaaggagatctcggcgacgattgccgagctcagcacgaatgtcagttgcggcagattgcagcccagcgccagcaacagcacgcgcagcgtggggtgtttggccaagtacagagacagcaggatgcaggccccgcccagcaacacgaatgcacagctgagccagccgcgggcgtagatcgaagtgacgccgcgcttgagcatgcgctgcgacagccacgacctgaccagcaccagcggaatgttgatgccggtgaaaatcatgaacatccagccggtttcttgcgtggagtaacccagcgccttgctcatgtaggccgggatccaggtgaacatcaccgagaagatccaatacgtggtccagtacaacagcatgttggccaggaaggtgcgatccgtcagcagcacccagtaaggcacgcgcgcttgcgatgcgttggcgctggcgccggcgttgcggacctgcccgtcgccgccgaacagcagccacagcaccatccagacaatgctcaggacgcccagcagcaggaacgccgcgtgccagctgtgattgagcatgatgtaggtgagcaccggcccggagatcagcaggccgaccgtcacgccctggaaaatcacagaagacggcacgttgcgctggtcgtccgtgaaccag

SEQ ID NO: 16353 - DNA, 216 bp, Glycine max
  Peptide Sequence Number=SeqID_133131
atggatggggcattctcgcaggacatggtggcggaaactggtcttcctatgatcttacttagtgagagtgacctgacaagcccattgtgtggtgtgtcttgttatatactcctaagcgaaccatggtggtttttcactgacatgatgaataagtggataactatgaagaacctcatgctaaaggacacgggaacaccacgctctgataggatgtga

SEQ ID NO: 16354 - DNA, 372 bp, Glycine max
  Peptide Sequence Number=SeqID_133132
atggctccggataggatgcagctacagagcatgtgtatgaaagagcatgaatctttcaaggaatacgcccaaagatggagggatctggcagctcaagtagtgcccccaatgatggagaaagagatgataacaatgatagtagacacgttatcgatgttctactatgagaagatggtgggttacatgccttcaagctttgctgatttagctttcgccgacaaaaggatcgaagtgggtctgaaaagaggcaaatttgattatcctgctttgatgaatgagaaaactggggcaaatagagaggatgcgaaagaggaaggaacccatgttgtgattgtcgttcctacatggtcaaatttcccaccagctcaataa

SEQ ID NO: 16355 - DNA, 261 bp, Glycine max
  Peptide Sequence Number=SeqID_133133
atggtgacaaaaagggaaaggctcaaggccattgaagaaggcggagatcatgcttttgctaacatggcagagttatacctagtgtctgacgtcatcatccctctgatgttcaaagtgccgaatttcgataagtacaaggggactatttgccccatgaatcatatgaaaatatactgtcggaagatgggggcatacttgaaagatgaaaaattgttgatgcatttcttccaggaaagtcttactggggcatccttcacctag

SEQ ID NO: 16356 - DNA, 180 bp, Glycine max
  Peptide Sequence Number=SeqID_133134
atggattacacaacaataccctttttgacttctggaatgttgcggaacttcatggattacctaacgatgggtgttaagtacctcgaggtggtcaagcgaaggttgcatgccaccaaacaatggtccccggatgaaattaggtcgctaagttcttcgcttaaactcttgcaagagtcatga

SEQ ID NO: 16357 - DNA, 341 bp, Glycine max
  Peptide Sequence Number=SeqID_133135
atgggagatcacctagaggatatgattcgtgatcttggacaagagtcttttcagcaagcacatgtccttatgtatgatacatttcaagctgattcaaataagctgatgtatcccaggtgcaacaattcgttgacgatgttgttagcggtgttaagtttggttaatctcaaggccagatatgggtggagtgacaaaagcttcagttcactacttcaagtagtgcatgatatgcttctagaggaaaacatgctaccaaaagtttactatcagacgaagaagatactatgttcgatggatatggagtatcaaaagattcatgcttgccctaatgattgcatact

SEQ ID NO: 16358 - DNA, 369 bp, Glycine max
  Peptide Sequence Number=SeqID_133136
atggaggaatcccatcgggaaaataacaaagatcacatttcccagtcaagagggtccgctcttgacggtgaagaacacattggagaatggaagaatccaatcgggaaaataacaaagatcacatttcctagtcatgagggtccgctcttgacggtgaagaacacattggagattggaggattcaatcgggaaaataagaaagatcacaattcccagtcattagggtccgctcttgacggtgatgaacacgttggagaatggaaaaatccaatcgggaaaataacaaagatcacatttcccagtcaagagggtccactcttgacggtgaagaacacatttgagaatggaggaatcccatcgggaaaataa

SEQ ID NO: 16359 - DNA, 599 bp, Glycine max
  Peptide Sequence Number=SeqID_133137
ggctacatgccctcgccttcagagggctacacgccctcgcctttagaaggctgcacgtcctcgccttcagaggtctacacgccctcgccttcagaggcctacatgtcctcgccttcagagggctgaacgccatcacctttagaggactacacgtcctcgccttcagcaggctgcacgccctcgccttcacaggactgcacgccctcgccttcataggactgcacgtccttgccttcaaagggctgcatgtccttcccttcagagggcttcacgtcctcgccttcagagggctgcacgccctcgtctttacaggaatgcacgtccttgcctttagaaggctgcacgtcctcgcctttaggggactgcacgtcctcgcctttagagggcttcacgtccttgccttcagaaggctacacgtcctcgccttcagagggctacacgtcctcgccttcagagggctacacgtcctctccttcggaggactgcacatcctcgccttccgaggactgcatgccctcgccttcagtgggctacacgtcctcactttcacagggctccacatccgcgccttcagggaactcaaggtcctttgcctttaa

SEQ ID NO: 16360 - DNA, 201 bp, Glycine max
  Peptide Sequence Number=SeqID_133138
atggacctagtactttgcttacctttggctttggacttggttgcctattggtggtggcggtgtgtctattgcccgctaccggccatcccaatgctactgtggtgtctcgccctgagcccgtctgggggcgcagtacttcttgatgaaagcccggttaatgcggggcctaatgaccttgttggggcaatgggcactccgtag

SEQ ID NO: 16361 - DNA, 387 bp, Glycine max
  Peptide Sequence Number=SeqID_133139
atggcagcacagttgatccatgatcgtgttgtgatggagtgcctagagggtgtttgggagaccctcgaaggcattgagagtacatccggaggaacccgcacgcacacttcaacagcctgtggagtggatactacctacactactccatatcgactagtggagccagttcaagtgatagaggtgtcattctctgaagaggatcttgaagaggacccagaggagttacctcctgaacctgctgtggatgctcttgacttcccagaggatgatgaggacccactccctgatgttgattctccagaggatatcatgtcagcatctgaagcagactctacagaggagagcggccctggagggacagcgaatagtgaagactcttcatcatag

SEQ ID NO: 16362 - DNA, 372 bp, Glycine max
  Peptide Sequence Number=SeqID_133140
atgctagccaatgcatcgttcccttatgccaaatccttttcattcaagatgaagatgattcgcattcttttcatctttgctcttctatccttcacttcccatgcttctaatgtcaatgacttctgtgtggcagacctgaagggtccagatagccctactggctatcactgcaagccacctaaaacagtaacatcacatgactttgtgttccatttaggccctggaaacacttcaaacgtgttcaagtccgcaataacctctgcatttgtcaaagattttcctgctgtcaacggtcttagcctttctgtagcacgcattgacatagctcaagggtggagtggttccaatgcacacacatcctggtgccaatga

SEQ ID NO: 16363 - DNA, 910 bp, Glycine max
  Peptide Sequence Number=SeqID_133141
ccatcagagggctacacgtcctcaccatcagagtgcagaacgccctcaccttttgaggactacacgtccccaccttcagagggccacacgccctcaccttcagagggttgcatgtcctcatcatcagagggctacacgtcctcaccatcagaggtcagcacgccctcaccttttgaggactacacatcctcaccttcagagggctacacgtcctcaccttaagagggctgcacgtcctcaccatcagagtgctgcacgccctcaccttcagagggctacacgtcctcaccttcagagggctacacgtcctcaccttcagagggctgcacgccctcgcgttcagaggactacacgtcctcaccttcagagggctacacgtcctcaccttcagagggctgcacgccctcatcttcagaggactacatgtcctttagagggctgcatgccctcaccttcagagggctacacgtcctcaccattagagggtttcatgccctcaccttctgaggactacacatcctcaccttcagagggcttcatgccctcacattcaaagggctgcacgtccgcaccagggctgctcgccctcgccttcagattactacacgtcctcaccttcagagggctacacgcccttaccttcagagggctgcacgccctcaccttcagagggctgcacgctgtcacctttagagggttgcacgacctcacctttagtgggctgcacgccctcaccttcagaggactgcatgtgctcgccttcagagggctgcacgcccttgccttcagagggctgcatgcccccgccttaaaagggcgacacgtcctcaactttggagggctgcatgccccctcgcctttagagggctacgcgtcctcactttcagtgggctccacatccgcaccttaa

SEQ ID NO: 16364 - DNA, 365 bp, Glycine max
  Peptide Sequence Number=SeqID_133142
atgaggaaaacacatgaaattccccaccacaatctagccgacttcgagccttggctcggatatgccactgaagggcaagcagttggtggtatacccattgaaaacacttcggaaggccctcagtatcacccccagctacacctcttgcattccacaacaagtaaaaaccctcgtgctatggcagaaatggaaaagttggatcatctagaggaaaggctcagggccattgaaggaggtgaagattattcctttgctaacctagaagagttgttcccaatacccaatatcatcacccctcccaagttcaatgtgctggactttgacaagtacaaggggactacttgccccaagaaccatctaaagat

SEQ ID NO: 16365 - DNA, 1281 bp, Glycine max
  Peptide Sequence Number=SeqID_133143
aggaaggactttacttggttgggaatacccttcaatgaaggaggcagggagagaagtttctcggctgaagaggggatagattatcgcacgagaactaggaggcttgcacgagaggaagcctttgctcagtgggaaagagaaagggatggtgcagctagggaagctgctgaggtggggtactttgtttctgagcggagttgtggtctatccaaaggtgatgatggtttaaaggagattgaaactcgatcgttggagtcaactgagtctgcgccctttttctgtatgaatgatgggaagcacgatcattggttgatggacaaaggtgttaattatgatacgaaacacacagctttggaaaaatcatttggagtaagatttcctggattgggacttcgattttggtccagagtaatatcagggcttaggaaacacaagttgaataggaaggctaatgggagtaacatctttgcatctggtggtgctatcaaaaagataatattggaacgtagtgcatcagctgctcatgcatacttttgtgatcaaccacaatggaagtttgaggagccttcatcaccttctgaaagttatggttttatgagtcatgatatgcatttggtgaaaagtgaggttgacagaaatacaatatctgttattgttagtgatgaaaatagaagtgatgataaccaaagtggaacacaattcaaagatctgggattccagtcccccttagtaaatgaaaatgttagcagtcaatcagattatttaaagtttgtctgtgattcaactttacggacaagagagagtgaaattgaaaatttgcaatctagtgatgatgttgcaaaacctgctaatccaaatagtagtacagtgaaaaatgaggagtttgtaccatatgttgctgagaatcaaattgatgataatgatagttcatcagggggccaacagggtttgccatctgaagatttgggtattgtgaagcctgagcctcagttggcaacttattttcaaaatccatttgagcacttgctcgtgaaatttggcttaacctcatttttaaaaaatattgaagagttgatatctcattttctttctggttccattgaaatgttgaagtctgatgtgggtctgaaagttgaagatattgtttcagaacatgttgatggggtagattttgtgcagtctgaaggcgttacgaagactctgcctgttacgctggattcagttcatttcagaggtgcaacactgatgctacttgcatatggtgacaaggaagttaggtaa

SEQ ID NO: 16366 - DNA, 312 bp, Glycine max
  Peptide Sequence Number=SeqID_133144
atggagtgtgaaacctctgttatggtttctgaagagaattcaaaggaggaagatgatcttctacttcagagcataagaaaagttaaaaggaaagctaatgaaaaggagattccactggaaagggaagtagagtacaaaaagatagggggagaggagaactatccttacaaagaaaagtttctttcaagtgaaggggcgattccattttctgcctttgatggtggatgttatgccttagaagggttctctcatagtgatagtgttagggaagaagatgggtttctatcatctagaggcaaagttgaaatgtga

SEQ ID NO: 16367 - DNA, 237 bp, Glycine max
  Peptide Sequence Number=SeqID_133145
atgaagagtgtatccactcttgtgtattgcgatggtgacatgatttcgtcatacgaagggatagtgtttgaatgccctagtgatcctaaagtcatcacaagaagtgaggacatgtcacttgatgccttaaggaaaacaatttttgacgctaatggagatgatggttgtgttgaatacgactgtaaggagcttaaatgcaacaatgatgtgagcaaaacgttttcacttagaatttag

SEQ ID NO: 16368 - DNA, 660 bp, Glycine max
  Peptide Sequence Number=SeqID_133146
atggaggccatgatgagcatgaagaagataatggaagccaatgtggttatagttgccgctactagcgctgtcgctaaagtgaacccgatgctcccatctggcctcaagcaaatgaatcatccaacctcaaatatggtaggcaaagatttgggaagtacggatgaccccatgatgtgcaaattcaaaacaagcacgccttcccgccatatggcttgcctcccaaactatacaccacccaatgtggcgtacattcccaatggggatgtcaataactccactcccatactcattaagagccaacaacctcaatctgatcatgcacatgtctctcgacccatggaggagacacatgaaattccccaccacaatctagccgacttcgagccttgcctcggatatgccactgaagagcaagctgttggtggtatacccatgaaaaacactttggagggccctcagtgtcacccacaaccacaaccctcacattccacagcggttaaaaaccctcatgctatggcagaaatgggaaagaggaaaggctcagggccattgaaggaggtgctggactttgacaagtacaaggggactacttgccccaagaaccatccaaagatgtattgtcggaagataagggcatacgcaaagatgaggaactgctaa

SEQ ID NO: 16369 - DNA, 740 bp, Glycine max
  Peptide Sequence Number=SeqID_133147
gcgcctcggccacgccaggcaactggcgcaggtgcttctcgatcagccagccgcaggcggcgcaactgatgccttcgatcatcaggctggtttccgccagctcgccctcatggcggacgaagccgccctgtacgtccgggcggtcgtagagctgcaactcttcgctgagcgccttgggcaaggcttcgggattggcggcgttttcgctgcggtgccggtagtagctttccaggccgccggcgacgatggcctcggccaccgcctggcagcccggacagcacatggcccgcgtctcgccgagtatgcgggcctcgaagcggctgccggcggggaccggcaagccgcagtgctccatgaccacggtcggcgataccacctcttcctcgaaaagacgccactggccgctgccttcctggccgagcagttcgacgaagcgacggccctcgacggcgtcggtcagttgcccgacgtagcgctcgcggtcggagttgctgcgcagcagctccacgcggcggtccttctccggctgggtcggcgagatcaggttgagggtgagccgatccggacggctgttgccggtcaggcgcacttcgacttcgccggtcaggtcgtcgaccttgaccttggcgtgcacctgcaggcgtacggccaggttctcgcgttccagggagcggttgatgcccttgccggcctcgtagtagttgtcggtgaccagggtgtcctggttgcgcaccgcgatg

SEQ ID NO: 16370 - DNA, 606 bp, Glycine max
  Peptide Sequence Number=SeqID_133148
atgaagattgggttcatgtttggagatgaaattctaaaagacaatcaggagaaagcagctatagcacttggtgaaggagccatgcaattttttcaaatgcaaaaagagattcgtgtaaaaaggggttccttatcaattcctcctgattggatgaaagttgaaagtgacaataaacaagagattagtgttgctagtgatattgaaattttgaatcagagtacaattattggactagttcaggtgttggaagaagcaaatcagtttgtgaatttggaattaaggagatcacatgaggaaccttggtacttgacttttgttgatggaagtcatgttccatccttaagaactaagttgtggagttttatgcgaatatctagtgatgaaatgaactcaccatggggtcttataggtgatttcaatgtcattttaaatgaagtagagagatctagaggtgttgaatccaataatcatagaggtatgagggcctttaaagaagttatggattactatcacttattatatgctggttttgaaggtctaaaatttacttgggccaaaagggagctatctatgaggcttgatagaatggtgatgaatctaagctag

SEQ ID NO: 16371 - DNA, 312 bp, Glycine max
  Peptide Sequence Number=SeqID_133149
atggatgatgttggaatggtgttcaagaatttatttactcaggaggaaggtctagaaactttttgtctcaaagggaggtttcctagaatggtggaggatgagatggagatgttgagaaaggatattacagaggaagaaaatagaatagttgttttccatatggggagttatgaggcaccaggggaagatggttatcaacctacgttttatcagagtcaatgggaggtggttgagatttctttatgtgagactattaggaatcttttcagaagtccagctgaggtgaagagagattgtggaaaaggtggttag

SEQ ID NO: 16372 - DNA, 492 bp, Glycine max
  Peptide Sequence Number=SeqID_133150
atggcttgggagctttgtactaataatgatgctttgtgggtacaggctattagagccaatataattatggggagttggggtttcctgttgaggaacatattcatttttgaaaacctcctttggagtgatcatgaagtcagaagtagattactcaatttggagcatcacttgcggcttggagacaatttgtacaaagctagcaattataatcaccatcacatggaagcatctatgttgcactggaggccacctaatcatggttttgtgcgcctgaatgttaatggagctttgactgtccatggccccaaagctgcatgtggaggggttataagatatcaaatgggaaactttcaaggagcttttacctgtagactaaaaacatgtttagttgctcaatcggagttgtgggccattcttcatggtattaacatggctagggagcgagggatgggatgggatggccaggggatggtgttgacttcttgggtatga

SEQ ID NO: 16373 - DNA, 318 bp, Glycine max
  Peptide Sequence Number=SeqID_133151
atggattttaggaggttggagactggagttggtaatggaagttgcaaacagggatatggtgtgaaaaggggcaaaaacattggtaaatggggtcagaaaagggcaagatgtgggaaaaaaggaatgagctttaccatcaggaccaatgacaaaggtggtggaggaatttgtggcagcaatgctttccaagattattttgatgatgccaaagactcaagtcaagaatcaagagtaaagcaagtttcaagaatcaaagagtcgttcaatcaaagcaagtttcaagaatcaaagattcgttcaatcaagattcaagattaa

SEQ ID NO: 16374 - DNA, 360 bp, Glycine max
  Peptide Sequence Number=SeqID_133152
atggctcgcaccaagaaaactaggcagatgacatctggggccgtaaaggaaatcgctgagaatattgagcaggcgtcacagggttcatttgacccctatggtcgtcaggatgtcctgactgctgctgttggccggtgtcaccatcaagcaatactttggctccgctccacgaagctcctgcatttcctccttcatccctcccgaagaactcgagcagctcactcaacaaatcagggaccagctggaggagtcgatcacagaaaaagtgattgggcagctcatggcatccttcagccaaatgcagccccagcttcagtcacaaatgtaatcacagggacttgcactgtctccggagcctga

SEQ ID NO: 16375 - DNA, 213 bp, Glycine max
  Peptide Sequence Number=SeqID_133153
atgtcgacttggcaactccgacagaatgtgaggcgtaacaaagggttatgcgtcaaacccgttgctttgtttgtggttctaaaggagatgctcacttccgacaccctttggttttcaaagaaagatgaacgacttgatgtcaacaacgacagatcaaatggaaaagttatgacgagcactaaggagattgttgttcttgttgaagaagaatag

SEQ ID NO: 16376 - DNA, 201 bp, Glycine max
  Peptide Sequence Number=SeqID_133154
atggctagaaaagagattaataaatcacaagagaaagtagccacaggctaccctgaagagttagggaaacaacttgatcaacatggacgggctcaaagtgatgagaattctaaaactggccaaatacaagctaaaggcccaagtggagaagggcgaaggcccaaatggagaaggacaaagcccttgagtggagaaagatga

SEQ ID NO: 16377 - DNA, 219 bp, Glycine max
  Peptide Sequence Number=SeqID_133155
atgagcgataactttgaagcggacacgggtgtcttgtgtcttgttggaataggtgtgaaaccaaccacacacagagagcgggcctactacgccgtttcgagtttgcttaatgcgatccaactcttttgccgaatccccgaccacagctgcaatcttgctcaagaagggaagaaacccggagaaaagatacggttttcttcccccaagagggcatcctag

SEQ ID NO: 16378 - DNA, 813 bp, Glycine max
  Peptide Sequence Number=SeqID_133156
aacctatcgcctttagaggactacacgtcctcaccttcagagggttgcacgccctcgccttcagagggctgcacgccctcaccttcaaagggctgcatgccctcatcttcagaggactatcactcctcgcctttaaagggctacacaccctcatcttcaaagggctacacgctctcaccttcagaggacaacacgctctcaccttcaaagggctacctagggctacacgcactcaccttcgtagggctacatgccctcaccttccgaggactacatgtcctcaccttcagaggactacacgtcctcgccttcagaggacaacatgtcctcaccctcaccttccgagaactacatgtcctcaccttcaaaggactacacgtcctcgccttcgccttcgtagggctacacgccctcacctttagaggactacacgtcctcaccttcagaggaaaatacgtcctcacctttgccttcgtagggctacacaccctcacctttagaggactacacgtcctcgccttcagaggactacacgtcctcacattcgccttcgtagggctacacgccctcacctttagaggactacacgtcctcaccttgagaggacaatacgtcctcgcctttgccttcgtagggctacacgccctcacctttagaggactacacgtcctcgtcttcagaggactacacgtcctcacattcgcctttgtagggctacacgccctcaccttaagaggacaacacgtcctcgccttcagaggactacacgtcctcaccttcagtgggctacacgccctcgccttcaaagggtga

SEQ ID NO: 16379 - DNA, 501 bp, Glycine max
  Peptide Sequence Number=SeqID_133157
cgcgagatggcctatgtgcgccaggcgactcacgatgcgctgacgggctgtaaaaaccgccgcgcattcgacagcgatgtcgcggaattgctgaatgcccagcagccgtttgcgatggcgctggtggatatcgataactttaagtcgattaacgacaccctgggccacctgactggtgatattgtcctgcgcaacgtagcccgtgaagggatccagattatgcagccgcatcacgtcccggtttaccgctacggtggagaggagttcgcggtgctcttccaggccgggcagatcgcggacgccttctccttactggaggcatggcgtaccgcggttgaaaagcgcgtctggcgggaggaaaacctgcgggtcacgttcagcggtggtcttggggagtggcatttcgaaccgctggagcaatttgtagaaagtgtggataacgctctctacagtgcgaagcggcaggggaaaaaccgcattcttcgcacctccgtcggctga

SEQ ID NO: 16380 - DNA, 668 bp, Glycine max
  Peptide Sequence Number=SeqID_133158
ataacaatcaaactgagaatggtggcacccataatgatgagatcaaagaatatctagattgcagaaaacctgttgttgaaagattacacttccatcttccaggccaacatagtgttctctatgaagaccatgatgatattgatgatgtattgtctaagccaagtatctctgattcaaagtttatttcatggatgaacactaaccaaaattctattgaagggagaaatcttacttatgcagaatttgtttctaagtttgtatacaatcagaagaaaagatgttggcaccttaggaagaaaggttataccattggcagattactatgggttccaccaattacaggggaattattttatttgagaatgatgcttactgtttgtaaaggacctacctcatttgaggatttaagaacagttgataatgttcaatattctacatataaagaagcatgttttgctatgagatttttgcaagatgataaagaatttattgaggcaatcaaagaagcaaaagactggggttcagcacattatataagaaagttatttgtgttgttacttttagctgcaacgatgagcaaacctgaacaagtttgggaccaaacttggcattggatggctgatgacattgtctataattataaaaaatcatcaacaagtacaagttag

SEQ ID NO: 16381 - DNA, 355 bp, Glycine max
  Peptide Sequence Number=SeqID_133159
gagaaagaagtccacccaaacctggattttcgaagtcccactcgtagccacgcacttcacgaccccgaaaatgccctcctttcgcgatttggagcagaaatgagcaccaaaggtgggagctttgttggggtttcaatggagaatggaggagaaggaaaaagcaacgatgttacagaagaggcccatgagttcctccgcctcatccaacaaagcgagtttaaggtagtcgagcaactgaataaaactccagcaaggatctctttgcttgaactgctcataaactccgagcctcatcgtgcgctgttgataaaagtcctcaacgatgcccatgtagcccatgatatctcaatggagg

SEQ ID NO: 16382 - DNA, 201 bp, Glycine max
  Peptide Sequence Number=SeqID_133160
atgtgtagtgattgcctaatgcaattctccattctccacttttattcggagccccatgaattgattgtcgttcatgcatcctccacccatgagtctggagccacgcgtagtgattgcctagcgctgttcatgtgtcctccaccgtcaagtgcggagcctccgaaaacagaagaaatagagacgagagtcgtcatagactaa

SEQ ID NO: 16383 - DNA, 483 bp, Glycine max
  Peptide Sequence Number=SeqID_133161
atgagaaagactttcaaatcgatccaatcgatcgagaatctctcatctgttagaaaaaaacctagaaaagaagaagagtcactaagacaagagctaggtaagcaagaaggagaggctagaaaaggcggggcaaggggctctccatctctaggaagattgtgtccaggatctggtaatctaagttctggtcggctcgtagtagcctgtgctttattacaggtagtcattccccccgttcctttagtcttttcaacgtttctagttcttaaccaaccctttctcgccgagctttataaagctttaagagagaagagtaagggggaccttctttttctcctgcggagccctcagaaagcggcaatggtaagagctggtaagcatggtaactgtaccggcggccggggccggcgctccgcgttctatctaggttccgctcttacgtacgccccacctcacatagaagaaggggaaccccttccatag

SEQ ID NO: 16384 - DNA, 306 bp, Glycine max
  Peptide Sequence Number=SeqID_133162
gtcagaatagggtttcgttctctaccgaaaccgcgagccaagttagaagattccgcttcggtcgaagggttcctcttagtgtggggttgcaacggagaacatggcagtttgtggtggctaatggtggctttgggtgatggagaaagtgcttgggatgttaaaaatggctttggaagaaagaaagaagaagaaatggtgtttttcctaagctacccgaaagcaaaggctgaaaacgctcaagtgagaaatggtctcggacacggaaatttcgcgtacactccagatatcttctcaaagatcccaatg

SEQ ID NO: 16385 - DNA, 180 bp, Glycine max
  Peptide Sequence Number=SeqID_133163
atggtggtgttgagtggttgggtggaggtgagacaaggtggtgatgggtggttagctgcaggggtgtacgaagcaaaaatagaagtggaggaagtaaaagcccaatcagttataatacatttttttcttgttttagtttctgttgttcacccagcaaagcaaagtcgtgctaaatcctaa

SEQ ID NO: 16386 - DNA, 1229 bp, Glycine max
  Peptide Sequence Number=SeqID_133164
atggcagaagttgaagacatagacaaccctcatcacgaccaccatcattacctttcttcttctacaacacaacctccaatgatcaatttcccgcgagatctgttaagaaccttcgtgggagtgaacaataataacaataacaacagtcagcaccacaatttgcctatgccagtggtgaagttagaggatgagaaagaagagctggaactaagtctcggcctttcgatgaatggtagatttggggtggaccctacagcgaagaagataaagagaacaacctcgataccggagtttgtgcgcgacgaggagatgggatatgctgctgcgatggggtgcacggggtctctggtgaggacgtgttcgcttccgacggagacggaggaggagtggcggaagaggaaggagttgcagacgctgcggcgggtggaggcacggaggaagcgctccgagaagcagaggaacatgaaagccttgagagaacaacaacagaggtccgaagggagcaatccggtggagcaaggtgcaggggggtacggtgaggttgcaccacccttggcgaggaccgtgtcgttgaccgcacgtgtttgtggactcggcttgaatggggacagtgaaaaggagaagaaggagaagagaagtggaatagcgttgccacctccctcgccttcacagggttccattggttcttccggaatttcagaagctgagtctcaacagggtcaagcattgttttcttacaaggatattctgtggactcaattacattgtttcacttatcttgattcatcacttctagcaactgaggttatggatggttgctcaagaacaacacctatggatgttagaagccctactagtgctaacttgttgccagacagcgaactgaaatcaccagcaggtgttgctgagaacaacacaggcaagaatgctgctgctgctgctgcagtaacaatgagaagtcaatctaacaaatattcaccaccacaaagcagaaccaaagacattgtgaggaacttgttggaagacatgccctgtgtctccaccaaaggagatggccctaatgggaaaagaatagaaggctttctttaccggtatgggaaaggtgaggaagtgaggatagtatgcgtttgccatggcagtttcctcaccccttccgagtttgttaagcacgccggtggcggtgacgtggcaaatccattgaagcatattgttgttagtccaagcttttt

SEQ ID NO: 16387 - DNA, 390 bp, Glycine max
  Peptide Sequence Number=SeqID_133165
atggtcaatggaatggaatgcagcatgattttccagccagatctttgttcattatttaagacagttagtttactttctcaggcttcgcctgttccgattggggggcgtcaagctgtagttgagataaagagaaccactacccgggttggcagtggcattaacagtactggaagacctaggatcccacctggtaggggtgggttacgaaatgactctttcaggggtcgtgggaattatggtggtggtcggggatacggtcgaaatgattatgtaagccgtggcgagttttctggtagaggtcatggtcatggtcatggagaaggttatcaccaagggagagggagaggtggccggtcaagtggacaaaaacaaaatgctgtttccaactga

SEQ ID NO: 16388 - DNA, 885 bp, Glycine max
  Peptide Sequence Number=SeqID_133166
atggctctgcaaacagctactcctccaactactcccagtgcccaagttgttggtaatgcatttgttgagcagtattaccatattcttcaccattcgccggatttggtctatcggttttaccaggactctagtgtgataagccgtcctgattccagtggtgtgatgacatcagttacgaccatgaaaggcattaatgagaagattctatcactaaatttcaaggaatttaaagcagagataaagactgcagatgctcaaaaatcatacaaggaaggagtgactgttctggtgactggatgcttgactggcaaggataacttaagaagaaaatttgcgcagtcattctttcttgctccacaagacaatggctattttgttctgaatgatgtttttaggtatgtagaagaccatgaaccatcagaactgcctccagttactggagatggtgatgcagctgctgttacagtaacaccagaaccaggcaagattataattcaaaaaatttgtatcttctctttcaaaatttattcaggagttggattcatgctgttctccttctttacagaacccagtcattttgctgattcttctgcaccagaccccacaaattctcatgtgaacaaaggtcaaactgttgctgagaatgcttatgagccatctaatcaccatgagagacagatacctgttgagaatgtcgacaatgtagaaccacattttcagtcaaatggtaatgatgattctcaggccacagaattggcttcttcagctcaagagaagaagtcttatgcatctattgtgaaagtccaaaaagagggttcagttgcaactaaagtctatgtgcctactaatacactaaagtcagggcctaacaaaactgagaacaag

SEQ ID NO: 16389 - DNA, 774 bp, Glycine max
  Peptide Sequence Number=SeqID_133167
atggcttcaaataatggccgtaaagcaagtgagatctttcaaggtcaacttctcttatacagacacatgtatgctcatgtagattctatgtttcttaaatgtatcgttgagcttggaataccaaacataatccacaaccatggtcaacccattactcttccaaaattggtgtcaattctacaagttccaccaaataaagttagtggcttgcagagtctcatgcgttatctagcacacaatggattctttgagatagtcacaatccatgacaacttggaagaaaaggaagcatatgctctcactgctgcatcagagcttcttgtcaaaggcagtgacctttgtttagcaccaatagttgagtgttttcttgacccaactttttcaagttcatggcatcaaatgaagaagtggatttgtgaggatgatctcacactctttggtatctcattagggtcacacttgtgggactttctcaataaaagccctacacataacaaatcattcaatgaggcaatggctagtgattctcagatgatgaacttggcgttgagagattgcaattgggtctttgaaggactggagaccattgtggatgttggtggtggaactggaatcacagccaagattatctgtgaggcatttcctaagttgaaatgcatagtgttggaacgtccacatgttgtagatcagaacttgtcaggatgcaacaatttgaaatatgtagttggggacatgtttaaatctattcccaaggctgatgcagttctacttaag

SEQ ID NO: 16390 - DNA, 372 bp, Glycine max
  Peptide Sequence Number=SeqID_133168
atgaatgatgatggcaaaatagtactcgtgtctgatgaagatggacaaaagcgagcacaggagccagtcaataaagagaagaggaagcttacattaagaagcattccgttctcattaacatgcatacttcacaagaattacatcttggcagatcctactgcagaagaagaatccattatggaaacccatgtgacagtagttttggatacatctggtcaactaatatctctttacaagcctggtgggccggttcttgcctacacttctgctatccagggtcagaggtattataagacattcggggtcctgagaccttcatatgccccaactgatattcaaagcgggaccacattaaggcctgcttctgtctag

SEQ ID NO: 16391 - DNA, 1065 bp, Glycine max
  Peptide Sequence Number=SeqID_133169
atggcttcttcaatcaatggccgtaatgcaagtgagatctttcaaggtcaaactctcttgtacaaacacttgtttgcccatgtagattctaagtgtctcaaatgcattgttgagcttggaataccagacataatccacaaccatggccaacccattactcttcctgagttggcgtcaattctacaaattccaccagctaaagttagtcaagtgcaaagtctcatgcgctacctggcacacaatggattctttgaaagagtaacaatccatgaaaaagaagcatatgctctcactgctgcttcagagctactagtcaaaagcagtgagcttagtttagctccaatggttgagtatattcttgacacaactatttcaggttcatttcatcagttgaagaagtgggttcatgaggaagatctcacactatttgagatttccttaggatcacatttgtgggactttcttaatagaaaccctgcatataacaagtcattcaatgaggcaatggctagtgattctcagatgttgaacttggcgttgagagattgcaagttggtgtttgagggactggaatccattgtggatgttggtggtggaactggagccactgccaagattatctgtgaagcatttcctgacttgaaatgcattgtgtttgaccgtccgcaggttgtggagaacttgtcaggaagcaacaatttgacatatgttggaggggacatgttcaaatctattcccaaggcctgtgcagttctatttaagatgattttacataattggagtgacgaagattgcaggaagatattagaaaattgtaaagaagctatttcgagtaaaagcaaaacaggaaaagtaattgtcatagatgttgtgataaacgaaaagaaagatgagcatgaaattacaagactaaagcttcttatggatctaaacatggcatgtcttcttaatggaaaggaaagaagagaagaagattggaagaaactcttcgtggaagcagggttccaaagctacaaaatatctcctttgacaggatatttgtctcttattgagatctatccttag

SEQ ID NO: 16392 - DNA, 586 bp, Glycine max
  Peptide Sequence Number=SeqID_133170
atgggattaccaaatgtttctgaggacttgtcatcagaggtggaggttgatgcctttaaacgcatttttccacttcgatattttgagcgtcatcttgctgaatctatacgggctgatggtagaccacttggaaaagctagagaaacaagtatttttcttggtgctgttgcgttcgcaaatgggtctgctctagtgaagattggatcaactactatgttgactgctattaaaatggaaattatgactccgtccttggagtcaccagatgagggctgtctagattggcttttgcttgttgggccacttatgtctattgatttccacatgcctccaatttgttctccaatcgttaggcctggcagaccagctgaagcatcaccgatggtgtcaaagcagttgtctaacaccatttcaaggcatgttttaatctttgctgtcactctttccagaatgactgatttgaaagaattgtccttggtcagtggaaaagctgcatggatggcttacctggatatctattgtttggatgctgatggtgctctttttgatgctgcgttactttctgccattgctgccttatctcatt

SEQ ID NO: 16393 - DNA, 198 bp, Glycine max
  Peptide Sequence Number=SeqID_133171
atggtgcttatgtgcactgacagaggtaacacaagcaaagagcgagtggcatgggtgcgacatagagtcactgcagaagtagaagacgaagggtttgtgaggctcgacaatgcagatgcaaccgcaccaaacaatggtgacagtagagtcactgaagaagtagaagaaagagttttcgagagcgcgaaggagaaatga

SEQ ID NO: 16394 - DNA, 241 bp, Glycine max
  Peptide Sequence Number=SeqID_133172
gaataatcaacatgaaaatacagaaaaaggtacgctttattgcattactttccctaattttttaaatagtgatcaaagggttcccacagaccctaagagaataaaggtcattcctgaatggcctactccaccaagtgtcgagggaaggagcccagagtatgaagaacctcgggatttgaggtcaaatcctttccaaggtggaggggatgatgcaatcctacaccccaagggtattggatag

SEQ ID NO: 16395 - DNA, 321 bp, Glycine max
  Peptide Sequence Number=SeqID_133173
atgcctcttctttccctcattttcgttttctctcttctcctctccaaaaccctttctttttcccgaaacccacaaaacctgtctcagaaaaacgatgatcttggactcattcaccgttggatcgtcgtgaaatttgagtaccacgtttggaatccaattctgagaattctcaccgttgggaattgtaaaaccatggagaaaaaggaatcgcatgaagatagtacaagtggaggcttcaatcccttctccgtctctctgacgtttgggaactctatcagagcagtcggaggaaaaactggaggaatcccaggaaaccgctag

SEQ ID NO: 16396 - DNA, 243 bp, Glycine max
  Peptide Sequence Number=SeqID_133174
atgacaggtggtatactcttgcaaaacactttgaagggccctcagtttcgcccacaatcacaacccttgcattttgcggtgggaggaggccctcctgctatggctaaaaagggaaagttggatcatatagaggaaaggctcaaggacgttgcaggaggcgaagattatgcctttgctaacctagaagagttgttcctagtacccgaacgtggtcattcccaagttcaaggtgccggactttga

SEQ ID NO: 16397 - DNA, 156 bp, Glycine max
  Peptide Sequence Number=SeqID_133175
atggtgagcaaagtttggagctttaatggaggcttcaatggagaggaagaagaagagaaaagcaacgtgggatccctcgcgtttctctgcacccatcggggcccgttttcgaaagtaggcaatatgtatatccaaatgctcagaatcaaaccctga

SEQ ID NO: 16398 - DNA, 375 bp, Glycine max
  Peptide Sequence Number=SeqID_133176
atggtgaatgacattttcacaccatctaggtacaaagaaatcatcatggtgcagcccaaaccaagtgctggcctaaaggggaaacctcaccaacatgctctcactttcatgccttcttgcattcaaaaatcaaaggcttgggtccctaggcctaagtcatgttttggcatttaccctaacttccgcaagctgtccccacatccaaaaagtggcaatcatacatgcacaaaccccatctataagcaacattcacagacttatgcgcaaacaccattgaggcatttcaccgagcacttggtgggcgcacttttgggtacaaacagcaaggggataggggcaatgtggcttgccccatcatttcagaacacaacctag

SEQ ID NO: 16399 - DNA, 948 bp, Glycine max
  Peptide Sequence Number=SeqID_133177
atggaggtacttatggcagaacgggccaatctagtctttcacaataaagtgataggtggaactgccattaaacgacttattagcagattaatagatcactttggaatggcatatacatcacatatcctggatcaagtaaagactctgggattccgtcaagctacggatacatccatttcattaggaattgatgaccttttaacaataccttctaaaggatggctagtccaagatgctgaacaacaaagttttattttggatcagacatcatcattatgggaatctagaggaaatgcgtctcaagtacaccaattagtgggtatgagaggattaatgtcggatccacaaggacaaatgattgatttacctattcaaagcaatttgcgcgaagggctttctttaacagaatatataatttcttgctacggagctcgtaaaggggttgtagatactgctgtacgaacatcagatgctggatatcttacacgcagacttgttgaagtggttcaacacattgttgtacgtcgaacggattgtggtaccattcaaggaatttcggtgaatacccagaatggaatgatgccggaaagaatatggatacaaacattaattggtcgtgtattagcagacgatatatacagaggttcacgatgcattgccgttagaaatcaagatattggaattggacttatcaatcgatttaaaacccttcaaacccaaccaatatctatccgaactccctttacctgtaggaatacatcttggatctgtcgattgtgttatggccaaagtcctactcatggtcacttggtggaattaggagaagctgtaggtattattgcgggccaatccattggagaaccgggcactcaactaacattaagaacttttcatactggcggagtcttcactggaggtactgcagaacaggtgcgtgggatcctctag

SEQ ID NO: 16400 - DNA, 378 bp, Glycine max
  Peptide Sequence Number=SeqID_133178
atgtcaatccttaccctcggaagcaaaaaagggggaaggaaattcccagtcaaagagtgggagaaagcgaaaagaaaaggaaagaaattcccagtcaaagagtgggagaaagcgaaaagaaaagaaagaaaattccccgtcaaagagtgggtgaaagcgaaaagaaaagaaagaaaattcccaaccaaagaatgggagaaagtaaaaaaggaaggaaagaaattcccagtcaaagagtgggagaaagcgaaaagaaaagaaagaaaattccccgtcaaagagtgggtgaaagcgaaaagaaaagaaagaaaattcccaaccaaagaatgggagaaagtaaaaaaggaaggaaagaaagttcctgatcaaagaaactag

SEQ ID NO: 16401 - DNA, 312 bp, Glycine max
  Peptide Sequence Number=SeqID_133179
atggcttgcacccacattccggtccttcaaaattgccccatgtgtggcatctcttgtcaatgtcaggatttacacgcgattctcctcaaatttcagccagcccgcatcaatttgaccttgcaccttacgcttcagagccctacaatgctcaatggaacgccccggggcatctccgtgacaagcacacgttgcgtttcgagtcgtattctcggagaaatggaggttgatgaaccttggctagggttatggctaccattgaattatcaagtagatatgggagcaagtcagcataggacactggaattggggtga

SEQ ID NO: 16402 - DNA, 573 bp, Glycine max
  Peptide Sequence Number=SeqID_133180
atgttgctgcgcggggtgtatgctgacctcccgcgagcacccgcctcgtggttggttgaaatctgggttcatggccgacttcgccgtgataaaatggtggatgagccacgctcgagaccaatcacgtgcgagccggtcagttctggacccatcgacgaccctttgcgtgcacgcacgctcccaacgagacctcagcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggtagatga

SEQ ID NO: 16403 - DNA, 504 bp, Glycine max
  Peptide Sequence Number=SeqID_133181
atggtggatgagccacgctcgagaccaatcacgtgcgagccggtcagttctggacccatcgacgaccctttgcgtgcacgcacgctcccaacgagacctcaggtcaggcggggctacccgctgagtttaagcatatcaataagcgcaggatatgttcatggtgggcttttcccggttcgctcgccgttactaagggaatcctgcgtggctcatccaccattttatcacggcgaagtcggccatgaacccagatttcaaccaaccacgaggcgggtgctcgcgggaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccgcgggacaccgtctccgggcccccgggagtcgcacttaa

SEQ ID NO: 16404 - DNA, 453 bp, Glycine max
  Peptide Sequence Number=SeqID_133182
tgcgtcacagatgatgcataccaagagacgtccccatgtgcttcctggtggctgacgtcgaaagcgcatatcaagggaatcacaggagcaccgtacagggcacgttgtgatgctttgaccgtcacagatggtcagctgagatggggtcctatggtggtcacagctcgaccggagagggtgctacgacagtttggttacattcagagcatccctccgtcgcatgttagtgctcgattgtcacatgatgatatggatgacaggtggatgcatttcgcggaccacgtactagctgtgggtgagctttgtctagtgcctgggcaggtatctgcggattacatgaagtggttttttcggatatctcacccattcatgataccgacccaggcaggtgaccagcctagagatgcacctgccgcagaccctaaggagtacatgcagctgcccagcccccag

SEQ ID NO: 16405 - DNA, 377 bp, Glycine max
  Peptide Sequence Number=SeqID_133183
atggctccgaagaaactctccacgaagaggtctagaagagacgccgcagcggaagggtccaatgccacccccgagtttgatagtcatcgtttccagagcgctgagcaccagcagcgcttcgaggccatcaaaggatggtcattccacagagagaggcatgtccaactcagggaggatgagtatacggactttcaggaggagatagctcacagatgttggacgtcgctggtgactcccatggctaagtttgaccctgagacagtcctagagttctatgctaatacttggcccacagaggagggagtgcgagacatgcattcatgggtgaggggtcagtcgattccctttgatgcagatgccctcagccagttcctggg

SEQ ID NO: 16406 - DNA, 246 bp, Glycine max
  Peptide Sequence Number=SeqID_133184
atgacgaggagaatgggctttgccgagaagactagtcagagatggcagagatgcaacagaagagatgatctgaaaaaaataaacccagatggaaggttgtcagagagtggtggtaactttcctccctcgccgaaaaattgtgatgatgttttatgtggcgaatgtgcccatgaaatcatggatgctagtgctgggaaaaatacaaatggaagccataaagtattcggggaacagagagattgttag

SEQ ID NO: 16407 - DNA, 255 bp, Glycine max
  Peptide Sequence Number=SeqID_133185
atgatttatgactgtcgcaacctgcccttcggcggaagggtgacgcgagggctcacgggtgtgtcttccaagataagaaaatgcgcggagtcaccaccaacatttattcaaggaaaacatcagaaaaaccggaaaaggcatggtctacaaaatttaagtgtgaaaggttcgggagttgtatttacgcacggggaagggtgtttcccttgctcctacatattcctcaattgtgataaggaaatcagatctacgtag

SEQ ID NO: 16408 - DNA, 410 bp, Glycine max
  Peptide Sequence Number=SeqID_133186
atgggtacgcacggtgctcagcgtaaaacgctggcgctcgcagtcgcgggcgcgctgttgggaacagggtttgccatggcgcctgaggcgaaagccgcagggtttatcgatgattccacgctgaccggcggcatctattactggcaacgtgagcgcgaccgtaaagatctcaatccggacagcaaggattacaaccaatacaccaccaacctgtcgcactccaccgccaacctgagcctggatttcgcttcgggctacgcctgggatatgttcggtctggacgtcggtgccttcaccgccatcgagctggcggaatccagcgccagcggccacccgaacgagatcgcgttttcctcgaaaaaccggacctacgacgaagactattccggtgacaaaggcggcgtcagcct

SEQ ID NO: 16409 - DNA, 165 bp, Glycine max
  Peptide Sequence Number=SeqID_133187
atgacaagtaaacttcaaatgctcataacttttgctacggttatccgtttgaggcccactatatatcaaaacgctcagaattcagaggagaatcttgataagggggatttggctacgaaggtttggatgacgccacttccagtgaaggaagataagtcagggtag

SEQ ID NO: 16410 - DNA, 533 bp, Glycine max
  Peptide Sequence Number=SeqID_133188
atgggattaataatcccacaagattatgctgaagaagttgccaatccttcgatcgaaggcaagagagcacttcgactaacacccaagtccttaaatcaaagctcacaaaagctgttcctaaagtatatgaggatttttctgagctttgacaagtttcttccccaacatgctccattcattagtcgagaggttggcccagcctggttcactgactatttccctgctgtcgatccggacaatgaagaagaagtgaacgaaatatggtccttttacttgaatccacagatcctgtcttgtcgtacaggtgttcaatcgaactatttaggcctggttggataccagcctaatttggtttcaagacaatttggcctctcgcaaatccgccctaaaagcttgttcgaagatcctcgagacgtcataagaggggccaatctttcggaaaagactttcaagaagtttttgaagatttctcttaatgaaaactataacctgcatccttttgagttcaaccattcccacttctgcaccatggg

SEQ ID NO: 16411 - DNA, 981 bp, Glycine max
  Peptide Sequence Number=SeqID_133189
atgaaagcggtcggtcagctgaccggcggcctggcgcacgatttcaataatttgctggcggtgatcatcggcagcctggcgctgaccgtcgatcagctgccgcccggcacgctggccagccgcattgagcgcgcgcggctggccgccgatcgtgccgcacagctgacgcagcgtctgctggccttctcacgcaagcaggcgctttatccgcgtgccgttgcggtggtggagctggtggaaaatctgcagtcgctgctgcagcactccctgctgcccggccagcatctggtggtggatgcgcagcgccccggctggccggcgtggattgatgccggccagctggagaacgccctgatgaatctggtggtgaacgcgcgcgatgccatggagcgccagagcggcgagatccgcctgcgcatctggaatcagcggattcaggaggccgatggcaagcgcgaccgcgtcaccattgaagtgattgaccacggctgcggcatgtccgctgaggtgcgggaacaggtgtttgaacccttctttaccaccaaagccaccggcagcggcagcgggctggggctgtcgatggtgtacggatttgtgcgccagtccggcggacagatcgaactggagaccgcgccgggccagggcaccacggtgcggctgctgctgccgcgcgcgccggaagccgcgcagccgctggtgagcgcgccggtgctgacgccgcgtgccagccgcgatcgcctgatactggtgctggatgacgagccggcggtgcgccagacgctgtgtgaacatctgcatcagctgggttatctgacgctggagtgtgctgacggcgagagcgcgctgacgctgctgcgccagacgccggatatcgatctgctgatcactgacctgatgctgctgggcgccctgaacgctggccatcctgctgatcagctgtcaggatctgcgctagacgccggtgacgctaccgctgtgtga

SEQ ID NO: 16412 - DNA, 240 bp, Glycine max
  Peptide Sequence Number=SeqID_133190
atggcgttgatgatggagaagcagctgaggaagaagaagatgcagcagaggatacagaatcagatgatgatgattctgatgccaccccatgaccatcagacctttatttttactcttactagctattggggcataattttgctgtcaccactacagatactgctgggcttgattactctgataatgaaagttgctgatcccacttgcatgactgctcgtacctgctcaggaagtctctaa

SEQ ID NO: 16413 - DNA, 306 bp, Glycine max
  Peptide Sequence Number=SeqID_133191
atggccaagtttgatccagacatagtcctcgaattttatcccaatgcttgtcctacagaggagggcgtgcgagatatgaggtcttgggtgaggggtcagtggatcccgtttgatgcagatgctatcggccagttcctgggataccctttagtgctggaagagggccaggagtgcgagtatggccagaggaggaaccggtccgatgggttcgatgaggagccatcgcccagttgctatgtataccgtggcaggattttgcccggactgctaccgggagacgggtgcggatcatgcgcaccaacatga

SEQ ID NO: 16414 - DNA, 141 bp, Glycine max
  Peptide Sequence Number=SeqID_133192
atggaggacacctgcgcggcggtcgccgctgacattcaaggggatcccccaaaaggggagaattgggggatgcccttgagggcaatcatgaagcataggtccaaactcgaaggtggaggacacatgaacagcgctaggtaa

SEQ ID NO: 16415 - DNA, 655 bp, Glycine max
  Peptide Sequence Number=SeqID_133193
gtttgcactcctgaggcctgatcctcaggagttggctgctaagctctatatcttagggaggggattcgagctaaatgctgatgggcagccattgaagatattgaggaagaacatgaccactctagctcagacatggaacgttctttacttttttaacctgattcctacctcccacacatctgatgtcaccttggacagagccaagttgatttatggtatcattatgaagatggatatgaatttggggtacctcatctcccaccagatctctctgactgcacaacatgatacatccagacttggattccctgccttgatcacaactatatgcaaggccagaggagtccaatcagattctagatccctggagaacttgagccttgctattaacttggcatatattaagaagaactgttggaatcttgatggtccaatagtgacatttagagggccaaggaaggccaggggtgtatacatggctcaagaggaggagacttccacagaccagatcccaaagccatccccagcacccatacctaatgatgccataccatctgcactagcatctgagttagagcagcctatctctcacgattcactagctgctcaggtgttggatcttaatgagcatgcacaggagcaaccacaggagtag

SEQ ID NO: 16416 - DNA, 246 bp, Glycine max
  Peptide Sequence Number=SeqID_133194
atgttgcctgatgcggagacatgttcaaagattaaagttacaacaccgtttgattccaatgatcctatccacgatgaatctcaatccatttctataatagcaaaccatgatccacttattgggcttcccttgacaccaacaaaacgacagtcatttcatgaatgtgaagatgaagcaagaagctccctgatttcaccagctcaactatcgtccaacaaattagcaaaacatgaccagattgaatag

SEQ ID NO: 16417 - DNA, 234 bp, Glycine max
  Peptide Sequence Number=SeqID_133195
atgagggcagagatcaacaaggatccaacactggtgagcaaaatgacaaagtatacaaagacgggcttacgcgatagccgtcgtagtcttatttatgttaattacaacattgccactaggttacattctaagacggttctttgtaaccaccttagaatgtgcgacgtaaaaatcaatatttctcccctgaattacaaaattgccaccgcctcctattctaatacggtcctttag

SEQ ID NO: 16418 - DNA, 737 bp, Glycine max
  Peptide Sequence Number=SeqID_133196
aggactacatgtcctcgccttcataggacaacaagtcctcgccttcagaaagctacacgcccccggcttcagaggactacacgtcctcgccttcagagcactacacgtcctcgccatcagagggctgcacgccctcaccttcagaggactacacgtcctcgccatcagaggactacaagtcctcgtcttcagagggctacacgccctcgcctttagaggtctacacgtcctcaccttcagaggactacacgtcctccccatcagaggactacaagtcctcgccttcagagggctacacgccctcgcctttagaggtctacatgtcctcgccttaagaggactacacgtcttcgccatcaaagggctgcatgcccacaccttcaaaggactacacgtcctcgccatcagagggctacccgtcctcgccttcagaagggctactacacgccctcaccttcagaggaccacacgactacacgtcctcgccttcagagggctgaacgccctcaccttcagagggctacatgccctcaccttcaaagggctacatgcccttaccatcagagtactacacgttgtcgccatcataagactacacgtcctcgccttcagaggactacacgtcctcgccatcagaggaggactacacgccctcacctttagagggctacatgccctcaccttcgaagggctacatgcccttaccattagaggactacacgtcctcacctcagagg

SEQ ID NO: 16419 - DNA, 345 bp, Glycine max
  Peptide Sequence Number=SeqID_133197
tggggccgaaacaagttccgaggggcattgtgggacagcaacagcaagctcaagcttcgaagggctgagacagaccagtcgagagtagaaggtatgatattagaggacaagttgaaggcttgtcaaaggtcaaagaggagtttgtccgaacaattaagtaggacggaagaaaacatgtgggccatcattgaccaatacaaagagaagctaagtctagctgcaacccatgaacaaaggctagaggacgagtatgcaaagcttcccagtctgctagccaaagccaagacaatggcggacatgtacttggctcccgaggaagttcatgggctcctcaattattgttag

SEQ ID NO: 16420 - DNA, 173 bp, Glycine max
  Peptide Sequence Number=SeqID_133198
atgactggagaaacaaaggtcgtaggcaacgctccagcttttgtggatgagctgaggggctttggaggtggcggcggcggcgcgtctgttgcctacagccggccatccgcaggctgctgtggtgtctcgccctgcgcctgcctgggggcgcagtacttcttgatgaacgctcg

SEQ ID NO: 16421 - DNA, 420 bp, Glycine max
  Peptide Sequence Number=SeqID_133199
gatattactgttgtgcctaaccttgtgccaagtcagaatgcttcaccagccatggtggaaactaaaatattagtggggaaagacacatctagtggagagcttcccgagagtactacacataaggaagtgcagaaagagtggacatgcgctttatgtcatgtaacgacatctagcgagaaaaccttgattgaccaccttcatgggaggaaacacaaggcaacttgtgaatctctgaaagcacaaaatcaacctgtgccacataaggtgaaaagtgatcagtccaaagatgatttgaatcaaaagaacgttatctatcagataaattccaagaccaagagtggagagaaggtaggaaaagaagccatggaccataagggggagatagtagaggcacacgcgactcgagaggttgaggatgag

SEQ ID NO: 16422 - DNA, 348 bp, Glycine max
  Peptide Sequence Number=SeqID_133200
atgcaggaaacaccagcagtcatggtgcagaagaaaggagagaccaagaggagggttgctgccctcgaagtcagcatcttattcttttcctctaacaaactggtgctttcattgatgtcggacccctcccacacccccgataaacttgaggatgctctcctccgccttacacagcaacagtcctccatgaccgccaaaattgatgaactcctcatgcgtttgccacccctccttcaccataacccatcccctacttcatcgtccccaccttcaccgtcccctgcatcagttcataaaatgaagttagacgttccccggtttgtatttcacagttttgtattattttaa

SEQ ID NO: 16423 - DNA, 2080 bp, Glycine max
  Peptide Sequence Number=SeqID_133201
ttctccagatatggcagcatctccatactgtaagaacagttatgtacatgcttttcttcatgcaacattaacactcttgcttcttgtaatgcctcttgcagctgcttcattagccttcaactatcagcaacttggtgacgcgggaaacgccaccctcagtatttctggagatgtctatcatgagcaagaagtcctccaactcaccaggtatgaaacatttagctatggtagagtcatatatcacaaacaattgcatctttgggacaagaactcaggaaaggttgcagacttcactacccatttctcttttaccataaacgcccgaaataacaccaattatgctgatggcatgaccttctttctggcacacccaagctttccagaactagatccaagagatggagttggtattggtcttttgagccgcactcaactgctgaatccaaatttcacaaaggaatatccatttgtagcagtggaatttgatacctatgttaatcccgagtgggatcctaaatatcaccatgtcggtatccaagttaattcttttgtcacttctgtctctgacactacacaatggttcactagcatggatcagagaggatatgatgctgatattagttacgattctgcttcaaacagattaagtgtcagcttcactgggtataaggataacgtcaaaattaagcaaaacttatcctctgtggtcaatctgaaagataaattacctgattgggttgaatttggcgtctctgcagctactggaatgtattatgaggaacatactcttagctcatggtccttcaactctagttttgtcttcgacaaacataagggtgggagcaaaaaaggcttggcagtggggatgggaatcggtggatttgttttgattggtgggacgggtttgatttcacttggcttgtggaagaagtggaagaaagtagatgaagaggaaaatcatattgttgaagagtatatgggtgaggattttgaaaggggggcaggacccagaaagtattcatatgctgaattagcacatgcagctaatggtttcaaagatgagcacaagctaggacagggtggatttggaggtgtttataagggttatcttaaagacataaagtctcatgtggctattaagaaggtatcagaaggctctgatcaagggataaaggagtttgcatcagaagtgataattattagccggttaaggcatcgaaatcttgtgaacttgattggttggtgtcacgaaaggaaaaagctcttgcttgtgtatgagtacatgtcaaatggaagcttggatattcatcttttcaagaagcaaagcattttgcaatgggcggtgaggtataacatagctcgaggattggcctcagcattgctatatttgcacgaagaatgggaacaatgtgtagtgcatagagacataaagcccagcaacattatgctggattcagagtttaacgccaaacttggggattttggtttagcaaggtttgtggaccatgcaaaaagtgcacaaactacagctttagctgggactatgggctacatggctcctgaatgtactttgggctacaggccggctagtaaggaatcagatgtctacagttttggagttgttgctttagagatagcttgtggaagaatacccataaaccatagggctcaagaaaatgaaataagtattgtgcagtgggtgtggggactctatggagaagggagaattcttgaagcagcagatcaaagactagaagggaaatttgaggaggagcaaataaaatgcttgatgattgttggtctttggtgtgctcaccctgaccataacaataggccttcaatgaggcaagcgattcaagtgcttaactttgaagctcccttgcctaatcttccatcaagtttgcctgttcctacatatcttgaaggccccttgcactcatacatagcaccattcagcataactgcttcagaggaaggtcaaagccagatcataagcttcagttccaacacaaactccattgggttcaccacaaaatctgatgatgcttctccctctgtgtcgcttctgtactcacggtga

SEQ ID NO: 16424 - DNA, 1140 bp, Glycine max
  Peptide Sequence Number=SeqID_133202
atggctctgaaggcaaagaacaagaaaaagcagcaaccttcaggcaacaaagaagttcagaaatccaaatcgtggctcgaccttccaaaccaactcatcaacacaatacaagtgcaccaaaatctcgataaagacatcacttctggtggcataatcaaatcatggagaacatcaccaaagcactgcaactcagattccaagcttccctggcttcaactcacaaaccctgatggctcaaacactgaaaaataccgcactcacattacacggcgacgtggttcactcctaacttcatatgcatacattccctcggggttttggtgcagacacttcttcagaaaactacccaggtacccttgggagaattatgtggggtgttccaatggaattctcatagctgaggctgaaccactttacatgtaccatttgtggaatccaacacaaggggtaatgtttcggcttcctttgtgggatcctaaggtaccaattaaactcgctgtgctttcttcaccaacagaggatccaaattgcactgttatggtgctaactggaattgctcaacctgcttttacattttacaaactgagaagagggtctaattatagttcgtggataacacaagagcctcaatggaccatgcaagattgcacccttacggagtcattagggaggcgacaaaaacatgttatgcaaatgcaattcactaatgccattggatttaaaggcaagttttacgttctaagtgttcagggtagtcttgtggttatagaaaacattgattctgttcctaaagtcatggatataagtggcacaaggatatttccttcggtttcttcaaatcacttcagggaatatctgcttgaatctgatggagaagtgttgctggtttttcttatatcgagaaaatcatcggtgcatagtgtggatgatgttgaggtttatcaactgaatatgggaagactctcttgggttaagttggagagtgttggggaaagagcagtgttggtggggagtaattgtagcatgtccgtgttggcaagtgaagttggatgtagaaagaactgtatctattttaagcaccctgtagttgatgaatggtgcgtacatgacatggaattaggcaacataaggttggagtga

SEQ ID NO: 16425 - DNA, 1220 bp, Glycine max
  Peptide Sequence Number=SeqID_133203
gaagccgccgtcctctccttctcgaggtctgcgcacgccgcattggccttctgccgctccatcctcacgattcttctcagcgtcattacgtcgaacacctcgtcctcattgcaaccctctctctcgttctctacctttccctccgacccatcatccgaaaccgcgttgcctctctccccggactcattgggccgcctccggaaggaagagctcgaagttgggtggcgcggttttttcaaaggtttggtctttgctttggagactttttcccgagcgacgttatcgaggcagaagcggagtttggggatgccgccggagtcgcagaggaagcgaatggagcccttggtgttccagccgaagcgcagaagcttgaagcagaagcctctgatgcaagagaagggagggagtggtctgcatctgaggcgggaggaggaggcgaaaggagggaaggaacaccgatcagagttggcgcgaaagggagcgaagaaaagagaagaatgaagaaagagagtgttgggagcgcagagaggaggaagagtggcactggtgatggaggaagtggtggcggacaaatagaggagtgcagacgcactagagagttgataaaactgccaaggtacccttgtaaacactacgtggggtcttccaatggcatcctcatagctgagattgaacctcttcacatgtactatccgtgtaatccgacacacggagaagttcttcgtcttcttttctgggatcccaaggatcacaattgcacagttatgatactaacaggaattagtgatcccgcctttgcattatgtaaagtgaaagaaacttgttgggttacaaaatggaggtggtctaaggattgtgtaactgtagaacctcaaaatcaacgggccatgcaagattgtacccttactgagcaattagggaagcaacaagttatgcaattcactaatgccattggttttaaaggtaagttttatgttctaagtgttaagggtagtctagctgttatagaagaagttgattctgttcctaaagtcacgaatttaagtgacacaaggatagtgttccttctgtttcatcaaaaccactttagagaatatcttcttgagtctgatggagaagtgttgctggtttttctcataccgagaaaatcgtctatgcacattgtggataatgttgaggtttatcaactgaatacgggaagactctcttgggttaattaa

SEQ ID NO: 16426 - DNA, 2049 bp, Glycine max
  Peptide Sequence Number=SeqID_133204
atggcagcatctcgttactgtaagaaaacttatgtacgtgcttattttctgcatgtaacattaatattcttgctccttgtaattcctcgtgcagcagcttcattagccttcaactatcagcaacttggtgacacgggaaacgccctcaagacttcaggagatgtctatcctgaccaagatgtcctcctactcacccgttatgagccagatagttatggtagagttacatattacgaaaatttgcatctttgggacaagaactcaggaaaagtcacagacttcactacccatttctcctttaccatcaacacccccaataaaacccatcatggagatggcatcaccttctttcttgcacacccagactttccacaatcgggcatagatggaagcggtatcggtcttgcgagccgcgaacaacttaagaatctgaattacgcgaaggattatccgtttgtagcggtggaattcgatacctttgttaatgactgggatcctaaatatgaccatgtcggtatcgatgttaattctatcaacactactgacactacggaatggttcacaagcatggatgagagaggatatgatgctgatattagttacgattctgcttcaaacagattaagtgtcaccttaactggatataaggatagtgtcaaaattaaacagcacttattctctgtggtcaatctgagtgatgtcttacctgaatgggttgaaattggcttctcttcagcaacaggatttttttatgaggaacatactcttagctcatggtccttcaactctagtttagacaaggaacaacaaaagggtggaagcaaaattgggctggtgatagggctgagtgttggacttggtgcagggctgagtgttttaattgttatttggggggtaactttccttgtgagatggatgctgaagaatagaggtttggaggaagtctcactttttgatcatgctatggacaacgatttcgaaagaatgtctctacccaagaagttttcctatgaagaacttgccagagcaactaataactttgcaagagaaaacaaaattggagagggaggttttggagcagtctacaggggacttataagagagttgaacatccatgttgccattaagaaggtatctcgcagatctagtcaaggagtgaaggagtatgcatctgaagtaaagatcattagccaactgaggcataaaaatttggttcaactcttagggtggtgccatcagaacaatgacctgctgctggtttatgagttcatggaaaatggaagcttggattcttatctgtttaaaggaaaaggccttctggcatggaaagtgagatatgatattgctagaggcctggcctccgcattattatacctgcatgaagagtgggaagaatgtgtgcttcatagggacataaaatccagcaatgttatgttggattctaattttgatgcaaagcttggtgattttgggttagccagactaatggatcatgcaataggttcaaaaacaactgttttagcaggaacaattggatatttgcctcctgaagctgtcacaagaggcaaggctagtagggagtctgatgtattcagttttggagttgctgctttggagatagcctgtggtagaaaggcaattgaacctaatgtgaatgaagaacagctctatttggtggattgggtttgggaactccatggcatggttgatcttcttaaagcatctgatccaagcttatatggacactttgatgagaaggaaatggagaggttaatgatagttggcctgtggtgtacttacacagatttccatctgaggcctacaattaggcaagttgttcaggtgcttaattttgaagctccacttcccactctctcaccacaggttccatccttttcctataattcatctttcagctctatgccctctaggacttctgcttttgcaaataaccaatgtgtctcttcaacttcaagtagcttaggcactggatcctcacaatcgaacacaacttgtgaagtcatcatttctccagcagccgcacattga

SEQ ID NO: 16427 - DNA, 2034 bp, Glycine max
  Peptide Sequence Number=SeqID_133205
atgcgaaaggacaagaactatggacatcattggtgtgatcacaagacgacaaagcatcaagcattgggaaactgtgttgtacagggaaaaaactttggcactgtggaagacctagcaacaagatcagcaaacgctgtagcaccaaatatccaactcacaacaaaccaagctgacaagggcatgaatggaagcattggtagagccacttattaccaacctatgcacctgtgggacaaagccactggaactctcacagatttcagtaccaatttctcttttgtcataaactcacgaggtcaaagtgtatatggagatggaattgcattcttccttgcccctgctggttcaatggttcctaattccacattaggaggtactatgggtctgacacttgataaccaaatattgaactccacagacaatccatttgttgctgtggagtttgatatctttgggaatgactgggatccacccggtgaacatgttggaatcgacatcaactctttgagatctgttgctaatgccacatggttggctgatatcaagggagggaaagtcaaccaggctttgatcagttacaactccacttcattaaatttaagcgttgcgttcacaggttttaaaaatggtaccgctctgctacatcatctatctgtcatagttgatctgaaactttatttaccagaatttgttactgttggcttctcagctgccacgggaaatttaactgctatacatactctcaattcatgggattttaactcaacctccattatagctcccagtcagaagaaaaaggacaagaaagccttggcagtgggattgggagttggtggatttgttttgattgctgggttggggttgatttcaattcgcttgtggaagaaaacaagtgaagaggaggatcatgattttgaagagtatatagatgaggattttgaaaggggggcaggaccccagaagtattcatatgctgaattagcacaagcagctaacggtttcaaagatgagcacaagctaggacagggaggatttggaggtgtttataagggttaccttaaagacctaaagtctcatgtagccattaagaaggtatcagaaggctctgatcaagggataaaggagtttgcatcagaagtaagaattattagccggttaaggcatcgaaatcttgtgaacttgattggttggtgtcatgcagggaaaaagctcttgcttgtgtatgagtacatgtcaaatggaagcttggatattcatcttttcaagaagcaaagcattttgcaatgggcggtgaggtataacatagctcgaggattggcctcagcattgctatatttgcacgaagaatgggaacaatgtgtagtgcatagagacataaagccaagcaacattatgctggattcagagtttaacgccaaacttggggattttggtttagcaaggtttgtggaccatgcaaaaagtgcacaaactacagctttagctgggactatgggctacatggctcctgaatgtactttgggctacaggccggctagtaaggaatcagatgtctacagttttggagttgttgctttagagatagcttgtggaagaaaacccataaaccatagggctcaagaaaatgaaataagtattgtgcagtgggtgtggggactctatggagaagggagaattcttgaagcagcagatcaaagactagaagggaaatttgaggaggagcaaataaaatgcttgatgattgttggtctttggtgtgctcaccctgaccatagtaatagaccttcaataaggcaagcaattcaagtgcttaactttgaagctcccttgcctaatcttccatcaagtttgcctgttccaacatatcttgagcacccactgcactcatccatattaccattcagcataaatgcctcagaggaaggtcaaagccagatcacaggctgcagttcaaacacaaattcctccggattcaccacaacttctgatgatgcttctccctctgtgtcgcttatgtactcacggcgaaattga

SEQ ID NO: 16428 - DNA, 1332 bp, Glycine max
  Peptide Sequence Number=SeqID_133206
atggtctcggcagcaccaaatgcaatgtatgcccagttgtccaaccttagtttctcccatcacttcttagtgatgttgttatccattttcttcatcttcattatcccttgtgctttccctctatcctttaacatcactagtttcgatccaaatggcaagagcataatatatgagggatcagccaaccctgtaacaccagttatcgaactcacaggaaacgtacgggacagcacaggtagagccacatatttccaacctatgcacctgtgggacaaagccacagggaatctcacagatttcactacccatttctcctttgtcatagattcacggaaccgaagtggatatggagatgggatggcattcttccttgcccctgctggtttaaagtttccttatgtctccagaggaggtgctttgggtctgacacttgagaaccaacgattaaactccactgacccatttgttgctgtggagtttgatatctataagaatttctatgatccacccggtgaacatgttggaatcgacatcaactctttgagatctgttgccaatgtcacatggttggctgatatcaagcaagggaaactcaatgaggtttggatcagttacaattctagttcatttaatttaagtgttgtgttcacgggttttaacaatgacaccattctgcggcaacatctatctgccataattgatctgagacttcatttaccagaatttgttactgttggcttctcagctgccacgggaagttcaactgctatacatagtgtcaattcatgggattttagctcaactttggcagcacaagaaaacataacaaagggagcagacacagttgccaggtctccagcaacctccaatatagctcccagtcagaagaaaaagaataagaccggcttggcagtgggattgagtattggtggatttgttttgattggtgggttgggtttgatttctatatgcttgtggaagaagtggaagaaaggaagtgtagaggaagttcatgtttttgaagagtatatgggaaaagattttggaagggggggaggacccaggaagtattcatatgctgaattaacacaagcagctaatggtttcaaagatgagcacaagctaggacagggaggatttggaggtgtttataagggttatcttaaagacataaagtctcatgtagctattaagagggtgtcagaaagctctgatcaagggataaaggagtttgcttcagaagtaaacattattagccggttaaggcatcgaaatctagtgcacttgatcggttggtgtcatgcaggggaaaaagctcttacttgtgtatga

SEQ ID NO: 16429 - DNA, 171 bp, Glycine max
  Peptide Sequence Number=SeqID_133207
atgggcgaggatggtgtggtggtcgccccgagaacaacgatgggttcacggtggtgcgattatagcttgacgcggtggtcacagatgtgttcaaagatttggatctcacacggttcgatcttgtgcgacaacaatgagaatgagatcggagggttagcgaagggggcttga

SEQ ID NO: 16430 - DNA, 1086 bp, Glycine max
  Peptide Sequence Number=SeqID_133208
tctctatggagatggtttgccattcttcctagcaagcccaaatctgccaccgcagacgatgaaaagctaagaggaggagcccttagcataggccttgtggatggtgaccgaaatcttctcgagacacattatcaatttgtggtggtggatattgtatacaattctagaaacaatattttgaaagtttctttcactgagaacaaattaggtggtggagatgcaacacagattattcagcacctttcataccacgttaatatcacggatcaattatcaaagtcggttactgttggcatatcagctgcaacaggagaatacactgaggaacataccctgttttcatggtcatttagtacaagtacaagctcaccaacaccaagtaagggccattcaaagaaaggaagaatcaacactatattgttggagggaactggaattggtacaggttatttcaagggcttaaactcctatgctgctatgaagaggatatcagcaggttcagcgcaaagtttgaaggaatacgcagaggaagtaacgatcattagccaattgaggcacatgaatttggtgaaactcgctggttggtgccacaagaagaatgatctctttctgatatatgagtatatgccaaatggcagcttagattcttgtctttttggtggagaaaagttcttgccatggaaggtgaggtacaacgtagctctgggcctggcatcagcatggctttaccttcaggaagaatgtgaaaaatttgtgtttcatagggaaatcaagtcaagcaacataatggttgactccaatttcagtgctaagctaggggattttggcctggctaggcaagtggaccatgagaaagggtcacaaagttctgttggggtagcaacaggaagaaaagccattcaccacaaagacatggagggtggagtatcattagttgagtgggcgtgggagcaccatggattgagaaatctccttgcagcagcagatccaaacctatgtgcagaatttgatgtgcaacaaacggaatgcttattggttgttggtctttggtgtgcaaatccagattgtgcatccagacccctataa

SEQ ID NO: 16431 - DNA, 855 bp, Glycine max
  Peptide Sequence Number=SeqID_133209
atggtctcagcagcaccaaaagcaatggttgtcccgttatccaatcttaatttcccctatcatcacttcttagtgatgttgttatccattttcttcctcttgattatcccatatgcttccgctttgtcctttaacttcactagttttgatcctaatgacaagagcataatatatgaaggatcagcaaaccctgtagcaccaactatccaactcacaagaaaccaaatggacaaaaacatgattggaagcataggtagagccacatattgccaacctatgcacctgtgggacaaagccacagggaatctgacagatttcactatccatttctccttcgtcatagattcacgtaaccgaagtaaatatggagatgggatggcattcttccttgcccctgctggtttaaagattcctaatgccactaaaggaggttctttgggtctgacacttgataaccaacgattaaactccactgacaatccatttgttgctgtggagtttgatatctataagaatccctatgatccacccggtgaacatgttggaatcgacatcaactctttgagatctgttgctaatgtaacatggttggctgatatcaaggaagtaaaactcaacgaggcttggatcagttacaactctagttcgttaaatttgagtgttgtgctcaatgtttttaacaatgatactgatcataccattcagcagcaatatctatctgccaaagttgatcggagactttatttaccagaattggttacttttggcttctcagctgccacgggaaatgcaactgctatacatagtgtcaattcatggattttagctcagctttggcagcacaagaaaacataa

SEQ ID NO: 16432 - DNA, 456 bp, Glycine max
  Peptide Sequence Number=SeqID_133210
atgacctctcccagtcaacagcccctcgggaaaacgattctcatggccctcttagggttccctcctggagtccccccccttcctcacatctccaagatcaatgtggatgggagttttcttcctcttcagggggtgtcatcagagatagttctggacgatccttgccctcctcatcatcccaatgggggtcttcttcttagcctcttggagtttttccataggaattggaatgtgtccatccaatttattggtagagaagccaattcagtgatctacaatggaagagtcgtttgcgccgtcgaggaaagggagatcaatcacggtgctggcgtacccgtcggcgttgacctcattgcagcaccgtcgaccttacccaggactaaaaacatattctgcccttttattatctttgaactgaattgtgagaggggacagtacagttattccatcagatag

SEQ ID NO: 16433 - DNA, 2126 bp, Glycine max
  Peptide Sequence Number=SeqID_133211
atggtctcggcagcaccaaatgcaatgtattcccagttgtccaaccttagtttctcccatcacttcttagtgatgttgttatccattttcttcatcttcattatcccttgtgctttccctctatcctttaacatcactagtttcgatccaaatggcaagagcataatatatgagggatcagccaaccctgtaacaccagttatcgaactcacaggaaacgtacgggacatcacaggtagagccacatatttccaacctatgcacctgtgggacaaagccacagggaatctcacagatttcactacccatttctcctttgtcatagattcacggaaccaaagtgcatatgaagatgggatggcattcttccttgcccctgctggtttaaagtttccttatgtctccagaggaggtgctttgggtctgacacttgaggaccaacgattaaactccactgacccatttgttgctgtggagtttgatatctatgagaatcccgatgatccacccggtgaacatgttggaatcgacatcaactctttgagatctgttgctaatgtaacatggttggctgatatcaagcaagggaaactcaatgaggtttggatcagttacaattctagttcatttaatttaagtgttgtgttcacgggttttaacaatgacaccattctgcggcaacatctatctgctataactgatctgagacttcatttaccagaatttgttactgttggcttctcagctgccacgggaattgatactgctatacatagtgtcaattcatgggattttagttcaactttggcagcacaagaaaacataacaaagggagcagacacggttgccaggtatccagcaacctccaatatagctcccagtcagaagaaaaagaataagaccggcttggcagtgggattgagtattggtggatttgttttgattggtgggttgggtttgatttcaattggcttgtggaagaagtggaagaaaggaagtgtagaggaagatcttgtttttgaagagtatatgggagaagattttggaaggggggcaggacccaggaagtattcatatgctgaattaacagaggcagctaatggtttcaaagatgagcacaagctaggacagggaggatttggaggtgtttataagggttatcttaaagacataaagtctcatgtagctattaagagggtgtcagaaggctctgatcaagggataaaggagtttgcttcagaagtaaacattattagccggttaaggcatcgaaatctagtgcacttgatcggttggtgtcatgcagggaaaaagctcttacttgtgtatgagtacatgccaaatggaagcttagatattcatcttttcaagaagcaaagtttgttgaaatggacggtgagatataacatagctcgaggattggcctccgcattgctatacttgcacgaggaatgggaacaatgtgttgtgcacagagacataaagtcaagcaacattatgctggattcagagtttaatgccaaacttggggattttggcttagcaaggtttgtggaccatgcaaaaagtgcacaaactacagctttagctgggactatgggctacatggctcctgaatgtgctacctcgggcagggctagtaaggagtcagatgtctacagtttcggagttgttgctttagagatagcttgtggaagaaaacccataaaccatagggctcaagaaaatgaaataaatattgtggaatgggtgtggggactctatggagaagggagaattcttgaagcagcagatcaaagactagaaggggaatttgaggaggagcaaataaaatgcttgatgattgttggtctttggtgtgctcaccctgaccataacaataggccttcaatgaggcaagcgattcaagtgcttaactttgaagctcccttgcctaatcttccatcaagtttgcctgttcctacatatcttgaaggccccttgcactcattcatagcaccattcagcataacttcttcggaggaaggtcaaagccagatcacaggctccagttccaacacaaactccaccgggttcaccacaaaatctgatgatgcttctccttctgtgtcgcttctgtactcacg

SEQ ID NO: 16434 - DNA, 2001 bp, Glycine max
  Peptide Sequence Number=SeqID_133212
atggcttggtggcgcaatagtcttcaaaatccaactcttcttttctgttatgcaacaagaaccattttcatcctccaaataatccctcttgcaaactcactatcatttgattacccgaactttaagaatggtgatgtaaaatgggaaggtgatgcttctattctaaaaggagccatccaagtcacatccaacaccatggaccaaaataacaattacagtgttgggagagtcacaagttataagaaaatgctcctctgggatatgaacactggaaagcttgctgatttcactactaaattttcctttgttgttttttcagggaaaagttactatggagatggaatggcatttttccttgctgatcctaatctcccacttctgaagaatattagagaaggaggtggtcttggccttgtggatggcaaacaagtgctgaattcaactcaaccatttgtagcagtggagtttgacaccttccacaataaatgggaccctcaaggtggcactcatgtaggtctgaatttcaactctatgaggtctaacataactaagcaatggttgacagatattcaaatatggaatgtttataattgcagcattgagtacaactcaagcactcttaatttgagcgtttcgttcactacgtacaataatgttagtaaaccagttgaggaatacatatcttacaaggttgatttgagagattacttgccggggaaggttattcttggtttctcagccgcaactggaaaattgtatgaggtgcatacactgagatcatggtcatttaattcaagtctacagagtgatgagaacacaaatgagataaaaccagtagcagcaccaccaacttcaaatcctgattctgaaaatgaacacaagataggattgtgggtggggattggaattggtgtaggcttggttctgggtcttttagggctgatttgtgctttattgtggaaaaggagtagagagaaaaaaggagagttagtttttgatctcaatatggctgacgaattcccaaagggcactggacctaagagcttttgctataatgagctagtaagtgctacaaacaaatttgcagagaagctggggcaaggaggttttggtggtgtgtataaaggttacttgaaagacttaaagtcctatgttgctatcaagaggatatcaaaagagtctagacagggaatgaaggaatatgtgactgaagtgaaggtcataagccaattgagacatagaaatttagtacaactcattggttggtgtcataggaagaatgactttctcctcatatatgagttcatgccaaatggaagcttagattctcatctatacggtgtgaaaagcttcttaacatggacagtgaggtataacatagctttgggcttggcttcagcattgctttacctacaagaagagtgggagcagtgtgtgattcacagggatattaaatcaagcaacattatgttggattcatgtttcaatgctaaacttggtgattttggtttggctaggctggtggatcatgagaaagggtcgcaaaccacgcgtatagccgggacgaggggctatattgcgcctgaatatttcacttcaggaaaggctactaaggaatctgatatatacagctttggggttgtgttattggagatagccagtggaagaaaacctgttgaactagaagctgaggagggtcaaataactgtagttgagtgggtttggaagctctatggattgggaaggttccttgaagcagctgaccctaagttatgtggagaatttgatgaaaaccaaatggaacgtttagtgattgttggcctttggtgtgttcatccagattattcattcagaccatctataaggcaagtgattcaggtgcttaaatttgagtctgctttacctattctccctgaaatgatgcctgtgccaacctaccttcctccaacaataaaagcacttttttcttctgtttcatcttccttttggggtagaagttag

SEQ ID NO: 16435 - DNA, 447 bp, Glycine max
  Peptide Sequence Number=SeqID_133213
atggtggtagctacaaatggcttcccttcttccaatgccacaatccccccaacaaatatctctcctaatgccatcctacctcttgatcggggcgatccggtagtgttcgaagaatactggaaaaagatgtgtgagtcctgcaccgtagttatcaaagggtgggagctaatgagctatctgagtgacatgagcaacgtgtgctggtacatgttgccggagatgaaggaagccattaaaaggcttcatcacgtggtgggaaatgctgttactgaagacagatacattgtggtagggaatggagcaacgcaactattacagggagctgtttttgctctctctccttcggaggctaattctcaacccatcaacgttgttgctgctgttccatactattcggtgattatacccttttgccccttaccatattcttattatatcatgtcttaa

SEQ ID NO: 16436 - DNA, 341 bp, Glycine max
  Peptide Sequence Number=SeqID_133214
atggttgacttggaataccaagatgaggttgatattttgcgttcaggattgtatcaatgggctggtgatgctgcttcgtatgagaaaaatgaaccctacatagaggtggtaacctctccaaacaaccctgatgggactatgaggggtcctgtggtgaaatctgaagctgaagggaagctgattcatgatcttgcctattactggccacactacactcccattactcaccaagctgaccatgatatcatgatcttcacattctccaaatgcactggtcatgctggttcacgtttagggtgggccattgtgaaggacattgaggttgctaagaagatgacaag

SEQ ID NO: 16437 - DNA, 416 bp, Glycine max
  Peptide Sequence Number=SeqID_133215
atggagagaatgagaaaggataatgaggagaggttgagaagaatacacgggagtagtgaagctttaagtgtgaggattcaaaacataaagaaaggaggagaggataaatcatcaaattcttctcatggagaagatgaggcgtatgaagaggatgtgggaggaagcaggaatgagaggtatagggatagtagaaatcatagaagatatgaagttgagcaagtctttgcttgttacaactacaatgaagagaaaaagatgaaatttgcctcactagagtttgagggatattgtcgcaacctacccttcggcgagagggcgacgcgtgactcgtggctcatcttccaagaaaggaatacgcgcggagtcgccaccatcgtttatttgaggaaaacgtcggaaaaaccgggaaagacgtg

SEQ ID NO: 16438 - DNA, 678 bp, Glycine max
  Peptide Sequence Number=SeqID_133216
gttgtaccatctgtgggtccttataaccaacaaggacagtggagatcacaccctggcaatcaattcaacaaagaccaaggtggaccttctaacaggccaatcaaacaagggccaaatatctttcagaggactactaagctggaggacaccttgactcagtttatgcagatagctgacaagtcatccaatagttttgtggcgaatacagaaaagaatcccaaggaggaatgcaaagttatgatgacaaggagtaagaggtttatggaggaggaggatgaggacaatgttgtcatgcccaagaagaaagttgctgaaaagaaagatactgatgataagaaagaagatgtgagagagaggagtagaagtgaacaagctagagagaagaagaaagaaaaagttgtgaatgaaggtatggaagtaccatatcttgtggtaccttccaagaaggagaaggaccgtcatttggatattttaacaaggaaacacaagtatattcactgggaaaacattgtcgtggaaggaaattgtagtgctgtgattcaaaagatccttccacccaagcataaagaccctgggagtgtaaccattccttgttcaattggagaagtcactgtgggaaaggatcttattgacctgggagccagtattaacttaatgccactctccatgtgcagaaag

SEQ ID NO: 16439 - DNA, 323 bp, Glycine max
  misc_feature (254)..(254): n is a, c, g, or t
  Peptide Sequence Number=SeqID_133217
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctggggtttgttggtgatttggaaggggagggacgaatcanagcgacaagggctgaatctcagtggatcgtggcagcaaggccactctgccacttacaataccccgtcgc

SEQ ID NO: 16440 - DNA, 369 bp, Glycine max
  Peptide Sequence Number=SeqID_133218
atgggggcctgcatgcagagagattcgactgccaagtacatagttcagcagtacgtggcagcgacgggaggagtagctgcattgaattcactggaaagcatgtatgctatgggacaagtgagaatatgtggatcggaggtgcgtcgtcaaggtgatggatacgaagaaagcgttcaatcaagaggcaaaactgaagtgggaggctttgtattatggcagaagaaccctgatttatggtgtttggaattggtcgtttccggtttcaaggtcagtgctggcagtaatggtaagctagcttggaaccattcttcttctcaacctttccatgctaacaaaggtcctcccagacccctccgccgcttctttcag

SEQ ID NO: 16441 - DNA, 534 bp, Glycine max
  Peptide Sequence Number=SeqID_133219
atgccggacgtgatgctggtcagcacgctgctggcgcaatacccggaaatccagccgattctggatgccatggagcgtgaaacgcgtcagcgcaaagcgggctttgccggcattttgtcgcggctagccgatgtggtggcggcgcaaattgtgcggggctgggtggagaatggctgtggtcagggcagcgggctggtgcaggccctgcgcgatccgcgcctcagcctggcgatggcggccatgcaccgcgcgcccggcgaaaactggacggtggagcggctggcgcgcgaatccggcagctcacgctcggtgtttgccgcgcgctttcaaaacgccaccggcatgacgccgctgcgctacctcaccgaactgcgcatgcgtctggcagtggagcgcatagttaacgatggcgaagcggtggagagcgtggcgttccacctcggttacggttcactggccgccttcagtcgcgccttcaaacgcattgtcggcacaccgcccggcgcactgcgcgccggacgtgaagcgtcgtga

SEQ ID NO: 16442 - DNA, 1075 bp, Glycine max
  Peptide Sequence Number=SeqID_133220
ccggcgatatcggtaaaaggcgccgttgaggtcagggcccacagtggtcgtcgcccgtgccagcggacggccctgcgcggcaacgatgatcttcagcgagcgcagcaggcgtgccgcagcttcggcctgcggatgcccgtcgcgttgggcgcgcaacagcgcctgcacggcgggattgtcgaggttgaggtacagccgcgacggcgcacgcgcctcgatgcgcgcggtgaactgccgggccaggcgcagcgccgccatcgagacgcgcttgtcgttctcatcgtcttccaggcgctgcttcagttcggcctcgcgatcgggcaccaccaccaccggcaatgcctccggactgaagcgtgccggcagcagctgttcaccatcgcccagctgctcacgcagccatgccagctgcgcctcgtcgaggctgtcgtcagtgcggaacagcgcgcggttgccctgctctgtgccgagctcgaccaggcgcaggcccttggcctgggcccagcgccgcaggaatggcaccaccgcatagcgatggccgtgcgccaccggcacgcccatcgcacggaacagcatttcctcgaagccgccgccattgtcgaggatcacgtgcaccgcaccgcgtgccggcaacgcactggctggcaggtcgccctgcgaagtcggcacgcgcacgtgttccagcagcaggtcgaacaggcgctcatcgcacagcgacgcacccagcagggcctcgttgtggcgggtcagcacgcgccgccaggcttccggttgctgcttcgcaacgtcggccaggccgtcgatcagcgcctccagcagtgcatgctgcaccgcgcggtactggtcatcgcgctgcaggtcttcgcggctggcggtgggcgtcaaccgcgaggattcgatcaccccgccgatgaaaccggcccacggcggcagcaggtcgcgcgcgtcgtcatccagcagcatgccgcgcacgaacaccgacaggttgcggttgtcgctggtgccataggtggcgccgtcctggacccacaacaggccggtggcatcgctgttgccatcggcacgcaatggcacg

SEQ ID NO: 16443 - DNA, 381 bp, Glycine max
  Peptide Sequence Number=SeqID_133221
atgatgattggaaatttgatttctttgtgcatgatgcccaccgcgttggtttgcaccaaccaagcggatatgaccagaaggcttcttgccggctcattggcttttgaaaactgcatccttcattatctcattgtaaaaaagggtgctcaacccattgatgaagaaggaaacttaccagttagagaagattcctctcttcttcaaaaaatcttggataggttcgatggttttcaaacctttgttggtgaaaggtttgatgctttggagttacaagtggacatgcggttcgatgagatggattcaaggatcaccaaggttgaaagagatgtttcttacatctacacatgctttgatctaccaccaccaccaccatcatcttag

SEQ ID NO: 16444 - DNA, 818 bp, Glycine max
  Peptide Sequence Number=SeqID_133222
atggccgttgatctttgctcagaaaattgtgtggttgcttcctcttcttctgtgagtccaagaatctcattctcacatgacttctcccaatctgatgtcatccctgttgagcaactcccttttagatcaaactcttctggcttgaatcccaccattgattttgatttttgtgtcagtgagagctttgagcttgagtcatcttcagctgatgaacttttctcacatgggaggatccttcccactgaggtcaagagaaagaacaatattgttccacctatgaagcaattagcaccgaagagtagtacttcattgcctcctcctccttatgctggtcccaacagtgtctccactggtagaaacttgaagaaagagattacccccaaagaaagcaagtgtttaaatgatgaagtgtacgatcagaagcaaagttcaaagtccttttggaactttaagagaagtagtagttgtggaagtggacctagaaggagtttttgtcctttgccacttctatctagaagcaattcaactggatcatcaacaccaagtgttaagaggaatccactttcaaaggagggtgttaacaacattaaacagaaacattcttccacaaggttggctcatcactcctttgtgccaaacagctatcatcatcatcaaaagcctccattgaattacaagagtcatcatggatcttatggtaccagtgtaagagtcaatcctgtcctgaatgttcctcctgcaaacctatttgcggtgaccgctatatcctctttgaagattccaacatcgaataaacttgtcgcttgcaatcctagtgg

SEQ ID NO: 16445 - DNA, 381 bp, Glycine max
  Peptide Sequence Number=SeqID_133223
atgccgaactgggagctcaggaactgttgtgaccacgaccagaaggtcttcattgcttgtgttgctgccttcaccgttgtaatcctcgtgctatggaggacctttctacttacaccttttaagctcatcaccgtgtttctgcatgaagcaagtcatgccattgcttgctggctcacttgtggcaaggtggagggaattcaggttcatgcaaatgagggtggggtaacccagactcgtggtggcatatactgggtgatcctgcctgctggatatatttacgatgatttaatatctcggagagtccactctagtgatgctgaaaagtttgcagaagtttgcccatgcccttgtaatggttttggatggggagttatttggtga

SEQ ID NO: 16446 - DNA, 132 bp, Glycine max
  Peptide Sequence Number=SeqID_133224
atggaggtgttgacaccagcgaaggtgatgcgagatgctaccatggtcggaactgtcggaggtgttgacgccgacaaaggtgacgcgagacaaagggaaaatgacgaagaggaagaagatagatatgagtag

SEQ ID NO: 16447 - DNA, 750 bp, Glycine max
  Peptide Sequence Number=SeqID_133225
atggctcacacgctgagcgctcctcacccgttgatacagcagaggatacgaagcacgcgcttggcgggctctgccgcgccaagcgcgctcatctattgggaagcacgcgctaagcgcgctcttatgacttcccgcaagcgccgtgccgtgcccacaccaggggaagcgtccaactgggacacttcccgcttcacatctgagattgcctggcacaggtaccatgacaacatccagcttcggaacatccttccggagaggaatgttgaactgggacccgggatgtttgacgagttcctccaggaactcaggaggcgcagatgggatcaggtgccgactcaccttccggagaagcggattgacgtggctctggtaaaagagttctattcgaacctttatgatccagaggaccacagtcccaggttctgcagggtgcgaggacaggtcgttcgttttgatgctgacaccattaacgacttcctcgacaccccagttatcttggaggacggggaggagtatccagcatacaccagatacctcagcactcaccccgatcctgacaccatcgcggccacactgtgcactccaggggggcgctttgtccttaatgctgatggtctcccctggaagctcctgaggaaggacatgacgacacttgctcagacatggagtgtcctttcttactacgatcttgcgcccacttctcacacttctgatgttaatcttgacagggcccgcttgatctacggtttg

SEQ ID NO: 16448 - DNA, 162 bp, Glycine max
  Peptide Sequence Number=SeqID_133226
gcctatcgtcagcgagtcgcctggccaggagaccagccctccactgacaggggggaagagccttctggagccgctgaggatcctgcagtcgatgaggacctcattgctgacttagccaccgctgactggggcccatgggcagacttgggcggaggcagttga

SEQ ID NO: 16449 - DNA, 135 bp, Glycine max
  Peptide Sequence Number=SeqID_133227
atgaaggcgcgggagcctacgaagttttatgttggagttccaatgtctacttcggttttagtttgtttgcaactacttttgaagtccgcagctgttatcacaaacacaggaatgagaaagattatctataaatga

SEQ ID NO: 16450 - DNA, 819 bp, Glycine max
  Peptide Sequence Number=SeqID_133228
atgaaaccttgtggttctgttgggaaggggaaaaattttgctttccctatcagaagtaatggtgctgagctttgtgacggacacattgtgagaagtagagtcaacttaagcggagattggagtttcataggaggatccagaattattgtgaaaccaaaagctacaagattgcttcttcattatccaaaaaggggtcaaatgcaagcttcatttttccatttctcagagcttcttacaggtgaagctggagattttactattaggtctctttgctttaaaattactaagtggtctgctgtaattttcaccctaggaaaatttccctgcattctgatttatataaatatcactggcttcataggatctcaactcgctagcactgtatttacagtaggaacaatagcagtgctcccattttacacactcatggttctagctccaaaatctgaactaaccaagaagtccatggagagtagtataccttatgtagtgcttagcattctatatgcatatttattgtacctttcttggacccctgagacagttcggttgatttttgcaagtaaatacttgctaccagagctggctggtatagcaaaaatgttctccagtgaaatgactttggcctctgcctggattcacctgttggttgttgatctttttgctgcaaggcatattttccaagatggactgaagaatcagattgaaactcggcattctgtttctttttgcttgtttttttgccccattgggattcttactcatgtcatcaccaaatccatgaccaaacctgccagaaaggagggtcatggtttatag

SEQ ID NO: 16451 - DNA, 828 bp, Glycine max
  Peptide Sequence Number=SeqID_133229
atggctatttgtgtttctgggtcgcacacacttttcgtgaaccgttccaatttgaagactgtggcggttctgagcagagagaagaagatgcgtgtgcaatacgatctgaagcaagggcagagtcgtaatttccacgagctccccagtggtctaagcatggaggtgattgtgcaaaagggtgcaaaaaagaacacgaattttgagtaccctcctttggtttttgttcatggaagctaccacgctgcttggtgctgggctgaacactggttgccctttttttcatcttctggccacgattgctatgctattagcttgttaggacagggtgaaagtgattcacctcctgactctgttgccggtacacttcagtgggatagtctggcgttatatcttttccaagccaattgttgccttcaaggtatttggactgaattttctgaagaatgtgacttcttctgtgtttatcttctgatatgcttgtatccaccgcctggcagggagacatttttctcagccactatggaggatcatgttgttagaagatatcaagagctaatgaaagaaagttccaggatgccattgtttgatttaagaaagctgaatgcatctcttccagttccttcagtgccaaactgcccttttgaaattcttgtgttgggtgcaaaggatgacttcattgtggatgctgagggactcaaagaaacagctaagttttatggggtgccaccagtatgtgttgatgcaattgcccatgacatgatgttggatgtttcgtgggagaaaggtgcagaagtaattttttcgtggctaaatggttcagagaagtaa

SEQ ID NO: 16452 - DNA, 336 bp, Glycine max
  Peptide Sequence Number=SeqID_133230
atgccgccggtcaggccgatcaccgcgcaggcggtggcgtttcatgtgcgagaaattgcgcggcgcaccgcaactcaggccgggactttacataaagagttgagcaggctggctgaaggcggcatcttgctcaggcagcggcagggcaaccaaatttgctatcaggctaacgccgattgcctgatttttcccgagttggcggcgattttccgcaaggcttgcgggccggctgcgcgcttacggcaggtactgactggatttggggaagacatcgaacgggctttcatctttggttccgtcgccagtggcaaagcgacggcggccagtgatattgat

SEQ ID NO: 16453 - DNA, 216 bp, Glycine max
  Peptide Sequence Number=SeqID_133231
atgggtgccaagtacctcgaagcagtcaagcaaaggttgcatgccatcaaacaatggtccccggatgaaattatggggtatttgactctgaatatagttattaaccttctttatgaaatctatactaaacttctttcaatttggtatatagaaccttgcgtttggactgacgagcgtgaacgagagagacctctgagcgatgcaaagaggaactga

SEQ ID NO: 16454 - DNA, 117 bp, Glycine max
  Peptide Sequence Number=SeqID_133232
atggccctctacaggatcctgggctgtcttgcagcgacgttttccacttgtccagcgccgggaagggacgatgatctatcggtcgtgaccctatcctctatttgcatccgtccctaa

SEQ ID NO: 16455 - DNA, 243 bp, Glycine max
  Peptide Sequence Number=SeqID_133233
atggcctctcatcagcgggagattcgccacttgagtgaatcccccaccgagggtcaggaggccagacaagaaagattcgcgcgcctcaagacggttcttgactcagtcgacagccggttggatcaagcccgagaaatagatcgggttcgtgacaacgaacgtgctcggctacgggcagaaatggatcacgactgtgatcggtggagggctctcgagagaaagaacgcgccaaaatgcgattga

SEQ ID NO: 16456 - DNA, 198 bp, Glycine max
  Peptide Sequence Number=SeqID_133234
atggcggagttgattaacaaaacacaactctctcccaaaataatcccaacgtcatcacgtcggctcggcagctcctcaacagaatctcacttcctgcaccctactactgtcattctgctcctacgaacaaggatgatgcatgcacctgacctcaactctcagatgcaatgtggtacataccatcaaccaaggaaatag

SEQ ID NO: 16457 - DNA, 720 bp, Glycine max
  Peptide Sequence Number=SeqID_133235
atgacaaaaagatattggaacataatcttggaagagatgatggaagcaggagttcattttggccacggtactagaaaatggaatcctaaaatgtcaccttatatatctgcaaagcgtaaggcggattcagtagcacgggctgcaataagagctcggtgtcattatgttaataaaaagtggctcggcggtatgttaacgaattggtatactacagaaacacgacttcaaaagttcagggacttgagaatgcaacaaaagacggggagactcaatagttttccaaaaagagatgccgctatattgaagagacatttagctcatttggaaacatatcttggcggcattaaatatatgacggggttacctgatattgtaataatcgtcgatcaacaagaagaatatacggctcttcgagaatccattctaattattcgaaatctgcaaaccattcccgctttcggtcagaatttctttgaatatgttcttgaattcattcgagacgtgagcaaaactcaaattggagaagaatatggtccgtgggttccttttattggaactttgtttctatttatttttgtttctaattggtcgggggctcttttaccttggaaaatcatacaattacctcacggggagttagctgcacccacaaatgatataaatactaccgttgctttagctttacttacatcaattgcatatttctatgcgggtctttaa

SEQ ID NO: 16458 - DNA, 312 bp, Glycine max
  Peptide Sequence Number=SeqID_133236
atggttatggttttgaattttgatggttacgtttggggtgcgtgtaatcaccgatcacctgaatacaatgatggaaggtactggacaatgtggaagctaccaatgattgggtgcacagactcagctcaggtgttgaagggggttgatgaggccgttaaggcctaccctactgccttcgttcgtatcattggattcgacaatgttcgtcaagtccaatgcgtcattttcattgcctacaagtccaatgcatcattttcattgcctacaagtcccctggctactaaacttgaattttacaagagccatttgtag

SEQ ID NO: 16459 - DNA, 1119 bp, Glycine max
  Peptide Sequence Number=SeqID_133237
atgaatcttacatggaaattaatgcaagagttgaagcctacccttctcatggtgttggtgcaggtttcgtatgcttttagcagtgtgctttacaagctcgccataaatgatggaatgagccttagagtactcagtgcctaccgtctcattttcggagctgctttctcattttctcttgctcttattttcgaaagagggagtttattcctaaaccttttcttctttgctttggctttggtatcaacaacatatgcttacgctgtttttaatctggttcctgcaaccacttttatcctctccgtcttgtgcgggtacgaaaacttaaatgcgcgaaccgcagcaggaaagactaaggtgttgggaacgatgctgggaattggcgggtcaatgctgttgtcatttttcaaagggatgaaaattaatatttggaactttcacattaagcttttgcataaaaatgacaatagtgatcagctaggaacacgaacaccacatgcaaaccccaaaacagaatggctaggtgttttaagtggtattggaagttgcttgagtttttcaatatggctcatcattcaggctaaggtgagtaaggaatatccaagccatcactcagctacagcgttgatggccttaatgggagcaatacaagccacagcctttgccctctgtgttgaaaaagattggagtcaatggaacttgggttctagtattaggcttctcacagcacttttttcgggaactgtgacctctggatttgtgattattgccacaacatggtgtgtacggaagagaggtccattgtatgcatctgttttcaaccccctttcccttgtgctcgtggctattgctgcttccatgttattacaagagcacttatacgtaggaagtgtaattggagcagtgctaattgtgtgtggtctgtacatggtgctgtggggtaagaacaaagaaatgaaaacggcaactcacttggtgtcattagacaacaccaaagaatttggagtgatcactgacgttgttgtcgtgtctacgacggagaatagtgatcgtgagaacaatagccacgacaattgtggacatggactaaatgacattgagaaaacgggaagctggaagtga

SEQ ID NO: 16460 - DNA, 324 bp, Glycine max
  Peptide Sequence Number=SeqID_133238
atggcgggatggggtaaaacaggagagagagaggtcccgcccttggagctggcgggacaggtgagagcggtactgccaacagtggttgcgggacagggggagagaggatcccgccaacagtggttgcgggataggcttgtaaagatgcaaaagactttcttaagttctccacctgacttaattgctgtcatcgcagtcaacaatattaatggtgttgggtttacggtatggaatgagagaattgcgttaattaaactgtacacgttgcaatatatactaacttggagatatttaaaacctattgcttacgaaggatgtgtttga

SEQ ID NO: 16461 - DNA, 345 bp, Glycine max
  Peptide Sequence Number=SeqID_133239
atgggttccacgttcaaagaggttggagttggaggaagtgacgtgggacaagccttaaatggcagagacagggaagtgtgtctttattacggaatctgccactgggaagagggtaaaagcagaaagggaaatgaggaagagaggaagtgcatgcaaatgggtacaaaaattgaggagggaagaatgaggcgcgtggcgagcacggtcagactcctggttttcgggaattggatggaaagtggttttgtgacaaaaaccaaagactggtttccggttttggtattaggactgtgggcgcggttgatgaaagaggaaagcattaaagccaatggttttggagtgtga

SEQ ID NO: 16462 - DNA, 807 bp, Glycine max
  Peptide Sequence Number=SeqID_133240
atgttcttggctagaggtccactacccctggcacccttgtgggagaaattcttcaaagaccatgatggattttactccatttacctgcaccaacatccttgttacagtgaaaccatgcctgaagattctgtattctatggaagaaatattcctagcgagctagtggtctggggcgcaccatcattgatggatgccggaaaacgtcttctagcaaatgcactaatggacttatccaaccaacgttttgtgctgctatcagaatcatgcatccccttatttggcttcagaaccatatatgactatctcatgaactcaagcacgagcttctcagactcttttgatgacccaggatacgatgccagaggaagatactgcccaaaaatgaggcctataattgacataaccgattggagaaaagggtctcaatggtttgaggtgcatcgtgagcttgccattcacattgtatctgacaccaaatactatcctatagttcagcactattgtacttcaccatgctttgcagaagagcattatataccaacttttgtgcatatgatgtaccctcaattaagctccaatagtagcatcacttgggtggattggtcaaggcgtggccctcatcctcgaacatttgggtccaatgatattacagaagcgtttttgaaccacatgaggtttggatcaacatgtgtttatgaagggaacatcaccaacatgtgcttcctttttgcaagaaagtttcatccaagcgcattgaagcctttattattgctattgtctcccttgatgcttggtgctgatacttaa

SEQ ID NO: 16463 - DNA, 207 bp, Glycine max
  Peptide Sequence Number=SeqID_133241
atgtgtcccatcactgacttctcttctttttttgtcaagcattatgtggctcctgaaagatttgtggccactaaaagtcaacggttccgatcaaggatactgcaacattcaacatttgaccctaaaaaacggaaaagaagggtatatggtagctcaaaattctaccaattgctctcccaaggtcacactgcactcagccgcccttaa

SEQ ID NO: 16464 - DNA, 297 bp, Glycine max
  Peptide Sequence Number=SeqID_133242
atgtcagaaatcaaaaggaagcattgttacgcaatccgcccacttgggtcttccagattcttcctccaggaggcggttgcttctggaggaaggaacctggctcgccagctcgccctcctcccctattttgttataaatagagggaggagtgaagaaggaaggggttcagccttcttggcatttcgtaatcacttgaaattggtgaggaaaattgtttccgtgggtgatttcacgaagattttcaaccgttcttcgtcattcgtcattcgttcttcgtcgttctgtggtcttcaacca

SEQ ID NO: 16465 - DNA, 321 bp, Glycine max
  Peptide Sequence Number=SeqID_133243
atgcctacaagctccaatggagctacatcatgtggtatcagagctaggttcctttgtgggcttaatatgaaagtgagggacaaggttgaactcctttcatatagggacttagatgaactagtccatatttgtataagagtcgaacaacaacttaaaagaaagcattcttcaaaatcttatgcctctcattcttatccaagaaaggaccaagcccatggaattttgggggctgcaccttcaaaacccaaggaagataagggaattaatgaaacattgggcttaatccggattttggttatggacttgaagagggcaaattaa

SEQ ID NO: 16466 - DNA, 128 bp, Glycine max
  Peptide Sequence Number=SeqID_133244
ttattgctgctgtcatcaccgtcgtgattgttgtgaccatgacagcaattacggtggtggtgatcaatcacaatagtgatgattgcaacgatgatggtgattgtgatgacgatcttaacgtaaattaa

SEQ ID NO: 16467 - DNA, 822 bp, Glycine max
  Peptide Sequence Number=SeqID_133245
atggctatggtggtcctcacaccccttttggccatactcggtattctcctacttaaactcatctatgacagcctctcatgttactggctcacaccactacgcataaaaaagacgatggatatgcaaggtgtccgtggccctaaacctcgtttcttcaccggcaacatcctagacatggcttcccttgtctccaaagcaacctcccaagacatgaaaaccataagccatgacattgttggccgtcttctcccacattttctactttggtctagccaatttggaaagaggtttctatattggaatggttcagaaccaaggctgtgtctcactgagactgagttgatcaaagagttcctttcaaaacacagcacggtatctgggaaatcctggcagcagagacaaggttccaagaatttcattggggagggactgttgatggcaaatggtgaagattggtaccaccaacgtcacatcgttgcccctgcattcatgggagacagacttaagagctatgctgggcacatggtggaatgcactaaggagatgctccaatccctgaagattgcgttggagagtggccaaactgaggtggagattggtcactacatgactaaactcactgcggatattatctctaggactgagtttggcaccagctaccagaaggggaagaaaatattccacctcctcacactgctacagagtcgttgtgctcaagcaagtcgtcatctttgcatccctggaagcaggtttctgaatcatccttttctcgtgttccaggatcacgttgaaatatcagtcaacaacgttattttattttga

SEQ ID NO: 16468 - DNA, 988 bp, Glycine max
  Peptide Sequence Number=SeqID_133246
ggaatcatctttggagatgattgagcttgcactttcaatttttcacaagattgatgctcctgatacctattcctgcagtaacatgattgttggtttgtgtaagcttggtagactagagtcggctcttgagatttttgatcgaatgaataggatcggagtgcttcccactcgttctgctgttaacttgcttattggggagctgtgtttgatgagtggaaaagaagggtctgttgagaaggtgagagtgaggaatacgcggagaccgtatactattttagttcctaacatgggaggaaatagcggcgcgattcagcctgcagttcaagtgttttgggcagtttgtagttctggcttgttgcctagtgcttttgttgttgtcaagcttatgtctgagctttgtcgcttgggtaatacggtagaagctgttcgagtgttgaggattgtcgaggaaaggaaattgactagtgttcaagagggatactctgttgttataaatgcattgtgcgaatgttgccgagtagaggaagctagtgatttgtttgggaggatgttgtcctgtggcttaaagccaaagttggttgtttataattctgttatatcgatgctgtgtaaatttggaaaattgaaggatgctactagggtcttcgaaatcatgaacaagaacagatgccttcctgatggattaacctacactgctctgatccattctcacggtgaggttaggaactggaaagtttcttatgacttgctaatggaaatgttgggtttgggatggattccacattttcacactttcaatttagtagagagtcttttgagagaacatgatcagttggatctatgtgttaaattggaaagaaaattggagaaccagaagttgcagaagctgtgtaaaggaggtgaactagatgctgcttatgagaaagcacaatcaatgcttgaaaagggtattcctttatcagcttatgctagagacatttttcaacag

SEQ ID NO: 16469 - DNA, 449 bp, Glycine max
  Peptide Sequence Number=SeqID_133247
atgctttccctatgtaggtctcgacatgcccttcacgttttcaacgcatcttcacgctttcttcattcctcttcttcccgaatcccgcgcaaagcacctccttctgatgtcgtttacccttcctcctcctctttgctctccgacctcgtctcttgcgccaccgacgatgcccacatccgtcgcgttttctctcgccacaagcgagacctaacctcccccctcgttcttcgcgttttgaagagctacaagcaactgggtagggctaaaaccttgaaattcttctccttggccgggacccacttaggttttcgctttgacgattccgtcgttgagtacatggctgatttcttgggtaggaggaagctctttgacgacatcaagtgcttgttcaatacgatgtcgtttcataagggtcgagtttcgcccaaggcattgtccatttgcatcag

SEQ ID NO: 16470 - DNA, 579 bp, Glycine max
  Peptide Sequence Number=SeqID_133248
atggctgaaattgaataccatgcaaaatccaatactaacactcaacccctaaagctctttggcatcaacattagcaagtccccagaagatcaaactcatgaagcaggttcgaattctgagcctttcagttcaagaaagtacgagtgtcagtactgttgcagagaatttgcaaactcacaggcactaggagggcatcaaaacgcgcacaagaaagaaagacagctcttgaaacgtgcccaaatgcaagctgctcgtggttttgtttcttcacagattcacaacacaatcatatcaagcttctcaccacagtctcagccacctttgtcgtggttatgcacaccacatggtggtgcatatcattcaggagctgcctttgtggcttctggaagacgaatctatgttgcagcagctggtgcctccatcactgatggccatggtcaccgccaccctctgccgcagttcggtggcttcaacgggggtgaaggtagtggtggtggtcgtgaacgagggttaggtttggatttgcatcttagcctgtactcaaacataaaatcttccttaaaagtatcgacttgttaa

SEQ ID NO: 16471 - DNA, 804 bp, Glycine max
  Peptide Sequence Number=SeqID_133249
atggatgctatcagctttatacctgacattgtgtttccttccttttttaccagtatggagcaaaacaagaaagggcatggttttcaccctgaccccatgaattactcttattatggtcaaccggaacatgatactgaactttcagattctgcaacatcctttaacaaaggaaggatggatgagatactgagtgatgttgtcaaccaaattccccgggcattagaaagtttgctcacttttgggacagaattgacacgaagcaagctcaaccatatgaaggatattctcttgaattctgagttggtgcttagaattgcaactgaccgcagagaggatcaagggccacaacttctaatttatcagtttctcgttgatgatcttgacagtatggtgagtgatgctatgtggacagatgctaatggcatcgtgggttgtgaggattctaaacagagaaaggagctaaaggggtttcttcttgattgtgttatagaatatctagaatcaaattgctgccaatattttaactctggattcaagaaatggacgaagctgcccttgtgcatggaagctgagatgttggctcaagaggtgaagagggagatcaacaagtggttatctatggttgggatggtgcctgatgaaataatagaatgggaaatgagccactccttggggaaatggactgactttgacattgaagcatttgaggctggtgttgatatagatggggatatacttcaaattttggttgatgaagttgttcaagacctgcaggttgcaagcaggggcaccatttacttctaa

SEQ ID NO: 16472 - DNA, 612 bp, Glycine max
  Peptide Sequence Number=SeqID_133250
atggagctaaagtggaatatactccttggctcattattggcttgggcaatcctggttggatttgaaataattgatagcctttctcgagcagaagggattcagatgaacacaatacagtcaaaggccctcattggaataggttctattggtgaagtaccgattttgctggcaaagccccaaacatacatgaatttcagtggggaatcggttgggccacttgctgcatattatcaagtacccttgcgtcatattctactagtttttgatgagacaagccttccaaatggtgttttaaggcttcaacctaaaggcggacatggacatcacaatggattgaaaaatgtaatgggccatttggatggttgcagtgcttttcctcgacttgcagtcggaattggaaatcctcctggaactatggatttaagagcttatcttctacaaaaattcagtgtagaggaacgaaagcagaaaaaaaatatgaaaggacttgaacagattgacgcttcattggagcaagcagttgcagcagtaaggaccgtagtactcaatggttttgaccagcatgtcaatagattcaatttaggacaaaaatacaagtaccataaagtttaa

SEQ ID NO: 16473 - DNA, 2064 bp, Glycine max
  Peptide Sequence Number=SeqID_133251
atgaatgattctactgtgaagaatttggccatcacggagaagaaggtgcagcagcataaacctggtggttgtgttggcattttctttcagctcattgattggaagaggaaactctccaagaagaagctcttctccaagaagcttcttcctcctgctcgtgcgaaaaagtttaagggagatgaaaaaatgccaaattccaagcttcacttgattgctaatgagaacagtggaggttttcctggtgctaaaaaagttgggaatcatggtctagatgtagaacaaaagagtgaaatgcgagttccgagtctggtagctaggttgatgggtctcgaatctattccggcagctcagcgagacaagtccaagaaagccttgtgtgctgatgggaagaaggaatctttgggtgaccattgtgagttggataggcaaggcgtggatttggaaatgggagttgtaaagcatgattcaagacctcagaagcttcagaaaactgggtcatatgagagaagggcggtgaccaggtttggagccgaggcactgcaaattaagagtgttttgtcacgagcaagaaaatataatcaccatcatcatcagaagcttgcttctttgagaaccccaagaattccttccggaaagagtgcttctcgaagctctaggttaataggagcagctacaaaaattttggaacctggactgcaaagcagaagtagagctaaaaattctcttacatatcctgcttccatgtatcctcccaagactggcattgtgacaaatggtgtggaagatgggtcagcgattatgcaaaatcaatcttgttttgaaaccagctcatgcaagcaattgatggggcagacctcttgcaaaaactgtggtaatttgctagatgttcttgactgcaagcttgaggttgggagacagtcattggttcctccacccattgtttcagatgtgatcactgctacctctatggtatcattagagaagaagggaaagtcattccctcctcatggacatgaaagagatgtagttcttccgagaagtcaggaaaagctcatatctcttgttactgaaggaaaaggaaaaaataatgcacaacaatcatggagtgaacccactgccagaagaatgccaatgccccatgacggtccagctaaatggaattcatcttgccaaccatcaagggccctagaggatgatgcatcttcttttgccttaaaacacaaaactcaaacacaagaacagatgttaagcagtgaaagatattcatctgggtctacaacgagtgatatgcaagtaaaaagggtatcatcatctatgagtgctgtgaatggaactaaagattttgttgctatgaatagaagtctaagtggtcgatcaaggataaggtcacttaccaaagcggatggttccaaatttgacctagagaaaaaaccttacaatcgacaacagagttccttatctcacgtaaggacattagagagaaaaagaaggattcctaatgtcacacaactagaaggtacaggttctgtttattcagttggtacaaaacaaagaaatctccattctggtggaatgggtggcaaaagaagggacttcaatgcttcttccttgaacaattctattgtaaaaaataaacaagatggtcaaggagaaagagttattaaggttaatgacaataagatcaatgatgtagtgtcatttacatttaattcctccttgaagcaaaagatagaaatacctggcaagagggaagagacaagcagcgacaatgagagtatggtgtatttccaaaggccttcgcccttgagagttgatgctttaggtgcctttcttgaacaaaaattgatggaattgacctctcaaagagatgaggagttggctacaggtgctccacctaaaaaatctagtgccatgattcttcaagagctgatatctgctctaagttccgagcatctgatctgtcatgatggtcatcacatgtttaatgaaaatgtttgttttcatttccctgttgctcagtttcatattgaatttgtagtcaatgttatccccatgatttgttga

SEQ ID NO: 16474 - DNA, 204 bp, Glycine max
  Peptide Sequence Number=SeqID_133252
atgggaacaagtctgcaaaacttgacagcagcaggactaaggcagaaagcaactcttgatacagcaaaacgacaccgtcgaagaaaaagcaaagaacaatacaattactacatagcaacgtttctaaatcacaagcatcaacaaacaatgcagctaatgctatatgctctaagactactactgcaaggtgcaaagcaaagctaa

SEQ ID NO: 16475 - DNA, 306 bp, Glycine max
  Peptide Sequence Number=SeqID_133253
atggatattgagtatcagaagattcatgcttgcccgaatgattgcatattgtacagacatgaatttgaagaattgtccaaatgccctaggtgtggggtaccacgatacaaagtcaaggatgatgaggattgtagtagtgatgaaaacccaaagaagggccccccagtgaaggtgttgtggtatctaccgatcgttccaaggtttaagtgtctttttgctaatggagacgatgctaaagaccttacatggcatgcaaaggggacaaactacgatggaatggtccgtcatctggctgattgctcatag

SEQ ID NO: 16476 - DNA, 252 bp, Glycine max
  Peptide Sequence Number=SeqID_133254
atggcttacactcacattccggattcaacaagcgattctcctcaaatttcagccagcccgcatcaattagaccttgcaccttacgcttcagagccctacaatgctcaatggaacgccccggggcttctccgtgacaagcacacgttgcgttcgagtcgtattctcggagaaatggaggttgatgaaccttggctagggttatggctaccatttgaattatcaagtagatatgggatcgagtttagcatatga

SEQ ID NO: 16477 - DNA, 159 bp, Glycine max
  Peptide Sequence Number=SeqID_133255
atggcatctattggaaaagccttaaagaccttagatggtgtgtggtcacagtcatactttttccataggaaatctttgagcatctgtcaaaggttcccttggagcagctcttttaaacctctagattgtggggggatggaggtggacgcggttgtgtag

SEQ ID NO: 16478 - DNA, 378 bp, Glycine max
  Peptide Sequence Number=SeqID_133256
atgggagagatcatcaagttgtgtgcttcctgtcctcaccatcaaatcaatgagaaatttttgatccagtatctctatgaggggttgatagttgacatcccttgtgacgcggctagccattggtcaacaatagaatgtgatggtagccaatcaaccaaggctgtgtggtatatttgtgctcttgatcatccaacagattgtggaagcaatgtcttccaagattattttgatgatgccaaagaatctagagtcaaacaagtttcaagaatcaagatcaagattcaagattcaagaataatcaagatcaagattcaagattcaagaataatcaagatcaagatacaagtcaagagaagactcaatcaagataagtattaa

SEQ ID NO: 16479 - DNA, 438 bp, Glycine max
  Peptide Sequence Number=SeqID_133257
atgagagttggaccggtaccaaggaggtgtttggaggagaaggcaaaggccttggcaaatcaaggtgaatgggcttcctttgttgacatcttggcgcttttgatcttcggagttgtcctctttccaaatgtgaaaggggtagtggacctagcagtgattgacattttccttgcctttcatcatggcaaggaaagcccgatcgtcgccattttggctgacatgtatgacacgttcgatcggagatgtgaaaagagcagcgcaagaattgtttgttgtacactgactctctatgtgtggctggtttcgcacctttttcgccaagaaggtaggcccgcctgtccactacaacgtcaccgctcgtgcgctgagaaaggaaaggcgaattgggaccaattcttggctagcatgtgttggatcaagtggcctcagaataattaa

SEQ ID NO: 16480 - DNA, 312 bp, Glycine max
  Peptide Sequence Number=SeqID_133258
atgaaggcccgggtgatcggcggtcggatcaccttactgggggtgacgggaaccccgaatgactggcagagtcccgtgatcaacgccggaaaccccagggccctgttagacttatccgggtctagagggtgcctggatggcatacaccaactggcacttaggcagagggagatcggagttatgatcgctaggcaagacattgctgagcagcagtgtcatccacgtctgggtcaaggtggtcatgctggtgcgcatgatccgcacccgcctcctagcagcggtccgggtgaaatcttgccccggtgtgcataa

SEQ ID NO: 16481 - DNA, 429 bp, Glycine max
  Peptide Sequence Number=SeqID_133259
atggctccgaaaaagctttccatgaagaggtctagaaagaaggctgcgggggaaggctccagtacagccttggaatttgatagtcaccggtttcggagcgtcgagcaccagcagcgcttcgaggccatcaaaggatggtcgttccatagagagaggcgcgtccagctcagggaggatgagtatacggactttcaggaagagatagctcgtagatgttggacgccgctggtgactcccatggctaagtttgaccctgagatagtcctggagttctatgccaatgcttggcctacagaggagggagtgcgagatatgcatgccctcagtcagttcctgggtgacccgctagttttggaggaaggccagcagtgtgagttcagccagaggaggaacaaggccgacgggttcgatgaggaggccatttcctag

SEQ ID NO: 16482 - DNA, 399 bp, Glycine max
  Peptide Sequence Number=SeqID_133260
atggaggccataaaagagcaaatggccacaatgatgaaggccatgatgagcatgaagaagataatggaagccaatgcggttatagttgccgctattagcgctgtcgctaaggtgaacccgatgctcccatctagcctcaagcaaatgaatcatccaacctcaaatatggtaggcaaagatttgggaagtacggatgaccccatgatgtgcaaattcaaaacgagcacgccttcccatcatatggcttgcctcccaactatacaccacccaatgtggcatacactctcaatgaaaatctcaataactccactccgatactcattgagaaccaataacctcatcaggcacatgtcttttaaaccgtggaagagacacatgaaattccccaccacaatctag

SEQ ID NO: 16483 - DNA, 207 bp, Glycine max
  Peptide Sequence Number=SeqID_133261
atggatggcggtggatcgcaccgccattgtgcgcaggttcagcgcagattacgcagccgctgccttgtgccaggcgggacggcgtcccacagcgcacagccgctgcaggtcgctgcgcaggaacaggccgttgtcgacgctgttatccgccagaagccctcttcattctcctgggtgtcgatatgcaggcttccacccacgccagct

SEQ ID NO: 16484 - DNA, 457 bp, Glycine max
  Peptide Sequence Number=SeqID_133262
agaagagctatcggtagaagaagcaaagtctacgagctatgtcgatttggctaataggaaaatattcttttttgataccaagaacaggactaaccatgaacttcccatctgtgatgcggccaaatgtttgttagaggacaggagggatatcgttttagataaagaaacaaaagcgagtcgaaggaaatgggtctttccagcaagatctccgcgaagccaggctggtcactacagcgacagtaaaagtctcagggaatatctttgtgaggaggcaggaatcgttaagcttggaactcatgacctaagaagaacattcggtcgtatagcagaagagcttgtttcctatgcagtagtgaagaggcttttgaaccaccgcaatacgaccgacccaacagaaagtttgttggcatcagctaaataccctccaatacctgaaaatgccgggaaggatgcatga

SEQ ID NO: 16485 - DNA, 216 bp, Glycine max
  Peptide Sequence Number=SeqID_133263
atgcctaaatcatctcccaacatgcatgtgaagcaagtatcaacaagagtaaagccaaggctattgtgcaagcaatcaatagggcaaaacacaccgaataaaatagatgacgatggctcaaattctcaccaaggagaaaacaaggattcaattcacaaaatgccaagaaactcctatttcaaaaacaattacccattacctgtacataacctataa

SEQ ID NO: 16486 - DNA, 371 bp, Glycine max
  Peptide Sequence Number=SeqID_133264
gcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttagttag

SEQ ID NO: 16487 - DNA, 132 bp, Glycine max
  Peptide Sequence Number=SeqID_133265
gcgttctctgaagaactagctaagcgcgcttaccgcgctaagcgagttcatcctttgaggatgaacactcatcctcttgctgactacctgttgctaagcgaggctaaatcgctaagcccagatggcttctag

SEQ ID NO: 16488 - DNA, 234 bp, Glycine max
  Peptide Sequence Number=SeqID_133266
atgtctctggatcagcagttcttgacttgttctggagcagcctttgaggtatcgaattgtgaccaccactttacaaaggcgtgtctttgcaatggtggatactgcttgctattttcagagcctgatggggaagtaggaatactgtcctacatgtttgaacagtacttcctggaagtacaacagtctaatattttagttgaatggtactgtagcagtaagacccgtggtggataa

SEQ ID NO: 16489 - DNA, 348 bp, Glycine max
  Peptide Sequence Number=SeqID_133267
atgcgaacatgctttagtaaagagacaaaacttccaactgatcagagcaacatatgctttttggatgaaaaacaatgtgtctatcggggaaggagacatttcatttctaaacgaccatttagaggaaacactgggtccaacaaagataggagaaaatcactcaaagtgtatcaatctcacacagggcaaggattgacattctcaccctgggtcaaggtttatgataagttgggattttggctcaaggcttgtagaacggctggtcatgatatatgtcagggtttggccagcggttcggggataaaggggatgtgctacattatttccatgatacacatgcgacaatga

SEQ ID NO: 16490 - DNA, 528 bp, Glycine max
  Peptide Sequence Number=SeqID_133268
gctggtgagtcaggaggagctgcaacttcattatctgagtcatcaggaatgagtatcaaaggtggtgccggtggagctggtggaggtggtagaatctcaacctccggggaagccggtgggtctactactggtggttgcgactcaactggtgcaggctctgtccttgttgctgagcttcaggccaggccactttatctaaaaattgctccatggataccattggcctgttatgagccaactactgctggaactattggttgtgcttgtaggccatctggttccatggttgttgttggaggaggtgggttggatgatgaagggatgtcttcagctcttgctctctttcttgaggccatcttcttcacagaaaacactatacccgcttggcgacctatagatctcgttatgcctaaaacttaccgcaatgatgtgcgcttagctctccctgagccacgcttagtgcctcacttagccacaagtacttatccaaaggatgagtattcatcctctacagatccgatcgcttag

SEQ ID NO: 16491 - DNA, 466 bp, Glycine max
  Peptide Sequence Number=SeqID_133269
atgaactcgctgagcactgaaggttcgctgagcgagttcattgcaaatttccagaaaacagcagaaaacgcatctggaaacctcctttacaacaaagagaagaacaagatgaaagactgcaaaaacacaagtggtgaggatgtctccttcacctctaggatctcacaatcactcacaaactcatctcaagctctcagaacggcttccgcttcgaattcccgtctctgcagatcttcacacagcaaaatctctcagaactctctggaacttggacctttctctctcaagaaccttcgtggccttgttcgtgctcgtgcgcttagcgcagatctggatcgcttagcacgcataagtggattttggcttagcacgcttgttttgcttagcggattaactgaagtggtgcgcttagcaaacttgacaactcatcttcttctggattcttccttgcgcttagccactaaag

SEQ ID NO: 16492 - DNA, 988 bp, Glycine max
  Peptide Sequence Number=SeqID_133270
ctgactgcgctgaccctgaacctggaagtggccggccacctggccgagggccaggcgctggaccatgtgaagcgctcgcacgccctggccaagctgttgctgggcaacgtgcgcgaggtggtcagccagctgcgacccgcagagggcccacgtgctgctgcgctgcacccaggagatcatcaccaacgcggtgcgccacgccggcgcccgccacctgtggatcaaggtgtaccgtgaagcccccgaccgggtggtggtggaggcccgcgacgacggtgtcggcgcggatatggtcaatgtgggcaatggcttgcgcggcatgcgcgagcgcctgcaacaatgtggtggccagctgcaggtcgaaacccggcccggtgaaggcttccggttgcgggcgacggtgccggcaacggtgctggtggccgcccttaccaaggttcctgaaggagtgcgttgatgattcgcgtctgcctggtcgacgaccaaaccctggtgcggcagggaatccgctccctgctggcgctcgacgacggtatcgaggtggtggccgaggccggcgatggccggcaggcggtcgagctgataccgcaggtgcgtcccgacgtggtgctgatggacatgcgcatgccggtgatgtccgggctggaggcgctgcaggtgctgtcgcgccaggagcagctgccgccgaccatcatcctcaccaccttcgacgacgaccagctggtgctggccgggctcaaggccggtgccaagggctacctgctcaaggacgtgaccctggcgcagctggtcggtgccatccgcaccgtggccgaaggcggttcgctggtgcagccggccgtgacccagcgcctgctgtccggcctggagcacatgcgcaacgagttcgtcagcctggaccggccggacccgttgaccgaccgcgagaccgagatcctgcgcctgatggccagtggcttctccaacaaggagatcgccaattcgctgg

SEQ ID NO: 16493 - DNA, 401 bp, Glycine max
  Peptide Sequence Number=SeqID_133271
gtttaagcatctttttgctagtggagacgatgctaaagaccttacatggcatgcaatagggagaaatcatttggatgattgcccacagtggaggaagatagatcgtttgtttccggatttcggcaaagaggcaagaaatcttaggcttggactagccagtgatggaatgaatccatatgacaatttaagcactcaacacagttcatggccagttctactaccaggaaatgacattgatgtttatctaagttcattgattggagacctgacaaagttgtggggcgagggggttttagtgtttgatgggtttcgaaatgagacatttcaaatgcgtgcaatgcttttttgtaccattaatgactttccagcatatgggaatttaagcggttacagtgttaagg

SEQ ID NO: 16494 - DNA, 435 bp, Glycine max
  Peptide Sequence Number=SeqID_133272
atgaagttaccgccttgtttagagataggaagttgcatgagaagtttgacagcagttggaaggagaagtagacaaggttctttgatgtacatgaacctgtctatccaaggcaataaagataaggggaaagacaaggcaatagaagtgtcttctgagactaattcagaggcaactgtgacagtcacaccccctcgtcccaagggtgttgtgatagggtcaccaaaatggagaagctctgggaaagcaaagaagtctaagaagaagagaaggaggtcagaatatgaagttaccgccttgtttagagataggaagttgcatgagaagtttgacagcagttgggtaaaaaagaatgttgcaaatgggagttatattgatttattggagatcaaggaatatggttgggacattctatgttttgtaaagaaggagaagtag

SEQ ID NO: 16495 - DNA, 2973 bp, Glycine max
  Peptide Sequence Number=SeqID_133273
atggctgccaataagtttgcaaccatgttacagcgaaacaccaacaaaatcacccttgttctagtctatgccatcctagaatggattctgatcatcctcctcctcctcaattctctgttttcttatctaatcattaagtttgccgattactttggcctcaaaaggccttgcatatggtgcaccagaatcgatcacatcctagagcctgggaagtacaagagttcttgcaaagatcttgtgtgtgaagctcatgcctctgagatttccaaactggggttctgctctaatcatcacaaactggctgagtcacaagacatgtgtgaggattgctcatcctcgtcccaaccagattatgtgaaactctcacagagttttggtttctttccatggatgaaacagataggtatgattcaggatgagggtgctgaagatgctgttgacaaggcaattgtgaaggttgaagaggctttgaggtgttcttgctgtggtgtcaacttggacaacagattctaccctccttgcattctgatcaagccttctctcaatgttttggagtatgaccagaagcagaattcggagcgccgggttggtgtagagattgatgaagatcacaccagatcggatattgtgcttgatcatcatcaggaggaaaaggagaatgaagaaaacaagggaagccacatggtgtttgaggttgatcggggtttggatagaaaagatgaggaggtagagaagagttgtgattgttctgtgtgtgatggcgtggagattctgtgtgatgaaatttgcaatttggatttgggtgtggagaaagggaaagaaacaattgaagaggaaagtttgaatgtccctaagcctaaggataatgatggtgatgatgttgttgctgctgctgatgatgaagatcaagcttgtgagaaatccactgctcaagttgattgcactagagagataactgtggagactccatccatacatctggaatttttcattcatggtgatgattgcagattgattcctattgaattggttgactcccctgccctagaaaacaggaaacaaagcaaatataaggtgggaggtgaagggatcaacagcaatgaagattttattctggactttgataagagtgctgatgcagaagccgaaccggttgtggagaattggcacatttctggggatattgtggcagaattttcagcacaagggaatgaaaatgtttctaagtccaatgggggtgaatcagttcaattaaggaccagaggccagtcctcagaactgttacaagtagaagaagaaaatttggagcagaattgtgaagatgtgagatttgttcaaacctcggatgacttgaccaaggatgataatgttgaagtaaacatggaaagaagagatgcagaactatgttcagatgtttctctagcatctgaagatgcatcacaaatggaaggtgaggaatatgaagcagaagtctcaatagggactgaaattcctgatcaggagcaagtggatgagtatcaaagccaagatgttcttttggatacaaatcaacaaatgcaagaagatccatctactagcacagtcagatttaatgtgcaagatgaaattggtcatgacaaaggtgaagagtttgtagaatttaaaaccatgtcacttgaagtgaaaatgccaacagtaaataaccatttgccatctttattggagcttaatgagaatgaggaagaaaaagttcctgagacacccacttctttggagagtctacatcagctacacaagaaactacttctccttgagaggaaagaatcaggaacagaagagtcattggatggaagtgtgataagtgatatagaaggtggtgaggtaaccattgaaaagttaaaatctgcattgaaatctgaaaggaaagccttaagtactctatatgcagaactagaagaagagagaagtgcatctgctatagcagccaatcaaacaatggcaatgataaataggcttcaagaagagaaagcagcaatgcagatggaagccttgcagtatcaaagaatgatggaagaacaatctgagtatgatcaggaggctttgcaactcttgaatgagctcatgatgaagagggagaaagagaagctagagctagaaaaggagattgaagtatatagaaagaaggttcatgaatatgaggtaagagaaaagatgatgatgtcaagaagagatggtagcatgagaagcagaacttcatctccctcttgtagcaatgctgaagatagtgatggattgtccattgacttgaatcacgaagcaaaggaggaaaatgggttttgtagtcatcaagatcaagaatgcagcaaccagaacacccccgtggacgcggtcttatatttggaggaatcattggcaaacttcgaggaagagaggttacaaattctagaacagctcaaggtattggaagaaaagctagttatattgaattacgaggaagatcactgctccgatgatgctaaatcagtagaacatctttgtgaagagaatgggaatggataccatcatgatcatgatgatcacaatggtcaggtaaatggatttgcaaatggtcatgtaaaggaaataaatggaaagcatcaagggaggaaaatcatgggtgcaaaaggcaaaaggctcctcccactttttgatgcaatgagttcagaagcagatgtagagttgagtggagacgagttagactttccccacttgcaaaacaattcagttgaaaaggttaattcggataagaaaaagcttgctttagaggatgaggtggataatgtttacgagagactacaggtgctggaggcagatagagagtttctaaagcattgtatcagctctctgagaaaaggagataaagggttacatcttctacaagaaattttacaacatcttcgtgatttgaggaatgtggaactccggctcaggaacatgggagatcttgcagtgtaa

SEQ ID NO: 16496 - DNA, 3978 bp, Glycine max
  Peptide Sequence Number=SeqID_133274
atggatcctctttttccttcttcgcaagtgaagctccctcatcttatctctgtcaagcttgatgataagaatttcaagcagtggaagcaacaaattgatggtgttgttcgtggccacaggctgcaacgatttgtcactgtaccggtgattccaccaccgtcgtcgtctggttctgattcgtcccttcacgatgccaattctaggtattccaattgggaacagcaagatgcactcatctgcacgtggttgttatccaccatctccgattcaattttacccaaacttgtcgactgcaaacatgcctggcaagtctggatggaggttcatcggtacttcggtacacttctatccaccaaagctcgtcaactacgctcggaattacgccgtcttacgaaaggaacgcttacaattgctgaattgatgatccgtgtccgtgaaatcagtgaatcactggtttcgattggcgatcctgttcctctccgtaacctaattgagattgtgcttgatgcactgcctgaggaatacgactccattgtcgccgccatcaacagcaaagaagaagtcggttcacttgacgaacttgagtcgtcaatgctggcacatgaatcgcgattggaaaagcatcgtaaagctattctcactgagccggtgacggtcaatttgactcaggcttcgaaaccgtcgtcgccggctacttctgatcaatccagcgctggcactgacgcttttccacagggaacaagccatgtaactgccaatgctgagaatcatggctatggttcacgtggtggacgttctaaccgtggaggtggtcgttttggccgtggaggtggtcgttttggcaaaactcagtgtcaaatttgccacaaatctggacatgatgcgtccatttgttattatcgttactccaattctgttgctgcgatgtatcagcctcaaagagctccctttaatcccttcttgatgccatcacgacctatgtatcaacctccctttagctatgctgctccacgaggtgcacctcagccacaggttttctatgcaggcactgatgctggcttcagcaatcaatggtggtatcctgattcaggtgcgtcccatcatgttactcctgatccatcaaatgtgtctgactctacttctgtgcctggaactgagcaagtctttatgggaaacggacaaggtttgtccattcactctattggttctatgccttttcctttaccaaactatcctcacatgtcactcactttacagaatctcttactcgtgcctcacatcactaaaaatctcatgagtgttagcaaatttgctcaggacaataaggttttctttgagtttcacccaaagttttgtgttgtaaaatctcaggcttcttctgaagttctgctacgtggtctagtggaagctgatggtctctacaaatttcttattcctgcctcacaaatttccaagtctccaccaagtctcaactcttgcatagctgagtcttccaataagtgtagtagtagttctttatgtagttctgtagccaatgaaaatgattcatacaattgtatctctctatgtactacagacttattcatgaataaagataattcaatgtgttccaattttccttctctcaatgctactacttatgactctttatcatctcagcatgtgaataactctctatctatagcaaccaacaaatatgttttgtggcattctcgtttaggtcatcctcatcaccatgctctcactgaggtgttcaaactttgtcatctccctgttccttctaaaccacttgcagaactatgttcagcctgttgcttaggcaaatcccacagacttcctacatcattatctgccactgtctacagtcaaccttttgagctggttgtttgtgatctatggggtccagctcccatgcagtccttaggaggttataactatttcctaacctgtgttgatgccttctctcgatttgtgtgggttttccctcttagacttaagtccgatactctccctcaatttattcagttcaagaaaatggttgaacttcaatttaactaccctatcaaaagtgtgcagagtaatggagggggtgaatttaggccattcaccaagtatcttaatgacttgggcatagtccacagattcacatgcccacatactcaccatcaaaatggcatagttgagcgcaaacatcgctatactgttgaaacaggcctagccttgcttgcccagtccacattacccttaaaattttgggatcattcctttgttacagcagcctatctaattaatagactccctagtggtattcaactgctcataaaggctacaagtgtctggctcccaatggccacatctacatctctaaagatgtcttgttccaagagtccaaattcccttactccacactattccacactattccacactattccttcttctgtcccaactaaatcttctaccacctcattttttactgtgcccctcatgtcgccaactcccattcatcaagtcagtcctaaaccatccacatctgctactcctctatcttctgctcccactgatgcagcctccaatggctctcctaacactgttccagaacccaacaatttatctgaacagtcccctgttttgtctagttctcccaacacctcctttcacaattctacatctgcacctgagcttatcacttatgatctggcagaagcaagctatgaaggaagagtattaggcactgatgagaaatcagacttggacactgagaattctgatggctctctcaacaagtataaggccagattggtggccaaaggcttccatcagcaggctggaagtgatttcactgaaaccttctcacctgttgtaaaacctgttactgtcagaatagttttgactcttgctgtcactcacaagtggaccatccaacaaatagatgtgaacaatgccttcctcaatggcactcttgaggaggaagtgtttatgcaacaaccacctggatttgagtcttctgacaagtcccttgccagtaaatgtgatcccagtctctttcttctacatcatggaaaacttcagattatgattttggtgtatgtggatgatatcatcatcacaggaaattctgcttcatttattacagccttgatcaaacatctaaatgatgttttctctctcaaacagctaggaaaattagactattttctcggcattgaagtcacacatttgcctaatggttccctactactctcacaaagcaaatacatcactgatttactggctaaggtgaatatgacaagtgcaaatggtatgcccacacccatggtctccagcaacaaattatctaaaattggttccaatgaggttgatgatcccacacagtttaggtcagttgttggggctttgcagtatgcaacactaactagaccagaaatatctttttctgtcaacaaagtttgtcaatttttgtccaaccctttggaagaacattggaaggcagtgaagagaatattgaggtatttaagtggtaccaaacatcatggcctgctcattcaaccagcttcccttcagcagcctttgcatttacttgggttttgtgatgctgactgggcttcagacccagatgacaggcgatccacctctagtgcttgtgtgtttctaggccctaatttgtcattgctcagggagttgcactgcccttttcagacccctaaagtattgtgtgacaatctgagcactgtgactcttgctcacaatccagtcctccataatagaaccaagcatatggagctggacattttctttgtgagagaaaaagttctcaacaaaagtcttgttgtggctcatgtccctgctcaagaccaatgggctgatgcctttaccaaacctctatctgcaaataagtttcttccactgcgttctaagctaagagtttttgacaaacatagtttgcttggactatcctcagcttcaaagggggaatga

SEQ ID NO: 16497 - DNA, 186 bp, Glycine max
  Peptide Sequence Number=SeqID_133275
atggggtttgttttcaaacttttaacggatgatctgtttctgtatggataccgccagaagaactggcaacatagctatcacgttggtgccgccactgaagatggcgagatgcattggcggcaccaacgtaacaactatctcgtcaattcttctgacaacatccgcaaaaacagactcccttattaa

SEQ ID NO: 16498 - DNA, 465 bp, Glycine max
  Peptide Sequence Number=SeqID_133276
atggaaaaggacaagtctcacactcacagctttcttcacagtatcgtcaaacacttcaaattcggttcaccgaaagagcgaaacaatgaagctgacgtacaccaaatggctgcacaggagcagaagatctttgcctacgaaaccttgacagctgcaactaagaattttagtgctattcataagcttggtgagggaggttttggaccagtctacaaggggaagctgaatgatgggagagagattgctgtgaagaagttatcacacacgtcaaaccaagggaagaaggagttcatgaatgaggccaagttgttggcacgtgtgcagcatcggaatgtggtcaatttggtgggctattgtgtctatggcaccgagaagctacttgtttatgagtatgttgctcatgaaagcctagacaaacttctattcagtaagtgcttcaatgccaacccttattctgttcaataa

SEQ ID NO: 16499 - DNA, 789 bp, Glycine max
  Peptide Sequence Number=SeqID_133277
atggatgatgcagaatcagaaaagagagaggagcttgattggaaacgtagggttggaataatcacaggcgtggcaaaggggttgctttatcttcacgaagactcgcacaattgcatcatccatcgcgatataaaggcgagtaacatcttgcttgatgagaaatggacgcccaagattgcagattttggcatggctcggctcttcccggaagatcaaacccaggtcaatacacgtgtggctggaaccaatgggtatatggctccggaatacgtgatgcatggaaatctatcggtgaaggcagatgtatttagctatggagttttggtattggagttgatcaccggccaacgaaactcatcttttaatttggacgtggacgcgcagaatctgctagattgggcatacaagatgttcaagaaagggaagagcctagaacttgtggattctgcattagcatctaggatggtagctgaagaagtagcaatgtgcgttcggctgggtttgttatgcactcaaggcgatcctcagctacgccccacgatgaggcgcgtggtggcgatgctgtcgaggaagcaagggaacatgcaagaacctacgagaccaggaataccaggttcaagatacagaagaccacctaggagacactccgcattgtcttccacattgggtacctctggttctgattctagtaataatgataataccacggttactactagtgccacagggactagctcagctactgcagaaacagaccccaaagggaaacgtccaatgcgggaggcttag

SEQ ID NO: 16500 - DNA, 465 bp, Glycine max
  Peptide Sequence Number=SeqID_133278
atgcatcatgcttttacttttagaatttggacaaaattgccaaggtacaccggtgaagatagtgatggtgattactacagagattcatgcagtgaaggaagtagtgattatgaatatggaaaaaggactgaatttatgactcaaagaagtagtcagtatctaacaggtggtatctcactgcaaatgaacacactatctatgcatgataaacacagtactgtgcaagaaggattttctagtgatgatagtgaaactgggaatcctcaagatctactttttgagtattttgaacaagatcctccgtatagtcgtgagcccttggctgacaaggcaattactgatcctttgttaatgtgtgacttatttacccataatctgatctgtccatcttatacctataatattctgacagattcaagatcttgcacgccactatcctgccctcaagtcgttgagaagctgtga

SEQ ID NO: 16501 - DNA, 291 bp, Glycine max
  Peptide Sequence Number=SeqID_133279
atggttgccgattattctatatgcaatgcttattgcttaatgaagagcacaactagggtcaatgtggtgttgagggggcaaaatgattttggtccactgatgcaacatgacctaaagctgaaccagaaaataggaaatatgagtacaattcagttctacaacaatcctctgaaggaaattgtggctaattcaaaatttctaacagtgggaaaggttgagggtgaagttgacagcacctatggtctaagtggcaaggatcggttgaagaggcttaaccgtggggagagataa

SEQ ID NO: 16502 - DNA, 468 bp, Glycine max
  Peptide Sequence Number=SeqID_133280
atggctaacttgcttatggataatgataataatgttcatatgagctttggagttgtgctgattgagcttatatcatcaatgcctgcggtcgatatctcgagacgtaggcatgagataaacttgtccaacatggccattaagaagatacaaagtggggcattgcatgagattgtggacactactctagggtttgagacggatttcaaggtgaggaaaatgatcagcgatgtggctgagttggcgtttcagtgcttgcagagttctaaagatgtgaggccctctatggcagaagtgttggatatgttagaggatattagaagtgatgggagttataagagcaagcatgaggtgcaggaggatatatcagaagatgatgatgctttgctcaagaatgtgcctcctccaccttcacctcattcacatttggtgactatttctaattctacaccaccaaatggtagccaatga

SEQ ID NO: 16503 - DNA, 150 bp, Glycine max
  Peptide Sequence Number=SeqID_133281
atggaggagaagaaaaagaaaaaactgaaggaagttgctcaatccagaagcactgactccgtgattaatcgtccatctcccatcagacgacacattcattggaggagcaggcttcatagggttcctttgctgcccttggacgctaagaat

SEQ ID NO: 16504 - DNA, 255 bp, Glycine max
  Peptide Sequence Number=SeqID_133282
atggagtcatcaactgtcacaacctacccttcggcgagaaggcggtgcggggctcacgggtgcgtcttccaagaaaggaaaatgcgcagagtcgccaccaacatttattcaaggaaaatgtcagaaaaattggaaaggtttggtctacgaactttaagtgtgaaaggttcgggagttgtatttatgcatggggaaggctatttccctcgctcctacgtattcctcaattgtgataaggaaatcagacctacgtag

SEQ ID NO: 16505 - DNA, 2235 bp, Glycine max
  Peptide Sequence Number=SeqID_133283
tgtgagaattcaaatcaagatgggaaatgggtggaaagagattttctcagcctgagtgagccaagggaagattcttcaaagcgatcccttgaggaagttgttgagagggagagtaatagggagaagaagccaaaactggagacacttaacctctctcttgctttgcctgatgtgtcactttccctcactgcctcaaacgccttgcaaaacggtgatcaacaacaaccaattaggaccaaaccttgcaggccatccactactactcacacttcatattccaatgactacactgcagcttctttgtcttactcttattcccaccctttctctcacaatccaagctgttcactcacccgcaattcaactgataattttgattactcagtgagcaaagatgaccaaatttggaactgtggagaggggactaatggctctgtgcatagtaggttcaagccaattggagatgggttggttggtttatccaaccatggtggtgctgctggtggtattagttcctttatgcaaggtaataatagtcagtataaaactactagttcagataaccattcttttttcccttcagagttgcctgcaaggtcaaggtttgaggctcagtcaggggactcaagggggaggaattctaagaatctgagaatcttggaaggcttggatgatgggaaggtaaggaagatttctaggccagagagaattgttagggaaattgtttcagagtctatacctgtcatggcattgacaattcaggagcttactgatgatgtcatagcatcaactaaggaatacttgaggaatctcattgagaagcccgagaagaaagaggaactggtaagcctccagaaccggctcgagagaagatctgaccttactaaggagagtctttcaaagtgccataaagtgcaattagaggttttagtggctgtcaagatggggcttgctagcttcctatctaataaaattcaattgtctgagatggtagaggttttcttgtttaagaggtgtaggaatgtaacctgcaagcatttgcttcctgttgatgattgtgactgcaagatttgctcaggaaacaagggcttttgcagttcttgcatgtgtcctgtctgtttgaactttgattgtgcaagcaacacttgtagttggattggatgtgatgtttgttcacattggtgccatgctacttgtggtattcagaagaatcttatcaagcctgggcctagcttgaaggggccttcagggacctcagagatgcagtttcattgtattggctgtggacatgcctcggaaatgtttggttttgttaaggacgtgtttgtgtgttgtgctaaggattggggtcttgaaaccttgatgaaagagcttgactgtgtaaggaagatcttcaggggaagtgaagattgcaaagggaaggaattgcatgttaagactgatgacatgctattaaagcttcaaactaaaatgatatctcctttggatgcctgcaattacatcatgcagttcttcagctatattttcatcttagcattggcattttgcactgaagtacttcatgagataggaagcaatggaatgccattagttcttgagaattgcagtggtgggagaaactggaaagatgcgtatataactgttacttatgcagacagcatgtcagactttcatacttctggtatttcttcaaaggatttgccagcctctcaatctaaccttacaaaggatacaccatctctttcaaaacctaattctctattaccagaatatggttatgacatgggctattctaggtcacatcctgatgccatgtcaagtgatctacttcagaaagacctcaaagcttccatcttaagtgaactgaaaaatgaggctgatttccatttgggggctttattaaggaaaggtggacttgaaagtttggagagcattgtgaggataaaggaggcagaagccagaatgttccaaaccaaggcagatgaagcaagaagagaggcagaagggttccagaggatgatcaggacgaagactgcgcagatggaagaagagtacgccgaaaagctttccaaactctgcttgcatgagaccgaggaaacgcagaggaagaaattggatgaactgaaagtcttggaaaattcctattttgattactataaaatgaaaaagagaatgcaagatgagattgatggtttattgcggagaatggaggcaacaaagcagcaatgggtttaa

SEQ ID NO: 16506 - DNA, 294 bp, Glycine max
  Peptide Sequence Number=SeqID_133284
gtattattagggcaccaaatccctaagataggtggtatgatgaatgtgttgagtggtgcaaccctctttcgaaatcacccatgcacccaacacctttatgattcgtgtaagaatagggactcattaggtagtgatcaaggggttcccatagacgttaagagaataaaggtcatttctgagtggcccactcccactccaccaagaggggtgtgtgtagctaagctcaagcatctcatctcaaggagctatgctctaacttctcaaggaagtttctcaaggaagcttctcaaggag

SEQ ID NO: 16507 - DNA, 1380 bp, Glycine max
  Peptide Sequence Number=SeqID_133285
atgcaaagtattgaaagggatcttcaaactcaacaacccaaaatacaaagggttgacatacatatgcggaaaaaccaaaactttgccaagtatttttctcctaggatgctatcaattggtcccatccaccatggcaaggagaatctcaggctaggagagcattacaagcttatttggacagcaatgtatttgaaggaaagcaaacaaaaccctgaagatctatgtcaaaaaattgaactacacattgaagaagtgaagggtttttacactaaggaagcaattggagactacaatgacaacgacctcgtgtggatgttgtttgtggacggatgttctgtccttcaaatcatgcaaaaattggacgcagtgcatccaaaaaaactgaggattaaatttgaccagcaagagcatgtgatcatggatttgcatttattggagaaccaagttccatacaaagttctcgagcttttgagcaacaatgatgaggccatgttactgcactccatgttcaacctcggatttgatggctttctaagttatattgtctatgattccttaatcccattcaatgatagtgaatcttgggcaaaaatcttcgaaaagcttctctcagacgaagatctaccacaagcgaagcgcaaaccaaatcatgtacttgattttgtgcgcttaatgttcttgaaaattgattataaagatcttatggtgaacaagagtaagcaagagaatgaaatcccaaaaaaaggtgatggtgaacataagatagatgtcaaaggtcgtcatagttcatggctaacatataaaaacataagggaactcaaagcagctggaattcaagtgcgaaagaatgagacactatgcttgaataatgtctcttttgtctccaagtggttttctggagagttgacacttccttggtttcatgttgatgagttgttcttttacatctacttaaacatgatagcatacgagaagtgcccagattttcattataactacgatatatgctcctacttggccttcttagacactcttgttgatgatgcaaatgatctgaaggagctgagattggcaggggtgtgtcaaaacacgcttgggagtgatgaagaagtggccaaactcttgaattctatagggactgaattggccagcaaagaattctgcttgctcagcactggaatgatggcttataatgagaaatacactcgagtcagagatgaaattaaaaagcattgtaataccaagtggaaaacatggatggctcaagtttataacacacatttcagcaatccttggtctatatgtgccttcttggctgcagcactagcacttgtgctcactgctatccaaacttggctggcctttctctccaataattga

SEQ ID NO: 16508 - DNA, 291 bp, Glycine max
  Peptide Sequence Number=SeqID_133286
atgaagctggtcgaggacaacaagagcttggaggaccaggtacttgctctgaccatcgaggctaaagggttagagactcgagctgctaatgctgaggctttggttaagtctcgtgaggacacgggggtctttgacatcaataaagatgtctatgatgggaagctggtgctgatagatgacatctcgaaagacgctgcctctaccctagagaggctgatgaccctagcagaggactttcacgctaaagatgccgatgcagaggatgaagaccacacacgacctagggaatga

SEQ ID NO: 16509 - DNA, 393 bp, Glycine max
  Peptide Sequence Number=SeqID_133287
atggggcacaagaaagttttggctcttataatgtttgttatggcttatggtttgggaacaacaacattctctactgtatctcaacatcttcctgcaaaatgcaatgggtatgaaccattaattgacacttgtaagcctgatttgactgctccaggatctggggtccatccaactctcgaatgttgtgtcttagcaaattacgcgtttacaattgccatgcaaaataatggtagaggtgtaggaaatatgtgtgattgtttacagtttgctaccaaaacattacactatgacccatataaaattataggacttcccggtgcatgcaacattaaaactgatattcctattgccatatgtatattttggccaaatgatgagtcaagtgataattaa

SEQ ID NO: 16510 - DNA, 540 bp, Glycine max
  Peptide Sequence Number=SeqID_133288
atgcgaccaaatacaagaaaaacaagaactttgatggaacgtgatcaagttcaacatcaaccaatgcaaaaggaaattggaataaatcttatccaccttgccaacattgcggaaagaaaggacatcctccattcatatgttggaaaagacccgatgctaagtgcagtgagtgtaatcaaatggggcatgaagctattatttgcaaaaataggaatcaaccacatagtgaagctgcaaaggctgctgatctggagaaggagtacttgtttgctgctacatgttttttctaatattgaatcaagtcaaaatcgacttattgacagtggttgtactaatcacatgacaaacaacaaagatttattcaaggaactgagcaatataagcacattgaaggttcgagttggagatgacaagttcatcactatgaatggaaagggaactacaacaatctcaaccaacaaagatgaagaagacaatgatattctcaaagtaaaaatgagagaaaaaagttttgctttaaatccattggaggagaaataa

SEQ ID NO: 16511 - DNA, 492 bp, Glycine max
  Peptide Sequence Number=SeqID_133289
atgcctccaatgccaaaggcatggaaatctaatacatcggtcggtcaaagagttacatccaatggtttccccttagtcgttgctatttggacattgaacattcttgggccctttcccacaactccagggaaaaggaaatttctgctagtagcggttgattatttcacaaaatgggttgaggtcgaaccactaacaaacatcatggcctatgccatcaaaaagttcttttggaagaacatcattacatgttttgaaattccgaatacgctgcaccctcaagccaatggacaagccaaggcaactaacaaggtaattctggaagagttgaagaagtggctggatggagccaaaggaagatgggccaaagagcttgcgaaggtcctattagcaaataagtgcaccccacaatctataacccaggagactcattttcgccttacctatgggacaaacatgatgttgtcgatcgaggtagaagaagtctctctctga

SEQ ID NO: 16512 - DNA, 462 bp, Glycine max
  Peptide Sequence Number=SeqID_133290
atggggatattctataagaagggaggggcagaagacttgtttgctttcacagattctgattatgcaggagatgaggaagattctaaaagtacatctggttatgttttcttattgagttcaagagcaatgtcatggatgtccaagaagcaaccaatcattactctctcaactattgaagcagagtttgttgctcctacggtcagtagtgcttgtcaagctgtgtggatgagaagagttttgagaaacttaaatcatgctcaagaagttatgtatggcaagagcaagcatattagagtgggttttcattttttaagagatcttgtaaaagatggagaaatcgagttggcacactgtggaactcaggagcaggttgcagatttgatgactaaagccttaaaacttgaggccttccagaagcttagaaagaagatgggaatgcttgatctcactgaagtagactaa

SEQ ID NO: 16513 - DNA, 522 bp, Glycine max
  Peptide Sequence Number=SeqID_133291
atggggtactctcaacaacatggaatcgattttattgaagttttcgcccctgatgcatgcatggatacggtaaggatgattgtggcactagcagcatgcaagggatggaacatatttcagttagatgtcaaatctgcattccttcatggagagttgagagaggacgtgtacattgaacaacccaagggatatgtgaagaaagggaaagagcacaacatttacaagctacataaagccttgtacggccttagacaagcaccaagagcctggttcagccgtatagagtctcattttgtgaagaaaggatttcaaaaatgtccaaatgaacaaactttgttcatcaaaagaggcacgaaagataacatattaattgttagcatctatgttgacgatttgatttatgctggtaatgacaagggtatgatgattgagttcaagcagtctatgatgcaagcttttgacatgactggtctaggaaagatgagattctttcttggcattgaagttttgaagaaatcataa

SEQ ID NO: 16514 - DNA, 156 bp, Glycine max
  Peptide Sequence Number=SeqID_133292
atggaaataatagaaaggaggcagccggcttggatgggagaatttgtgaatggtgaggggttgagtgaagaagaagcagaggcctacatggtgcaagatgttgtaggtgacgatccaactcagtttgaggaagctatgaagcatgagaaatggtga

SEQ ID NO: 16515 - DNA, 477 bp, Glycine max
  Peptide Sequence Number=SeqID_133293
atggtcattcaagagtgcaaagagatatatgagaattcacttgttgatggaagacctccaaaggcaggctccacattctaccttgaactttgcttctctgccatagcctatgagcccaacatcactcacaaagtcaccaaccattgcgacgtcatccaactctccctaagcgttaccttccgcgcggtgaagcacaactacttcatcatgaagaaactcctaaccaaacaggacctaatgaaacatgtccatgattgtctcgaaatcatagacgaaaccttcaacaagctaagagaaacacataatgaccttgaactttaccctaacatgaaaactctataccagcatgccaatgatcttaaaatcctcattagcgttgccataacaaaccaggtcatgtgcctcgatggtttctctcacgatgacacagacaaacacatgagagagacaaacctcaaagagaaagcgaggttgtga

SEQ ID NO: 16516 - DNA, 1044 bp, Glycine max
  Peptide Sequence Number=SeqID_133294
gtaactggatgggtggttgaataccaagataatctgattgggcttggagtcgatgagtctctagcccaagtgtgttctgagagtggtgcaatggatcctcttatgaattcttatgttgagagaatgcaagctacgactaggaaatggtacctgaatattttggaggctgatagaacacagccccctaagaaaactgaagatgggaagctatataccccagctgctgttgatctcttcaggatacttggtgagcaagtacaaattgttcgggataatagcactgatctcatgttatacagaattgccttggcaaccattcaggtgatgattgattttcaagcagctgaaaagaagagactagaagaaccagcttctgaaattggtctggaacctttatgtgctatgattaacaacaatttgcgctgctatgaccttgcaatggagctaagtaatagcaccatagaagcccttccacagaactacgctgagcaggttaattttgaagatacctgtaagggatttcttgaggtagctaaggaagctgtgcatcaaactgtcagtgtgatatttgaagatcctggtgtccaggagttactggtgaagctatatcagaaagaatggagtgaggggcaggttactgagtacttggttgcaacatttggtgactattttggtgatgtaaaaattttgttgaggaaaactaagtttcgaccatccatatattcaaggtacattgaagaacgatcttttaggagatttgttgaagcctgcctggaagaaacagtggttgtttatgttgatcatcttttaacacagaaaaattacattaaggaagaaactattgaacggatgaggctagatgaggaggttatcatggacttttttagggaacatatcagtgtttctaaagttgaaaacagagtgagtgtacttagcgacttgagggagcttgcttcagcagagagcctggatacctttacactcatctatacaaatatactcgaacatcaacctgactgcccggtaaaattatgcccaatctaa

SEQ ID NO: 16517 - DNA, 2476 bp, Glycine max
  Peptide Sequence Number=SeqID_133295
atgttgtttgaagacgaagagtcgaagacagagagtgcaatgctaatcatgtcgaaaagcatagcaacgttgaccacttatccaacatatcatagtcacagaaacaaatcaaactatgcaaaatctccgaattgtttcatcctcttcagacaatcttggtcaacatttctgttaccttcgaatatggacctttcttgcggtagcagtgttggtgtctctgcgactttgtccgagacaacccacaacaacgtaaccgtggacaaaaatgcaaagatttgcaagttctgcgaaatgggtgatctcagaaacgccatgaaattgctctcaaggtcacaaaggtctgaacttgagttgaatacttactgttctgtgttgcagctctgtgctgagcttaagtctttggaagatggaaagagggttcattccattatcagttccaatggcatggcaattgatgaggttttgggggctaaactagtcttcatgtatgtgaattgtggtgatttggttaaagggagacgaatatttgatggtatcctcaatgataagattttcctctggaatcttttgatgtctgaatatgcaaagatcggtaattacagggaaagtgtgggtctttttgagaaaatgcaggagttgggaattagaggggattcttatacatttacttgtgtcttgaagggttttgctgcatcggcaaaggtgagggagtgcaaaagggttcatgggtatgttctaaaactgggttttggttcttataatgctgttgttaactctctaattgcagcttattttaaatgtggtgaagttgaaagtgcacgtattttgtttgatgaattgagtgacagagatgttgtttcctggaattctatgattagtgggtgtactatgaatggcttttccagaaatggacttgagtttttcatccagatgctgaatttgggggttgatgtggattcagccaccttggttaacgttcttgtggcttgtgcaaatgttggcaaccttacactgggtagagctcttcatgcttatggagtgaaagctggttttagcgggggtgtcatgtttaacaacaccttactagacatgtattctaaatgtggtaatttgaatggtgcaaatgaagtttttgtgaagatgggtgaaacaactatagtttcttggacttcaatcatagctgctcatgttcgagaaggtctacattacgaggctattggattatttgatgaaatgcaaagcaaaggtcttaggcctgatatttatgctgtcacaagcgttgttcatgcttgtgcttgtagcaactccttggataaaggaagggaggtacacaatcacattaaaaagaacaacatggggtcaaacttgccggtttctaatgctctcatgaatatgtatgcaaaatgtggaagtatggaagaagctaatttaattttctctcaacttccagtcaagaacattgtctcttggaatacgatgattggaggttattcacaaaactcacttcccaatgaagctctacaactgtttctggacatgcaaaaacaattgaagcctgatgacgttacaatggcttgtgtccttccagcttgtgcaggcttagcagctctagagaaaggcagagagatacatgggcacatattgagaaaagggtacttttcagatttacatgtagcctgtgcacttgttgatatgtacgtgaaatgtgggttactagttcttgcacaacaactgtttgatatgattcctaaaaaggatatgatcttgtggactgttatgatagctggatatggcatgcatgggtttggaaaggaggcaatttccacatttgaaaagatgagggttgctggtattgagcctgaagagtcttccttcacttccatcctttatgcttgcactcattctggattactgaaagagggatggaaactctttgattccatgaaaagtgaatgcaacattgagcccaagttagaacactatgcatgtatggtggatctccttatccgctctggaaatctatccagggcatacaagttcattgaaactatgccaattaaaccagatgctgcaatttggggtgccttgctttctgggtgcaggatacatcatgatgtggagctagcagaaaaagtggcagagcatatttttgagcttgagccagagaacacaaggtattatgttcttctagcgaatgtctatgcagaggctgaaaagtgggaagaagtgaaaaagatacaaagaaggataagtaagggtggattaaaaaacgatcaaggctgtagttggatagaggtccaaggaaagtttaatatcttttttgctggtgatacttcacaccctcaggccaaaatgatagactcattgcttagaaaattgacaatgaaaatgaataggggaggttactctaataagattaagtatgcattgattaatgcagatgataggctgaaggaagtgcttctatgtgcacaca

SEQ ID NO: 16518 - DNA, 750 bp, Glycine max
  Peptide Sequence Number=SeqID_133296
atggaccaagcaataagcaaaggcagtggtgagattttgaatcatgttgatgaaagggtggatgaggatttgaaccaattggttgaaggaaaagcaattgatgcaggagctggacatagcttgggtgaaggagttagtgtaagtggagaagatgggacttcagaagagatgtgcaatgatcttagattgaagaaagagctaaaggagggacctcaagaagttaatgatcagaacatgggtgacccacaagaaattaatgatacattgcatggggttgatcaaggaactagttatagttcaagagatttggttagtggggaagtacctgagacttgtgttgttatagatccttttactcagattgagtgtgtcaatggagataataggaaattggaagcaaaacctaaggaatcagggttgaacaaggtgtccatgaaagtgacaaaaggggtgtctgagactgataaaaattcatgtgtgattgatataaaccgtggcagctgtgatggctttagcgagaatttggaaggtgaaatgatttgtaggatttgccatctggcctctgggcaacgattggaagcagcagatgttggcactgcaagtagtgctactactaatacagatttgattcagctcggttgtgcatgtaaagatgagctagggattgtgcatagtcattgtgctgaggcatggttcaagcttaaaggaaacagttttttgttaatgcctgcaacgttgaacatgccctga

SEQ ID NO: 16519 - DNA, 3087 bp, Glycine max
  Peptide Sequence Number=SeqID_133297
atgcaatcggcgcaaaacctggcgctgcgcatcaaacaggatatcgataaccacagcggtaaggtctcggcgcaggggcaactgaccgtacaaggggccgctgacggcgagcacgctggcaccatcaataacaccggcggcgaatggctggcgggccaggcgctgactatcgccgcccgcagccttgataacgtccaggcggggcaactctacagccagaagcagctgcggctcaatttgaacggcgggctcgacaaccgcggcgggaaaatacagagcggcgatgcgctggcgcttgatgcgcaggcgctgaataatgccggtgggacgatagacggccagcaacgcgtggcgctgcgcattcttggtttgctggaaaataccggcggtgcagtgcgcagcaatggcgggcaagaggtgtcggccgccggtatcaataatacacgcggcgtattcagcagccgcggcggcatcacggtggcatcaaagcaactggacaataccggtggtacgctcatcagtcagggggcgggcacctaccgactcgaccggcttaacaatcagcatggcaaggtgcacagcggcgacgcgctcacgcttgagggggcgcaggtcaacaaccggggtgggcaattggtgtcaacccacgggctggcgctcaaggccgggacgctcgataacagcggtcagggcacgctcagcagccaggcggaactggatgtgcaggccgagcgcctgaacaatcgcgatggcgggttgatactgggcaccacgcgcaccgatatcacctctcgtgatatcgacaataccgcaggccgcctgcagagtagcggccagatgaccctctcgggggtaacgcagctggacaaccgccaggggcggatcctggccaacggcaacctcaatatcaatactgaccggtcacggaccgactcgccgctggcgctgctcaaccagggcgggcgcgtggagagcgccgggcaacttaccttgcatgcgcgtaccttggataatcagaacggtaccctgctggggctgcaggcgctgacgctgtccgcgcagcaggactacacccatcaggccggcgaaacgatcagcagtaacggtacggtgacgttctccctgagcggcgcctttaccaacctggcggattggttgctgcccggcaagctggcgctcaatgcggccagcatcaccaatccggcggcgctggtgggcaaaacgctgcagctgacgaccggagccttgcaaaacaccgggcgccttgaggcagacagcatgacgctgaacgtcgataccctggacaacgccgcggcgctgatgggcgacgacatcaccgtgaacgggcgcattatcgacaaccacggtgcgcctgcggtgatggcggcgacccacagcctgacggtgcaggccggtgagcggctgaccaaccgggagggagcgctgatttacagcgccgaccgtctgcacctgcacagcgatgacctgattgaaaaccgggccagctttatcgaagcggacggtgacgccaccgtggaagcgcgtcgcctgaacaacctgcgcgaagggctggtgattgagcgtaacgccgagaagagcgactacaaatggcaccgctacaactactactggcgctcctacggttcaaaggtcaatcccgataaaagcaccctggcgccgaccacccagcagctgacctatcaggatgacgcggcggcgcaaaccaaccgctacggcacactgctggccattgatgtggcgggcaagcgcgcacaggtgcgggtcaaggacaataagggccaattgaccgacctgtgggtcaactacctggcgctcaagccgaatgccgatggcagctatgcggtgacgttctatgaaacgcgtgggggcaatcagctggcgaccatcccgacgccttatcaaaacggcttccattgggagcacgactggacgcaggtgatgacctgggatcccgaaaagcatgtcgatatcgacagcgcgccgttcatcaccgattacaacaacttccgcgaacgtaccgagagcggcacggtgacgcgcgacaagctggtgagtgaggggatcggcgcgcgtattctggctggcggcaacatggtgctgcgcatcacgggagcgttgctcaatgacgccagcgtcattaccgccaacggcaatctgacgcaagacggcggcggcagcgtggacaaccgcggttactcggttaatgagcggcgccaggcggctatcgttgaccattatgacaaggacacgcatcactggtaccccacgttcaaccgggacgaaaccacggcgctggcgaccgttgacggggtgatcaccggcaatggcacggtcaccatcaacggagcccgcatcaccaacaccacggtcaatcaggcgcaaatcagtcaacttgatgcggcgttaaaggcggtggatgccgaacgcgccgagcttgagcgcaatccgctggccttcacggtagagggcgctgcccgacctgacggcgatacgacgctggcgccgggcgagcaaatgacaagaccgggcgacacgccgtcctcgccgctggggcgtccactgctgccgtctgagctggcgctgacgcagttacagcacctgggcaatgtggccaccgccatccccaataacggcttgtttagtcagcatacggcgaccggcagcccgttcctggtggtgaccgatgaacgctttacccgccgcgacaactttatcagcagcgactatatgctagaacgcgtagggtatgaccccgcgcaggcccataagcgcctgggcgacggcttttacgagcagcgtctggtgcgcgagcaggtgctggcgctgaccggcaaaccgtccgtcaagggctgggatgcgatggagcagtatcagcaactgatgaacaacggcagtaaagtcgcccaggacttccatctggtgccgggcgtggccctgacgccggagcaaattgcagcgttgcaacaggatatcgtctggctggtgagcgagacggtgcaaacggaaggcggcccgcaaacggtgtgggtgccgaaggtgtatctggcacagatacgctgcgcctga

SEQ ID NO: 16520 - DNA, 351 bp, Glycine max
  Peptide Sequence Number=SeqID_133298
atggctatcgacaatgatgaatgtattgttgcgattgtagtggacggaggtgacggacatggagtgctagctagattggatgttgaagtttacacagatcaagagaaattcgttgtggccgtagagggtcttgatgtagttgcctccagtggtgtcccatatacggagggtacaatcatcagagtggagtcgaaggaccaagatagtttggagatgtccttagagtggcccatgaaatggtggaggagggaaatgatgacaaaggaccacaatttcacatgtgagggacagggttttgttgacggaggccaacactttggggcttccatcattggagaacttcacacatga

SEQ ID NO: 16521 - DNA, 930 bp, Glycine max
  Peptide Sequence Number=SeqID_133299
atggtgaacattcttctcaagaaagtccttcaagaaggaatgaaccatttggtttttatcacatatcgtctctcagttgctactatatttctggcccccatcggctactttaaggaaagggcatccgtcacacaatacttcttccttctggggatccaatacacctcagccacctttgcttgtgcctttgttaatatggtcccggtgatcacattcattatggcattaccatttggattagaaactgtgaacattaaatgcaaaggtgggaaagcgaagattcttggtacatttgtgtgcataggaggggcattgttgttgacactttacaaaggaaaacccttgtttgatgggtctcactatcaatctgcaatggaccaagcttcttctactactagatcaacacagaaatggaccatcggtgtaatagctttgattatgggaacccttttttggtctttttggtttattttacagtcaaagatagggaagagatatccttgccagtattcaagcacagccatcatgaccttctttggagccatgcaagcagctattcttggtttctccactggcagcagcaacttgtcctcgtgggttctcaaggataagatacaaataatcaccgttctttattctgggatagttgggtcaagtgtgtgctatgtgggcatgtcatggtgcgtaaagaagaggggtccggtctttactgctgcattcagccctcttgttcagataatgtcgggcatgattgatatccccttcttgcacgagcagcttcatcttggaagtgtggtgggatccatgttggtgatgatcgggttgtacattcttctgtggggcaaaagcaaggatatgatgcagaataatggcgccactaagttcgcccaagaagttgaagaaaccaaggaacaggagccgcaagtataa

SEQ ID NO: 16522 - DNA, 945 bp, Glycine max
  Peptide Sequence Number=SeqID_133300
atggcggagaaggatgtgccgaagcttaagctgaaacctcgaagactcaagggtcacgacgacagcacaacctgctgcattgcctcacgtgaacgctctcatctgattgtcacttccggcgatgccgccgcccaatggaagccattggagaattataattataacaaagaggagataaacaaggttgtatgcaactcaaagtcctcatttgttgctgcagcagacgataatggtgaagttaagttgaccgtgcctggtctctccctccaaatccctcactcattcccttcctgccttcttatccttgttctccctaacaggttctttctttcctccaactaccctgccatgtgtgcagctacatttgatgtgagtagtggcattgctggccggtgtgtcaatcctgcttttgttcatgcaatagctgttccagaagttgacatgctagataaattagacaaaatatgcgctgctgcaaggggcgatggagctattgatgtgattaatattgaaacagaaatggctgctacaaaatcaaaaagctcttcaaattcacgaaaaggatcacactcaagatcaaaagatggtagttcatctagcaatacagacgcagatcaaaatggaaaaaagaggttgcatttgaattacactttgggtggccatactgcagctgtttccagcctggcattttcattgtttggggaaagagggaaattcttgatatctggaggaaatgataagttggtgaagatatggaattggtcctgttatccagatgtagggttaagtgacgacaataacaataatatcctacatttgaacattgaagtatctcgaaaagtcaattggctgtgtaccacctcagctgatacagacaaccttgttgtgtgtgacacatctaaagtagtaaaggaatatggaaaagggttttgtaatgcattttaa

SEQ ID NO: 16523 - DNA, 2925 bp, Glycine max
  Peptide Sequence Number=SeqID_133301
atggtgcagtctagtgttcccctctgcaacacttgtggggaacaagtgggacttaatgataatggggaagtgtttgtggcttgtcatgaatgcaatttcccaatttgcaaggattgttttgagcatgagatcaatgaggaccatagggtctgcatgaggtgtggcactccctatgaagagagaacaaaggaggaggatgatttccatgagataaaggttcacgaaaatgaggatgatgatttccatgagataaaggttcatgaaaatcaatccgcaacaccttccgaaatcagtaactctcaggatgttggactccatgctagacatgtcagtacagtatccgcagtcgatagtgaagtaaatgaagaatctggaaaatcaatctggaaaaatagagtggaaagctggaagggaaaggataaaaagaacaagaagaaaaagtctgcacccaaggaagaaaaggaggcctcaattcctccagagcagcagatggaagaaacacggcccgcagaggctgctgctgcaccactttcagtagttattccaatgtcaaaatccaaaattgcaccgtacagaactgtgataatcatgcgattgataatattgggacttttcttccattatcgagttacaaacccagttgaaagtgcttttcctctttggttgacttctatcatctgtgagatctggtttgcattttcctgggtgctagatcagttccctaaatggagtcctatcaataggcaaacttttattgacaatttgtctgcaaggtttgaaagagagggtgaacccaatgaacttgctgctgttgatttctttgtcagtacagtggatcctttgaaagagccaccattgatcacagctaatacagtgctttctatccttgcggttgactatccagtagataaagtatcctgttatgtgtcagatgatggtgctgcaatgctcacatttgaatctcttgtggagactgctgactttgcaaggaagtgggtgccattttgcaagaagttttcaattgaaccaagagcaccagagttttacttctctcagaagattgattacctgaaggacaaggtgcaaccttcttttgtgaaggagcgtagagcaatgaagagagactatgaagagtataaagtacgagttaatgctatggtagctaaggctcagaaaacaccagaagaaggatggaccatgcaagatggtacaccttggccgggaaataactcacgtgatcaccctggcatgattcaggtttttcttgggcacactggtgcccgtgacatagaaggaaatgaacttcccagattggtttatgtttccagagagaaaagaccaggttaccaacatcacaagaaagctggtgctgaaaatgcactggtgagagtgtctgcagttctcacaaatgctcccttcattctcaatcttgattgtgatcattatgttaacaacagcaaggccgttcgggaagcaatgtgttttctcatggatccagaagttggtagagatgtgtgttatgtgcagttcccccagagatttgacggtattgatcgcagtgatcgatatgccaatcgcaacacagttttctttgatgttaacatgaaaggacttgatggcattcaaggaccagtatatgtgggaactggatgtgttttcaatagacaagcactttatggctatagccctccttctatgcccagcgtaccaagatcttcatgctgttgcttcccctcaaagaagtccaccaacgatgtctcagactttcaaagaaacgcaaagagggaagaacttgaggccgccatttttaatctcaaggaacttgacaattacgatgagcatgagaggtcaatgcttatttcacaaatgagctttgaaaaaacttttggcttgtctactgttttcattgaatcaacactaatggagaatggaggagtgcctgaatctgcagatccctcgatgctgatcaaggaggccattcatattggttggatttatggttcagtcactgaggatatcttatcggggttcaagatgcaatgtcgaggatggaagtcaatatactgcatgcccttgaggcctgcattcaaagggtctgcacctatcaacttgtctgatagattgcaccaagtccttcgatgggcccttggatcaattgaaattttcctaagtaggcactgccccctctggtatggattttctggaggccgtctcaaatggctacaaagaatggcttatataaacaccattgtctaccctttcacatcccttcctctcattgcttactgttctctgcctgcaatttgcctcctcacaggaaaatttatcataccaacgctttccaacgttgcaagtgttctctttcttggacttttcctctcaattataataaccagtgtgctggagctgcgttggagtggtgttagtatcgaagatctgtggcgtaatgagcagttctgggttattggaggtgtttcagcccatctgtttgccgtgttccaaggacttcttaagatgttggctggtgttgacaccaacttcactgtcactgctaaggctgcagaggacagtgagtttggggaactttaccttgtaaagtggaccactctcttgattcctccaacaacccttatcgttgttaacatggttggtgttgttgctggattctctgatgcacttaatggagggtatgagtcttggggacccctctttgggaaagttttctttgctttctgggtgatttttcatctctatccattcctcaaaggtctcatgggtcgccaaaaccgcacaccgaccattgttattctctggtcagtgttgttggcctctgtcttctctcttatttgggtcaagataaatccatttgtcaacacagttgacagtgaaaccatcgccgagacctgcattgccatagattgttaa

SEQ ID NO: 16524 - DNA, 627 bp, Glycine max
  Peptide Sequence Number=SeqID_133302
atggtactttctctctctacattagggttttcttcagcactttcgcgcctaaacttcttcccaaagccaccaccttctcttttctccgcactcaccactttccgcagaaaccaacttccactcaaatcgtcgctcgccgcatcgaaacgtgacggcgatgttgtcgttttgggcatcgaaaccagctgcgacgataccgccgctgctgtcgtgagaagtgacggtgaaattctcagccaagtagtgtcttctcaggcagacctgcttgcgaaatatggaggtgttgctccaaaaatggcagaagaagctcactcaaaagttatagaccaggttgtgcaagaagcccttgataaagcttatctgaccgagaaggatcttactgctgttgctgttactattggtcctggtttgagtctctgccttcgtgggggacacaatttactcgttcttgctcgtgatcttgggcagtacatacaacttggaactacgatagatgatgctatcggtgaggcatatgacaagacagcaaaatggctcggactggatttgaggagaagtggtggtcctgctattgagaagcttgctatggagggtaatgctgaatcagtcaagttttctgtaagttag

SEQ ID NO: 16525 - DNA, 1809 bp, Glycine max
  Peptide Sequence Number=SeqID_133303
atggcacataagacccttgtttcatggactacaatagttttgggatatgccagatttggttttctagatgttgctcgggagcttttgtataaaattccagagaagagtgttgtgccttggaatgcaatcattagtggctgcgtccaagctaagaatagtaaagaggcattgcatctattcaatgaaatgaaaattaggaaaatagaacctgataaagtggccatggttaactgcctatctgcatgctcacaactaggagctcttgatgtaggaatatggattcaccattatattgaaagacacaatttttctctagacgttgccttggggactgcactagttgacatgtatgcaaagtgcagcaatattgcaagggctgcccaggttttccaagagattcctcaaagaaattgtttgacctggacagccatcatttgtggtttagcacttcatgggaatgcccgtgatgctatatcctatttctcaaaaatgattcatagtggcttaaaacctaatgagatcacgtttcttggtgtcttatctgcttgttgccatggaggaagggctggtcatttggaggaagcagaagagcttattagaaatatgccgatagaggcagatgctgctgtatggggtgctttattctttgcttttcgtgttcatcgcaatgttctaataggagagagggaagctttgaagcttcttgagatggatcctcaagatagtgatatttatgttttgtttgccagcttgtacagtgaggcaaaaatgtggaaggaggcaagagatgcaaggaaaataatgaaggaaagaggagtagagaagactcctggttgcagctcaattgagatcaattgcattgtgtatgagttcatggcgagggatgtgttacatccacagtctgaatggatttatgactacctggtttcgttgacaaaacaactagagcttattgtgtttacacatgatattcctgagcaattcagagctggagtcaaaaaaggccatcagtatatcacggtcaaagtgaacaatatgggttcgcacaaagagttgcctagaactgcccaaattcaccttgtgagttcgcaccaagaggtttatgaaccatgtgatgattcttttgcactggttgatgctcttctagctgaccgcaataacctgttggaacatcgtccaacattgtgcatggagataggctgtggtagcggatatgtcattacttcccttgctcttctccttgggcaggaaggttgtggcatcaactacattgcaactgatatcaaccctcatgcagtgagggtaacccatgagaccttggaagcacatggtgttggtgctgagttgatagtaacagatattgcatcggggctagaggaccggcttgctgggttggttgatgttatagttgtgaaccctccttacgtgcctacccctgaagatgaagtgggtgttgaaggtattatgtcatcttgggccggtggggagaacggccggagtgtaattgataaaattttgcccgttgcagaccgtcttttgtctgaaaagggatggctatacatggtcacccttacagctaacaatccttctgagatatgccatcaaatgagaaagaaagggtatgcttctaagattgttgtccaaagatccacagaggaagaaagtcttcatatcatcaagttctggcgggatttcgatactgaagcaaatgaaactgaccaatctgcttctgggttcataagcttcatgcttacacaaatccctctactttcatattggagaggcaccaatagcaacaataagagctga

SEQ ID NO: 16526 - DNA, 249 bp, Glycine max
  Peptide Sequence Number=SeqID_133304
atggaagtgggtatgcttccaatctcagcttcaaagagaggaaaactcttggctgctggttacaccactctcgatgccattgctcgtgcctcccccacccaccttgctcgagatattgatgtttctgagagtgaagccacggaaattctgaatcttgcaagcaaacctagtgctttggagagaccgaatgggtctcacactgctgttgttggtggtatgtgttgtgttggttccaatttgggtatttag

SEQ ID NO: 16527 - DNA, 701 bp, Glycine max
  Peptide Sequence Number=SeqID_133305
gtggtcagactgcctgggatatgctcaatgatgaaaagttttcttcttacattaccacatcttgtgcagatctggataacatccttggtggaggaattaagtgcaaagaagtcactgaaataggtggagttccaggcattggtaaaacacaaattgggattcaacttgcggtaaatgttcagattccacaagaatatggtggcctaggagggaaggcaatatacatcgacacagaaggaagctttatggttgaacgtgttctacaaattgctgaagcatgcatagaagatatggcagaatacagccggcactttcataaggattttcaagcttgtgatgttaaaatgcaccctaataatatcttggaaaatatattctattttcgtgtttgcagctacactgagcaaattgctttgataaattacttggacaaattcatcacagagaataaagatgtaaagatcctcattgttgacagtgttactttccacttccgccaagactttgatgatatggctctcaggactcgattactcagtgaaatggctttgaagttgatgaagcttgcaaaaaaattccgtttggctgtaagaatcaatttattctacttgccagtggtgttttgtactgaactagtcattgatagcattagcagccaaatcatgttgatgcaatttgtttggactttggatcaagtgtaa

SEQ ID NO: 16528 - DNA, 1299 bp, Glycine max
  Peptide Sequence Number=SeqID_133306
atggcccaagtgagcagagtgcacaatcttgctcaaagcactcaaattttcggtcattcttccaatcccaacgaacccaaatcggcgaattcggtttcattgaggccacgcctttggggtccctcgaaatctcgcatcttggtgcacaaaactggaagccttatgggaaattttaatgcggggaagggaaattccggcatgtttaaggtttctgcctccgtcgccgccgccgcagagaagccttcgacggcgccggagatcgtgttggaacctatcaaagacatctcgggtaccatcacattgccagggtctaagtctctgtccaatcgaattttgcttcttgctgctctctctgagggaacaactgttgtagacaacttgctgtacagcgaggatattcattacatgcttggtgcattaaggacccttggactgcgtgtggaagacgaccaaacaaccaaacaagcaattgtggaaggctgtgggggattgtttcccactattaaagaatctaaagatgaaatcaatttattccttggaaatgctggtactgcgatgcgtcctttgacagcagctgtagttgctgcaggtggaaatgcaagctacgtacttgatggagtgccccgaatgagagagaggccaattggggatttggttgctggtcttaagcagctcggtgcagatgttgattgctttcttggcacaaactgtccacctgttcgtgtaaatgggaagggaggacttcctggcggaaaggtgaaactgtctggatcaattagcagtcaatacctaactgctttgcttatggcagctcctttagctcttggcgacgtggaaattgagattgttgataaactgatttctgttccatatgttgaaatgactctgaagttgatggagcgttttggagtttctgtggaacacagtggtaattgggataagttcttggtccatggaggtcaaaagtctcctggcaatgcttttgttgaaggtgatgcttcaagtgccagttacttcctagctggtgcagcagttactggtgggactatcactgttaatggctgtggcacaaacagtttacagaatcaaattcttgaggaagccttcaagaactacatcatgatgttccctgtgcaaaacaggttcgccgacaaaagagaacatctacaagttcctttacacatgccaaaaattcctcaactgaacaattgccaagagtcatgttgcgaatttcaggttggagttgacgaaatttggtgcgtgtatgattctggaaatgagcatgaagttttttcctaa

SEQ ID NO: 16529 - DNA, 1097 bp, Glycine max
  Peptide Sequence Number=SeqID_133307
gtgaggttccatctcttttgggaaagaattccatactagataggttggatcttagttataataatctcacagcattatatttcgcaagatgcttttctaaaaccaaatttgaaggaggattagcaaagaatggagacttgttttctgtatggaactatgatggcaaagttgcatttgaagacatcattgaagcaactgaagactttcacatcaagtactgcattgggactggtgcatatggaagtgtctatagagttcaattgccgactggcaaaattgttgcagtgaagaaacttcaccaaatggaagctcaaaatccatcttttgacaaaagtttccgcaatgaggtcaagatgctaaccgaaatatgccatagaaacattgtaaagcttcatggtttttgcctacataatcggtgtatgtttctagtctatcaatacatggaaagtggtagcttattttatgccttgaataatgatgtggaagctcaggagttgaattggagcaagagggtgaacatcattaaaggaatggcaaatgctttgtcctacatgcatcatgattgtacaccacccattattcatcgagatgtaacaagtagcaatgttttattgaactcacacttgcaggcttttgtctcagactttggcacagctagactccttgatcctgattcttcaaatcaaacattagtagttggcacatacggatatattgccccagagcttgcttacacattgactgtatcagaaaaatgtgatgtttttagttttggggttgtggcattagaaacattaatgggaagacatccaggagagttcatctcgtctttatcaaattcatcaactcaaaacatattactgaaggacctcttggattcacgtcttcctcttcctgtttttccaaaagatgctcaagatataatgcttgtggtagcactagcattggcttgcttgtgtttccaaccaaagtctagaccatcaatgcaacaagtggctcaagaactctgtgcttcgaaactacccccacctctgcctttctataaaatttcaattgctcagttgatgactccagatatattattgtctttcatttga

SEQ ID NO: 16530 - DNA, 231 bp, Glycine max
  Peptide Sequence Number=SeqID_133308
atggaggacaagaaaaagaaacgactggaggaagcaacccgatctggcagcactcacacaatcgttgatcctccatctctcattagacaacatgtgaagtggatggcccgcacgaaaaaatctggtcaaatgacgactgaggcaacaaagaaaattgcatataaaattgattcccgaaagagtaggcctcaaagggaagctttgtcgctcaaggacgtcaggatgtactga

SEQ ID NO: 16531 - DNA, 939 bp, Glycine max
  Peptide Sequence Number=SeqID_133309
atgtcacttgtaatcccctcatcctctgcagctcctttgcatttttctcaattggagactaacaattttaattcccaccaaaagtttgcctctaatttcttctccccttttcaaaatagagtgggcttgggttgtaaatcaaggcatataaggacttacttgagaaatgaactaaatgttcttcataagtgcaattatatacaaaagaaacgcgacaattttacatctggagtattgcactaccttggagagggctgctgcaatgggattgcgtgttacaaaagccactttccaaatggcactcctgttcagatatctatagatgtgaccaagaagaaaaaattgaggcttgatgggatcataaaaactgtcatcactcttctttgcaataggtatctggatgctaagcatcgcaagtaccgttgcatacttattcacctgactgagttatcgaatatcttcctgcataattattttaatgtttcatcattttatgaggtagccaatagtgcaaatatagcagtttcagtcaagtattgtgcgccatctgctgagagcatattctctgagttctcacttttactcactgacaaaccccttgaagaaccagagactattgacaagggtgttatatttggggaagacaaacttacaacctctggaaacagtggtgaggatgatgacgacgatgcacttattgacatggatgatcaactatattttcctccagaacagaaacaaatagacatttcgaagaacataagggacagggtgcatcttgagattacaatgaactcagtatatggtcctgggtgcaagggcatgtgcctgaaatgtggtcaaaactttaacactggcaattgcaattgtagcaagcaggaagtacaagaaaaaagctttggcccacttggaaatttgaaagagaagatgcagttgtaa

SEQ ID NO: 16532 - DNA, 492 bp, Glycine max
  Peptide Sequence Number=SeqID_133310
atggatttgtcacgggttgcacaaagccttgacactctctggttctacaccaacatcttgacctgtagagatcagcctgaacccgaagcctcattgattgatcaatttgcacctttagtccatttcaaagagtgtcccaagagagatttgctgaaacccattaccccattgcaacatgagtctcagaatgtggagaattcgagtccaagatgtcacaaatttgaagaagtgaaggccatggtaccaacaagtaaggaaacaaagaagagagagaggagaaaaagaaggaagtggcacaaattggggatatatggaaccaatgtggttcatggagggcctgatttgaggtttgattattttgatatgtttaaggaggagtcacgggaatatcagattcagtggcaaactaagatgcctccgtttgatgatgttgtggcaatgaaacaacatctcaagtcatgggcttatgcagttgcgtgcactgtcagataa

SEQ ID NO: 16533 - DNA, 177 bp, Glycine max
  Peptide Sequence Number=SeqID_133311
atgaaagtgcaacagcctgaggcaatactttgtaaattgaaagccaagggtggtcttggaaacaaagagatatttcaactaaattattatgagaatgaagacattatgggtggcagtctgacagaaaatttcataggagaagcgcacgaatgtcaaagaacctctggaagtaggtag

SEQ ID NO: 16534 - DNA, 153 bp, Glycine max
  Peptide Sequence Number=SeqID_133312
atgaaagaaaaagatgggagtagacctcgtttggttactggtgagaaagggtggttgagaattgaattgggatttaaattcacgggtgagagaaaacgggagtgctgtgactgtgaagctgacgagagattgaatcaatgtctgtattattaa

SEQ ID NO: 16535 - DNA, 261 bp, Glycine max
  Peptide Sequence Number=SeqID_133313
atggcaagaatccaagacacatcactccattcaccacctataaataccctgcctgagttaagtactcacaaatcacaatatatatcattcacattcactaaagaggaagatgaagccaagagaacctcccttgccaagagtaccgttctacgcttatacaagctaaagctcgcactggaaactgtcaaaagacagtatgaaaacctattagccaccagaagagagtgcgttaggctattgaaccatgtcaaagagagcaag

SEQ ID NO: 16536 - DNA, 953 bp, Glycine max
  Peptide Sequence Number=SeqID_133314
atgcagcaggtccgcaagctggccgtcggcccgaccctggtcaagaccgatcgtccgctcgaccaggccgaatccgagcagctgatgcgcaagttggccgccgacccgaacgtggaatacgttgaagtcgaccagatcatgcgcgccacgctgatcccgaacgacacccgcttcagcgagcaatggggcttcggcacctcaaatgccggcatcaacatccggccggcctgggacaaggccaccggcaccggcgtggtggtggcggtgatcgataccggcatcaccaaccatgccgatctcaacgccaacatcctgccgggctatgacttcatcagcgacgccgcgatggcgcgtgacggcaacggccgcgacaacaacccgaacgatgagggcgactggtacggcgccaacgagtgtggctcgggcatcccggccgccaactccagctggcacggcacccacgttgccggcaccgtggcggcggtgaccaacaacagtaccggcgtggcaggtaccgcgttcaatgccaaggtcgtgccggtgcgcgtgctcggcaagtgcggcggctacacctccgacatcgccgatgcgatcgtgtgggcgtccggtggcaccgtcagcggcgtaccggccaacgccaatccggccgaagtcatcaacctctcgctgggcggcggtggcagctgctcgaccacctaccagaacgcgatcgacggcgcggtcggccgtggcaccaccgtggtggtcgccgccggcaactgcaacaccaacgtgtcctcgtcggtgccggccaactgcccgaacgtgatcgcggtggcggcgaccacctcagccggtgcacgtgccagcttctccaactacggtaccggcatcgacatttcggcaccgggccagagcatcctgtccaccctcaacaccggcaccaccaggccgggcagcgcgacctacgcgtc

SEQ ID NO: 16537 - DNA, 480 bp, Glycine max
  Peptide Sequence Number=SeqID_133315
atggtcattcccaagttcaaggtgccagactttgacgaatacaagggaactacttgccccaagaaccatctaaagatgtattgtcagaagatgagggcatacgcaaaagatgagaaactactaatacatttcttccaagaaagtcttactggggtagctgttacttggtacgctaacttggaaccttcccgagtccattcttggagggacctaatggttgccttcattaagcagtatcagtacaattttgatatggcttcggataggatgcaactatggaatctgtgcaaaaaaaagagcatgtacgcccaaaggtggagggatctggcagctcaagtagcgcccccaataatagagaaagagattatcacaatgatagtagacacgttactggtgttttactatgaaaaatggtgggttacacaccttcaagttttacagatttggtcttcaccagcgaaaggatcgaagtgggtctga

SEQ ID NO: 16538 - DNA, 660 bp, Glycine max
  Peptide Sequence Number=SeqID_133316
atggcatccttcagccaccttcaatcgcagatgcaatctcagggagttgcagtgcctcctgagcctgtggttggtcctagtccctcccggtcctcgagaaacgatcctgagaccggtgactctgacaggtgcggcttgtacatagaagcagatcctgcacgcctggttgccatcgggagagtttatgagggatccactgttgttcataacacccttttgttgcctggccaagtaaaggtgagtgtggaggaggttagagatgcagatgctccagttcctgtacccactgatgaggtttccttagtggggcaggcacttcacaccttccttgcttggccgacacatctggtcaagtctttatcacagcaggttagatgggatgccaccgtgttcggggtcgttaatccagatttccccctgtacataaagcacgaagacctctccaaaatcgcacacggtggtcaatgtctcagcatatcagtgttacagttgtggattctgcatctcactgaaacatgtatgcgagcggggaattttgatatctatgcattcctcgagcctcagtccattcagaggtctgggcaatcgccgtttgaatttgaaagttccactgcagcggacactggcagatggtggtcatcctacccaaggaacacttag

SEQ ID NO: 16539 - DNA, 367 bp, Glycine max
  Peptide Sequence Number=SeqID_133317
atggaagagggatatgctgcttctgaaaatcagaattaccattgggcaggttcatttgcagatgaggaggatgttgctgtcatttgcctcacaagtttttcaagggaaggttacggaagggcctcaactgtttgttgtttctggggtgttgctgttgttgttgttgctactggattggtggaggaacgaggtctgttgcaatgtgcccttcacgggcgagcgaaggcgaggctcacgggtgcgctttccaaaggaggaaagatgcgcggagtcgccaccaacgaaggtattagcacctctcacgtcgacaaaagcggggcttttgctcctacgcaccctccatcgaggaggaaatcagaccttcgtg

SEQ ID NO: 16540 - DNA, 318 bp, Glycine max
  Peptide Sequence Number=SeqID_133318
atgactatgcaaaacatgcagtttcaaaaagaaaccagagcctccattgagagcttaactaatcaaatgggacaattggctacacaattaaatcaacaacaatcccagaattctgacagattaccttctcaatctgtccagaatcccaaaaatgagagtgccattaaattaaggtcgggaaagcagtgtgaatcatccactggtaattctgattttcagaagcagcatatccctcttccattccctccaagagcaatttccaaccaaaaaatggaagaggcagagaaagagatattggaaacatttagaaaagtagag

SEQ ID NO: 16541 - DNA, 939 bp, Glycine max
  Peptide Sequence Number=SeqID_133319
atggaaccagaattggccatgatactttacacttatagaacagtctttgatgtgccatcaggattaccccctagcagaactcacaatcattcaatcccattggttgaaggtgctggaccagaagggattattgcccctagcagaagccctttttcacctccaatcattcttgtcaagaagaaggatggcacttggatattttgcacagattacagggccttgaatgccatcacaatcaaagatagctttcctattcccactgttgatgaactaattgatgaactacatggggcagtatatttctcaaatcttgatttgagatctggttatcaccaaatactagtaaatgaggaggacaggcataaaacagctttcaggacacatcaagggcattatgaatggcttgtcatgccatttgggctcactattgcccctgctacatttcagtctctcatgaatgaggtatttcagtgctatttaaggaaatttgtactagtcctatttgatgacatacttatatacagtccaaactggtcagctcatttacaacatttggaaacagtgctgaaagtgttagaacaacataagttgtatgccaaattatccaaatgttcatttgggttacaagagatcgattacttgggccacacagtatcaggcaagggagtaacaatggatcaagaaaaggctcaagcagtcctgaattggccatatcctataaatctgaagcaattgagaggcttcctcggtctgactggatactacaggaaatttatcaaaggttatgtgtcaatcgcaactcctttatccaatctgttgaagaagaaaaaccttcattggaatgaccacacttccatggcttttgacaatttgaaagctgcaattaccaaggcaccagtactggcattgcctgatttttccaaagcctttacattttaa

SEQ ID NO: 16542 - DNA, 231 bp, Glycine max
  Peptide Sequence Number=SeqID_133320
atggcatcttgcgacaaacagaagatcgctttagtgatgatgcaaatgacttatggtggtcccagttcatcaagctgtttgaagcaaaattgccatggagacgttatctaccattcaccggcctatggtgatgagaatcctgaaactgaccaaatacaggctaaaagcccaagtggagaaggacaaagtccccgagtggagaaggatgaagccccaagtggagaaagatga

SEQ ID NO: 16543 - DNA, 796 bp, Glycine max
  Peptide Sequence Number=SeqID_133321
taccctcgtcttcagagggctgcacgtcctcaccattagaggactacacgtcctcgccatcagagggctacacgccctcgccttcgtagggctacacgccctcacctttcgaggactacatgtcctcaccttccgaggactacacgtcctcaccttcaaagggctacacgccctcaccttcagaggactgcacatcctccacttcagaggactacacgtcctcgccttcagaggactacacgtcctcgcctttagaggactacatgtcctcgccatcagaggactacacgtcctcgccatcagagggctacacgccctcgccttcatagggctacacgccctcacctttagaggactacacgtcctcatcttcagaggactacatgccctcgccttcgccttcgtagggctagacgccctcacctttagaggactacacgtcctcaccttcagaggactacacttcctcaccttcatagggcaacacaccctcacctttagaggactagacgtcctcgccttcagaggactacatgtcctcaccatcagagggctgcacgcccttgccttcagaggactacatgtcctcaccttcagaggactatacgtcctcgccttcaaagggtcatgtaccttcgcctttgtagggctacacgccctcaccttcagaggactacacgtcctcgccttcaaagggtcatgtaccttcgccattgtagggctacacgccctcaccttcagaggactacacgtcctcgccatcataggactacactccctcgccttcaaaaggtga

SEQ ID NO: 16544 - DNA, 930 bp, Glycine max
  Peptide Sequence Number=SeqID_133322
atgagtgcttcgataaccgccggcgaaagccgcgacaacggcctgcaggccatctggaatcgtctgcgcgccaacccgaaaattccgttgctggtcgccgcctccgccgcgatcgccatcgttgtcgcgctgctgttgtgggtgaaaagccctgactaccgcgtgctgtacagcaatctgaacgaccgcgacggtggcgccatcgtcacccagctgacgcagatgaatatcccttaccgcttcgccgagaatggcgcagcgctgctgatcccggcggaaaaggtgcatgaaacccgcctgcgcctcgcgcagcaagggctgccgaagggcggcgccgtcggcttcgaactgctggatcaggaagaattcggcatcagccaattcagcgaacagatcaactatcagcgcgcccttgagggcgagctgtcgcgcactatcgaatcgctggggccggtgcaaaacgcccgcgttcacctagcgctgcctaaaccttcgctgttcgtgcgcgaacagaaatccccttccgcgtcggtgacgctgaccctgcaacccggccgtgcgctggacgacggccagatcaacgccatcgtttatatggtgtcgagcagcgtcgccggcctgccgccgggcaacgtgaccgtggtcgatcaggccgggcgcctgctgacgcagtccgacggcaccgggcgcgatctcaacgcctcgcagctgaaatacgccaacgaagtggaaaacggcttccagcgccgcatcgaagcgatcctcgccccggtggtcggcagcgccaacgtgcgtgcgcaggtcacggcacagatcgacttcgccactcgcgaacaaaccgatgaacagtaccagccgaaccagcagccggacaaagccgctatccgctctcagcaaaccagcctgagcgagcagatcggcgggccacag

SEQ ID NO: 16545 - DNA, 204 bp, Glycine max
  Peptide Sequence Number=SeqID_133323
atggcctcttatggtgtggcgtctcctttctctcctccttctccattccgctgccattcatcttccaagaagcaaagaaatccattgatgaagaagatcctaggcctacaagctccaatgaagcttacaccaactaggcttgagaacatagaaactaggctatcccttagtaaccttctcaacccgaatcaggatgaagcgtag

SEQ ID NO: 16546 - DNA, 273 bp, Glycine max
  Peptide Sequence Number=SeqID_133324
atggaagcttgcttgtggggctcctatggaggctggatctttgagcttcaattaggtcctttaatggtgattttccaccatggagatgtagcggaagacaaaggagaagaggctcatgagaaccctagggccttcccttggatctctggcccaatttacttggagtcttctatccaattcccttacgaggtaggattgcatcattccctccaccttggaaaggatttgacgtcaaatcctgaggttcttcatgtagacaaaggatcaagctga

SEQ ID NO: 16547 - DNA, 141 bp, Glycine max
  Peptide Sequence Number=SeqID_133325
atgtcgttcaccgagggaaagataggtataaataaaatggctccaaagaaactctccacgaagaggtctagaagagacgccacaggagaaggatccagtgctgcctcagagtttgatagtcattgtttcccggagtgctga

SEQ ID NO: 16548 - DNA, 303 bp, Glycine max
  Peptide Sequence Number=SeqID_133326
atggaagccaatgtggttgcagttgctgctacaagcgttgttgctaaggaaaacccgatgcccccatctggcctcaaccaaatgaatcatccaacctcagctatgcgtacactcccagtgaggatgacaataactccgctcccatactcattgagagccgacaacctcgtcatgtacatgtctctcaacccatgggggaggcacatgaaaattctccaccacaatctagccgacttcgagccttgcctcggatatgccactgaagggcaagcagttggtggtatacccctgcaaaacacttag

SEQ ID NO: 16549 - DNA, 376 bp, Glycine max
  Peptide Sequence Number=SeqID_133327
atgagcgatgcactcaaggcattgaacaatcttcgtacgctgcgtgctgaagcacgtaatattgaggttgcggtattaaacgaaatgctggagaagtttgccgtggtggtcgccgaacgccgcgaagagacggctgcagagagtgctgcacagcgcgaaaaagaagagaagctggcgttatataaagagatgctgcgcaaagacggcattacaattaatgaactggcgcaattaaaccagggtgaaacgaagagcaaagcaaaacgtgcaccccgtccggcgaagtataaatttaccgacgaacagggtaatgagaaattctggaccggtcagggtcgtactccctcgccgataaagtcagcgattgacgctggcg

SEQ ID NO: 16550 - DNA, 897 bp, Glycine max
  Peptide Sequence Number=SeqID_133328
ggcaaggagctgtggcggttcgatccaagggtgaaggatgcttctattccctataccgctgcctgtcgcggtgtgagctattacgagcagcccagcacgccgaccgttgctgatgcggcattggccgatgtcgccgctgatctggcgctgccggaaccgccgcccagcatcacccgcaatgttgcaccgggcagtcgtccggcatgctgggcgcgcatcatcgaaggcacgctggatgggcgcatcatcgcggtggatgcggacagtggccgcccgtgcgcgaatttcggcaacaacggccaggtcgacatcaccctgggcatgggcgaagtgccgccgggctatgtgtcgatcacctcgccgccggccatcgtgcgcggcgtgatcgtgaccggtcatcaggtgctcgacggacagcgccgcgatgcgccctcgggcgtgatccaggcctacgatgccatcaccggcaagctgcgctgggcatgggacatggaccagcccgagcgcagcggcttgccgccgcgcgagcagacctatacgcgcggcacacccaacatgtggaccaccgccaccggtgatgaagcactggggctgtggctcgcgcacggagagccagaaccgctatgcaacctcgctggtggcgatcgacgtggccaccggcaagccggtctggcatttccaggcggccagcctgatcgactacccgacggcggcgggcaaggtgccggcgatcctgttgccgaccaagcagggcgacctctatatcctcgatcgccgcaacggccagctgctgaccgccgccgaagagcgcaaggtgccggtcggcggcgtcgaacccgagcagcgttcacccacccagctgttttcgctgtaccacacgctgcgccgcgaacatga

SEQ ID NO: 16551 - DNA, 450 bp, Glycine max
  Peptide Sequence Number=SeqID_133329
atgaccgagcctctcgatgagtcgatctctttctttctcataaaggtggacccttgggtactagtacctatcacctttagaggaccttatgttctcgccatcagaggactgcacatcctcgtctgcagagggttgcacaccctcgcatttagagggctacacgtcctcattttcattcttgggccaccccctgatattggagggcgaccaactgtgcgagcacatccagagagggaggctatcacgcatctactatgcataccggggcaagatttaacccgtgccactgcaaaaagacgagtgcggatcatgcgcaccaacatgactactcttacatggttatggatgacgttgctatttagtaacattctgcccagcgaccacaatgccaatccccccctacagatggatcagttgggatcgcgcccacaagacgcccagtggacttga

SEQ ID NO: 16552 - DNA, 231 bp, Glycine max
  Peptide Sequence Number=SeqID_133330
atggccggacacgattggccattggattttttgtttcctacttacaggtacatatggacggatgcaagtggggatagggtcacgaccgaccgatcgttgccccttcccggcgctaaacaagcagagaacgtcgctgcaaggcagcccagttcaagtgggcaaacgctagcccataaggaaggaggagacatggttaatgttcccctcaaaaaaaaaaaaggtacaggttag

SEQ ID NO: 16553 - DNA, 201 bp, Glycine max
  Peptide Sequence Number=SeqID_133331
atgtcccttgttgtcaaggacaatcgagggaaatgggccccaaactacgaagggccttttgttgtgaaaagggttttttccggaggagccctgatgcttaccaacatggatggcgaagagctaccttcgcctgtacttaggaacggatgcaattggggatggggtcatgaccgactgatcgtcgccccttctctgcgctaa

SEQ ID NO: 16554 - DNA, 261 bp, Glycine max
  Peptide Sequence Number=SeqID_133332
atgacagatcttgtaagtgcggaagacgatgtaaatctccgcgtgtcaacgggcttgtcggccgcgattgacgaagggtgcggaatgaccataatttgtctctatgtgccatcggacacgactgtgtctgaatggcaaaagaggtgcggaataaccataatttgtctccgcatgtcatcgggcccgccgcctctggatgacaaaagggtgcagaatgaccaaaatttgtctctgcgtgccatcggacacgactgtgtctga

SEQ ID NO: 16555 - DNA, 256 bp, Glycine max
  Peptide Sequence Number=SeqID_133333
atggtgggagcaggtttgaaaaaggatcttagagtgtctagggttgtgccaggagggtctcttaatgccttcctttttcttctcatcggagttatttcacaaagacttgccatggaatctattgattctctcccaattggttggactgtaggtgcgatgatttacttcacgggcgaggtctctgctcagttggtagagctccgctcttgcaattgggtcgttgcgataacgggttggatgtctaatagtccaggcg

SEQ ID NO: 16556 - DNA, 213 bp, Glycine max
  Peptide Sequence Number=SeqID_133334
atgtcattgcctagcgctgttcatgtgttctccattatcaagtgcgaagcttgttgtgactgggaagcacgttattctgttgttttccagatcggttccttcgccaaaagaaaaaaagaagaagtagagatgagagtcgtcatcgcgaaaagggcaggacggacgaaatcagtgtcctatctttgctttcctcttatctccgatgagaggtaa

SEQ ID NO: 16557 - DNA, 456 bp, Glycine max
  Peptide Sequence Number=SeqID_133335
atggccgttaccaccacccatgatatgccgacgctgcgcggctggtggcaaagtgacgatttgcggctgggcagtgctctcggactgtaccccgatcgggcgattctcgctggcctgtatcgcgatcggcgcctggccaaacaggcgttgctgcgtacgctgttgcgaagcggtgatttgccgccgcgccgccgcttccggcgggccagcgtccgcatgagtcatcagcttagtcaggcgatccatcgctatctggcccgcagccagtgtgcactgctcggtttgcagccggaagagtggctggatatggcactgccggtcaacgtgccgggcaccgtcgatcagtatcccaactggcgacgtaagctaagcgtaacgctggaagcgatggcggaggatgacagaatcgatgcgttgctgacggcggtacaatcacgtcagcgccagcgtaactag

SEQ ID NO: 16558 - DNA, 207 bp, Glycine max
  Peptide Sequence Number=SeqID_133336
atgttgagcttagctcatcagtgggctaagcgcgcatccaccgccaagtgtagcttcagcgcacttagcgcaatagaggaatctggcagaacatcaatttcaaggctgcgcactaagcgcgagatcagtgcactaagcgcagtagttgtcttcagccaggctcagcgaaagactggcgctaagctcaaatccagttactcgcgctaa

SEQ ID NO: 16559 - DNA, 207 bp, Glycine max
  Peptide Sequence Number=SeqID_133337
atggatacctcaaagccctacattggggcaatgaaaggcaccatgcataaacctcaagcgaacctaggggctgattataagttctcacccaataggttccctgctacaaggtcatggcaaaacaaaacgattggtacctcaaagccttacactggggcaatgagaggcaccatgcataaacctcaagcgaacctaggagcagattag

SEQ ID NO: 16560 - DNA, 810 bp, Glycine max
  Peptide Sequence Number=SeqID_133338
atggcgcgtggccgctctcgaactgaagcgaatcaacggccagcggcatgttctcttggtcaggactacacttggactcgtgagggtgcgcactgtacatcatcgcacgcagcactgccgaaacgcgtaagaggagttacggcaattattctcgaggttgcgaaccgcagcggttggggtggcgttcctgtgagaaagcgagacgttaaacgcagcgttgcaggtaagcgacgtgatttggtggagtctgatgccgcagaagcagagaatagcgtcgcacgtggcgttgggctgagggattcggatgttgcgggagagaagcgaatcctggagcgagttgacgcatttttgggagtcgtcgggcatcatcggaaggtcggcggaggacggaggaggggcggcggagacatcaagagcggtgcgggcgtgagcggcgaagagccaggcggcgaggacggggcagcagcggctccggtcgaggtccttgccgcaggcatccttgacgccgccgaagagctcgtcggagaggtcgaggcggcaggaaaggcggggacagtgttggagcccggttcgagaggctggttggggtcgctcaccggttcggagagtaaaccggcacgagaaaaaggaaatgaaaaagggggaggaagatggggatgggttgaaaaaatgataacttggaaagggaagagaggaggtgctaaaatcgagacagcgcgggctggtttgggtaaaaaggttaggattttctggcgtttgctttggaccctgccggtagtggtgtttctctcactgctttgtgctctttga

SEQ ID NO: 16561 - DNA, 1113 bp, Glycine max
  Peptide Sequence Number=SeqID_133339
atggtgaatttaccaagtaataagaaagccatagaagtgaagtgggttttcaaaaccaaagtcaagtcatctggtgaaattgccaagtataaggcaaggctagttgcaaaaggtttcttgcaaaagcctggtcttgatttcaatgaagtatatgcccctatagctagaattgaaactgtgagactcatagttgcaattgctagcatgaggaaatggacaatgagtcagctagatgtgaagtatgcttttctcaatggtccattagaagaagaagtatactcaaggcaaccaccgggctatgagaagataggcatggaagatagggactatggagtaactggtgtagtgatgctatgcttgtatgtggatgatcttcttgtcacaggtgatagcaaacaagagattgacaagtttaagaaggaaatgatggatgattttgaaatgtctgatataggcataatagcttatttcctaggtatggaatttgtgacacctaagagtggcatattccttcacctaaagaaatatgcaactgatatattgaaaaggccagatattacctatggagttggcttggttagtagattcatggagaaaccttgcaaggatcatctacttacacctaagagaattcttagatatgtgaagggcacactggaatgtggaattctatttcctgcagcaaaagaaaattctgagacagaaattgttggttacacagatgtagattggagtggagatgttggtgatagaaagagcacatccagttgtgaagctgagtatatcttagctgcttttggttcaagccaagccctctggctaggaatgttactggaagagcttaacatcaagtgcagtaatgtaatgaagctcaggattgataacaaatcagccatagaccttgctaagcatccaatagttcatggatgcagtaagcatatagaggtaaaatatcattttcttcatgaccaagttaacaagaataaactagctcttgagtattgtagaactgaggagcagtgtgtagatatgctaaccaaagctttgaagcctaagagacttgaagaaatgaagaacaaaattggaatgcacaaattgacaaatttgaattaa

SEQ ID NO: 16562 - DNA, 207 bp, Glycine max
  Peptide Sequence Number=SeqID_133340
atggagtgcccgtcatccccagcaaggtcatcaggcctcctactaaccgagctttcatcaagaagtattgcgcctccagacaggcagagggcgagacaccccaacagcctggggatggccaacaacaggcaacaaaggcatcgtcgccacctccagagcccctcagctcatccacaaaaaggttacagtattgcctacgacacatga

SEQ ID NO: 16563 - DNA, 252 bp, Glycine max
  Peptide Sequence Number=SeqID_133341
atgtggggcatcccttttatccttgagccaaaccaaaccctgacatgtatcatgtctagccattctacaaccttgagccaaaatcctggctcaccacaaaccttcacccagggtgagaatgtcaatccttaccctcggaagcaaaaaaggagaaggaaaatttccaatcaaagagaaagcaaaaaagaggggaaaggaaattcccaatcaaagagtgggagaaagcgaaaagaaaagaaagaaaattcctaa

SEQ ID NO: 16564 - DNA, 471 bp, Glycine max
  Peptide Sequence Number=SeqID_133342
atgcagcgactaaaaaccaaggagactccaagcttcaattcctatgcattgtatgcatatgatactgtttggttagtagcccgtgctcttgatgcttttgtcaaaaaaggtagtgttgtatctttctcctctgaccctaagttgctcgaaacaaatggaagcatgttgcatttacaatcgcttcgtgttttttatgatgaccctttgtttcttgagacaattttgagcaccaatttctctggtctgactggaacagctcactttgatattgaaaggaatagaaatcatccagcatatgatatgttgaatattggtggatctggaatgcgcagaattggttattggtctaattactcaggtctctcagttgtgactccagaaattttgtataagaaaccacctaacacttcaacaagaggttgggtgttccccaacaatggaaagccactgagaatagaagttcctaactga

SEQ ID NO: 16565 - DNA, 645 bp, Glycine max
  Peptide Sequence Number=SeqID_133343
atgacattgaccatcccagagcttttcttgaggccttatcaggttagatgggatgtcaccatgttcagggtctttaatccagatttccccctctacataaagcacgaagacctctccgaaatcgcacacggtgggaattctgatatctatggattcctcgagccacagtccattcagaggtctgggcaatcgcagtttgagtctaaaagttacataaagagttggatgcagagttcacaacacgatgtctatcttggagcctacctaaatgggttccactgcagcggacactggcagatgatggtcattctgcccaaggaacacctagttgtttggttttgttcattgcataacaggccagacaactaccttaaggggattattaatagtgctttaaaaggtcttgatgatgctccacagcctaaatcaaagggtcctgctaggtggattgtcatcaagtgtaatagacaaaaaggaagtactgagtgcggctactatgtgatgcactggatgtccaccatcattttaggaacttttatgaataattgggaagcgtattttaacgatcctagaccattggagctagagagattaaaggcattgcggatccagtgggcacagttttatctccgagttagagattag

SEQ ID NO: 16566 - DNA, 246 bp, Glycine max
  Peptide Sequence Number=SeqID_133344
atgaaggatttccagaagaatgaatggatcaaattcgtgggagcttttgcaaatgttgaagctaaagccaatcaaatctatacaacagttcgcaacccaagttttcaagttttgaccattggaatttgcaaaatacgacctctggacatcttgtttagtgagacaagcgcgctaagcgcaattgcacacagagaagataattcgctcagcgagatcaatgtgctaagtgagatctgtagattgtaa

SEQ ID NO: 16567 - DNA, 402 bp, Glycine max
  Peptide Sequence Number=SeqID_133345
atggagagaagtatgatagatgctgccagtggtggagcccttggagacatgactcctgctaaagccagaaatttaattgagaagatggcttccaactctcagcagtttagcgccagaaatgatgccatagtcattagaggagtgcatgaggtagctacaaactcagctgcatcatctgagactaagaagcttgaaggcaaactggatgcattggttaacttggtaacccagctggccttgaatcagaaatctgtacctattgcaagggtttgtggtgaatcttccactggtaattctgatttacagaagcagcatatccctcttccattcactccaagagcaatttcaaacaaaaaatggaagaggcagagaaggagatcttggaaacatttagataagtag

SEQ ID NO: 16568 - DNA, 429 bp, Glycine max
  Peptide Sequence Number=SeqID_133346
aaaaagcgcgaaaatgacgccagactagatgcccagaaacaggcacatatctttctgctcgagaaagcccaaactgctcaacatgaagtcgaacgtctcaccaaagaggcgaaagaaggatcttctgagatcaaagcctgtgatgataacatctcttcctgggaggcaactattatggatttgctgtctcaggttgatgatttaaggcagaaaattgtgacagagcaggccaaacgcaaggaactccaggagaaggccgctcactcgattcagaaactgattgctgaaaaagggagggaaggcctgaaggcctttagcgcatctcaagctgtagcagatgaggcaagagttatggagggtgctgaccaggtcttaactaaagaaatggccaccttgaagaagctatatgaggatttgatcatgacttag

SEQ ID NO: 16569 - DNA, 612 bp, Glycine max
  Peptide Sequence Number=SeqID_133347
atggaggccatgaaagagaaaatcgccacaatgagggaggccatgatgagcatgaagaacataatggaagccaatgcggttacagttgccgctaccagggctgttactaaggtgaacccgatgcccccatctgatctcaaccaaatgaatcatccaacctcagatatggtggacaaagatttgggaagtacggacggccccatgaagtgcaagcacgccttcccgtcatatggctcgcctcccaaggaggatgtcaataactccgctcccatactcattgaaagccgacaacctcatcatgcacatgaaatgccccaccacaatctagcggactttgagccttgcctcggatatgccactgaagggcaagcagttggtggtatacccatgccaaacactttgaaggggcctcagtttcgcccacaaccaccacccttgcattttgcggtgggaagagcccctcctgctatggctgaaaagggaaagttggatcatatagaggaaatgctcaaggacattgaaggaggtgaagattatgcctttgctaacctagaagagttgttcctagtacctgaacgtggtcattcccaagttcaaggtgctggactttga

SEQ ID NO: 16570 - DNA, 259 bp, Glycine max
  Peptide Sequence Number=SeqID_133348
aagtgctaaagttgatgtcttgctaagcgagctcaatgcacgtaacaagagtcatccattaagcgaggcatcaacgcgcttagcggataggaggaatctggaagggaatctgtcacgcaggcatgcgctcagggcgtcatcagctcgctcagcgagtcgtttgtcaccttccaagcttagcacgagtttggcgctgagcgaaaattcacttactcgcactaagtgcgagaatggcgctaagcgcaacgtaagagcttga

SEQ ID NO: 16571 - DNA, 600 bp, Glycine max
  Peptide Sequence Number=SeqID_133349
atgaccgaaaggcttcttgccggatcattggcattcgaatgccgcatcatgcactacttgattgtgcgcattctactccctagatcttccaaccttgcacaggttttcttaactgatcgtcaaatcgactgggcccatcttgtgagatatcgtatgcataaggcattgcgatcaaatgctccactcccatatccccatctgatcaccttgtttctacaacgttttaatgtccctcttgactctgagccatttgtcaaagtcaagagatccttctctatcagtgcgaatgtagtctcttcttttggataccgcaaagagagaggtggttcttgggtgaagaaagacgctccagtacaagccgcagaagatcgctctccttcaccacctcctcagagagatgattcttcatctcttatgcacaacatacttgacagattggatggactccacactttcgtcggagagcactttgactcgctgaatagccgtattgatgtcatggatgcacgatttgcagggatggacactcgtatcaccaaacttgaggaagatgttagttatgttcgacaattctttgaccttccaccaccatcctcatag

SEQ ID NO: 16572 - DNA, 120 bp, Glycine max
  Peptide Sequence Number=SeqID_133350
atgtctgttaaccctgacccgggaagtcaggtggcagacgggggtttttactttcgtcatccggagacattcaagtttgacgacgcacgagattcttctctgctaggcggggacgattga

SEQ ID NO: 16573 - DNA, 219 bp, Glycine max
  Peptide Sequence Number=SeqID_133351
atgagcaccagagcggagatgaaggatggggcgcagtttgacgttttgcgcagggggatcatttatactgaggtgcttggctgggttgacatggggcatgctcggggtagtgatattatggagcttaaaagccagtttatcgcgggggagcgtagcggtaagccttcctacatagtgatgtatcggcaggatatgcactttgtgaaattcaattcataa

SEQ ID NO: 16574 - DNA, 840 bp, Glycine max
  Peptide Sequence Number=SeqID_133352
atggcaaaagtggtcaagatctcagaacatgagctagacaggttgaagcaaaatagaaatgaggtagttgggataccgaggaagcgcttggaggagaaagcaaaagctttggcaaatcaaagggagtggacctcgttcattgacatattagcgttgttggtgtttgggactatactatttccaaatgtagatgatctagtggacctagcagcgatcaatgcctatcttgcttatcaccatagcaaggaaagcccggtcatcgtcgttttggaagatacatatgatacactcgacttgaggtgcgagaagagtagtgcaagaattgtttgttgtacgcctgctctttatgtgtggttggtctcccatgttctttgtcatgaaagtaggtctgtctatcctctacaaggtcatcgcatgtgccccaaaaatagaaaagcaaattgggaagaactcttagcaggtatgagaatccgtaaagcatggaatatagtggaaaggaaagataaggagctcaggggaagtagcaatggtgccatcaacagctatcataagtggttgaagtctaggacgcaagagataaattggctcccaaagctaaaaggcctaagtgggaaagaagctgaagtccctgaggaaagcaaagaagtgcaagctttgaaggtagagctcgaaaaaacaagagtggtcaaggagaagctaaagacggaagtcactagggtcaagaaagagtgtgatgtgctgagagatgtcaacatgactacagtcaaagcattagagtgggaaacaaaaagagcccgacaggaagaatggagcaggaacatgttccgaggggctctatga

SEQ ID NO: 16575 - DNA, 642 bp, Glycine max
  Peptide Sequence Number=SeqID_133353
atggaaactgcagttcagtttttgaattatagttgcagactgcagaggatgatgatgacgtggatccttatcctagtgtggcgtaacggtgctttggctggttcccttgaaacggtttctttcgggtgggacatgtggaatgtggcaaaatcaatagagagcttaatctatcaatcaatagccaatccaaatgaccctagaaggaaggagctagagctgatggagaagcaaaagtggatgattgatgaaaaggccaaggcccaggtccgagctgagctttattttgggctgggcttcttgacagtccagaccctcgggttcatgaggctcactttctgggaactaagctgggatgtgatggagcccatatgcttctttgttacctcattcggcttcgctcttgcttatcttttcttcctcaagacctccacagaacccacctttcagggcttcttccatcaccggtttaaggccaagcaagagcgtctcatgaagacacacaactttgacatgagtaggtacaacgagttatttaaggcatgctatacaaattatcatggtggtgccaaatttgaatcttcttatcccttccactaccctggggagacacatctaactgatctaagagccttgcatcgttga

SEQ ID NO: 16576 - DNA, 414 bp, Glycine max
  Peptide Sequence Number=SeqID_133354
atggaaaagatatgtaacaagctagatgcatatatatgctccaacttgaggattcgcgagccgcgacacgaaagcgagacaaatttgagagaatggacggaaaaacgaagggctcaccggagatctaacgacgacggcttcatcggcggcgcggcgggagccaatactggagaagctgtggtactcgtcaggcggggcgaagggcggtttcgtgatgaaggcgaggtggcgcttgagcggcgggcgggtgggggcgccggcagccacccgcggcggagaggcgcggcgatcgggagctccggcggcgctggacatgaggaggcgggaaaaggggaggagatggggcccagcggtattggggggaaattggagggaaacgggagaaggatcggaaggaaggggagagtggtgtag

SEQ ID NO: 16577 - DNA, 1212 bp, Glycine max
  Peptide Sequence Number=SeqID_133355
atgaagcggaagagtggaatgaatgacagtgaaggggagtcactagcacaaaagtggagtaacagtcctggatacactaatgttagcaatgtaacaaataatagtccctttaaaactcctgtgtctgcaaaagggggaaggacacagaaggcaaaggcttccaaaggcagatcatgtcctccgacacccatctcaaatgctggttccccttctcctcttactcctgctagcagctgtcgttatgacagttccttagagggtggtattcttgacctaaataaagcagcagaaactttggaggtgcaaaagaggagaatatatgacataactaatgttttggaaggcattggtctcattgaaaagaagctcaagaacagaatacattggaagggaattgaatctgctacatctggtgatgtggatggtgatatctctttgcttaaggcagaagttgagaaactttctttggaggagcagggaatagatgatcaaataagggaaatgcaagaaaggctgaggaatttgagtgaaaatgaaaacaaccagaagtgcctttttgtgactgaagaagatattaaggacctaccttgcttccagaatgaaactctaatagcaattaaagctccgcatggaaccaccctggaagtccccgatcctgaggaagctgtagactatccacagagaagatatagaatcattcttagaagcacaatgggtcccattgatgtctatcttatcagatattctctcgaaaacatatttgttagattaatcctcatgctggggatggtggttagtcaatttgaagagaaatttgaagaagttaatggtgctgagctcccaatgatcccacttgcttccagttctggttccaatgagcaactaatgacagaaattgttactgctgaatgcagcggaaaagaacttgaacctcaaactcagctctcttctcatgcattctctgatgcttcacaagagtttgctggtggcatgatgaagattgtcccttcagatgttgataatgatgcagactattggcttctatcagatgctgacattagtataacagatatgtggagaacagattctagtgtcgattggaatggtgtagacatgcttcatcctgactttggagtcatttcaaggcctcaaactccatcatctgggtttgctgaagtgccatcaacagcagcaaactctattcagaagtga

SEQ ID NO: 16578 - DNA, 513 bp, Glycine max
  Peptide Sequence Number=SeqID_133356
atgtccaaatcttgtggatttgggatgaccggccctctcgatgaatcgatctcttgctttctcataaggctgcatcccttgggtacttgtaccttcacctttagagggctacacgtcctcaccttgagaggactacatgtcctcgccatgagaggactacatgtcctcgccatgagaggacttcatgtcctcaccatcagagggctgcacgcccttacctccagaggactacatgtcctcgccttgagagggctacacgtcctcaccttgggactacacgtcctcaccatcagagggctgcacgccctcacctctagaggactacatgtcctcgccttgagagggctacacgccctcaccttgggtactagttaccctcaccgtcagaggactacacgtcctcgccttgagaggactacacgtcctcaccatcagagggctgcacgcccttacctccagaggactacatgtcctcgccttgagagggctacacgtcctcaccttgggtactag

SEQ ID NO: 16579 - DNA, 315 bp, Glycine max
  Peptide Sequence Number=SeqID_133357
atggcgaaagacaacgattgtgcctcaaagccttacactggggcaatgaaaagcaccatatttcctacatctcgtgtccaatctttttggatgaccggccctctcgatgagtcgatctcttgctttctcataaaagtggacccttgggtactagtacctatcacctttagaggactatatgtcctcgccatcagaggactgcacatcctcgcctgtagagggctgcacgccctcgcctttagagggctacgcgtcctcatttttagtgtgctccatatccacaccttaaaagaatataaggtcctttgcccttag

SEQ ID NO: 16580 - DNA, 363 bp, Glycine max
  Peptide Sequence Number=SeqID_133358
atggaatcaagcaatatgaagaacaagtcaagtggaaaaagaaagatgtctagtgaggacacaagaagttacttcgcatggaacttggaaatggagctggagtgtgtgctagctgatgtgcttagagatcaaagaaatttgggcaataaagataatgctaagaactgttttaagctttggagaacatggtatggaatttcacatgaagaggccaaacgatttcgattcaaagtcattcctaattgggatgatattgttaacctatgtgcaaaggataaagctactggacttgaagcagaaaatgcattagatgcagatgatatcatgagcaaagaaataaatgaagaggaagcaattcatagt

SEQ ID NO: 16581 - DNA, 276 bp, Glycine max
  Peptide Sequence Number=SeqID_133359
atggaaagtagtatagttgatgctttggctgcttcaagaaaacgtagaagagatgaggaagaggaagaagaacttgaacaagcatttttcattattgttagtgttgccactatgcttttgagtgcactgacttggtatcatgacaaatccatggaaacaataagtaggcaattcaagaatatcctgcaagctataatgaaagtaagcaaagaatatttgaagtttcatgactataatctagaaggctcggtggaaaacaaatggagatggtttaag

SEQ ID NO: 16582 - DNA, 117 bp, Glycine max
  Peptide Sequence Number=SeqID_133360
atggagttagaacatagagaaccttgggaaagaaggctacacacacgatgtggcgacaagagcgagatgaccaaaaaaagaggagctcagaggcctcactttgttattcctgaatag

SEQ ID NO: 16583 - DNA, 159 bp, Glycine max
  Peptide Sequence Number=SeqID_133361
atggggttgaaccaagcacatgttcatcaagtcaaggtcaagtatggaagtaaccagcttgcaaaagttggggcggaagatggatcaagatgtgcaagagtaatgagtgaaatagaggaggtgcaaagagcggatgaaggccgatatgggaggccatga

SEQ ID NO: 16584 - DNA, 348 bp, Glycine max
  Peptide Sequence Number=SeqID_133362
atggccagctttaccaactcagggtcatatgctatatccacgagagttgctccaccctttaaaggagaaggcacactgaagttaaaggtgaaggataatattggtcttggagaagaagggaagctgctgaatgatgagaatgtttcaaagcagatggatgatcttttggcatgttatctgactttgaatgcagatgagtatcatgatctcatcatcaaagtgttccggcaggtatggtctgacatgaggcaaggtggtttagacttaaccacaatacacaatctgcatccaattcacttgcggatacaagttacaatgcctgaatatggtacttgggataactgttaa

SEQ ID NO: 16585 - DNA, 273 bp, Glycine max
  Peptide Sequence Number=SeqID_133363
atgacctccgtgaacaatgtcaccgcaatgacctttgggttctcaaaagctgaaaaactcactcagaaactcactcacgagcaacgtagcgcgggaaggtttgatgtgaaagagtcaaggtgttgcaaaactcacttagaaactcacccacgagaagctagcgcgcgagctagcattactcatagcattatttcttggaatccacctcttgaaggatggattaaagtcaattgtgatgcatctgatatcagtaggctgtggaggaattattag

SEQ ID NO: 16586 - DNA, 558 bp, Glycine max
  Peptide Sequence Number=SeqID_133364
atgacgaatgtggttgccgatgctctgtctcggattcctgacaattccattggccaatctttattgctatcggtccttaattccgccttcttgaaggagcttaatacatctaaacattcaggcttaggtgtttcaccctatgaaatcgcctttggcaagaagcctcttagtcttccacaatacattataggaacttcaaagattgatgtagttgatgagtttttgagcaatagacgagaaatgcacttcaagattggcgattgggtaatgattaagctacgtcctcatacacaatcgtcaacttcaggagttagtacttcatactccaagcttgttaaacgattctatgaaccataccaagttttggaccaaattggcaaggttgcatacaaacttctattgcctgaaagatcccgcattcatcctgctttccattgttccttccttaaacccttccaccaaacatctgaagaagattgtgtcccactagcattgccttccaatgatgttgaaaatcaaccagttatctctcttttagccattctgggcactcattag

SEQ ID NO: 16587 - DNA, 738 bp, Glycine max
  Peptide Sequence Number=SeqID_133365
atgggcattaccaagacccttgcacaagtgagcgagaatttcctatggccaaatatgaagaaagatgttcatcaatacgttatagcctgtctcgattgccagcacacaaaatacgagactaggaaaaccgagtgttgtcatcccactgtggcattactcttcatggacattgttggtaagctccatggtatgcccagaagtctcgtctcaaactacgacccattatttattagtcgattttggtggggactattccaattaagtggaacaaagctatacatgagttcagggtatcactcgcagactgacggccaagctgagatgatcaatcagaagttggaaaaggcacaactgaatatgaaacattttgctaacactaaaagacgagaagtgcaattcaagatttgcaattgggtaatggttcagttgcgtcctcataggcagccgtcagttccaggagttcgtacatcatactccaagcttgccaaatgtttctatagaccataccaagttctgtaccaaattggtaaggttgcatacaaacttcaattgcctgaaggatctcacattcattctattttccattatttcgtccttaaacccttccaccaaacatctgaagaagattgtgtcccacgagctctgtcttccaatgatgttgaaaatcaaccagttatctctcctttagccattatgggcactcaatgggcctatgagtctactgatccaaagctaaag

SEQ ID NO: 16588 - DNA, 1116 bp, Glycine max
  Peptide Sequence Number=SeqID_133366
atgggaacaagacactttaactatcttcttgaggctgagcaacaaagagtgtgggatcagtatcagcaggtccttgctgaagaagaggtcatgttctaccaatctcaatggcacctagttagtgatgatattgtggatcttgtgcttcgggactttcgacctattggattatgtaacgtctcctataagttggtgactaaaattcttgcttataggttgagagggttgatacagaacaagaaaggggttaaagggtggatgaccatcaaagtggatcttaagaaggcatatgaccgtcttaaatgggagttcgtgctggagactttgtttgatattggctgccctagtagttttgtgaaatttggtttcgtatctttactcctaagatgtgtatgttttggaatggggaagttttggaggaattccagcccaaccgcggagtttgctaaggtgatcccatctcaccttacttgtttgtgctcttccttgagcggtttcttcaacttatccacttggaggacactctttgtggactgcaatggaccagtggttagatctaagtacaagtgtggtcgggatcaaactcctaaaggggataagaagcatattccaaaccaaggttctctcaaggataaagctttgatccctcttcaagagtcgaatttgcaatccaaagtgattgattttgttcttccttctagagctgtgatgctctttggaaacgttgttggtccaaatcctctttttgaagcaatctggaagtggaggggtcataaaagaaccaaagtccacctttggaaaatggctcatcaagccctgcttacgaatcagagtagacttagaagtcacatgactaacaatgctacttgtctgggttggcatggagggttgatacgtgtctcggagtgccatgaagggtaccacgcgcattttatggaccttagacagtacataagccctccaagctctgagcaagcttatgggcaaaagagattatccaatgttgaaggagattgtcccatgtcggggagagtatatgatgtccgaggtgtggtaaccacgacagttgtctgggatagacatgtctttggagtgttaggtgagggaagtctctag

SEQ ID NO: 16589 - DNA, 186 bp, Glycine max
  Peptide Sequence Number=SeqID_133367
atggagggtgaggagccaatgtctcgtctcaaggttgagtgcacttggagcacccaaaccgccagtcccactggcgagtttggtgtccgtgaacaaatcgccatttcccctggcgatatatacatgcatagggaaccgccagcgtgggacaaggaaatcgccatgcctatgggcgagttagcctaa

SEQ ID NO: 16590 - DNA, 135 bp, Glycine max
  Peptide Sequence Number=SeqID_133368
atggtgattagggccctaagatgcgacaacaatgatgcaggcatagtgaagcttccctacattgcgggtgtcggtgaagaaggtgaggggcatttatgtccaataggagtgcaggaagcaaaaatgaaattgtag

SEQ ID NO: 16591 - DNA, 645 bp, Glycine max
  Peptide Sequence Number=SeqID_133369
atggaagagaccaaatccaagttcaagaggatttgtgtgtactgtggaagcagttctggtaacaaagccagttaccaagaagctgccgtggaacttggcaaggagatggttgagagaagaattgatttggtctatggaggtggtagcgtgggtttgatgggtctagtttctcaggcggttcatgatggtgggcgccatgttctgggcgttatcccaaaaagcctcatgccaagagagataactggtgatcctattggggaagtgagagcagtatctgatatgcatcaaaggaaagctgagatggctcgtcaagctgatgcattcattgcccttcctgggggatatggaacactcgaagaattgctggaaatcattacatgggctcagcttgggatccacagcaaaccggtgggcctattgaatgtggatggattttacaattccttgttgtctttcattgacaaggccgttgatgaaggctttatttcaccaaaagcacgtcgcattatcgtgtcagcacccacagctaaagatttggttagggagctagaggaacatgtacctgagagagatgaagttgtatccaagttggtgtgggaagacaggctaaattacgtggtgcctgaatcagaagttgccatgtga

SEQ ID NO: 16592 - DNA, 693 bp, Glycine max
  Peptide Sequence Number=SeqID_133370
atgctcgacgttgcgctcagcccgagcttcgccgccgaccgcacgatctatttcagcttcagcgagccgcgcgacaagggcaacggcaccacggtcgccaaggccaagctggtcgagagcgacgggaaggcgcggctcgaggacgtcaaggtcatcttccgccagatgccgacctatgatggcgacaagcatttcggatcacggctggttttcggaccggacaacgaactttacgtcaccgtcggggagcgttcggatgccacgccgcgcgtgcaggcgcaggatctgtcgagcggtctcggaaaagtcttccggattgatgccgatggcaaggccttcgagggaaatcccttcgccggacagcagaatgctcttccggaaatctggagctacggccaccgcaatcttcaagccgcggctttggatggtcagggccggctctggaccgtcgagcatgggccgaagggcggcgacgagctgaacctgccgaaagccggccttaactatggctggccggtgattacctacggggtggaatatagcggccgggcggttggcgagggtgcaacagccaaggaaggcatggaacagccggtttattattgggatcccgtcatcggcccgtccggcatggccttttacgacggtgacgggattcccgagtggaagggagccttcatcgtcggcggtctg

SEQ ID NO: 16593 - DNA, 351 bp, Glycine max
  Peptide Sequence Number=SeqID_133371
atggatatcgaacctcggtatgaacttctactggggcaacgccgtactccttggtttatgggatggaagcgatactcccatttgaggagccatgggcgcctgtatcaacaaaggataaagaacgtgttcgacaggaaggtgtgcccgcgcaagttcaacgagggggaccttgtgctgaaaaagatatcccacactgttaaagataatcgagggaagtgggccccgaactacgaagggcctttcgttgtgaaaagggctttttctagaagggctctggtgctcaccaacatggatggcaaggagctaccctcacccgtgaactccgatgttgtcaagcgatactacgcttaa

SEQ ID NO: 16594 - DNA, 156 bp, Glycine max
  Peptide Sequence Number=SeqID_133372
atggcatcagcaatcacctgggccacgtggacgctcatccgtgttaggatggcacacaccaactggcacttaggcaaaggatggcctagggttagcaaaaaccaaaatcccatgagtgcttgcattcttaagggggtgcttgcccaggagagctaa

SEQ ID NO: 16595 - DNA, 351 bp, Glycine max
  Peptide Sequence Number=SeqID_133373
atggcgcctactaggcaccctctggacccagataagtccaaaagggccctagggttcccggcgctgatcacaggcctctgccagtcctacgtagttcccgtcacccctagtaagagcgttatttacagcatttggttcgccagcaggcagtcaaccaccgcggacaggtgcagatacattattgtctctaccccggagcagtttggggctgaggtcgcatggcctggagattggcgcgatgcccaggcaggggaagagcatgcaggatcctcgggtgaggtggatgagtcccatatggatgaagatatgactaacctactcggtttcttgggagggagcggagccgcgtga

SEQ ID NO: 16596 - DNA, 318 bp, Glycine max
  Peptide Sequence Number=SeqID_133374
atggctcccaatcgcactcagctgcagaatatggttaagaaggaaagtgagacctttaaagagtatgctctgcggtggagagacctggcaacacaagtggcccctcccatggtcgaaagggagatgattaccatgatggtagacaccttgccagtgttttactatgagaagttggtaggctacatgccttctagtttcgcggacttggtattcaccggggagagaatcgaagtaggtttgaagagagggaagttcgattatgtctcctccacaagtaccaatgctaggaggatcggagcaactggggaaaaaaggtag

SEQ ID NO: 16597 - DNA, 360 bp, Glycine max
  Peptide Sequence Number=SeqID_133375
atgacaacttttacatggatatggatgacgttgctatttagtaacattctgcccggcgaccataatgccaatctccccctgcagatgtatcggttggaatcgcacccacaaagacactcagtggacccggagaagtccaacagggccctggggtttccagctctgggatcgcgcctgcaagacacccactggacccgaagaagtccaacaaggtcttggagttgtcaagctctaattacgggtctctgtcagttctacggagtgcttgtcacctccggcaagggcatcaggccccctgctaatcgagctttcatcaagaagtactgcgtccccaggcaggcgcagggtgaaacaccatag

SEQ ID NO: 16598 - DNA, 576 bp, Glycine max
  Peptide Sequence Number=SeqID_133376
atggtgggttacacaccttcaagctttccggatttggtcttcgctagaaaaatgatcgaagtgggtctgaaaagaggcaaatctgatcatcatgctttgataaatgcaaaaaaaaaaactggggcaaatgaagagggtgagaatgagggagaaacccatgctgtgactgtcattcctatacggccaagtttcccaccaacccaacaatgtcattactcagccaataacaacccttctccttacccaccacccagctatccacaaaggccatccctaaatcaaccacaaagtctatctaccgcacttccaatgacgaacaccacctttagcacaaaccaaaccaccaaccaaaaaggaattttgcagcaaaagcctgtaggattcaccccaaatgccgccataacccctgctaggtttcctcaacctccatttttccaagggtacaactcaaacgcaacatgtgcatatcatggaggagttctgggacattccattgagcactgtatgacctcgaagcgtaaggtgcaaagtctaattgatgcgggctggctgaaatttgaggagaattgcttgtga

SEQ ID NO: 16599 - DNA, 510 bp, Glycine max
  Peptide Sequence Number=SeqID_133377
atgcaatacgacctcatcattatcggtagcggctccgttggtgctgccgctggctattacgcccgccgcgccggtctgaatgtcctgatgaccgatgcccacaaaccgccgcaccaggaaggcagccaccatggcaacacgcgactgattcgtcacgcttatggcgagggcgaaaaatacgtaccgttggtgctacgtgcccagcagctatgggacgaattcgcgcaagacagcggcgagaccgtattcgaaaaaaccggcgtcattaacctgggcccggccagctccgattttctcaataacgttgcccacagcgcgcgtcagtttaagcttaacgtagaggaactggacgctgaagctgtcatgaagcgttggccggagatccgtatcccacaagattatcgggcaatttttgagccggcttccggcgtgttacgcagcgaactggcggttgaaacctggatccggctggcgcgtgaggcgggttgtgcccagctcttcaactgtccg

SEQ ID NO: 16600 - DNA, 492 bp, Glycine max
  Peptide Sequence Number=SeqID_133378
atgaagcagaaaagattggtcaaagcaattgttgatgaagataaaggtttgaacaactttggcattgccaagagggtccaaaagattatgagtgaacaacagaagagaaaaaagagaagaaaatatacccaaagggaagaaaaggaggaagagtttatggcaaaagatagcatgaacaaagagatagcaaagggtgcattcactgctattcatccagtagccattactcccaagaagaagaggaaggttgatattcagaagcaagcatctcctacccctaagaaggccagagtaactagagcaacccctacggccaagaaaccagttattccttctaagtttccaagaagattaaaaactagagcaaccaaggctaatccaaagattattgataaggagtgggctcctcccaaggcaacttacaaggaatggactcctccctctcctccatcatcatcaagcagtgagatcacacatgatgctcttatctaa

SEQ ID NO: 16601 - DNA, 429 bp, Glycine max
  Peptide Sequence Number=SeqID_133379
atgccctttgagaactcacctgaagaagaaatcattcctaccatggattttaccaccatcctcactgatggcgaaccaaccatccatgtcaaacactactttgacatcattgagttagagaaagtaggtctcaaactcgacgagactctactattctgttgtgcaagactatacttcaatgagcctcaacttgtctacctagagctcatcagaatgttctggagaaaatttgagttcttgaatagcaaagccattgtgtcctggctcttggagttaaggaaactctgtcaaatgactccattgccaaggccactaggtgtcttcgtgagggcaacacctattatgaaggttgggagagggcctatggttgtcatgtatccaaagccctttacaaagaagctgcaaacaaatttggtgaccaaaagataa

SEQ ID NO: 16602 - DNA, 636 bp, Glycine max
  Peptide Sequence Number=SeqID_133380
atgggcggcccccattttgtgcaagttcaaaacaagcatgccttctcgccatatggcttgcctcctaattatacaccacccaatatggtgcatactcccaatcagaatgtcaatgactccactcccatcttcattgagagccaacaaccacaatctgatcatacacctatccctcaacccatgggggggacacatgaaacaccccaccacaatctagccaacttcaagccttgcctcgaatacgccactgaagggcaaacagttggtggtgtacccctgccaaacactttggagggccctcagtttcgcccacaaccacaacccttgcattttgcaatgggaagagccccttctgctatggctggaaagggaaagttggatcagatagaggaaagattaagggtcgttgaaagaggtgaagattatgcccttgctgacatggaagatttgtgcctactacctgacgtggtcattcctccaaagttcaaggtaccggacttcgataaatacaaggggactacctgccccaagaatcaccaaaaggtgtactacaggaaaatgggagcatatgcaaaagatgaaaaattgttgatgcatttcttccaaaaaagtcttactgaggcagccgtcacttag

SEQ ID NO: 16603 - DNA, 537 bp, Glycine max
  Peptide Sequence Number=SeqID_133381
accccactactcgtcgtatttggtttggtattgcaaccgcacatgacttcgaaagtcatgatgatattactgaggaacgtctttatcagaatatttttgcttctcatttcgggcaattagcaataatttttctgtggacttccgggaatctgtttcatgtagcttggcaagggaattttgaagcatgggtacaggatcctttacatgtaagacctatagctcatgcaatttgggatcctcattttggtcaaccggctgtagaagcttttactcgaggaggtgctctaggcccagttaatatagcctattctgggcatttagtccatgtcgctattccgggatccaggggggaatacgttcgatggaataatttattaagtatattgcctcaccccgaaggattaggtccatttttcacaggtcagtggaatctttatgctcaaaaccccgattccaatagtcatatatttggtacccctcaaggagcaggaactgctattctaacacttctcgggggatttcatccgcaaactcaaa

SEQ ID NO: 16604 - DNA, 483 bp, Glycine max
  Peptide Sequence Number=SeqID_133382
atggcgagtttgctggccatctcccacgtggcaaggaaaacgccagtggtgatggcgagttcataccacctgcaagtcgccagcccttctggcgagtctgagcacaggattagcttgctttttcagagggaggttccagctttttcatatgaaagaattccgcttatttgcttcttcaacgttgctgtactcagatttaagggctttatatacgtgaaattcatcttaacgttgctgtgtactgagatttcagtttttaaaattgtacacgatgaattcgattataacagtgttgtattccaatggaagggcagtaaaaaagcaattcagattaaacgtggaattagtttcaatgctttgaagaaaaaaattagagacaagattttgtgtcagaaaaatatattgccttgcaaatttgcgatgacgaagacgttgaaacgatgctggaaagttttaaacaacaacaagaaatgtcagttttag

SEQ ID NO: 16605 - DNA, 747 bp, Glycine max
  Peptide Sequence Number=SeqID_133383
atgatacattggaaagaatcatctgagtcttccaatatcaataggttgattgttccgctcctgtatcttccaaaaggaaaaaagatctctgagagctatttcctggatccgaaagagagtactcgggttctcccaataactaaaaagtatatcatgcctgaatctaactggggttcgcggtggtggaggaactggataggaaaaaagagcgattctagttgtaagatatctaatgaaaccattgctggaattgagatctcattcaaagagaaagatatcaaatatctggagttcctttttgtatattatatggatgatccgatccgtaaggaccatgattgggaattttttgatcgtctttctccgagaaagaggcgaaacataatcaacttgaattcgggacagctattcgaaatcttagtgaaagactggatttattatctcatgtttgcttttcgtgaaaaaataccaaaggaagtggagggttttttcaaacaacaagggactgggtcaattattcaatcaaatgatattgagcatgtttcccatctcttcttgagaaacaagcgggctatttctttgcaaaattgtgctcaatttcatatgtggcaattccgtcaagatctcttcgttagttgggggaagagtccgcacgaatcggattttttgaggaacaacatgtcgagagagaattggatttggttagacaatgtgtggttggtaaacaaggatcggttttttagcaag

SEQ ID NO: 16606 - DNA, 821 bp, Glycine max
  Peptide Sequence Number=SeqID_133384
gtgtctgcgacgtccagcgtgatctcgacccagaacacgctgccgcgcgggctgttcggcgcatagccgacctgcccgcccatcgactcgaccaggcccttggcaatggccgtgcccagaccggtgccttcatggcgacgggccaggccgacatcgccctgctcgaaggcattgaacaggcgcccgcgcaacgccaccggcacgccgatgccggtatcgacgatctcgaatcgcaggcgcatccgctcgctgcccagcgcatcggggctggacacgcgcagatgcacgtagccgctgtcggtgaacttgaccgcgttgcccatcaggttcagcagaatctgctgcagatgcccggcatcacccagcaggcgcggcggcacgttgtcgtccacctgcacgcgatagtccagcgatttggagcgggtctgcggggtcaggatcaggttgatcgcctgcagcacatcggccagcgcgaactcgtgccattccacgcgcaccttgccggcttcgatcgcggagatgtccagcacctcttccaccagcgccagcaggctgcgggtcgaggcctggatggtgttcaggcactcgcgctgttcatcgtccaggcgggtggtggccagcacctcggtcatgccggccagcccgttcaacggcgtgcggaattcatggctcatgttggccaggaagcggctcttggcctcattggcctggcgcgcctcggccaccgcccgggtcaaggcatgcagcaacgaatcgaactaccgcggaatcgcgcccaggcccagcagcaggccccagcccagatagtcgtggccgcgcca

SEQ ID NO: 16607 - DNA, 390 bp, Glycine max
  Peptide Sequence Number=SeqID_133385
atggtagccatgagcctagcaaagattcctcagcctccatttccccaaggatacaactcaaatggggcatgtgcttatcatgggggagttccggggcattccattgagtattgtatgaccttgaaacataaggcgacaacatcagatacttctaaaccctatactggggcaatgatagacgccatgcgcgagcctcgagcgaagctaggagtaaataggaaatgctcacccgcaaaaacaggtcattatggcaagagctctagaggcccaaaatcaacagacttccacctactaggcgcctccattattccattagatgctctaggttttattgtattatttttaagagtgcaattccttccacctaggagaggaaaggatgaaccttga

SEQ ID NO: 16608 - DNA, 408 bp, Glycine max
  Peptide Sequence Number=SeqID_133386
atggatcagttgggatcgtgcccacaagacgcccagtcgacccgaagaagtccaacggggccctggggtttccagctctggttacgggcctttgtagtcctacagggtgcccgtttcccccctgcagatggattggttggtctgtgccgtcatgacatagggatcgcgcccacaaagacacctagtggacccgaagaagtccaacagggccctggggtttccagctctggttacgggcctctgtcagtcctacagggtgcccgttcccccagcgaggaatcgcacccacaaagacacccagtggacccggagaagtccaatagggccctggggtttccagctctggttacgggcctctgtagtcctacagggtgcccgtttccccccggcaaggtcacgtcatcatga

SEQ ID NO: 16609 - DNA, 201 bp, Glycine max
  Peptide Sequence Number=SeqID_133387
atggccagtctgtcagtgatgttgctggtagaagaggacaccgtcacgccccgacagaaggtttgcattggggctgtttggcgcgtagaagaaaaggcgcattggcagaagacgagtcacgtgatggtgtcaccagtcgaaaatgtcgtcggaacggcgacagtggcgatttgcagcggaaaatgtagaaaatgtcgctga

SEQ ID NO: 16610 - DNA, 390 bp, Glycine max
  Peptide Sequence Number=SeqID_133388
atgagaatcccgtgggtgaagtgggatgtaatttgtctccccaaggaggatgggggtctcgggatcaaggatatctctaaattcaatgcagctctgttgggtagatggatctgggctctatcctctaatctaaatcagttgtgggccagaatcttgatatccaaatatggaggttgggcagaactcaataatggcagagacaaagcctggcattcccagtggtggagggatctcagaaaactaaatcagcagcctgagtttagctctatccatcagcagatggtatggaaggtcgggtgtggggataaaattaaattttggaaagataaatggttgggggttgactgtaatattgaacagcagtataatcagttgttcatgattagttga

SEQ ID NO: 16611 - DNA, 276 bp, Glycine max
  misc_feature (55)..(55): n is a, c, g, or t
  Peptide Sequence Number=SeqID_133389
atgggttgccaagtacctacgaagtggtcaaacgagggtcgcatcccaacaacgngagggtccccggacgaaattaggacgcagaatgaccacaatttgtctctgcgttttgttggacacgatcgagcctgggcggcgagacacagaatgactataatttgtctctgtgtgccaccggacacgatcgtctctgggcggcgaaaaggtgtgcggaatgacaaagggcacaaaatttgtctctgcgcgtttatcacccaacttgcgaaatctgaatga

SEQ ID NO: 16612 - DNA, 204 bp, Glycine max
  Peptide Sequence Number=SeqID_133390
atgaagctttgcttctacaagcacaagctacttttgaatcccgagtgcttcccggtaaaacagaaattaaggagaatgaaacccgagatgtccctagagataaaggaggaagtgaagaagcaattcgacgccagtttcttggccgttgctcggtacccaaaatgggtcgctaatatcgtgtcggtcccgaaaaaggattggaag

SEQ ID NO: 16613 - DNA, 331 bp, Glycine max
  Peptide Sequence Number=SeqID_133391
atggccagaacacgaggtttaggttgtgccataggtagagttgtaggccgagatagagctgctgacgaggatgctggcgatgttcccgagagtcgtaggcctactgcctcagcccgtaggctacgcgttcatcagatgactacggagggacgtgatatggctgaggaccctacggaggcacctgagatgcgtgcggacgcacagggtgctgatagtggtgaggggtcagatggtgatgatgctgcagagggattccctggtggtccacgtgacccgtcagtgctcacatcatttgccgagcatgttgcacatgccgtgtggagtggaccag

SEQ ID NO: 16614 - DNA, 261 bp, Glycine max
  Peptide Sequence Number=SeqID_133392
atgaccaaacttggtctctgcgtgccatcggacacgactgtgtctgaatggcaaaggggtgcggataaccgtaaggtatctccgcgtatcataatgaccaaacttggtctctgcgtaccaacggacacgactgtgtctgaatggcaaaggggtgcggataaccgtaaggtatctccgcgtatcataatgaccaaacttggtctctgcgtgccatcggacacgactgtgtctgaatggcaaaggggtgcggataaccgtaag

SEQ ID NO: 16615 - DNA, 264 bp, Glycine max
  Peptide Sequence Number=SeqID_133393
atggagaatgggcgaacagcgctaggaatcaatttgcggggctccagactcgttggtggtggacacatgaacagcgctaggcaatcaattcatgggtctccgaataagattgagaatggagaattggcgagcagcgctaggcaatcaattcatgcgtctcccaataagattggcgaatgggaattggcgaatagcgctaggcaaatcaattcgcggggctccagacttgatggtggaggatgcatgaacaacgctaggcaataa

SEQ ID NO: 16616 - DNA, 147 bp, Glycine max
  Peptide Sequence Number=SeqID_133394
atggctattctatgtgttattttgaaacttgaatgggcgagggcttcaaagaagctttttgctaaaatggctaggaaggccaccgcaggggagggatctagttcagccccacaagcggaaattgagtttgatggacactatttctga

SEQ ID NO: 16617 - DNA, 225 bp, Glycine max
  Peptide Sequence Number=SeqID_133395
atgtcaggatttacacgcaattctcctcaaatttcagtcagcccgcatcaattagaccttgcaccttacgcttcagagccctaccatgctcaatggaacgccccagggcttctccgtgacaagcacacgttgcgttcgagtcgtattctcgaagaaatggaggttgatgaaccttggctaggtggtgttcgtcattggaagtgcggtagacagactttgtggtaa

SEQ ID NO: 16618 - DNA, 204 bp, Glycine max
  Peptide Sequence Number=SeqID_133396
atgacgactctttgcaaatccgaaggaaggaaatccgaacatttccataaggattacctaaagtgtaagtcttggttcgaaaagaaaagtgagcttaatgctcgtagattccttacaatccaaaccataagcccaaatgagaagttcattttcatggggaatagagtgaaactccaatgtaagcagtcgagacttattgcgtaa

SEQ ID NO: 16619 - DNA, 551 bp, Glycine max
  Peptide Sequence Number=SeqID_133397
atgactgcacgttgtgtattttttgtgtcacttgttttgtgtaggactcctttagaagagcaggtaacgcagggctcgtttgtaccccatggtcggcaagacattctgaacactgcgattggccgacctgagcatgggggtcgcgttcgggcagcaggctcaggtgtcactattactcagtactacggaagggcatcaaggacatgcagcagctcatccacatccatcagccaacaacaactagatgaagttgttgcaaggcttagggaagacatgactgggcagattagggaagaattgaggactcaaattaaggaagaattgaggactcagctagaagaggaaaataagaggagcttggaaataatgaccaatgcattgaaagaggctattaaaaaagagttgtcaaataaaggatccccagagctactccaaattcagtcggacatacaacaagtagctgcgcgtgtcagcacacagggaagtaatgttgttaccaatgtccaggcttcacaagaacatcatgctgatgccataccattgatgggact

SEQ ID NO: 16620 - DNA, 381 bp, Glycine max
  misc_feature (289)..(289): n is a, c, g, or t
  Peptide Sequence Number=SeqID_133398
atgacatgcgccttacgtggaggctgcgaaagagtccttggaaacatcctttcaagccttggaagtgagttcatagggaaccgtggaaggttcagaatgggatatgagcctacgcataccgacatgaggcagattgccctaggaaggaggagaagaagcatgggccagctacaagggttgctagtgaaaagggttcccttgtgtcacatcaacaagagatttgtcagtgcgggttggatgtgcgaggggcggatcaccatgatacacaaagaaacccctcaagagcaancaaattgggtgcggccgtgccctccggagttcgaattgggaaattggcgaatcggcaaaaaacccggaatttccgtggcgagctcaatgtaa

SEQ ID NO: 16621 - DNA, 499 bp, Glycine max
  Peptide Sequence Number=SeqID_133399
gaacgaggataagggctacgtgggagtacgtgagctcatttggaggtgggcaacaagggatggtgggttatacgtgatttgtggatgtggagaattgttgtgcaccattgcccgaccgccacctagtaccacatgtgatggaatggtacctggagatatgtcgcaggggtcaggagaccttggggacgtcaggcgagctcctgacagtcaacagataaaaggaacaaagaccacaaagcaaggaggcttgtgtggtggctgggccagctgtgaatcttgtgtgatatatgggttatggcctctggaagctaggggagcttctggtaatcgattaccaggggatgtaatcgattaccatgcttcaaaagggaactggaagactgtggaggcctctggtaatcaattaccagtatttgtaatcgattacacagaggaatgggtcactgtttggcctctggtaatcgattaccaaggctgtgtaatcgattaccaaggatga

SEQ ID NO: 16622 - DNA, 171 bp, Glycine max
  Peptide Sequence Number=SeqID_133400
atggggtccaagtggaccctgagaaaatcaaggccttccaagaatggcccaccccaaaaagtgtgggagatattaggagcttccatgggttggcaagcttctatagaagtgaaaaacttcatggtgccacccttaactaccccacctatgataaagagctttatgccttaa

SEQ ID NO: 16623 - DNA, 666 bp, Glycine max
  Peptide Sequence Number=SeqID_133401
atgttgataatcattgaccaatataaagagaaggtgaacctagctgctagtcatgggcatatgctggaagatgaacaggcaaaggtgttagccttgcgggttgaaagggaagcgagagaaggggtgatagagttattgcataaagaagccatgaaatggatggatagatttgctctcactctgaatgagagtccagagcttccaaggttgttagctagagccaaggcggtggctaacacatactctactcctgataaagttcacagtcttttcaattactgccaacacatgaatgaacgtgctttaggacacccttaccaaacacgtgccaaggctaggatcatgagtgagatagaagaagttcaagaacagatgaaggctgacatggaggccatgaaagaccaaatgaccaccatgatggaggccatgatgagtatgagaaaaatggtggaggtcaacgcggctacagtcgttgccataagtattgtcactgaggtggacctgactcacccatctggtatcaataaagtccagagcaagcatcccttcccatcgtatggcttgcctcccaattatgcaccacccaatgttgcacacgcgcccgatcagaatgtcgacaactccgctcccatacccattgagagccaacaaccccagtttggttaa

SEQ ID NO: 16624 - DNA, 279 bp, Glycine max
  Peptide Sequence Number=SeqID_133402
atgtgggctatcattgaccaatacaaagaaaagctaaatctagctgcaagccatgagcaaaggctagaggacgagcacacaaagttgagcttagctcatcagtgggctaagcgtgcatccaccgctaagcgcagcttcagcgcgacagaagaatcaggcagggcatcaatatcaagttcgtgcgctaagtgtgagattagtgtgctaagcacagcagatgtcttcagccaggctcagcgcacggctggcgctatgcctgaatccactttcgcgcgctaa

SEQ ID NO: 16625 - DNA, 462 bp, Glycine max
  Peptide Sequence Number=SeqID_133403
atgattttcataattggtgtgactgaagctacaaattacacggttggtgacagcttcggatggagcgttcccagcaacaagagtttctatacagactgggctagcaccaagaaattcttcgttggtgacaatcttattttcaactggaacgggaatcattcgataaaaattacgatgaagactattgactacgagagttgcaattccagctggtttgatgctctcacgtacctggtcacaaaaaatgggacggctatgtctatacatactattgatgctccaattgggtatcgctacttttactgcatcgttggtaatcactgtgaattaggtcagaagtttagtatcaacgttcagtctcattctggttcttctcctgctcctgctcctgcaccctctttcggaatcttatctgcatttttgtctagcttggctgtgtatttcttcacccttacccggtag

SEQ ID NO: 16626 - DNA, 486 bp, Glycine max
  Peptide Sequence Number=SeqID_133404
ggtaccattgttgatgactggaaattcgattattcgagtcatgatgcttgtcgcatggtctacaatgatcaagctgaaatgaccggtagattgttggccgggtcattaacttttgataatcgcatcatgcattatatcattatcgactgggcccatttggttcggtaccgaatgcataaggcattacgggccaatgcacctcttccttatccacatttgattactctgtttttgcgtcattttcaaattccgcttgatgatgaaccctttgttcaagtcaagcgttcctttgcaattggtgctggtgccgtgacctcctttgggtatcgtaaagatcggaatggacaatggctgaagaaggatgcactccctcctcaagatgaacgggagatgcttgccgcccagctcgcccaggcgagccaggttgcttcctccagaagcaacaaccttctggaggaatcttctggagggcccaagtgggcctgg

SEQ ID NO: 16627 - DNA, 144 bp, Glycine max
  Peptide Sequence Number=SeqID_133405
atggcgaccattgcattatcgagtagatatgggagcaagttagcatatgacaccgaaattgaggtattggatgtgcggcaggcgagccttgtggctgatttagggttcttggttgatagggtgatgggtaatgagaagggctga

SEQ ID NO: 16628 - DNA, 1033 bp, Glycine max
  Peptide Sequence Number=SeqID_133406
atgggcccagttttgccagactcgcagagacccttcttgggaggtatgtacattgcaatccagaaacagaacattgccccccatgtcttgtctcatgggggttatgaatatttggagcagaaactcctggctgagaagaccaagaagaagctggagaaagctggacagtcaggaagcattgatggcatcatcgaccctccatcccccgtcaaacgccacgtgaagtggaagatggtccgcgtgaagacaataggggagatgacgactgaggccgcaaaggaaatcgctgagaagatcgattcctttgaggagcgggcgacacagggatccttcatccctcatgggcatcaggatgttctcaccgctgctattagacgtccagagcaccctggacatgtccgtgctgctggattcggtgtcaccatcaagcaatacttcggatcggctccatggacgtcccgcagctcttcctccctgcctcttgaagaattacagcagctgacctatcccagttcagtcttagatgcaatctcagggacttgcactgcctccagagcctctggaaacgatcctgagacgggtgactcagataggtgcggcttgtacatcgaagcaaatcctgcccgcctggttaccctggggaaagtttatgagggatccactattgttcataacactcctttgttgcttggccaagtaaaggtaggtgcgaaagaggttaaagatccaaatgctgcagttcctgtacccactgatgaggtttccttagttgggcagacaattcacaccttccttgcttggccgacacatctggtcaagtctttatcacaacagcttgttgtgtcttcggcaaaaccacctgaaaagtcggatccagaggtcgatgatctgctttatctgatgacattgaccatcccagagcttttcttgaggccttaccaggttacatgggatgccaccatgttcaaggcctttaatccagactttccgctctacataaagcacaaagacctctccgaaatcgcacacggtg

SEQ ID NO: 16629 - DNA, 255 bp, Glycine max
  Peptide Sequence Number=SeqID_133407
atgcctctatcagcagcagccgatagcttggcggttacatcacactactacagtgctggatttacgagcactttctctcagtcgtggagtccactgttgatcaggactacgacgaggattcctcgcgtgtcgaagcttcatcagatgttgcatttcaagatcacttcctcttatggaagaacggaatgcacttcttgcattgtatatctctttaatggtcgtacaactattggcattgtgttccttcatagttag

SEQ ID NO: 16630 - DNA, 174 bp, Glycine max
  Peptide Sequence Number=SeqID_133408
gttaaagcttcggaagaaagtgatgaggtacaagccctaaaggcagagcttgaaagagcccgagtagttgaagagaagttcaagtccatagccatcaaaagtctgaaaagaggcagcaatagtaagctcaagctccgaagaggtgaaaggaatcatcacgggtcaaaggcatga

SEQ ID NO: 16631 - DNA, 354 bp, Glycine max
  Peptide Sequence Number=SeqID_133409
atggctgacgaggttattaatgctcgactgtttgatcaaagaacaacacatgaagagagacatttgactttggagacattattacatgaggaagaaaggtatcaagaaactgcttttcaatgttctgtcactgcaggaataagttctgatgaaagaaatgaatatgcacatgaagaagaaataggagaatttgatgatgatgggtatagtgtggctcatggagctcagactattgataaagatcaattggaatatggtttgctttgtgatgctggatatgaatttcctcaatctttagaaactactagaaataatcagatggttgaagaagctggctcctcagcattgtcctaa

SEQ ID NO: 16632 - DNA, 399 bp, Glycine max
  Peptide Sequence Number=SeqID_133410
atgggagatgctgggtttatgctggagtttgttaagtttctcaatgcaaagtcattcgaggttcgtgaaatggcagccgaggcactgtctggcatggttatagtgcctagaaatagaaagagattttctgcaggatacgctgccattgttgttaggccattagccatggcagattgtaccaaagaatgttccaaaaatattatagtgtatgcttttgtgttgtgctaccacatgttgaagacatcaatccttggcaagcatatagtgatagatgaagtttccatctgtattgcttttccttgtagtaaggcaatgtcttttggctatagctacttcctagttgttaatgaacaatgtgagcacgtggcaattgccaattgttcatatcatgttgcctga

SEQ ID NO: 16633 - DNA, 198 bp, Glycine max
  Peptide Sequence Number=SeqID_133411
atggatgcattgctgatatcaaaacaagtagcaaggactagcaacactcaaaaagatgccttatcaaagatagatgagagccatgggttaaattatgagaagagaaccaaggtttacagaatccagcatgagctggttgacatggatctgtggcttagtgtattcttgttacattcattagaaggtgggtttttttag

SEQ ID NO: 16634 - DNA, 174 bp, Glycine max
  Peptide Sequence Number=SeqID_133412
atgggatctgagaccgagacaacaaacaaagagttaagagagagaaagagagacatagttagagagagagaagagacaccgttcggtgctccgctgaatacagttgtggccccagcgctccgttgcaatgatttcgacccaccgggtactattaagggaagatggaggctttag

SEQ ID NO: 16635 - DNA, 378 bp, Glycine max
  Peptide Sequence Number=SeqID_133413
atgagttcagagccaatttgtgtgtatgtttatatcaatggtgagatcatccatggttcaagtgatgtttccaaaggtgcacactattcactcacatgcaccaacaaccgcattaatgcaaatctcaataatccgcatggaatcgatgagcgatgcagaaaaggcttgctcagcgagtcagattggctaagcaaggctcatccgcttaacgaggaagtcagcttgctaagcgagtacaaaatcctagagaatgttgagtcagagagcagcgcgcagccaacccgcccagcgaggatgttgtctcttctcgcgcttagcgcacaaccactgattctcgctcagctagacatgctcgctgagcacgccttcataagctga

SEQ ID NO: 16636 - DNA, 969 bp, Glycine max
  Peptide Sequence Number=SeqID_133414
atgcattcgacggcgacgcgatcttcaaggtaccgttcccgaaggtcaagcgcaccgacttcccggatggccgcggcatcttcgtacaagcagggcgccaggtcacggtacagctgccactcatcgaaggagacacatggacgcccgtccgctgagcgcgagcgcgcacccgcatcgacgtcaggggaagggtgtgcgatgacggtcaccttcgatgacaccgcactgcgtgcacacgtcgaccccgcgctcgcccgcacggagagtcgtgagcgtgtggccagggagggccgccaggtcggcgtggtcctcggttccgggtgggtcgtgttccagtcggccgtcctggtggccggcgccggagtgctcgcggccctcgccgtcgtcgccgtgcagttcatgttcggcggcgacggagccgacctgacgacggtcgtgctggcggtgctgatggtgctgccgctcgccgtggtgcggatccggtctcaccttcgcgggccgcgcgaccgcgaggtcgaggagtaccgcctcgagaagttcgccgaggccaacgcactgacctatcgcaccggcgagctcgaccccgagcgtccggccgcgctgttccggctcggcacatcacgggtcgcgagcgacatcgtcgcggggacgtcaccgcggcccttcgaggcggcgaactactccttcgacgtatgggtggcgcgggcgcgcatgccccgggtggcgaactacgtcgagttcgcgttgcgcaatccgctccccgcgctgaccgtggtcaccaaggcgaccgatgtggcggcatccgggtgggagccggcggcggggcaggagcgtctgccgatcgagggggacctcgcctcgcgtttcgaggtcttcacggcgggggcgacggccgagccggtgcgtcatctgctctccccggagggggaggctgcgttgatcgcggtcgccgagcggtgcgacgtcgag

SEQ ID NO: 16637 - DNA, 150 bp, Glycine max
  Peptide Sequence Number=SeqID_133415
atgactcgtggcagccacggatggttatgggtggtgaaggaagggtttccagggtttggtgagagtttggagaaagagagagtctcgcttagtgaggtggtctcgttgagcaaattatttcctttgggtgaaattgtgcttagtgagtag

SEQ ID NO: 16638 - DNA, 228 bp, Glycine max
  Peptide Sequence Number=SeqID_133416
atggcatgttatgattttccaaagcatttattaccagttcatcttaatctgcagttttacactcaaaaagacctcatgtctaacatagaggagaacaaatatctaggacagatggacgtgaatgcatctgataagtcagctaacatgccatcatcccaaaagcaggaggaggctgtaaagaaaaagtatggaggaatgctgcccaaaaagccgccactcatatctaag

SEQ ID NO: 16639 - DNA, 2952 bp, Glycine max
  Peptide Sequence Number=SeqID_133417
atgaacgaagatggcgtaacctctgcgaatctcaatccctctcttcccaaaccaccctcttctcctccaactcctgctgccagctctgcgggggcgtcgtcgccggcgtttccggcgaacgccggcaacggagatgctagccggcgcgacaaatcgagcgcggattcgcacgcggttctcggttcggtgctgctaggggcttcggttccgtcctgccggccctgggaacgcggcgatttgctccgccggctttcgacgttcaagctcgccggaaaattgcccaaggttgctggctcattggcttgtgccaagagaggttgggtgaatgttgatgtcgctaagattgagtgtgagatatgtggtgcccagttagattttgctctgccttcagcttcctcttttgaagctgatgcctccagtgaagaattttctgaacagcttgatagaggacacaaaaccacctgtccttggagaggcaatagttgtccagaaagcttggtgcagttccctcctacttcaccttcagctctaattggaggttttaaggatcggtgtgatggactcttgcagttttattccctccccatcgtatcttcatctgcagttgagcagatgcgggttacacatagccctcaaattgattgcttacttactcaattgcaaattcagactgctggagaattgggctgcagatcagaaaatgcatgtggaatgggcttaactggtgaacaggctcctcatccatattctcatgctcaaaagctcataagtctttgtggatgggagccacggtggcttccgaatgtgcttgactgtgaagaacagtcagctgaatctgctaaaaatggttacagctctggtccagccaaaggctctgcacatgatccagctccaagcaagaaggagtattcaacttcgtccaggaaagatactggggataatgatgtactgggttcagagtttaattgcgaatctaggtcacctttgttagattgtagtttatgtggggccacagttagagtgtgggatttcttgactgcccctcgtccagttcatatgactccttgtgggattgatacccctcaaacaagcaagaaaatagcatcaacacgaggaataagtgcagctagtggtatcaatgaatgggctaccactgatggtgttgaaaaagagaggactggcgaccatgatgaggctacaacatctgataaaaggcaacttgtatctaataaaagtttagatttaagtcttagaatggctagtgggccatccttttcaccaataaacttgacttcaacctcaggtcatgttcaaggtgctggtgaagggaaatatttaatgattggtcggccttctggaagcgaggttggtgacctggcaacttattatgaatcacaaggccccaatgcacacaaacgcaagttggatgatggtggaacaacatatgacaggccccatctaaacatgcaacaggcagacagtgctgaaagaactgtaactgactttgataataatgaagtcatgggtagtcaacagtattcagctcacccttttaagcgtgcccgtgatactaatgtattggaaacatcccagtttccattaagaaattcttctgatgtacctagccattcactggatattcaaatagagccagatgcaaacaccactaaccagttaaacccaggaagggatcatgctatcggcatcctgtctacaagagattctgcccatgcgtcttctattattgcagtgaatacggtttatcaaggttcagatgatgaatcaatggaaagtgttgaaaattttcctgttgatgttaataataatgtagtcaatttcccttctgttgatttgaatgaaacatctgagttaaatcaagcacaacagagtgtttgtttccaaccacttttagaaagggcaggaggggagacaggtgttagcagttcaaatgcttgtggggaagttttgaacaccgagatattgactgcacatgctagagatggacctagttttggtattagtgggggaagtgtgggcatgggtgcaagtcatgaggctgaaatccatggaactgatgcctcagttcatagaggtgatagtttaggtgatgttgaaccaattgctgaagtgattgaaaatcagggccaagctggtgaatttgagccttctcatggacttactggggattttgtgcctggggaaatgagtagggaagatcctcaaggggatagtcaagctgtggtgtctcaatctacagcaagggctgatagtggctcaaaagttatagcttcagctaaggttgaatctgttgaaagtggtgagaagaccagtagtagcatgcaggtgctaggccttgaaaatggtgcccatccctccctttcttgcaatgctgttgtatgttctgcttatgaagtatccaaggaagaagttactcagactaggaaggcatctcacattgacgatggtgcatctcatgaatcaagccgtttaattactgatgttatggggactccttacagagacaacagtaatgggggtgttgaatttgatccaatcaaattacataatgactactgtccttgggtgaatggggatgttgctgctgctggttgtgataatccctgttccagttctggtgtgggtagtgtagctctatgtggctggcagctgactttagatgccctggattctttccagtctcttgggcatcttcctgtgcaaactcttgaatctgaatcggcagcatccatgtgcaagtcaattgctcccactatcgcgggaggacagaagtggagtgactccctgctacaactgaggcacttgatgcagatgcctggttgtcatggttgctgcagtgtgattcatgaaaaatcgcagcaatatgcaggctttacagacgattctccgtttgtgccatttctggacatgccctgtgacttgtgccactgctga

SEQ ID NO: 16640 - DNA, 1494 bp, Glycine max
  Peptide Sequence Number=SeqID_133418
gtacatgagaagatctgggatctggcaatgatagaaatgtcagttgaagccattgcatctcttactcaatactataaccaatcactcagatgcttcacttttggggactttcagttagcaccaaccatagaggatttcaaagggatcttaggatgcccgataggaggaaggaagccatacctcttttctgggtactatccttctatggcaagaatagcaggagtagagaagacaaaaactctggcaagccaaggagagtgggtatcattcatcgacgtattagcactgctagtgtttgggtcgatactattttcaaatgtagacgggctggtggatctagcaacgatcgatgcttttcttgcttatcaccacaacaaggaaagcccggtcattgttgttttagtagatgcatatgatatattcaacttaagatgcgagaatagcagtgcgagaattgtctgttgtatgcctactctttatgacaaagcaaattgggaagaactcttagtaagcatgacgggagcgtccattagttgtttcccacagtggaaagaaggaggggcaggaggttcaatgaaaatacttcagaggatctgtaaggcatggaataaagtgggaagaaaagataaagaacttaggggaagaagcaatggtatcatagacggctatcacaaatggttgaactctagaatgcaagggataacttggctccaaaagctaaagagtctgaatggggaagaggcagaagtgcctaaggagagtgaagaggtgcaagccttgaaagctgagctcgaaaaaacaaaagtagcgaaggagaagctgaaggtggcagtcactagagttaggaaagaatatgataagccgaaggatatcaacatgactatggctgaagtgctagataatgagctcaaacttggaaaggacaagagggacaaatcaaggatggagagcgtaatgttaaaggataaggttgaaagggaagaaagagaagaggtgatagagttattgcatgaagaaggcatgagatggatggataggtttgctctcacactgaataaaagtcaagagcttttgaagttgttagccaaagccaagacagtggctaccacatactctgctcccaatgaagttcatagtcttttcaattactaccaacacatggaggtacaagaactgatgaaggtcgacatgcaggccatgaaagagcaaatgaccacaatgatgaaagccatgatgagtatgagaaaaatgatggaggtcaacatggctatagtcattgccgcaagtaccaccactaaggtggacccgactcacccatttggcctcaatcaagtaagccatccagtctcggatattgtaggtcagggaggtgaagcgttaggaagtacaggaagcccccattttatgcaggtccagagcaagcattccttcccaccatatggcttgtctcccaactatacaccacccaatgttgcacacgctcctgataagaat

SEQ ID NO: 16641 - DNA, 510 bp, Glycine max
  Peptide Sequence Number=SeqID_133419
atggcatccttaactcaaaatgtaggaatcattggcctagttctcattgttgcctccctggttgcactattttatcttcttaaaaggccaacaaaaccagggatgtttgacacagagcaggcttactatcaaaacattacaatccccaaagcttccacattatcagcaagagcaaatgcaaataattgcagatcttgctacaagctccacccagttccttcctctgccctcactcccgcctacgctgccaacccttgccatttccttgatgcactcaaggtgttcgacgaaatgctccaaccaaatgtggcatctctaaatgcttcactttctggcttttcgcgaaacgggcatcacggagaagctctccggagattggcaaagtacgtgaacgacaatggtgtaacggcagaagtgatcgaagattttgctgaagctttgaagtggaaggaagatggaagaaataagaggttggaggagattggtaaagaggatatacatttgaactaa

SEQ ID NO: 16642 - DNA, 372 bp, Glycine max
  Peptide Sequence Number=SeqID_133420
atgcttcctttccatcctttatgcaggctgccaggaacacaacaaccagaagaaaatggtcaaacgagaaggaactgggtggagcacccgaatcgggaagggtcggttttggaggtggaggatcagactcccacccaagatccgaatcaggaaaatcccattgcccaagaagatggtgctgtgggttcgggatgcgtacgtgaggatgatgctaggcttggccatcatccagatctacaagtccctcctcatggcgcatggtgcttcgttcgtgcctcgtggcgccgccgcaacacaagtccagtgacccgtaatgggccaaacgtgaacctcaagaacaaagtcaacacaacagtctatgtggcactgtaa

SEQ ID NO: 16643 - DNA, 882 bp, Glycine max
  Peptide Sequence Number=SeqID_133421
atgtggaaacaaatagaaatatcacaccaaaacaggatatggcggatatttggcaatgggggggataagttggaagagggatatttggttacacaagtatatggctttcttcttcaagttgatgaggaggggaatcaaaacttctttaacaaaatttggagatttctaataccatttaaggttgaagagaaggaattcgtgtattacatggcgggcaatttggatggctgtcgtatggacattatgggtgtgggttacaaagggattaaggagtttgggcactgtatgccttttagtttttgtgttagtaccgagtcaaaggaaaggtggattacaggtggggagttgtctgcatatgttggggagatatgttactctatcttgtttaggattaatatccctcccttgcaaaccccaaacacgtcgcgcaccacacgccatcgagcatcaacgcaaatcgatggcggcgatgggttccctcgcaaaactcatcatcgttcactgatgaaaccaaaacctaaaccctactccttcctccctctcaaccgatttcttcgcgcgctacaatctcgtcccctcatggcccaaaccccaacatctctcgatgcagagcacccctccgacaacgaccagcacatgggctttcgggcgcggagcctgagcggagagtctcgggcggagcaagcgtgggcccattggaccaagctgggccggcccaggttcatagtggccccgatggtcgacaactcggagctgcctttccggatgctgtgccgcaagtacggtgcccagggcgcgtacacgcccatgctccattcccgcattttcaccgagaccgaaaagtataggaacgaagagttcaccacttgcaaggtagtgtaa

SEQ ID NO: 16644 - DNA, 1372 bp, Glycine max
  Peptide Sequence Number=SeqID_133422
gtcagcggatagcgcgcttttggtgttcgttctgcggtacgccatcgctaaagaagagctgccgcagctggctgcgttcagacaggttgcgcagatagccatcatcaagaaacgtaatactcaccagccggtagcgcccggcctcgcgcgtgctgctgatatcgcccaccgccagcgctgccgcacgctggccgatgcggacaaaatccgcgcggtcggccggaccgggtacctcatcactgctttgcaccagtggcgtctgcaacagatcgcgcaggtacggcccgatgcgcagatccgccaccggctgaccgttgcgccacacggcggtcggctgattggtgcggtcaagcagcacaatcagctgatgatcaaacatatcgtacagccagctaccgacgttttgattcagccagtcgctgtccggctgcggctgcgccagttgatcggcaagcggggaccagcgcgtcaggctgcgcagctggcgcagatgttcactcaggctctgattgaacgaggcggcgatcatccgctgctgctgctcgcgcgcctcatggttggtggccgaggtgctccagaacaggccgaaaccggcaccgagaaaagtcagcagcaaaatcgccaccagcggcaggatcacttcgcgcaaaaaattgcggcgaaaaccgtgcgaaagtttgaaggtgtttatcattttaaggtttcgcgctccgggcagggcttactgattaaattagcagaatttacgcagcctgcatccggtaagggaagcgttaaaggcgtgaaactgcacgcgatttttttgcgcttagtcacaaagcgtgatggagatatccagacatccgaccactgtctatcaggcggttgccgcccagctggagcaggcgctgcaggagcgctatcgctgcggcgattatctgccgtcagaacagcagctggccgatcactacgccgtcaatcgccacacgctgcgccgggccgtacattagctggtgaacaaaggcctgctgcagcggcgccatggcgtcggcatcctggtgctgatgcgccccgtcattcacttacgcaccctgcgccgcgtcaacggcgtgccggtgtgcgtgatcaaccactatctggccgacctgtgctggtggccggcgctgcagacgttccagcacggttccctgcacgacttcatgcagcagcagctcggcctgcagttgagtcgccgtcagacccgcatcagtacccgccgcgcacaggccaaagagtgcaaacagctggagattacgctgcacgcgccgctgctgtgcgtgcgcaccctgaatacacagccggacggtcaggtggcggagtactccgtcagcctgacgcgtggcgacatgattga

SEQ ID NO: 16645 - DNA, 843 bp, Glycine max
  Peptide Sequence Number=SeqID_133423
atgctggtggaggaattagcctactgtttggcaaccagtgaaggtgagatcctgggttatctgtactccaagggaattaaaccagatggggtacaaacaatagacaaagatatggtaaagatgatttgtaaagagtatgatgtggaagtcatagatgctgatccattcaaagttgaaggtttggtgaagaaaaaagaaattcttgataaagatgacctcgacaaactcaaagacaggcctcctgttattactattatgggccatgtagatcatggcaagacaactcttttggattatatacggaagagcaaggtagctgcttctgaagctggtgggatcacacagggaattggggcctataaagtggaagtacctgttgatggcaaaaacttgccatgtgttttccttgacactcctgggcatgaggcatttggagcaatgagagctcgtggagcaagcgtaacagacattgctattattgttgtggctgctgatgatgggattcgtcctcaaacaaatgaagctatagctcatgccaaagcagcgggaatagataaagatggagcaaatccagaaagagtcatgcaagagctttcttcaattggtttaatgccagaagactggggcggtgacatcccaatggttccgataagtgctctcaaaggaaagaacatagatgatcttttggaaactgttatgcttgttgccgagttgcaagaactgaaagctaatcctgatagaagtgcgaagggaactgttgttgaggcggggctagataaatcaaagggaccattcgcttcatttatttgtgcagaatgggcaccctcagatggggagatatag

SEQ ID NO: 16646 - DNA, 783 bp, Glycine max
  Peptide Sequence Number=SeqID_133424
atggtcaacatttggcaggagccttggcttcgaaagcaaggccatagatatgtggaaactcctatggtggagggtttggaagatatgacagttgctgacattgttagtcatcaaaatgattcgtggaatctggatatcattaaccagattcttatccctgatgatattattgatatgttggatgagccaaatcaagttcgagcagctatatcatttggagcttgtggaggtgtgggggaaaaaagtctagattataaagcaatagtgcagcatggtgacttcttctatcaggatgggatcaaagctcaagagaagataatcattagcccaactgatccatgggatcatcagaagcagcattgtggagcaagcctccaacaggaatataactgcactagtataggtatatctatcagaggcagttcaggtgtgtttgtagaaaccatcactcagtggagatcccctagattgtacgttttggaaggagaaaccaggactttgtgtgttgcccttgattttgtccttggcatgggtctctcaaatgtaatcttcgagatggacaagacaatcgttgacaaagtgcattacaacagtcttaatgaaactgaggtgggaatatttattcgggaatgcagaataattttggatagtaatcaaaccttcaacataggtttcttgaggagacaacacaatggtgtagcccatgcatcagctagggttgccccatatttctcttgtagccagtattctaatcatgctcctacttgtgtattgatcatttga

SEQ ID NO: 16647 - DNA, 189 bp, Glycine max
  Peptide Sequence Number=SeqID_133425
atgaaggataataatcaatggtgtctctatgaccatgacccacttcttctcacagacgtttctttgcaacaagaatcctcttcttatactcactgctccagttctctttcacaagcatcactgagctctcggagtttggctatggcggacaagcctgtgtctcgcggtgacagccccagcattggttag

SEQ ID NO: 16648 - DNA, 1473 bp, Glycine max
  Peptide Sequence Number=SeqID_133426
atggacgaacccacattgttgttccccgacaccgacctcgatctcagcttcaccagcaccaccaccgaccgcaccaccatcagtgcaagagccagcttagcccgaaccagcagcctcaccctcagcttcaacgaccgtctctcgacattctccgccgcggaaaacaccaccgccgccgtcaccaaccgccttccccaccggagcgccgaccctaactggtccgccatccaggccgccgtcaatctctcctccgacgggcgcctccacctccgccacctcaagctccttcgccacctcggctccggcaacctcggccgcgtcttcctctgccgcctacgcgactacgacggcgcccacttcgccctcaaggtcgttgataaagacctcctcacagcgaagaaactctcccacgcgcagaccgaggcggagattctccaaacgctcgaccaccccttcctccccacgctctacgcgcgcatcgacgtgtctcactacacgtgcctcctcatcgatttctgccccggcggcgacctccactccctcctccgcaggcagccccaattccgcctccccctcgcggcggcgcgtttcttcgccgccgaggtcctcgtcgccctcgagtatctccacgcgctcggcatcgtctaccgcgaccttaaaccagagaacgtcctcatgcgtgaagatggccatgtcatgctctcagatttcgatttgtgcttcaaatctgacgtggcaccctgtgtcgactttcgggcccactccccacgccgagtgggccccacgaacggttgtttcagttataactgtcatcgatctcaagacaggagaaaagaaaaattggttgcagagttcgtggcggaaccggtgacggcgttttcacggtcgagcgttgggacgcacgagtatttagctcccgagcttgtttctggtaacggtcacggtaacggcgtggattggtgggcttttggggttttcgtttacgagttgttgtacgggacgacgccgtttaaagggtgtagcaaggagggcacgctgcgcaagatagcgtcgagcaaggatgtgaggtttgtccacgtggcggagcgagaggagcctgggatgactgaggcgagggatttgattgagaagttgttggtgaaggaccctaagaagaggctaggatgcgccaagggtgctactgagattaaacgacaccgtttttttgatggaattaagtggcctttgattaggacttatcggccaccggagctgaagggtttgatgagaaggaataagtcaaaagtgagttgcaagagtaagaggtggtggtggtggtggaagagactagggcatgttgtgaggaccaaaggggagagtgaattcatgcttttgaaggctataaagtgttctaacgaggtaaaagataaagaattcattgtcaaacaaatgagagatataattataaaggttggagcctcagatttggtgtaa

SEQ ID NO: 16649 - DNA, 2622 bp, Glycine max
  Peptide Sequence Number=SeqID_133427
atggagtcctccgaagtatgcctctttgtgaatagggatagatttgctgttttgagcaggaaaaatgataccgaggatattgggatggaagcgaagtttaagaggctgaaaagagactttgacagtcagagaaaggagctgacggaaacaaggagggagttgggggagatcaagagagagaatcaacagaagagtagagaatgccaagaagcttggaactccttgaaagagcttcaaaatgagctaatgcgcaagtccatgcatgtaggatctttggcatttgccattgaggggcaagtgaaggagaaaagtaagtggttttcatcactgagagacttgacgaggaaattgaagattatgaaaatggaacacatcaagctattagaggaagcagaggcaagcaaaaaatatcaagcagatatgagagaaatggggcttattattaagtccaaaataaatgaacagctggagtcacatgaagatctcaagtccaaatatattgaaggggctacggaacggaaagatctttacaataaggttttggagttgagaggaaacataagggtcttttgccgttgtaggcctctcaacaccgacgagatatatgcaggagcaacagtggccttagattttgaatctgcgaaagatggtgatttaactgtaatgtcaaatggagctcctaagaggactttcaagtttgatgctgtctttggtccccaagctgagcaagctgatatttttaaagacacagcaccatttgcaacctcagttctagatgggttcaatgtatgcatttttgcatatggtcagactgggacaggaaaaactttcacaatggagggcacagaagaggctcgaggtgttaatttcaggactcttgagaaaatgtttgacataatcaaggagaggcagaagctctactgttatgatatttctgtaagtgtcttagaagtgtacaatgagcaaataagagatttgctggtagcaggaaatcatccaggaacagctgcaaaaagacttgagataaggcaagctggtgaaggaatgcatcacattccagggttggttgaggcacatgtgaacaatatgactgaagtctgggaagtcctacaaaccggtagcaatgcgagggcagtaagctcaaccaattccaatgagcatagcagccgatctcactgcattcactgtgttatggttaagggggagaatttgttgaatggggaatgcacgagaagcaagctatggctggtggacctagcaggcagtgagcgagtagcaaagacagaagtgcatggcgatagactaaaggagacacaaaatattaataggtctctctctgcacttggtgatgtcatatcagctcttgcaacaaaaagttcacacattcctttcaggaactccaagcttacacacttactacaagactcattaggaggagactcaaaggcactcatgtttgtacagatcagtcctaatgaaaatgatttgagtgagacaatttgctctctgaactttgctagtagagtaagaggaatagaattgggacctgcaagaaagcagttagacactgttgaacttttgagacacaaacaaatggttgagaaagtcaaacaagaggtaaggctgaaagatttgcaaatcaagaagctggaggaaacaatccatggattggagtccaagatgaaggaaagagacagtaagaacaaaaatctccaagagaagtcttcctttccccaagtagatggattctcttggacttcacttgcgaatgtctcatcattgtccgttttcacttctaaggtcaaggaactggaatcacaacttctggttgagagaaagctggcgcgtcaacatgtagactcaaagatagctgaacagcaccaaatgaaacatcaagaagagcaaaacaatacacttctgagaccagcacttgcaagtagaccactaggaagtctcaagaatttcaatgatccagttagtggtgggtggttcaaagaccaacaaataaattcagctaaaccactcactgagaacaacatcttgaaacctcgtatacctttttctacaatggagagctccatcaagtgcattgatcatgctgagaaagaaaacaatcctgacatggctgacaaagccctactgccaaaaaggcctggaagagcttctatctgcatgatgacaccgcgtgttccttcagctgttgcttcaaggagaaactctctgattccactcccaagtatacctagcttaacacagttccaatcaccattattaccaaagttaacaaaccaatttgatcagaaggatgccaatggggaatcagaaaccaactgtgtgcctgcacagactcattgtgagagtcccaaagaagttagaagtggtgctaagaggattggtagcatactaagaagaagccttcacaagaaaatacaggttaagtctccacttcagcagcacatgaggaaggttggtgtaaatgtagggatggagaaagttagagtttccattggaagtagggggagattggcaccaagggggcaagtaggatctggtagaagaggaggagctaaagatattcaacaaaagaatagtcaaaaggagaaggaaaggggatggatataa

SEQ ID NO: 16650 - DNA, 312 bp, Glycine max
  Peptide Sequence Number=SeqID_133428
atgaaaggaacattttacctagaattggtaaaagttttctatacatttgctagtgctaacatgcaaggaaatttgtactctactgtcaatggcgtagagatgatcattggtgttgtagtttggaaagtagttgcaggaataaatatgggtggagtctgcaaatttgaggaatctacggatggctataataagatgcagacttacagagttatgctccttgacccaattatggcaggagagccactaccagtagaaaatatcaatcagatggaagaagagatggaagaagaagctcaacaagagtatgcttaa

SEQ ID NO: 16651 - DNA, 378 bp, Glycine max
  Peptide Sequence Number=SeqID_133429
atgacaagaacaacgttgttgttcgctacagttcctacgattcaagttctcaaaaatgattctcttatcagtgtcgcggagccgaaatatgaggacactctcactctcaatcttaaccctgatccttatgctaacctccctggtggttctgctcagaccaaggagtattattcatactcttcttcgtgcagaaggaagagtcttgatcgatctagttcgattagaaggattattggtgttgttgttgaaatggatgaattgaaggttgttgcaaatgttggtgttggtgctaatgttattgcaaggtttctcatcgaatggggagaagagaatacaatttctgatttggtgtattgggggaccacaaccttgctttag

SEQ ID NO: 16652 - DNA, 447 bp, Glycine max
  Peptide Sequence Number=SeqID_133430
atgtttctggtcatattttaccaagtcaaaggattccgaaaaactgttcccgacaaatgggaattcgccaacgagtatttcaagcgaggacaaaaggatcttctcgccgagatcaagcggcggaagacggtgtcttcggtgtccggaaaatccggcagtggcggtaacatttcggcgtcccactccggcggcgatgacatggggtcgacatcgacggggtcgatggaggcggcgacggcgacagtaacaacgactcagtgcgcggatttatcgggcgagaacgagaaattgaagaaggacaacgagaaattgagcgacgagttagcccgcacgaagaaacattgcgacgatttggtggcgtttcttagagactcgctgaacgtgggccccgatgtgatagattgcatcattcggcaaggaacgtgtgggtccagcaacgatgatgcg

SEQ ID NO: 16653 - DNA, 381 bp, Glycine max
  Peptide Sequence Number=SeqID_133431
atgaaggtgactgagaagtgtgacatctatagctttggggtagttttgctggagctagttactgggaggtcacctgttcaacctttggaacaaggtggtgatttagtgacttgtgtgagaagagcaattcaggcatcagtaccaacatctgaattgtttgacaagagattgaatcttagtgcaccaaaaacagttgaagaaatgtctcttattctcaaaattgccctgttctgcaccagcacatctccacttaataggcctacaatgagagaggtcattgcaatgttaattgatgctagggaatatgtcagcaactcaccaacctctcctacatcagaatctccattggatgaggatgatggcatttcttccaaaggttag

SEQ ID NO: 16654 - DNA, 717 bp, Glycine max
  Peptide Sequence Number=SeqID_133432
ggtgagtttgtgaaagacaggctggaggaatacctgaacaatctgaaaatagagaagaaaccggatagtagagaatcctgggactcctacttcatgaggattgccaggatggttagtgagcgatcgacctgtgttcacagaaaagtgggagctgtgattgtgaaagatcacagaatcctcgccaccggatacaaccagcctccctcgaaatttccccactgcaacgaaatcggatgtatccgcgatgaccttgaaataaattctggagaacaccaggagatatgctacgcgctacacgcggagcagaacgcattgatgcaagcggcaaagttcggtatagcggtcaacggtgctaccatatatgtcacgcacaaaccgtgttcaatctgtgcaagactcatagttaacgctggaataaagagagtcgtttacgagaaggattatcctgatcctctgacagatttcttcttcaagccgggcaggtggccgagcgtctggtgcccgggttgtgggaacggaatagtcctgaaagcgttcctggaagccgtggatgacctcgcacttccaaaagaaaaagtggctgtggtgtctggaatcggttgttcctcgagggctacagggtacctcgatttcaacacgttgcacacccttcatggaagggcaatcgccttcgcaacgggagtgaagctggaaagccggatttcgaagtggttgtga

SEQ ID NO: 16655 - DNA, 341 bp, Glycine max
  Peptide Sequence Number=SeqID_133433
caacattctgcgcagcgaccacaatgccaatctccccctgcagatgtatcagttggtctgtgccgtcatgacatagggatcgcgcccacaagacgcccagtggacccgaagaagtccaacagggccctggggtttccagctctggttacgagcctctgtagtcctacagggtgcccgttccccccggcaaggtcacatcatcatgacatagtgcttgtcgcccccagcaaggtcatctggccccctactaatcgagctttcatcaagaagtactgcgtccctaggcaggcgcagggcgaaacaccacagcagcctggggatggccggcgcaagctcagaag

SEQ ID NO: 16656 - DNA, 318 bp, Glycine max
  Peptide Sequence Number=SeqID_133434
atggaaaaacaatatgttataagcaaaggggaggcacttgtgaagggagttgggagtcggaagagcaaccccataagacataatgactgcagtgatgagtattctctttggtgccatgaaaggaagaaaccaccttcgggattgtttagaatagagaaaaggatctctcacttatgcaacactgacatgcaaatttttaatcaggaaaaagctgcaggatacaaagtttttcaagtgattcaaagaaagcctctaataagtattgaaacaaaagggatggtgcctaaaaaaatcaaaggtgacactaaattacgataa

SEQ ID NO: 16657 - DNA, 255 bp, Glycine max
  Peptide Sequence Number=SeqID_133435
atgcaattgatccttgggttcgatatccaaaatttggtccactgttattatagcgtaggtgttgctgcaagaataagagcaataattgaagttgcgataaacaatctcatgaagacaccgatggactatctcactcccgaggtgggaaaaaccaacaacataccattgctaactctaactcaggggttgaaatttaacttcaaacatgatggaagcttgcttgtggagctattggatcgagtggcctcagaataa

SEQ ID NO: 16658 - DNA, 102 bp, Glycine max
  Peptide Sequence Number=SeqID_133436
atggtgaaggaaatgttgcgcacatcaattggggcaactccgttttcgttcgtgtacggaatggaagtcgtactgccatttgaagtagaggtcccctcttaa

SEQ ID NO: 16659 - DNA, 165 bp, Glycine max
  Peptide Sequence Number=SeqID_133437
atggctcagatagacccgggtatagggcctaatatctcaatgtgtgtgcgagtccacagtggagtcaccaactgtcacaatctgcccttcggtggggggtgcgacgtgagactcgatggtgcatcttccaaggaaggaaaacgcgtggagtgccaccaacgttaa

SEQ ID NO: 16660 - DNA, 4224 bp, Glycine max
  Peptide Sequence Number=SeqID_133438
atggataaccttgtattaggatttgatgagggtgtacaggttgggatgcctaatgaagagtttgaaaggacattgaaagatgaagaaacgacatttatggcaccacaggcttcagaagaatgtgtatcttatgataatgcacgtgataatggcaaggccctccaacctgttaatgatacctctcaagtgaatcttaacagcacttccactgtgttccaggaatcagagaagcctgctcaagatttggtcattcagcctagtaattctctttcccctgtggtgtctgagagtttagttaatgaggaagcatctaatggcctgttgacccaacatagtacaacaccgagtccagttactgttgcccctcactactcatcttctaatgctccaagtcaagctgaggtacccattaagcttcaatttggtctgttttctggtccatctttgataccatcacccgtacctgccatacagattggttctatacagatgccactgcatctgcatccacaggttggtgcacccctctcacacatgcatccatcgcagcctcctttgtttcaatttggccagctaagatatacatctcccatatcacaagctataatgcctctgggtcctcaatccatgtcatttgttcagcctaatataccatctagtttctcttacagtcataaccctggaggtcaaatgccagttcaaactgctccagaaacttctgattcctttatgaaaaatgagatcaggcatcattctgttgacagccaaccaggtaattcaagaaacttaccacaaagttcactgccaagtgaagatgcagaaaatattgctggaataaagggtcgatttgaggctgctcatgatcctaataatagcagtaggacttctagtttccaattggataagaaggggaatcaaaatgtagttggtaagagcagcaatatttcatccagtgcaaaagaatcagaagttcagcctgtcactagagatgcatcacttcatccagtttcaaaagagaattttatggagtcaaaaacacaattttgtggcaggggaaagagatatgccgttactgtaaaaaattcaaacccaagatcatcaggtccagctacaagggttaatcgcccagactctggaggatttatgaggaggcctcgccggaatatgcagcgcactgagtttcgagttcgggaaagtgctgaaaagaggcagtctactagttctgttttgaccgatcagtttgggttggataataggtcaaatatcaatgggaggggagcaggtgtatctggaaggactggacataggaaggctatggccaataaattgggaaaacagacagtagagtcagctacagaaaattcacaaggaatggattctggaagcagaggtgaaaaagttgatggaaaagaatcagcaaagactcagggcttctcacattctggacagagtaatctcaaaaggaatttgtgttctgaggaagatgttgatgctccattgcaaagtggaattatacgtgtgtttgagcaacctggaattgaagttcctagtgatgaagatgactttatagaagtaaggtcaaagaggcaaatgttaaatgatcgtcgagaacagagagagaaagaaatcaaggccaagtctcgggttgcaaaggcgcaacggagaccccgttccggttcgcaaagtgttgtggcagtggccaattctaccaaaggatccataactgcagttgaagtggcaaacagtatccatgccgattttgttgctgctgatgtgcggggaatgactaagatggatgcctcatctggatttaattcaagtttactgtcccaagcattacctccgataggcacacctcctttgaaaattgatgcccagcccgatttaagatcacagatgagcaggtcacataagacaagtctcccagcagtttctggtggtgaaaaggaccctgggtctggtgtgatatttgaaagcaagaacaaggttctagataatgttcaggcatctctgggctcttggggtaatgcgcaaattagtcaacaggtaatggcacttacacagacacaacttgatgaggctatgaagcctcaacagtttgattcacaggtttctgttggcaatatgactggtgctgttaatgaacccagtttgccaacatcatccattttgacaaaggagaaaatcttttcatctgcttccagcccaattaattccttgcttgctggagagaaaattcagtttgttattcatttgtttagtgataggaaattttcttgcagtttgagccgtgttgtgtctcatggcattggtccacctcgatcatctagatcagacatgcaaatgtcccacaatcttactggatctgacaatgactgcagccttttctttgataaagagaaacatggtaatgaaactcatggtcacttagaagattgtgatgcggaagccgaagccgaagcagctgcttcagctgttgctgttgctgccattagtagtgacgagattgttggaaatggattgggtacttgttctgtccctgcttcagatggtaaaagttttgtagctgcagatattgatagggtagtagcaggagtaggttgtgagcagcaattagctaatcaatctagatccgaggagcctcttagcgtatctcttccagcagacttatctgttgagactctgccaatttccttgtggcctcccttaccaagtacacaaaattcttcgggtcaaatgatttcacattttccttctgtccctcctcattttccttcaggccctccttctcattttcctttctatgaaatgaatcctatgatgggtggtcctgtctttgcttatggacctcatgatgagtctgcatctacaacacagtcacagcctcaaaaaagtactacatctgcatcaaggccaattgggagctggcaacagtgccattctggtgtggaatctttttatggacctccgacagggttcactgggccttttattgctcctcctggaggcattccaggagtccaggggccaccacacatggttgtttataaccattttgctcctgttgggcaatttggtcaagttggcttgagtttcatgggaaccacttatatcccctctggaaagcagcctgattggaaacacattcctacatcttctgctgcgggggctggtgagggggatataaacagtatgaatatggcatcttcacagaggaatcctgctaacattccttctccaattcaacatcttgctcctggttcaccacttatgccaatggcttctcctgtggcaatgtttgatgtttctcctttccagccctctactgagatgtcggtacaagctcgatggtcacatgttcctaattcacaacttcctctgtcaatgccattgcagcaacaagaagggatacagacttctcagttcagccatgtcccttctgttgatcagccattaaatgccaaaaggtttaccggttctcgagcttcaacatcttctgagggcgataggaattttcctagagccactgatgtgaatgtcaaccaattgcccgatgaacttgggttaggggacacttcaaactcaactcctaccaagacttcagcacagagtgttgtcaacaagactccatctgtgatccccattacagatactttgaaggttgatgttctgaatggcaatagccatagtagtaataaccagaatgcaagttcttctttcaagaatcagccctcacaatttgaccattcctcagggcatggtaattatcagaggggtggtatttctcagaggaataattctgggggtgaatggtcccatcgtagagggtaccaaggtagaaatcaatctctgggttcagacaaaaacttttcctcaacaaagggtcagcgaagaaacagaaggaaggggaaagagggcagcaccgtcgagaaagaggaactctttggagagggaaggagagagagagcaaacttaaaggagagtgggagaaggatctttgccttgtgtgctcttagtttcatttctcatggcctcaccatccgtcttcctctcactctcgtcgcgcgtcatcgttaccccattgtcatccttggcccttcgttggttttcactcactgggaaaggatgcgatgtgaatttaatttggaatggggaaaggatggggttttaaggagaagtaataatagtaatagtaatacaggaaaagaggaagggcttttataa

SEQ ID NO: 16661 - DNA, 2853 bp, Glycine max
  Peptide Sequence Number=SeqID_133439
atggcggccaattccggcaccaaatacgtctcagtgaatctgaacaagtcctatggccagcattcctccgccttcggatccgcccggacgccgcgccctgccgccggagccgccgcagctccgtcgtcgtcgcggccccgcagctcgcacaaggccgggcccaagctttccgttccgccccccttgaaccttccttcgctgcggaaagagcatgagcggttcgattcgctgggatcgggaggtgggcccgccggcccgggtggttccggaaccggggccaggcccagctcctccggtttgggctggaccaagcccatcgcagaggatgtgtcgcggccagtcgttaaaccggccgctgctgcggctgctgtgccggtttcgtctgccgttttgagaggagaggattttccatctctgcgtgccaccttggcgcctgggcctggcccaaatcagaagatacaggagaatcagaattcgattcagaatcagaatctgaatcagaagcagaaacattctctgggtgatgagaatgtgtttgtggaggagaaggagggttctttggttactgatcagtttagtgttcctcgcagagtgaatgtggttggtggtggtgatggtggtcgcggttcgcgggtggtgcacccgaagtatgggggtggtcttgggaggaagcaggaggagtatttccctggtcctctgccgctggttcggttgaacccacggtcggattgggccgatgatgagcgtgacactggttacagtttgagcagggagggcagggatcatggttttcggggggaggctttttgggatgttgatatgcctagggttggtggtttgcctcataagcatgaccagaggggacaattgaggggcaatgaagttggaaaggttatgaacagtgaagtggaggcttatgatagaatggggccggaggggaattcttggaggagttcgaatttgtcctttcccaaggatgctggaaatgagagaaatggtgttggtgttggtgtgaggccgtcgagtgggagtagggatgtggggaaggatagtaacaagtatgttccgtcaccatttagagatgaagatgctggaaagagggatggtcagggtgggaaacagcagccttggaataatgtggtagaaccatatggtgatcggaatcatgatcaactcaacaggagtagagctgattctgtccagagctcggtgtccagaacagcttttttgatgggtggtaaggggctgcctgttaatgatcctctgcttaattttggtagagagaagtgggccttgccaaagagtgaaaaaggtttcttggaggatccgtttatgaaagattttggaggttctggttttgatgggagggatttgttgggtggtcttgttggggtggtcaagaaaaagaaggatgtgctgaagcaaactgatttccatgatcctgagcgacagcgaatcattgaggagcaagaaagggcattggagttggctcgcagagaagaggaggaaagattaaggcaggctagagaacaggaagagaggcagaggagattggaagaagaagcaagagaggcagcatggagagctgagcaagagaggattgaagctttgcggaaggctgaagaacagaggttagctagggaagaagagaaacagaggatcgttttagaagaagagaggaggaaacaagctgctaagcaaaagcttttggaattggagcaaaggattgctagaaggcaggctgaggtatccaaaagtggcagtaatgctccagttgttgtggatgagaaaatgcctgcaatattgaatgaaaaagaagcatcaagggctacagatgtgggtgactgggaggatagtgaaagaatggttgacaggatattgacttcagcatcttctgattcgtcaagtgtgaatagggcattggagatgggctctaggtctcacttctctagagatttatcttccacctttgtggatcgaggaaaaccagttaattcatggagaagagatggatatgagaattggaacagctcagcattttatccacaagaccaggataatagtcacaacagtccccgaagagatttatcaattggtggaaagccatttatgaggaaagactataatgctggtgctggatttgtgtcttcaaggccttatcataaaggagaaatttcagagcctcatttagatgaatatgctcatgtaaaaccacagaggtggaaccaatcagcagatggagatcatcttagcagaaatacagagattgattctgattttcatgaaaattattttgaaagatttggtgatggtagaacgcagggtcattcccgtggcaatccatgtcctccattccctgagcgtacttatccaaattctgaatcagagggaccctatgccttggggaggtcgtcacggtattctgtcaggcagcctcgagtacttcctcctccttcactaggttctgttcacagaacttacaaaaatgaaaatgagcaccctggcccttcttctttcctagaaaatgagatgcattataatcaggcaaccaggagtgactctacccttccaactggttatgacaatgggaaccgtggacaacctgaagtagtggatgcccggcaagagactacagagaatgaggaccataaagtggaaatcacgccgaggtgtgattctcagtcttcactctctgtttcaaaccctccaagttctccaacacatctatatgatgaagatgacttggatgactctggagattctcctacaatattgacttctgaaggaagcaaaaatggccccctcacagctccagacaatgaatccattgcaacacctgctggaaatgagaac

SEQ ID NO: 16662 - DNA, 1162 bp, Glycine max
  Peptide Sequence Number=SeqID_133440
atgaagccttgtaaggtttcctaccaaaacataaagcagaagatgaagttcggtattcaagaattgccggtacttacaaatgagtttcactaccctggtagagaagctgttaatgacaaattcaattgtctcattgacaatatttggaatattccaaaaaatacaaataataatgagcagtttgtttgttcagtaaaaaagggcatcatctgtgctctatacaatttatgcattgcagataaccatggagttcctcttcttacaaaagcctctccttctggaaaaggttatacagcttttgtcctgttatcaggaccgcataaaggtgtttataccaattttaaagacctttgccttgcaaaggagggtattcaaagcccaatctataaaggtttctattcaagggaagaagcagaaaaagcccttgaattaaataccacagacattaataaaattaaaaggtctcttgaaccagaaaacccgactatagttataaacgctgaccaaaccaagaccagccaaaagacctataaagacacagtcagcccaaatgtcccaggctcaataaatgacctaaacttagacaattttaagaaaatacaaagtttattgtttaaggtacacaataaccaaacccaaattccgggactctacataggtgtacatgcttattttaaccaaaaatttgtatgcatcaataaaaccccatactgccaagacaaaaccaattgtccttgcaagataaaattcctctttagaaaagccagactagacattgaccagtttaagtccttcggatatgaggacttagcaatttccgcaaaaagtctattggactatggatgtttggaatcaatcctgattcctccatctgatagattcgagggatttaattcctcaatcaatgaaaccataaacttaatccaagcagaaatgatggactacattgccatcaagataacaacctgcccgagcaatttcactgctcagaattatccttgccatgttatgaaactcttagtagaggatcatagagattatccctgcctattcgatgatgaatacgaaagctgggatgtacaaggtaatacacaataccaatatagccttatgagggcacaaattcagggctatcaatggttcttctcagaagaggaaaaac
